United States Patent 8,877,916 (PROMOTER, PROMOTER CONTROL ELEMENTS, AND COMBINATIONS, AND USES THEREOF) - sequence listing, part 5

SEQ ID NO: 4836 - DNA, 3000 bp, Unknown
  misc_feature (1)..( 3000): cDNA_ID_1822243_gDNA_ID_1620735_Annot_ID_49477 3000 nt of promoter + ATG
taatctctttcatgcattgtactcaacaaaggtataattataaatagatgatcatgaaaagagactgcaaagtattacaactcctacaggaccactattagaatgctaaattgctaacatgcatatatcacatgattgtgttgacatcaaattttggtctgataggtccgcatcggttagttttgtacaaagatgaaggtttattcgtcccgttgcaaatttaataaatttgcaattgttttcgaaatgtattaatttttcatagagaaaaacaaatagatgtattgttaatatatagatgaagatctcaaagtcgtcatttctgaaacaaatattgcaaacaggaaagttgttatatttaacaagtttttttttaacaagcttatttcttgctaccatgaaaaagtatttagtatttattgacgaatccggtgataaataaaagttgtaaatcgacaaataaaacgattcaatggatttctcaaattaatcagtgcttaatatatatatatatatatatataagctttattaaataaaaattttactttttttagtggtctttgaattgtgcgagtgtgaatgggttggtcattgacgtaaaagaatggtcatgatcaaatgttgataatggctaggatggtcaacatatttttatttcttgatttgcttgtatcttacctgccttagttctattattaaccactctcgaatttgttttcgatcttaccaatcaaaatactttgtactcatctttatctcataggtagatagcaaagtctaaatattgacaggttaaaataacattacttttcttggcataaccaaattcattatttaattcatagaaatgaccacctcaacgtgtttaaaatacctgtttatttaagattttggacacgtactaacaattggatctagctagcagcaagcattcaaaaactttcgacgactagattagcaatcgtcatgtttctgcctaatttgaatcgcttttattgcagttttctagtcgaattcgattatggactacggttttagagttgcaagatttttcctaacaataataaattgacactaaaaatctttcgatagtaaatatatattcaatacttgcaaccattcgagaaaaatgaacatagtctaaaatacatgatcaactctcatcaaatataacatattacattattactatattagattacgacgttataaaaacaattggattagcatcatatttagtagcattcatataaaattattgtgacataaattttcatgcaatatttgtatagaataattccaatattatattgtcatacatttagctaaactattgtcggggtaaataattgattctaggctttggtcctaggtttatctacaaatatattaatactactaaattaaaaaattcagttagtgtatttagtctggtgtgatgggtacatcagtctcagcattttcatgtgcattgaatgtgaacacccttacatcaaatcttgacttctttttcccgctttttgggattgtaatcagatgtcaatatttagtatttacacaaaaacatttgatttgtgtaacaaagaagaacatgaatgaactatatcaaagcaaggcccaaaaatatgaagcctaaatattaaaattatttaacaaattcccatatctatgtctacatatgtggtagaatttaaacgtaatatttgtttggctgtcaaaaaaaaaaaaaaaaaaacgtaatatttgtttggaactgtttgtatttcttttttttcttaacgtttgtatgtctatctcatttataactccgaaagttgatcgcagtaactaatgataggtatttttcgaaactgctgaccatatttcactgttgatggcgtcatggtccgtatgtcaacaaaatctagtattatgtacgtactacatttagttatgttattttcttgagttcacgtgttggcttggttgataatacacggggtatcctcgtccacgcattatgaggtagagttcctcctgcttcattctcacttcattcttccctcgaaatattcaaattaatttattacaaatctcttcgtgtttttaatttttgacgaagtttcttgaaagtttaggatatttatatttaggtttttaattcgttaacgaatttcttagatctgaaacttttacagatttccaagagcaagtttcttatctatagtcatcctttatttatccttagaatatgaagttatcaaatgaaatatttctatctactattttaattggatttataatatatatagtgacgaatgtacaattatatcaattaatctcaattttccgaataatatttgctaactaatatacatcatgttttagctagtcaaaatttcacctgggattttatatgttacaattttggtaaaacatttactgactatcatttctaaaacatgaactgtggtcatttggaggattattcttaaacctaaactttgatttatgagtatataaatctaaattaaatcacccttatatcaattaatgaatcattaatatatatgatatatccattacccaaagatatttgtatctttcgcttactttaaaatgttgaagctataaaattttacatatttgaaaaatgagttattagtatttcatcaacaaaatgcattctactgtatattggattccaacgcaaacaataacatagctacaaagctatcacaaagcactatcattagtttattacactaaaatttcgaatattttcatgtacgacttcaaatatttttcattttctgccgcattctcatgtcattagtcatcattactccctctctcgcgtacccaactctatataagatttctccttcttctttttctcttctcatcgaactttcctctttcttctctcatctcctctctttcactcttcacaccagaagatacaaaaaacaatcactgtctcaagcctctctataccgaagataagaaaacaaaagcc

SEQ ID NO: 4837 - DNA, 3000 bp, Unknown
  misc_feature (1)..( 3000): cDNA_ID_1822243_gDNA_ID_1620735_Annot_ID_166246 3000 nt of promoter + ATG
gtactcaacaaaggtataattataaatagatgatcatgaaaagagactgcaaagtattacaactcctacaggaccactattagaatgctaaattgctaacatgcatatatcacatgattgtgttgacatcaaattttggtctgataggtccgcatcggttagttttgtacaaagatgaaggtttattcgtcccgttgcaaatttaataaatttgcaattgttttcgaaatgtattaatttttcatagagaaaaacaaatagatgtattgttaatatatagatgaagatctcaaagtcgtcatttctgaaacaaatattgcaaacaggaaagttgttatatttaacaagtttttttttaacaagcttatttcttgctaccatgaaaaagtatttagtatttattgacgaatccggtgataaataaaagttgtaaatcgacaaataaaacgattcaatggatttctcaaattaatcagtgcttaatatatatatatatatatatataagctttattaaataaaaattttactttttttagtggtctttgaattgtgcgagtgtgaatgggttggtcattgacgtaaaagaatggtcatgatcaaatgttgataatggctaggatggtcaacatatttttatttcttgatttgcttgtatcttacctgccttagttctattattaaccactctcgaatttgttttcgatcttaccaatcaaaatactttgtactcatctttatctcataggtagatagcaaagtctaaatattgacaggttaaaataacattacttttcttggcataaccaaattcattatttaattcatagaaatgaccacctcaacgtgtttaaaatacctgtttatttaagattttggacacgtactaacaattggatctagctagcagcaagcattcaaaaactttcgacgactagattagcaatcgtcatgtttctgcctaatttgaatcgcttttattgcagttttctagtcgaattcgattatggactacggttttagagttgcaagatttttcctaacaataataaattgacactaaaaatctttcgatagtaaatatatattcaatacttgcaaccattcgagaaaaatgaacatagtctaaaatacatgatcaactctcatcaaatataacatattacattattactatattagattacgacgttataaaaacaattggattagcatcatatttagtagcattcatataaaattattgtgacataaattttcatgcaatatttgtatagaataattccaatattatattgtcatacatttagctaaactattgtcggggtaaataattgattctaggctttggtcctaggtttatctacaaatatattaatactactaaattaaaaaattcagttagtgtatttagtctggtgtgatgggtacatcagtctcagcattttcatgtgcattgaatgtgaacacccttacatcaaatcttgacttctttttcccgctttttgggattgtaatcagatgtcaatatttagtatttacacaaaaacatttgatttgtgtaacaaagaagaacatgaatgaactatatcaaagcaaggcccaaaaatatgaagcctaaatattaaaattatttaacaaattcccatatctatgtctacatatgtggtagaatttaaacgtaatatttgtttggctgtcaaaaaaaaaaaaaaaaaaacgtaatatttgtttggaactgtttgtatttcttttttttcttaacgtttgtatgtctatctcatttataactccgaaagttgatcgcagtaactaatgataggtatttttcgaaactgctgaccatatttcactgttgatggcgtcatggtccgtatgtcaacaaaatctagtattatgtacgtactacatttagttatgttattttcttgagttcacgtgttggcttggttgataatacacggggtatcctcgtccacgcattatgaggtagagttcctcctgcttcattctcacttcattcttccctcgaaatattcaaattaatttattacaaatctcttcgtgtttttaatttttgacgaagtttcttgaaagtttaggatatttatatttaggtttttaattcgttaacgaatttcttagatctgaaacttttacagatttccaagagcaagtttcttatctatagtcatcctttatttatccttagaatatgaagttatcaaatgaaatatttctatctactattttaattggatttataatatatatagtgacgaatgtacaattatatcaattaatctcaattttccgaataatatttgctaactaatatacatcatgttttagctagtcaaaatttcacctgggattttatatgttacaattttggtaaaacatttactgactatcatttctaaaacatgaactgtggtcatttggaggattattcttaaacctaaactttgatttatgagtatataaatctaaattaaatcacccttatatcaattaatgaatcattaatatatatgatatatccattacccaaagatatttgtatctttcgcttactttaaaatgttgaagctataaaattttacatatttgaaaaatgagttattagtatttcatcaacaaaatgcattctactgtatattggattccaacgcaaacaataacatagctacaaagctatcacaaagcactatcattagtttattacactaaaatttcgaatattttcatgtacgacttcaaatatttttcattttctgccgcattctcatgtcattagtcatcattactccctctctcgcgtacccaactctatataagatttctccttcttctttttctcttctcatcgaactttcctctttcttctctcatctcctctctttcactcttcacaccagaagatacaaaaaacaatcactgtctcaagcctctctataccgaagataagaaaacaaaagccatggtttctcttcttaca

SEQ ID NO: 4838 - DNA, 3000 bp, Unknown; identical to SEQ ID NO: 4835
  misc_feature (1)..( 3000): cDNA_ID_1825774_gDNA_ID_1620735_Annot_ID_166244 3000 nt of promoter + ATG

SEQ ID NO: 4839 - DNA, 3000 bp, Unknown; identical to SEQ ID NO: 4834
  misc_feature (1)..( 3000): cDNA_ID_1825808_gDNA_ID_1620735_Annot_ID_166232 3000 nt of promoter + ATG

SEQ ID NO: 4840 - DNA, 3000 bp, Unknown; identical to SEQ ID NO: 4833
  misc_feature (1)..( 3000): cDNA_ID_2132471_gDNA_ID_1620735_Annot_ID_166230 3000 nt of promoter + ATG

SEQ ID NO: 4841 - DNA, 3000 bp, Unknown
  misc_feature (1)..( 3000): cDNA_ID_3090839_gDNA_ID_1620735_Annot_ID_166229 3000 nt of promoter + ATG
tgtacatatgataccaataatttcagaatatttttcttctatatataccaataagttttcttaaagatgcaaatgcaatactctgctttgtaattttgcaatgcatttgaaacaccgaatcaagagcaaacaacgaagtcagagagacaaataggctaaaacagagctttgagcaaaaaaaaaaaacaagtgaacagatataatacccacttacttggaagccactgacataacagataaacaatgtagtgacttgcaacaaaactccttaaaataccaaaaacgtatactctaggagcttggcttcttgtatctttgttgacttctgatttaacgtcaatagacactgaggaaaaagagttctcttagagccgccattcaaaagttttaagaattttaagtcaagtgtaagcaaataagaaaggtcaatggtcagcatgagactactaaattatgatactgctgtcatctatcacctgacccatctttattattatacacaaattagtaaaagtctgccaagtttgattagtgcaacttgtatctggggtatttagttactataataaatatcattttgtgtataaagaaaggtctcttctgtatctaaaagacatatcaaacgaaagaaatcaataaacacaatattctttcttccaaattttctcatttctcatgggcatatctcaagtacactattgcaatggtaagcaaaaggtacctgatgacgttagatcatttgatcctctttcgatgaaatataataaccacgagtgttaatttttcaggtgaccagaacttagaagcaaaccttctagatcatgaggaaactgaatcattttcagtacctcaaacgaagaactgtaagaggtggctccgtgtctccatatacgcaatctttgtcatcttctgccaaccacttgctacagttctgggtagactgtactatgaaaatggagggaaaagcacatatgtggtaacacttcttcaactcattggcttccctgtactgattctcttccgcttcttttctcgaatcaggcaacccaaatcaacagatacaaatttcagtcagtccccttccttcaccacccttgcatcggtttacttgtgcactggactgctagtgtctgcttatgcttatttgtctgcagttgggttgctttacttaccagtctctactttctccctcatcttggcctcacagttggccttcactgcctttttctcatatttccttaactcgcaaaagttcactcctttgatagtcaattctttgtttctccttacggtttcctctgccctcctcgtggtcaacactgattcagaaaacacaacaaatgtatctagagtacaatatgtgattgggttcatctgtaccattggtgcttccgctgggattggattggtactatctctgatacaactgctcttcaggaaagttttcacgaagcatacatcctcagcagtcctggacttggccaattaccagtctctagttgcaacttgtgtggtactcataggactgtttgcaagtggagagtggagaactctgccaagtgagatgagaaactacaaactggggaaagtgtcatatatcttgactttggcctcagcagctattttctggcaagtatacactgttggttgtgtgggattaatcttcgagtcttcttctgtgttctccaattccataactgctgtgggactgcctatagttccagttgtagcagtgatagttttccatgataagatggatgcatcaaagattttctccatcattttagctatctggggcttcctttcatttgtctatcagcactacctcgacgaaaagaagttgaagacttgccagacaaaacctgttgaggaagaaacacaaactttatgaaacaagttgtatcgaaggtctcagaaacaaacatacatagttgtacacagtcatgtaaataacctatataaagcttgtatgtgtaatatccgtaatggtccatgcaaatgggatatgtatgtcgctcatatttcaggtatttagaacttttattcaaaagagtattgtgtaatacgagcagagtgataaaagcagtcatttatttaacagaaaaaccatgtcaattttgtgatactttcattgtgtgagtgtgaaacccgataaaaattgaccagttagcataacttacagatatgtcaatgcaatattctcctttctagttttgaaatgcacctaaatcttgggaaacaagaacaaacagcaaatcatgtataatgagagatagaagataatttgtcagattggtccaacatccttggggaaacagagctttgaacaaaaagtaaatgaccagaaataataccattttatatagcgacttcctctgccgtccagtattaagttgttgcgaatgtcttctcttgaaaagataggcgagacataatctttagctaacgtcagcatcatcttgatggcaaaaacttcatgactagccatggaaaccgaagtgtgtacccaatccaaataaatttaaaaagacaaataacttttagaaatgtcgtcctcatcaagatcacagaatactacaacttgtgtacacgttcatacatatgcgtatgcgtgttaagtttctatttgtctatgcgtatggggttcatgtcctccacatagttgcagaagaaagtctgaatgaatattgcctacacataatttcctcctagacttaactcatctcttggtcaacaatagaggcatctttgcatgtagaaagactacagatactaaattcatggaaagagaagagatatggttggcatttactgaatgtggggccaagaacaaagaaaacttagacggtgaccgattcctaatcccagaatatataacttagcatatctcacccatatcaaaggagcaatcacttggtagcattatcaaccaagagaattgataataagatacgttagttcctccttgtccatctccaaggtggtgattccacatccacc

SEQ ID NO: 4842 - DNA, 3000 bp, Unknown; identical to SEQ ID NO: 4831
  misc_feature (1)..( 3000): cDNA_ID_3074332_gDNA_ID_1620735_Annot_ID_166228 3000 nt of promoter + ATG

SEQ ID NO: 4843 - DNA, 404 bp, Unknown
  misc_feature (1)..( 404): cDNA_ID_2178054_gDNA_ID_1620735_Annot_ID_166225 3000 nt of promoter + ATG
aacatataaattaatttgcataggaaaaaattacacaacttaaattgagattagttaagaaacaagaaaaaacaaagttgatagaaaaataaaagtattaacacgactttggattcacacacgtaccattgaattatatctcaatacacttttacttaattaacttatttccaaaccaagtagccaaaatcatattattcttctctctcttccttttttgagtttcaaaatgcataaatacgagaacgagagacgaagaccaaattaaagtccaagcaccaatctagacctcttaggaaaaaaacctaaaaacctaatccccaaacctaaaaggcttatctcatctcttcttctttgtcttctttactctttttttacctctctcttcattgttcttcaccatg

SEQ ID NO: 4844 - DNA, 3000 bp, Unknown
  misc_feature (1)..( 3000): cDNA_ID_1825886_gDNA_ID_1620736_Annot_ID_49479 3000 nt of promoter + ATG
atcgtaatgcacgtgtttgttaaagagatagaaaaccactatgtgcttgatgtattgtgacctttaccacgtaaaccatgctataatttagctgagatgttgcaggtttgtattattagattgaaattcaatgattgaattatatagtattaatattttatgacaaaaagggtaataataagtttttggtggaagtattaaagtgtatgattcgacaccatttggtatagttaactatctgtcaaagagatttgtatgtggaaaaactattttcattttaaagtgatttgcaaagcaagaaataacaggatctacgaaaacgtggatatagacccactagaagtactgtgcttagcggcaaataacgcacaaatgtagcagttagctaagtcgaattttatattagaaatcatatgatttttagatttagaaactcgaattagagtttgagatattacacatgactcaatttattcgggatatcgatatttcgtgtatgattcatgaaaaagaagtgataagtttacaagaatatgatagttttgtacgttatcatcttaaatgtattttgaggaaattcgaagtgacaaaatatgcctttttttttatcacagaaataatatctatggtttaaacaaatcctaggttataaaactaggttataaataaaacaattaaaattttcaaaatcacaaatgtattaaacgtataaagaaagttgatatgatcaaaatttgctttactccttttgcttctttgcattaatcaaaaatatcaaagagagtatacaagatttgtagcatggaaagttttctcacaaaactgcaaaagttttttattttatatttttaactcctacaaaaaaaaaaagatggcatttttatggaaacttctttcacttgattaacactacatactattctcgtaagatgatacacgttttggctaagagaccaaccatgtgccacatcatagacacattgcgaacgtaaatatttataatcatatacatataaaattacagcaatagaatgctaattttcgggcgtataaacaaagttattaagaacatgtactcgtgcttaatccatgatgatatatttttcttgagattgtaatgaaggtcttgtctttttgcgcagattttatctcttcagtgttgatcatatcaaacaggacatgttgagtgatctctttattattttcatcattttgaagtggtagaatctgtctttttttgtttaataatcttctgttttgtgacatctattctctttgatgtcttcatatcgtgagtcggtcagtgaacctttgtctttttttttttcttagttaacgccatttggtaacgtattggtttatcgagatatatattatgttccttgttcttctttcttattcttacttttatatttttttttattatttttactttttaatttatttattattatctttcatctttattttgttcacatatacatacatttcatttatttaattgtggtcgaacatacaaattttcgctttatggattggatcattaataatatcgttttcactaatcttgtaataatcctgactctgatctaaatatcaaagcgaaggatgtcaatacagcataccgttagttagagtaggtactaaagataaagatttagattagtgaggatcatctatcaaaaatcagaaactttgtgaagaacaactaatgaatgaccgaaccgttggtacgagaactaaaagaaaacggaagaaagatcaagcagagctattgtagggaatcattttaaagtgtactataatacacaaatatcgataactcaattggtaagactctcaccagttcgagtgatacttgagaaggtcgatataaaatgttatagtcctgacctaatgtgggcatagatctacaacctattagtcattcacaaaaaaaaaaaggccaaaagaaaagagttatcaaggtagtgaaattttgtaaggagagacttattgcatgccaacgatatatattagtcattactaaaataaaaagtgatctgactaatcaaccttgagctggaaaagtcagaatgagataagaaaggataaaggaagttggtcatcacaataattagaatttactcgatggaatttgaatttgggacataacacgagggattggccgaggaaaactacattttatcgagacatcaacgttgattttgtacgctacgatcatttaccatgaagtatgcaaaatgtggccgagaaattctcgagtaagctgtctgatcaatcgctgagaggttggtccatcgcttcatgtaagctgtcttgctggtttatccgcattttatggttggttcatccgcatttaatggctagaaagctgcctcgctcgaccaagcaggtgggtaaggcggacagtttcctacttatgattgtggtaaacttacctggcagcatatatatgcttcctcgtaaattaactgatgttagtcgcattgttaagcaactatatatagtgatgaatcgctgccatttgcaaactagccaggaatctattgtgtccaagctattgtcttagcagtttctcattttctagattcactagaaatcttttggcctacaattttggtttgcttctagaagttataatataaatatagatttttcaaaatttcaaaaactaaactgttatacgaaaacgttattctttccgactaatttcaatgtattcaaaaaccagaaaaacaatttgtagtggttggtatctttatgaacaaagaaatattcaaattaactctaataagcttatgaaaaatcatagatacgaaaagcattctgtcaattattaatcattccgtattattatagtaatgattccatattataatattctaattattatctctatatattattcatttatttattttatattttaggtttacccacacttctcctcaccttcaactctctaactctctttctctccctctctcaaacactatg

SEQ ID NO: 4845 - DNA, 3000 bp, Unknown
  misc_feature (1)..( 3000): cDNA_ID_1825882_gDNA_ID_1620736_Annot_ID_49480 3000 nt of promoter + ATG
gctcaaggttgattagtcagatcactttttattttagtaatgactaatatatatcgttggcatgcaataagtctctccttacaaaatttcactaccttgataactcttttcttttggcctttttttttttgtgaatgactaataggttgtagatctatgcccacattaggtcaggactataacattttatatcgaccttctcaagtatcactcgaactggtgagagtcttaccaattgagttatcgatatttgtgtattatagtacactttaaaatgattccctacaatagctctgcttgatctttcttccgttttcttttagttctcgtaccaacggttcggtcattcattagttgttcttcacaaagtttctgatttttgatagatgatcctcactaatctaaatctttatctttagtacctactctaactaacggtatgctgtattgacatccttcgctttgatatttagatcagagtcaggattattacaagattagtgaaaacgatattattaatgatccaatccataaagcgaaaatttgtatgttcgaccacaattaaataaatgaaatgtatgtatatgtgaacaaaataaagatgaaagataataataaataaattaaaaagtaaaaataataaaaaaaaatataaaagtaagaataagaaagaagaacaaggaacataatatatatctcgataaaccaatacgttaccaaatggcgttaactaagaaaaaaaaaaagacaaaggttcactgaccgactcacgatatgaagacatcaaagagaatagatgtcacaaaacagaagattattaaacaaaaaaagacagattctaccacttcaaaatgatgaaaataataaagagatcactcaacatgtcctgtttgatatgatcaacactgaagagataaaatctgcgcaaaaagacaagaccttcattacaatctcaagaaaaatatatcatcatggattaagcacgagtacatgttcttaataactttgtttatacgcccgaaaattagcattctattgctgtaattttatatgtatatgattataaatatttacgttcgcaatgtgtctatgatgtggcacatggttggtctcttagccaaaacgtgtatcatcttacgagaatagtatgtagtgttaatcaagtgaaagaagtttccataaaaatgccatctttttttttttgtaggagttaaaaatataaaataaaaaacttttgcagttttgtgagaaaactttccatgctacaaatcttgtatactctctttgatatttttgattaatgcaaagaagcaaaaggagtaaagcaaattttgatcatatcaactttctttatacgtttaatacatttgtgattttgaaaattttaattgttttatttataacctagttttataacctaggatttgtttaaaccatagatattatttctgtgataaaaaaaaaggcatattttgtcacttcgaatttcctcaaaatacatttaagatgataacgtacaaaactatcatattcttgtaaacttatcacttctttttcatgaatcatacacgaaatatcgatatcccgaataaattgagtcatgtgtaatatctcaaactctaattcgagtttctaaatctaaaaatcatatgatttctaatataaaattcgacttagctaactgctacatttgtgcgttatttgccgctaagcacagtacttctagtgggtctatatccacgttttcgtagatcctgttatttcttgctttgcaaatcactttaaaatgaaaatagtttttccacatacaaatctctttgacagatagttaactataccaaatggtgtcgaatcatacactttaatacttccaccaaaaacttattattaccctttttgtcataaaatattaatactatataattcaatcattgaatttcaatctaataatacaaacctgcaacatctcagctaaattatagcatggtttacgtggtaaaggtcacaatacatcaagcacatagtggttttctatctctttaacaaacacgtgcattacgattaatggatatatatctgagttattggttgattgtacctgcctccacttccatttctacctgataattgaatattagtggattcttttgaaaattcagtgatacgcatagggtagaaaccaatcaaagtcatcttttgctagagtgttccgtgttagctagagacttaacacgagatatacttatcatcaactatttttaagaatcaaataaacatgttatttcatagttgaatattgtgaagatatccaacccggattttggttgggtttggattcacattttcgagttttaggacttgtcggtttatgtataaaagtatccaatacaaaacgtacttaaatatgcatgttttggtataatgtcggttttatttcatagttgagagttcttcgtcaaatttatcgttagttcatatttggcatgtatctttagattgttattctcctcacacttggaacaaataaataattaccgttgcaagacttttaacacattttgaatcatgtttatcaaaatcttaattcaaaacatatgacactgtgaaaactggatcaaaaagacttctcatcagggaggttattggcgacggcgacgtcaacaatcgacctaatggcttgctcgccgactttggataatatgtaatcatcagtgaacgattcttgatctagtaatagtaaacccttttggtgatttatttatctatgctatcaatttttatgcaagtctttctatagaatatttctctctcgtcatgattaatgctaattttcagtttttcacctccacaaacaaaagacggttctactcgcacgtgttaaaagacggttctgctcataagcatacaaaaatagaaggctaggatcataaatcttataagttacaaatcaaaataacatatatattcactaaatactttacatgagagattgaattagaa

SEQ ID NO: 4846 - DNA, 3000 bp, Unknown
  misc_feature (1)..( 3000): cDNA_ID_3074378_gDNA_ID_1620736_Annot_ID_49482 3000 nt of promoter + ATG
cacgactatcaatatgttatttgacacatctcgttcatcttaaccctcaaaccatgggttaagacatcatagtcatcatgacctatcacaatgacataatgatattagcataatgttacattttctcaattagtgtcaaaaccatatttaaatatatatacattcataatcgttgtatataatgtgtctaatataggaaaattagtaatattaaatatcatatataacgaaaatggaatttgtgaacaatatatatatgaaaatgatttcactggtcaattctcgtttttcattttctaactggcctattatttctccttaagaaggctaacatcatcatatatactatatgcatatacgtagtagagtcaatataaggtctgtatttttaacttcttatataactcatatttttttcatctagttggaacaccgtaaattttattctaaaataaaacaaaattcttacgggttcatttattaatcaaattgatacattttcttcccacacacatttttacagttagagtcatgtaagacttatcgattcctatgctagaaaaaaacgtgcgactataccaaattatatggagaaaaatatgtggtcaacttaaaaaagtattccctagtttagtggtgattaaatattaccaatactttagcaaaggatataatagtgctttataagtcattattaatagtataatagagtgatgccaaatcaattaacatacctactagataacgatgacaactcattttttattttattttcaattgaaacatgcattaacattagacagataaatgatatatttaacataatttacttaatgactcgaattgggaaatttttcttctaaaatacagattttaacatatagagtgatgttagatttagctctttaaaatcatcaacacgttggaaaacaaataagctattataccaatttatatggagactaatatcatgaacggtacttcgttatcactcgtgcccgtcaacagtgccattggatatatgatgtattacatatcatggtattatgtaaaatgatcgagatcaaatatcatggacattctataagtgcatcgaggtcagttagacttagtatcgtggagcatacttcttgaccaccttactgtcggctaaaatttatatgtaaatattctcttgatacctcataatgatgtgacgtacgattctatttatgatgttgcactgttatttgttagatacacagtcattattttcctttgatatggttgtgaattcctctaatatgattatgtttttcttatatgacttggtctgaggtaactgatttgaacaagctgctgttagatttatcaccaactttatagaagaaaagattctgccactatgagaaattggcaaataatatagagaaaaatgtagtcaatttaaaataattattcctttatgagtgcttacaaattaatgatattttggcaaaacaattattagtattttataagtcaatgtttattagcaaagtattgtaaagccacgtcaattaagattatctaaatcaagtagcatgttcattaccattagatggattaaaaatatatttaagtttattttgttgggttgtgcataacttccacttccaatattgttccattttaaaaagtataatatgcatatagtagaacatacatcacaattacctagagaaattgttcagaaatgaatatttattcaatacatttttaagaatatttcaacaggaaaacaaaaaaaattgcagtacgaatttcattggttaattagaaatatctccttttttgtcttcatctagaaggaatacctaaacttgatctgaaaataattattttttactttaattttaaaaaaaaattagaagtcaaactgaaaacatttgagtacaaagttttttatttagagtgatggtaaattttctcaagcaactatatcatagaagataatctgcggcttgtcagaaaaaataataataatctgccactatgccaaattaccgaattatatagagaaagaattagttagtattaagaaacttgttccttagataagtagtgcttacataatatcagtattggcagaaaaagagaattagtgacataatattaatattttttcaaaaagaatattagagttctaaaagtcattgtttaatagtatataaatcaattaacacgtgcattatcattagatagataaataatatatttaagcttgttttatgtggttatgcgtattatttcacttcgaacattgttccatttaaacgaaaatatgatatacatataagaaatacatcacaattacctaaggaaattttgggcatatttttaaaaactatttgttatttaatttttttttccaaaatttgtcatagacccttggtttttgcccatgctgccaccccctagagacgggcctggttctatggtataatagagagtaaacatttgatttatgcttcaaactccttctatttcctttcaaaaaggtaaacaatagctgatgtagttttacattcaactaaaaaaaaaaactacttcaagcgaaaaatattataacttggttttaaattttgttcatcgagcagtatgtggagggctcgtaggacgttggcttgattgttaagtgttgtgattgttggtcaaaaaaagatatagaaaaaaagtcttatcaaattagccaccagacgaaagtgaaatttacggtccgagaacatgcgtttaccacaaatggttgtagtcagggtgtcatatcataagaaccacaacatgaggatccatagtgatgtgaattgttgactttgcctggctacatggtttttttctgtctgaaaaaaaaaaggccaaggaaaaaacaaatgtatccaaaaccctataaattacaaagtagagaggaagaagaaatgcacaaatttcagaataacatatattcactaaatacttacatgagagattgaataagaaatggaa

SEQ ID NO: 4847 - DNA, 3000 bp, Unknown
  misc_feature (1)..( 3000): cDNA_ID_3000065_gDNA_ID_1620736_Annot_ID_49486 3000 nt of promoter + ATG
aaccgtcctctggaatagaacaaaaaatatgaaagagagtcaagagagtaataccaattattacctacataataagtacagaacaaggtttcttttgtttttgtacctctgttatcacacggtagcgaccatgtccagaaagaccaagaccaaatcccattgttataccatccatcaatgaaatatatggctttttgtacgcagcaattgcacatatcagtgtatactctgctgtaaatacctaaggaagcaaaatatcgaagttaaaaaactacattttggaggctatactcttaaaaatgctaagagcaaaccattcaagagacaaacgtaaggaagtataaatcaaaccattctagagagctcttggaaagaccaaattgaaagagatcacacacatgcatgttcatcaaattagtacaccatttaatcttaacaagtttgaaataatgctaaatcatcttttgaagtttgacaaagcataatttattttataaaccttttgcacaagaggtgtgtttttgtccttttggatttctgcagcaactcctttaatatccatccctgcacaccattcatatagatagtcactccaaaacacacttcccaaacgaacaaacaatttcaatttaaatgaaacaatctacataacatagcttccacataaaaagaacaaaacttgcaattacctgcacaaaaggccctagatgtgcttccttcaacgataacacatttcactctcggatcagattcccattcatcaagaaagcttttatactttatatccatatctgtaacatcataatgaagcttcttataattatatctgagcctagcaatcatttgttacatccaactatttcaaagccaattccttttaaaaaaatgattttgaattcagtaaacactaaaaggttcttactttatcaaacccaagaaacaaaaattcaaaagggtcacctaaattcatggcgttgagagctttggttcgatcgagagtgatgagagcgacaccattcggaaaaacatttcctttaacgaaatcatcgacgccagctccggccatcgctgagaatttccgacgatcggagattgagaatctgagggtttggtggaattgagaagagaaggtttgtgagaatttggggaaaaagatgcgatgagacaaagttttgatgatgatcatagtggtgaagaagatacagtcatcagcgacggagatagagatggtaagtgaaacactctttctgcttcagaggtttctttagaccgtaaagtcacttttgttgcctttgtctcggtccatttgattcgagcggttgagtccatgtaattgattttaaattatttttatttgacagaaaaaaaaaaaacatgttcgaaaatcagcattaaaataagaagattttaagatgatttatttaatagtgaaaatcctgaattaatagccaattggaaactaattataataaccaatctaacaaatggcttattccttacaacaatattaaatcgcaattaacacatatgcggtttacaatattactttagacaatatatatgtctaactagataaggattcgcatatatgtgagtttttggtttaaaattttcataatcggtgaaaaagtaaaaactaaaattatatgaaccacgaatacaaaatcacatcatcaatctccaaagtattaaatagtgcacaaaatcttgaataatatttttctaatctattctccatcctggagattataggtgaggagattcagtggggtgaagagattgagttagtctttgttcgtcgacactggatctcgtaatgattgttgcgagatcacaagttcacaactaccttcaaaaatatttgtttatttcaaaatttggtaactacttctcatcgatatttttaaatattttcagttatcaaatttgttttgagtttttttaaaactacccaattatgtgataaaaataaattaaaaaattataagtaacacttagtcgttgtcttctataataatcaattataatatagaataccccacaattgtataaatcatcttacaattcgacttaaattttatatcaaatttttaactatttaaaattaaatttaattatccaaattttaaattcatatggcttaataaaaacaaagatcttcatttacaaaatatctattaaacatattaaatgaactaataaacaaatatcataaatttggacgtgtcttcattcgatttttaatcaaattaatcttatttacctaaaatcgtataaaaaaggttcttaatgtttactcaaatcatttatttttagttaaatactaattaatctatttttcgtaatacaaatcaatataaaaaaatatctacctactatgtattaaattttgttttagtttactaatatttttttatttgtttaaaagaaaaaataattataaaattataaataggcaaatagcgtagataagtaagtcgactattgtctcattttgccgtcaacgagacagaccacagccgtcgacgtcgtcaacaccggtcacaaacttagattccacaaaaatctaacgccgtcaattatttccgtccatctccttcctcaaatctctctctctactcttttaaccccacagaccattcttagctgtacaaagtctctctctctctctctctgcaaacactgattcaacaaagaagaatcaaaatctccagaaattcgatcgtcgttgaagattcgtctcaggttcgtctactttgctccgtttctcttctaaatctcctatagtttctggatctgtatgttattagtcatgatcgatctcaactctgtgaaccgaactagaatttgttgtcaaatctcgtgtttacgttagactaagcgaacaaatctgtaattcgtattgttcagaacttgatttcgccattattgattcagaaaactgatcctgagttctaaagtttgtgtagtttctagcttagtgttttggaatcgaaaatg

SEQ ID NO: 4848 - DNA, 3000 bp, Unknown
  misc_feature (1)..( 3000): cDNA_ID_1375709_gDNA_ID_1620736_Annot_ID_49487 3000 nt of promoter + ATG
ggaggctctcccacacgaagaggaataacactgtcacccaaaatttccctaacaggtcgagctacaggagggctagctgaacccaagtcttttacttgctcaggtgactgggagccctcttctgatgtttttctacccccaaacctatcctctctgcgccaatcattcaggatctcaggacgagcagggctttttctgttattaacagcattcctactacccgtctcgaaccctggacttctcccaccaggacttgatctgtcgccgtaacgacggtcatatccatcttcataaggtggactccgagaaccactagaactacgtgtctcacttggagacttatcatcattcttctcattcgtataccttttatttacatacacatgtctgatgaagtcccttaaccgctcaacattactgacagattaaaaaaacacaatcaatcaatgtaacacatccatctccacaacaagaagacagatttgtaactgtaataccttccgtcaggcactgattgccgctgttgatccaatcctttaaaataaatatccttagcatgctgttacaaaaacaaaagatactaaatcacaaatgccaagagaaaaaactcatcaaaagaagagagatttagcgtgtttacctgatttccaccttctttcaaagcagtaacttcttgtgaggtaaatttcgccattgatatcgatttaacacgatgtgtaaactcacgactgttcaaaaatacatatgcatatctcaaacaacatttccaatgaacaccatctacacaagaatatgagaagataaagtacactcactgtattccactgcagttggtacaaacaaaagtccagaaagtagtgcaaacatattgtggtccctaagtaaatgatatcgaagaagaaacgttaacgttaagttctctcaaaatttttatcggaaatgatcaaatgaagagcaaaaaaaaacttacaaggctgttacagtttatacacctcttattctcaggaagtttaagaagactcctaataatcttctcgttcttctcgtcttctttaactcgacccgccattttcgattccaaaacactaagctagaaactacacaaactttagaactcaggatcagttttctgaatcaataatggcgaaatcaagttctgaacaatacgaattacagatttgttcgcttagtctaacgtaaacacgagatttgacaacaaattctagttcggttcacagagttgagatcgatcatgactaataacatacagatccagaaactataggagatttagaagagaaacggagcaaagtagacgaacctgagacgaatcttcaacgacgatcgaatttctggagattttgattcttctttgttgaatcagtgtttgcagagagagagagagagagactttgtacagctaagaatggtctgtggggttaaaagagtagagagagagatttgaggaaggagatggacggaaataattgacggcgttagatttttgtggaatctaagtttgtgaccggtgttgacgacgtcgacggctgtggtctgtctcgttgacggcaaaatgagacaatagtcgacttacttatctacgctatttgcctatttataattttataattattttttcttttaaacaaataaaaaaatattagtaaactaaaacaaaatttaatacatagtaggtagatatttttttatattgatttgtattacgaaaaatagattaattagtatttaactaaaaataaatgatttgagtaaacattaagaaccttttttatacgattttaggtaaataagattaatttgattaaaaatcgaatgaagacacgtccaaatttatgatatttgtttattagttcatttaatatgtttaatagatattttgtaaatgaagatctttgtttttattaagccatatgaatttaaaatttggataattaaatttaattttaaatagttaaaaatttgatataaaatttaagtcgaattgtaagatgatttatacaattgtggggtattctatattataattgattattatagaagacaacgactaagtgttacttataattttttaatttatttttatcacataattgggtagttttaaaaaaactcaaaacaaatttgataactgaaaatatttaaaaatatcgatgagaagtagttaccaaattttgaaataaacaaatatttttgaaggtagttgtgaacttgtgatctcgcaacaatcattacgagatccagtgtcgacgaacaaagactaactcaatctcttcaccccactgaatctcctcacctataatctccaggatggagaatagattagaaaaatattattcaagattttgtgcactatttaatactttggagattgatgatgtgattttgtattcgtggttcatataattttagtttttactttttcaccgattatgaaaattttaaaccaaaaactcacatatatgcgaatccttatctagttagacatatatattgtctaaagtaatattgtaaaccgcatatgtgttaattgcgatttaatattgttgtaaggaataagccatttgttagattggttattataattagtttccaattggctattaattcaggattttcactattaaataaatcatcttaaaatcttcttattttaatgctgattttcgaacatgttttttttttttctgtcaaataaaaataatttaaaatcaattacatggactcaaccgctcgaatcaaatggaccgagacaaaggcaacaaaagtgactttacggtctaaagaaacctctgaagcagaaagagtgtttcacttaccatctctatctccgtcgctgatgactgtatcttcttcaccactatgatcatcatcaaaactttgtctcatcgcatctttttccccaaattctcacaaaccttctcttctcaattccaccaaaccctcagattctcaatctccgatcgtcggaaattctcagcg

SEQ ID NO: 4849 - DNA, 3000 bp, Unknown
  misc_feature (1)..( 3000): cDNA_ID_1825858_gDNA_ID_1620736_Annot_ID_49488 3000 nt of promoter + ATG
aaaagtgtgaaggctgcacggattaggttttgggttatatcccaaattatctcatactaatatgagtttcagttgaacgggatttttatgtgagtcagtcttcgtctaactcaggtcattctcaatttatgggaggactctcgacaaaaccaataagaaaataaagtctcttactaaacttcaaaaaaaaataaaaattaggctccttttatattagaaagaattttaaaattgatgtttggactcatagcaaagacttatattgcatttgcatacccctagagaggagactggtctagttgaaacttggattgatatctcaacaaagcgttacattctaaaaaacttagttgtccaagtacttgtcatacatatgttagacacaaatcaatatgtccatggtttaaatacatcatcactattactctatataaggtttatttgcatttttttaataactttttaatacaaggaaggttttgttaccttacctacgatggcagaaaaacattgatcttttgagtttctctctaaaatcgaattctaggacgtaacatcgaaaaaaaaatagattattttataatatggagtaatatgattttatccattaaaataattaactgaaaagatgatatcaatttatccattcagctctaaaaaaaatattgaaaccaaacttattaatttctcaattatatagtatcaaaatatgtccaatagataaagtcgatctattactatgccaagctttccagatactagtttcgacaatgttcaattacgaaatagaacatgcattaggattttcatcactaaacatcatccatctagccatttctttctcatcatcactactagggttcatataaacacctctatcaatttcattttcttcatctttcgttataggttcatcgtcctttttttccttttccattttgactatccttttacgcattttttcctcaagttctttccacaatttctcttcatcaaaatcgccagtgatgacaacttttttgttttctacatcgaccttacatgttttgacccctattcatacaccattcaatataaatgattaaaataacacatatttcaaatatatatgaataatagtattatttttattatataccttcgaatttagaaataacttttccgatgtctgcctcatacttctcacttagaaatgctatatgtatttcaagttttcttgtactacaaaaaaaaaaaaaagagagttaaaacacatgtaccatctcaagaaagtacacttgaacaaatgtaataaaaattattaagttagaagtgatctaccttgtttcaggtttgtcaattttttcttctacttcaggagtctcatcttttttgtcgactatatcaccttcttcattcttctttgtaactgtctcttgttcattagcttcattttgaacaacatcttctttctcaactttctcattcatcgtcaagatttctgcctttttaccagtttttttcttgagatttttcaataatttttccaaattaaaattaccagtaaccataactttttgattttccatatctgttttacatgcttcaactcctagcaatcacatatcatttaaaatggttatcctcaataatatatatgatcagttcaaacaatataaatttccaaagctgtgtgataaatgttcacatcataatattatatttttgcatataaactccactaaacacacaaattttaaaaacaaagaatatataaaacaaaattttttaaaattttgcaactataatgtaaaacttgagatagtaaaaccatacatataattttatatagtgtcaattacaccaaaaatatgaaatataaatatggattcaaaaaaaataattctaagtataagtgttaagctattgtaccaactaccatgaatgagatcgatatagtgttatcataaatgtggactataatatacgtttaccttcaaatttggacatagcttttttgacatctttaacacaattttcacaatgcatccaaatcttcaactcgacttcaattgaattgctagaaaaattttcaaaatagaaaacacgtatatagtatcgtaagaacatagaaaacacataactcttatttaattaacaaaaaaaaacttatttcgtcactctacttttcaggaatatttcgtcgtgaccgctttgaccaacaacccatcgcgaacttattctaaataaaatatactacttgtttaagaatcttctcaccacaaaaccttttcagaaacctaacactttaaatagaaaataagagtacaaaattttagacatacaaccataatttgtttatatggaagttatatagagaatattttctttaaaacattagcacagatttttttttatcttaatacagatgtcaatatctaaacattatgtattatcttaactttttttttgtatatctaaacatttaatcacaatttagagaaataatcacctatggtactttattattttactattaaatcttaaattttctcatttaatttttcttttctactaatatatcttattatatttatttttattttaatggtgttcttttatatcattaaagacataaaatctgtgaaagtataagatatgtgttaaaataaactatatataggaaatggagaaacattaataacacataagattacaagttaattatcctttttcaataaacaacattttaaagtgtttttttccagtcatattattttagaaaatgtttacttaaatattaatatttttttctttattattgtttacttatgttaaaaaaaactccgatattaaaccgttaccgtaggtactaattctggataaaaagttaaaaaccaaaataaagtttgatttcaaattttgaatcttgtaacggccaaagcttcttcaataaacttctcctatattcttcttcttcttctctgtgtttctcaaactcacaaagctcaaacaaaaatg

SEQ ID NO: 4850 - DNA, 3000 bp, Unknown
  misc_feature (1)..( 3000): cDNA_ID_1825845_gDNA_ID_1620736_Annot_ID_49492 3000 nt of promoter + ATG
atatattgcgggcaggctgcgtacctaactaaacatacttacaatgtgtcaaatactttctacgactcaatccctggttagtttaactcaagtactatcatttcaaaataaaaatgaaaaaaatgacgtgcaataatgtgatataacacataatgctttttaacagatccgttatactggccaacatttgtggtagcggtggcagcatcaatcatcgcgagccaagctatgatatcgggcgccttttcagtcatctcgcaatctctacgtatgggttgtttccctcgagtgaaggtggttcacacctcggctaagtacgagggacaagtctatatcccggagatcaactacttgctcatgcttgcatgcatcgctgttacccttgcctttagaactactgagaagattggtcacgcttatgggatcgccgttgtaaccgtcatggtcatcacaaccttaatggtgactctcataatgttggttatctggaagaccaatatagtgtggattgctatcttcttggtcgtctttggctccatagagatgttatacctatcttcggtcatgtacaagtttacaagcggtgggtatttaccacttacgataacggtcgttttgatggcgatgatggcgatttggcaatatgttcatgtcctcaaataccggtacgagctgagggagaagatctctcgtgaaaatgctatacaaatggctacaagtcctgacgtaaaccgggttccagggattggtcttttctacacggagcttgttaacggtataactccattgttctctcactatatatcaaatctttcgtccgtccactcggtgtttgtattgatatcgatcaagacacttcccgtgaaccgagtgacgtcatcagagcggttctttttccgttacgtggggccaaaggattccgggatgtttaggtgtgttgtgagatatggttacaaggaagacattgaggagcctgatgagttcgagcgtcattttgtttattacttaaaggaattcattcatcacgagcacttcatgtctggaggaggaggggaggtggacgagacggacaaagaagaggaaccaaatgctgagacaacagttgtgccttcgtctaattatgtcccttcatcggggcggatcgggtccgcccattcatcttcgtcagacaagattaggtcgggaagggtcgtgcaggttcaatccgtggaggatcaaacagagttggtggagaaagcgagagagaaagggatggtttatctaatgggagagaccgagattacggcagagaaagagtcttctttgtttaagaagtttatagtgaaccatgcttacaatttcttgaagaagaattgtcgggaaggagacaaagcacttgcgattcctaggtcgaagcttctcaaggttggcatgacctatgagttataagattctctatttcgtctttgtgtttcatcatggtttaaaatcattgtgacctaaataaagtgtctccatgtttaggggacccttgtttttgtttgtttgttgtcataaatagttggtaaatgtgtaagtcattattacctttttttttgtgattgccagtttgtcgattttattgaaaaataaaagttacagaagcccatatttttaatgtaagagactaagagtatatggaacaaagatgtaggactggtttattgtttttttttttttttgtgtgcccatattttaatgtaagagtatatatatattttaataatattatgtgatattttcatccaatatttcactggtatctttttttttttaagtaacagctttaacatttgtcatttatctaaataaatatatattgtcatttaccaatgttttgtattgttttggttaattatgatggttttgttcttgccatttcgtgtggttcaagtgaaaacagcaacacacgcacttgtacgacagataatgccaacgttgtgaatctttgttagttactttagatattatactattcccacgttatattttttattttttcgaagggatttaattggtttcatagagcaactacaaagtatacaggattttcgaaatagaaatattgcataagcaaaatatggtcatatattgaagatttatagaagtatagaacaatagaagtgaaatatgatatgattatttaaaaattaaaatattacaaaagccatattttttaaatcggcctaggcctacacgaatctaaggacgacattgagatgaggtatctaaggacaaaaatttgtagacgttccaggttcaattctatttcgaacaaagtcgtgtgtgtgtggccactttaacttgagctttagactatatattttaccccagatgagtttgctaaaaaaaactcataccaaagagtcttctcatgaatctcatcactatattagtcgaattaccggcagcaataggtgtctatataggaaaaataattttatataatgtcttggtacacaagcttgttttttcttctgcatcattgttagttacttaggtattaggctaattagttccacgttgtaatattctaataaaaaaaatagctataaaacaaagaaagaaaaagaaagaaggcagtacaactaaaaaatcagtcactgaacaaaaaagaaaagacatgtttttgcttctgaagcctctcctttctctacacgatttatctcttaacctcctctcggtaatggtaagacatcgtctttctttctctatatctctcgctctctgttttttcattacaatgtatatataatatatttcttacaattttttttcactgggataactttttattcttttgtccaccattatgagaagttccatggagaaactcttaaagcatccgtggatggtgtggggataaacatgagcactatgtggagagaaacaaggaatgtattcatagttccattgttcaagtgtatagtggttatgtgtttgatcatctcgctcttagttttcgttgagagtgtttacatg

SEQ ID NO: 4851 - DNA, 3000 bp, Unknown
  misc_feature (1)..( 3000): cDNA_ID_2990835_gDNA_ID_1620736_Annot_ID_166275 3000 nt of promoter + ATG
cctaaactaccaatgaaccgcgacacgtcaacaaacgcgatttatgtctatagctattggaaacgcctaaatccaaaacttaaaaaaaaaaaaaacgattgatggagtcaacataccgaaggatggtggatacgtcttgatcgtaataagacataactatccaaaaagagacgatgcggatgacaatacgtccgacgcatataacacttgacgcaaagatcaaacgtgttgccacatgaagattcaaagcatgtgacacacgtgaagtatagaccattgagaatccggaggcatgtgcggcagttaatggtccgggtccgagccacgtagtaaagcgtcaagacctcccaaaagtcaagctgaccatctccatttcggtcgagctcccgaaacatctcgggatggatccaagctaaaccagcggtttgacgcaagaagtcggtgtattcttgaaggctgacacggccgtctccgttaacatccattgcccggaaaaactgccacgacaaattttgttgttccatggagccattgttgtaataagcaatcgcggcttcgtggagctcatccattatttgttgtagaattttgaaaagctaggaagggaatctatggtttctggtatatatatacatgtgtttgcgaatgttatgaagagaggagactttgtttaagtcgaatgtcaatgtctagttgtagtgttagtttagtgcgtaaatcacaactttttccatgtgatatacaagcctgtaaatagaaatccaagaaacagaacttaagattatatgtgtattaaattatataaccttgctgtatatttggtttcttctttataaaccgccattttccaacactacaaattacaaataaaatttcaacacatttgtttttatataactcaaatcgcacgttcgttcataggagttgtataaggattggacaatatgtgagaaggcttttatggacttctacagaaatatgcatatgacccaacaaacaattattcgcttccatctattctggtggttgctaacttggcatgacgtttttttttctccttattcacccttatccatttttttttttttttgctatgaatgttaatatcatatgatatgaacagtttggtttttacatggacctcaacctaataaaagctaaaaacaagaaatcaatagatttcagagttgggaaagtgtcaatcttcagtgcaccaaagactcataagcaccgtgaaccgcttgtttgatctttctggcattgattaaaattcttgatctatctttctggcattgattaaaattcttgatctctctatcaatttttttgaagataattgatggccaaatgagaatctggttgggtaggacgttttaacgctgcttccatatagcataaatcacaaattgggcaacaagcttcctctgagtgcgtggggacctgtttgttcttccttcttgtccaagaaacaacgcaaaccaagaaatcgatcgattgcatcgcaacaacttgaaatggtagctcataatcatgtgttgcattaaagaacgcttaaaaatattgtttatctaaagttacaccgcctagattaaaagatcctatataaattaatggcttttttttttgtacaaatgtaaatttcatcaaaaagaaaatgagaaagtatgtaatagttataaattagcttaaccagtaaaacattactcaccagaaaaacaaaaactagaaaccaggaaaaacttaggaaaatcatagagttaagcaaagttaatcaacgtcattaagttattatatataactacattctatataatctctgtttcgtcattgtacattttggtgactggaagtttttgtcacgtggtaaacaagaacgtattcgccaacctaaagactcaatcctctttgtctacaaattaaatacattatcacgaaaaaagctttatgtattataaccaaactactttattctctcaaaactattgcattggtgtgcaaatacgttttctcgagatgatatcatcaatcttaatatcaacttcaacttttaaagtaaagcaaacgtaaattaacacggtcgttctagctttgtagcatcgaaatagttttaaatgtcaaaaaaatgagcgaaataatttattcttaattatctttgccagatttttaaaaacctttaagcatatataattcaactaaaagaattttaactatttgtgactatctagacttgaagcaaaaagtcaaaaatgagtagacataactcaattcctgctgttgatccataactcaacaaatatgtgtttaacaatttttttttttggtcaaacaattctttcagtcgtaagctagaatattacaagatagatgagattaaagaaatagtcccaaatagcaagcaacaaaactaaaacattaacacaaacaaattctaaaatagagacacaaacttaacaaagcttgatacaatgaaacctcaatgaattaatactcgatatactaataccttaaaatattttttctagttctaaattaataatttaacctaaaaatatcacttctataaattaataattacgataatttaatgaaatttagtaaaccattaatctcaatattcttaatttatagaggttttactaaattgtagaaacaactaattcgagtacatccctgaattaataaattttagaaatgtgaattaacgaatacttttgttcttgtgaatggttaaaaaaagttacttatcaagacaagtatgaagtatcacgtgattaaacgtttaatgacaccaacctaatgacaatttgtttgatttatttgtcacctaactagagactctctcacagtcaacgcagcttatgtgtcatagtaagactttttgtctactatagtagaaagacgaatttataacccctttaggttttttctaacacacgcctctaatctccgcgcacacacacacaccctcacgaagaagaagaagacgaagaagaatcaatg

SEQ ID NO: 4852 - DNA, 3000 bp, Unknown
  misc_feature (1)..( 3000): cDNA_ID_3074356_gDNA_ID_1620736_Annot_ID_166273 3000 nt of promoter + ATG
attgacagagtatacatcggttcttgtactggtgggaagacagaggattttatggctgcagctaaacttttccacgcagcagtaagttccacttcttgtctgtatcttagtactcatgcttagctctgttgtacttgattttgcggaagaaactacaatcgtcaatcttgcaaaaggatctgttatcttgtattagtatatgatctgaagctaagacttcatcaaattgaaattgttccattcagtgatagttttctttattattttctatgtcatgcatagttatgtgttttgtttgtctggttgagtcagttttgctggcatgttgttgatattaggaaaaagttattgattctttctctaaggttcttttcttttctctatcaccacaatttgtttgcgttagtctcatgaaaatctacttgtgttttatcagggaagaaaggtcaaagttccaactttccttgtcccggctactcagaaggttagctctacatttcgacattgttactatctcaagtggtttaatcaaagaatacaaataccaaatgcattgtatctatctggtcatcttatcaggtgtggatggatgtgtatgctctcccggtacctggagcaggtggaaagacatgtgcgcagatctttgaagaagctggctgtgacacaccagccagccctagctgtggtgcttgccttggtggcccagcagacacctacgctcgcttgaatgaacctcaagtacgtacccattacttaccctacttatccaattatctgcacttcacctattcttgaaagtgagactaacaaagacgtgttttaaaatgtttgttacaggtgtgtgtctcaacgacaaacaggaacttccccggtcggatgggacacaaagaagggcaaatttacttagcgtctccttacactgctgcagcctcggctttaaccggccgtgtcgctgacccaagggagttcttgcagtaggctaatgtaatggcttcgtgtgaaaaatcatatgctatgcatcgacgaaatattgctaaatgatggggcattgtgaactatatgtatgtattttccttatttcgctgttggacttgatagtttcaagcactatgtcaaactttgatgttttgagtttgaaataataaaagagagaaaaagagtgagttagataagtcaaaagcttacattctaatatctccatgaccccattagtgatttgatcgcaaaagttaattattgaaaacttggtgaaattttgctatcgaagataaatcatgcggtatcttcctttctggtttgcaaaagctagatatgcgtcatataacattgttattcacttattctgaaaatttctaaaatatattataatcaaataatgtaagctagtaagtcaatatattcattctctatgaacttaaatactgttgtatacttgtatatagaagattagtacagttgaaacatttgtagagaaagggaatatatttggtataacaattcattgaactagcaaagctgacaaaagagaaatatacaagtttaattaacccttaataatgctaataaataaataaccctcaataatacgtatttgtttatatagataaattagagaggtaacaatacaattggtgaggagccattgactcgagaaaagagtcgatagagatgtttgaagagtgactatttgcaagagacaatagaatagacgatgcaaaacaatcgactcattagccgcaagtagaacaagattagctaattggtacaaaatcgacgaaacaagtctatcaatacaaagcgagtacaataaaaacccaaataatatatttttctcaaataaaattatatgatcttttgttatttttgttttttttcttttgtttaaaaaacataaaaaaatagagtattttacatcatttatttaatacgtaaaaatattggatatgtatgaaccctctcataaagcatacattattttattttaaattaagtaaaaactcactaatgcacacaatgacaaaaactcatctaattgtttgaatggtgacctaaatacggttgatgaaggtccagaaagaacccgcaccggtatgaccagcacatgtagccgttcacagacatatttgaatgtcttgaatttcaaatacttaaaccacatatccagactttgatggtccattctatgttttaactggtagaattttccaccaactcgtcatgttacccaatcgtcctgtatttgtttgagaatgttgtgtaattattttcaaaattcaaattatccgttatccacccttaccaatattgttttgtccagatatcttaaatagacaatcctatcgaaaacttatagtcaattgcagactaatgttttggaaatattcaggatacatttttatttttgagaaatactctaaaatatcaaactattaagtttttgtttcaaaagtaccatcattagtttactttgcccataataccaaacttttttgtataaaaatatttgttcaaccaaaatgaattacaattaaaagagagtttttacttcattttaatctaaatactgtagactaacctttagaattcttcaggatatctacttcataaatctattagttttgtaatcattctcagactatacgtcggaaaaaagattcggaagatgttctacgtactaaccaatgaatattcctactctttagctagttcattaatttcccaaaacatttagcattgaaattgtatgtagattgaatagtttaaaagtttcaacagccggcaatacgtgtttgagacgcgtccctaccacattaaaaaactctattccacaaacttgttgagttttttggttgtttgtttaaccacaagtcagcttactattacgcctataaaagccactggcaaaagaagagttaaaaacgcatctaattagcccatctctctcaattgtcacaatatcacaacacaaaaaaaaaaaaaaaaaaaacacagcaaaaaatg

SEQ ID NO: 4853 - DNA, 3000 bp, Unknown
  misc_feature (1)..( 3000): cDNA_ID_2051898_gDNA_ID_1620736_Annot_ID_166272 3000 nt of promoter + ATG
taaacacacacacatataaataattttattattaattcactaacacaattttgcaaacaataaatgtcgcagattagtttctcatgtgtcgcatatcctgctttagtaacgatatattgcgggcaggctgcgtacctaactaaacatacttacaatgtgtcaaatactttctacgactcaatccctggttagtttaactcaagtactatcatttcaaaataaaaatgaaaaaaatgacgtgcaataatgtgatataacacataatgctttttaacagatccgttatactggccaacatttgtggtagcggtggcagcatcaatcatcgcgagccaagctatgatatcgggcgccttttcagtcatctcgcaatctctacgtatgggttgtttccctcgagtgaaggtggttcacacctcggctaagtacgagggacaagtctatatcccggagatcaactacttgctcatgcttgcatgcatcgctgttacccttgcctttagaactactgagaagattggtcacgcttatgggatcgccgttgtaaccgtcatggtcatcacaaccttaatggtgactctcataatgttggttatctggaagaccaatatagtgtggattgctatcttcttggtcgtctttggctccatagagatgttatacctatcttcggtcatgtacaagtttacaagcggtgggtatttaccacttacgataacggtcgttttgatggcgatgatggcgatttggcaatatgttcatgtcctcaaataccggtacgagctgagggagaagatctctcgtgaaaatgctatacaaatggctacaagtcctgacgtaaaccgggttccagggattggtcttttctacacggagcttgttaacggtataactccattgttctctcactatatatcaaatctttcgtccgtccactcggtgtttgtattgatatcgatcaagacacttcccgtgaaccgagtgacgtcatcagagcggttctttttccgttacgtggggccaaaggattccgggatgtttaggtgtgttgtgagatatggttacaaggaagacattgaggagcctgatgagttcgagcgtcattttgtttattacttaaaggaattcattcatcacgagcacttcatgtctggaggaggaggggaggtggacgagacggacaaagaagaggaaccaaatgctgagacaacagttgtgccttcgtctaattatgtcccttcatcggggcggatcgggtccgcccattcatcttcgtcagacaagattaggtcgggaagggtcgtgcaggttcaatccgtggaggatcaaacagagttggtggagaaagcgagagagaaagggatggtttatctaatgggagagaccgagattacggcagagaaagagtcttctttgtttaagaagtttatagtgaaccatgcttacaatttcttgaagaagaattgtcgggaaggagacaaagcacttgcgattcctaggtcgaagcttctcaaggttggcatgacctatgagttataagattctctatttcgtctttgtgtttcatcatggtttaaaatcattgtgacctaaataaagtgtctccatgtttaggggacccttgtttttgtttgtttgttgtcataaatagttggtaaatgtgtaagtcattattacctttttttttgtgattgccagtttgtcgattttattgaaaaataaaagttacagaagcccatatttttaatgtaagagactaagagtatatggaacaaagatgtaggactggtttattgtttttttttttttttgtgtgcccatattttaatgtaagagtatatatatattttaataatattatgtgatattttcatccaatatttcactggtatctttttttttttaagtaacagctttaacatttgtcatttatctaaataaatatatattgtcatttaccaatgttttgtattgttttggttaattatgatggttttgttcttgccatttcgtgtggttcaagtgaaaacagcaacacacgcacttgtacgacagataatgccaacgttgtgaatctttgttagttactttagatattatactattcccacgttatattttttattttttcgaagggatttaattggtttcatagagcaactacaaagtatacaggattttcgaaatagaaatattgcataagcaaaatatggtcatatattgaagatttatagaagtatagaacaatagaagtgaaatatgatatgattatttaaaaattaaaatattacaaaagccatattttttaaatcggcctaggcctacacgaatctaaggacgacattgagatgaggtatctaaggacaaaaatttgtagacgttccaggttcaattctatttcgaacaaagtcgtgtgtgtgtggccactttaacttgagctttagactatatattttaccccagatgagtttgctaaaaaaaactcataccaaagagtcttctcatgaatctcatcactatattagtcgaattaccggcagcaataggtgtctatataggaaaaataattttatataatgtcttggtacacaagcttgttttttcttctgcatcattgttagttacttaggtattaggctaattagttccacgttgtaatattctaataaaaaaaatagctataaaacaaagaaagaaaaagaaagaaggcagtacaactaaaaaatcagtcactgaacaaaaaagaaaagacatgtttttgcttctgaagcctctcctttctctacacgatttatctcttaacctcctctcggtaatggtaagacatcgtctttctttctctatatctctcgctctctgttttttcattacaatgtatatataatatatttcttacaattttttttcactgggataactttttattcttttgtccaccattatgagaagttccatggagaaactcttaaagcatccgtggatggtgtggggataaacatg

SEQ ID NO: 4854 - DNA, 3000 bp, Unknown
  misc_feature (1)..( 3000): cDNA_ID_2051902_gDNA_ID_1620736_Annot_ID_166271 3000 nt of promoter + ATG
atctggatccacaagacatgctttctttggctttaatggtaaataaagcattacattaattaacaaaagattaaaaattcatattatgggattttatgtatatatgcaggaactgcgggagtatggagaatggtggcgatggaagaagctggaggatggaaggaccggacgacggtagaggacatggacttggccgttcgtgttggtcttctcggttggaaatttatcttcgtcaatgacctcgaggtaattttagtccttttcttttaatttgtaatttatatggatttcttgttgtataagttaacatataataaacaaattagtttcgatttctagtgtttcttttttggtaaaatgtaacggcaaaggctaaccacaaccatatattatgtgcatttgcatgtggctatctaaatacaaatgcttataatcattgtaaaacaagaataattgtggttgtaggttaaaagcgagctaccaagccaatttaaggcctttcgattccaacagcatcggtggtcttgtggtccagccaatcttattaggaaaatgacgatggaaattattcacaataaggtctttttaccatttactatatttcattttcagacacacatttcccacgtgccaactacatttttgtttggctcatccttagcgacaattttaagaggggcaagtttctaaccattggcaaccaaacaaaatacataacgacatttgtttttggctcatttatcaataactaccttgaaaaaaatcttataaatcacttataattaactcatattaatccagaattcaggttggttgaaccaagtgacattgaaattttattttatatctaaacgcacataagatgcgtatgatatatatatagtaaccataaactaattaaaaacttatgataagcagagagtgaagatttggaagaagttttacgtgatctacagcttctttttcctacggaagatcgtagtccacttcttcacttatttcttttactgtgtcattcttcctacaagtgtcttccttcccgaagtaaatataccgaactggtcaactatatatgttccttctgtcatcaccctcttgagtgccattgccactccaaggttagtactatacatcctataacgacctcatttattcactctatatattaccttacttacatttttactattattggcagatcattctacctcgtgattttttgggtcttattcgaaaatgtaatggctatgcaccggaccaagggaactttgattggcttatttgaaggaggaagagtcaatgaatgggttgtcacagagaaattaggagatactcttaacactaagctacttccccagaatggacgacttccgaaaaggtaaattaatcaaattaaacgaaagaaagaaaattgaaacatctttgacaaaaaaaaaaaaagtgaaaaaaaaaattgaaacatttgaaaagaaagaatatcaattacttaacataaaatttgacgtaatccggacttagaagactcaaactagttaatagcatttgttatttgttaaattttaaattcttaaaatgatatttgttttttaatctattttacattattcaaaatatatatttgtgattattcagtcatgtgttatgaacttctgatatagtgatatattcgcaatagactagcaaaactctttttttttttgtgtgtaaaaaggttagaatgagggataaataaaacaatatttctggatactaatgagtgaaagaaaatgttttgttgcagagtaaatttgaaggagatgatgatgggtatatacatattatgttgtgcttgctacgactttgcatttggaaatgcatttttatatttgtatctcttcatgcaagccactgcttttctcatctccggagttggctttgttggaacttaacacgacgacttatatgaaaatcttctatttgtaatcaagtatatgtgcaataaacatacccatgtgaatccatttgtttagcatgatgtaatttgatatgtataagtgctttgtccgaatacattatttgttagtccagatattattgttatgggtaggttgtttgacaacatatatttagttgtctgactcattatatgttgaggtgttgatatgcacaaaacaatggatttaagtctttgtatcacttaggggaaataggagaggaaaacttgccacatatgattactgatattgaagatcaaaaaaaacaaaacttaagaaaggttattgtttccttttttgatttatcagttttttgttttgtaaatctaactatttctctattttctaatcttctttacattttgagaatgataattaaacttaatcatgggtttctttactggtgctggccttcttttcaattatttctttggttttaatatcattctcagcgaatcatgtaggtttagggactaatggatattccctgtaaataaagtttccggatgactaatgtaaattattatttacttgggtgatcaccttgagtaattcagtttaagttttatggtcttcactcttaagctcaattcgtctctatattcatttactcttgtcttttatcatacactcataggtttaaggtcttgttttgaggatgatgtctttgtagacaagaagaagcagaatattgttaagacttatcacttacttaagactcttgtaaaactcttgaagtctccttaatttcacttttggaaaatggtgatgtgacaagctggagatacgacgtggcaaattggaaagctgatgtgtaatatttttgattggaataatattgtttttttggttaaaaataaaacctacctgtaaagtaagaaagcaaactaaaataaataaaaatagtcaattgcttccagttctaagaactccggtctgccgccgatttcgtttctctttcaccggttctcgcctaccgacgtcttccttccattctttctctcatctgataaccaacctccacatg

SEQ ID NO: 4855 - DNA, 3000 bp, Unknown; identical to SEQ ID NO: 4849
  misc_feature (1)..( 3000): cDNA_ID_1825858_gDNA_ID_1620736_Annot_ID_166266 3000 nt of promoter + ATG

SEQ ID NO: 4856 - DNA, 3000 bp, Unknown; identical to SEQ ID NO: 4848
  misc_feature (1)..( 3000): cDNA_ID_1375709_gDNA_ID_1620736_Annot_ID_166265 3000 nt of promoter + ATG

SEQ ID NO: 4857 - DNA, 3000 bp, Unknown; identical to SEQ ID NO: 4847
  misc_feature (1)..( 3000): cDNA_ID_2051917_gDNA_ID_1620736_Annot_ID_166264 3000 nt of promoter + ATG

SEQ ID NO: 4858 - DNA, 3000 bp, Unknown
  misc_feature (1)..( 3000): cDNA_ID_3074378_gDNA_ID_1620736_Annot_ID_166256 3000 nt of promoter + ATG
tctcaccacgactatcaatatgttatttgacacatctcgttcatcttaaccctcaaaccatgggttaagacatcatagtcatcatgacctatcacaatgacataatgatattagcataatgttacattttctcaattagtgtcaaaaccatatttaaatatatatacattcataatcgttgtatataatgtgtctaatataggaaaattagtaatattaaatatcatatataacgaaaatggaatttgtgaacaatatatatatgaaaatgatttcactggtcaattctcgtttttcattttctaactggcctattatttctccttaagaaggctaacatcatcatatatactatatgcatatacgtagtagagtcaatataaggtctgtatttttaacttcttatataactcatatttttttcatctagttggaacaccgtaaattttattctaaaataaaacaaaattcttacgggttcatttattaatcaaattgatacattttcttcccacacacatttttacagttagagtcatgtaagacttatcgattcctatgctagaaaaaaacgtgcgactataccaaattatatggagaaaaatatgtggtcaacttaaaaaagtattccctagtttagtggtgattaaatattaccaatactttagcaaaggatataatagtgctttataagtcattattaatagtataatagagtgatgccaaatcaattaacatacctactagataacgatgacaactcattttttattttattttcaattgaaacatgcattaacattagacagataaatgatatatttaacataatttacttaatgactcgaattgggaaatttttcttctaaaatacagattttaacatatagagtgatgttagatttagctctttaaaatcatcaacacgttggaaaacaaataagctattataccaatttatatggagactaatatcatgaacggtacttcgttatcactcgtgcccgtcaacagtgccattggatatatgatgtattacatatcatggtattatgtaaaatgatcgagatcaaatatcatggacattctataagtgcatcgaggtcagttagacttagtatcgtggagcatacttcttgaccaccttactgtcggctaaaatttatatgtaaatattctcttgatacctcataatgatgtgacgtacgattctatttatgatgttgcactgttatttgttagatacacagtcattattttcctttgatatggttgtgaattcctctaatatgattatgtttttcttatatgacttggtctgaggtaactgatttgaacaagctgctgttagatttatcaccaactttatagaagaaaagattctgccactatgagaaattggcaaataatatagagaaaaatgtagtcaatttaaaataattattcctttatgagtgcttacaaattaatgatattttggcaaaacaattattagtattttataagtcaatgtttattagcaaagtattgtaaagccacgtcaattaagattatctaaatcaagtagcatgttcattaccattagatggattaaaaatatatttaagtttattttgttgggttgtgcataacttccacttccaatattgttccattttaaaaagtataatatgcatatagtagaacatacatcacaattacctagagaaattgttcagaaatgaatatttattcaatacatttttaagaatatttcaacaggaaaacaaaaaaaattgcagtacgaatttcattggttaattagaaatatctccttttttgtcttcatctagaaggaatacctaaacttgatctgaaaataattattttttactttaattttaaaaaaaaattagaagtcaaactgaaaacatttgagtacaaagttttttatttagagtgatggtaaattttctcaagcaactatatcatagaagataatctgcggcttgtcagaaaaaataataataatctgccactatgccaaattaccgaattatatagagaaagaattagttagtattaagaaacttgttccttagataagtagtgcttacataatatcagtattggcagaaaaagagaattagtgacataatattaatattttttcaaaaagaatattagagttctaaaagtcattgtttaatagtatataaatcaattaacacgtgcattatcattagatagataaataatatatttaagcttgttttatgtggttatgcgtattatttcacttcgaacattgttccatttaaacgaaaatatgatatacatataagaaatacatcacaattacctaaggaaattttgggcatatttttaaaaactatttgttatttaatttttttttccaaaatttgtcatagacccttggtttttgcccatgctgccaccccctagagacgggcctggttctatggtataatagagagtaaacatttgatttatgcttcaaactccttctatttcctttcaaaaaggtaaacaatagctgatgtagttttacattcaactaaaaaaaaaaactacttcaagcgaaaaatattataacttggttttaaattttgttcatcgagcagtatgtggagggctcgtaggacgttggcttgattgttaagtgttgtgattgttggtcaaaaaaagatatagaaaaaaagtcttatcaaattagccaccagacgaaagtgaaatttacggtccgagaacatgcgtttaccacaaatggttgtagtcagggtgtcatatcataagaaccacaacatgaggatccatagtgatgtgaattgttgactttgcctggctacatggtttttttctgtctgaaaaaaaaaaggccaaggaaaaaacaaatgtatccaaaaccctataaattacaaagtagagaggaagaagaaatgcacaaatttcagaataacatatattcactaaatacttacatgagagattgaataagaa

SEQ ID NO: 4859 - DNA, 3000 bp, Unknown
  misc_feature (1)..( 3000): cDNA_ID_1825833_gDNA_ID_1620736_Annot_ID_166279 3000 nt of promoter + ATG
attctcaatactttcacatcatcattaaaccaggatgaccaatccggttaagccaaatatactcttgaaacttttaattcttttgaaacttctagttctttcaaaacttctaatttacttttcattgcttatcagttactcccttaatgagatcttataatccaaaattacttccatgtattttaataatcaatcatatgttaataaaacaataacgagataataattaaaattttatattctagtataaacgatattaaatttgactaactatgtaagatcttatattcacttcagaatatgagtattacttatcatagataactcatatgttttcttagcctttgaaaaacactcgatttaagtttataatagttctcaaaatttctttcaaaatattgtgtctacaagacaacaatacttgcgtaaaagttgaagtgtctgttttaccatctccgcatcaaagatattctcttaacaatgtgagttatattcacaaagagacttcaagtcttgaagttttagtaataactaattataacttattttatctaataacacattcgtataagaattgctttatacaacttttagatctttagtagtcaaagattgaacataatcttctggatatgtcacttattatccatgtgagattcattacttctcctcctcgaaatgatgaaacttcaagttcatccatctcgtattgaattccactctagaatcataatgtatttatatctcatcatattaactttgagatttggagaactataccgcatcgatgattttaattttgtattcccatagaaaacaatgtatatgctcttctagagtcttttaataagattttatactacttaaaaaactttgaccatcaaaaatatgatatcttcttaagatacattaaactagtcattcatgaaaatttctataagtgattatacctttaaattaagttatttatcaatcaatttatttcataaaataatcaagtattatatactaatacaattttaatgcaatattgtaaaaccaatcagaataaaactattttgtgcaaaattagggcaaaaccatgaacaattttttttttttatatattttttatttagatactacaaagatttagagaaaaaaatcttataaaaagaaaaattatcttgcaacgtttttagtaaaaataataataacacaatcaaatatatggaaatcttataaaaagatttagataataataacacaaagatttagatatatggaatcttataaaaagaaaaattatcttgcaacgtttttagtaaaaataataataacacaatcaaatatatggaaatcaaatatttaatatggaaaagtcaatatctaaaagtgataagatatgtataacgttttaatcaaaggagttaaataagggatatcatatcaatcataaatggattttagacaatataatatttataaaatgatattgaatatagatgcaactattcaaaactggaatgctaaaacattaatacatgcttgcatcacccaccaccgggctatgaatagttacaaaattagttatataattataaaattggtaatttatatattcaatattgtaatagtaaatcacaaaaattaacaattaacaagcatgattctcttctttaacgattttctttgtagaatcattgaatcatgcgatagtaattatagaaacaaatgataagcatgattctcttctttattgaatcattgaaaacatgcttttaccgatctatagtataatcatcgatcggttcatattgttttgtttcaataatagaaaataagtactatgaaccatgagtcgataagtaaacatggttcttaaaaaaaaatgtaagaatctctatatctaccttttagagcgtgctgataacgtgttataaacagagaaagagatagaggaaatgagtgtgttattccattgagataaagggttctttatataggagtacaaggaaagggtaaaaccctataaacatctagatgatgggcttaaatgatgggccttataacgggcatccatctttattcataacagatttatatgaaaaaggtaattttcttctcctttatagaacaaaagatagttcctaaattattatttttttatacatcctctattactaattaatttgatgtaaagacaataaaaaaaattaagctttgaaagtgctagctaatcacctccataatgattggttaagaattaactatgatggctttcaaatcatgcgttcaattggtcattttgaaatagaataaagattgagaagaatgtttgaattctttatctgtcaaaaaatgccaaacaaaaaactcccaatttgttttattgatttttcattttaattggtaactttgattgaattctcattttaattgctaactttatttacttttacaaaaataatcacttcgttaaattgactgacggaacaaataaacaaggttaactctctatttagaatttctgttaaaacaaaatttgcatgcagtttctgttttgtcaaatagtttcttcatcatctttcaaaacagtcaaaaaattataagaagtcagggaaattttttttaacagaaacacacaaaggccaaagccatagaaataattggtgattttgatatgttgttgttgtgttggaagttggtgacacctaaaattaaccaaaacaaaagtgacgtattcctcaaaaatagcaacactaaccaccaccacaacaattatcctttttttctaaacgtagaacacacaaaccggttaagtggctttaatttttcccaactgttttttcagagataaacatgaacacaaaccgtgacaacaaatcgtgagtttttgataccgtaatttatctgatcaaaagtaaaacaaacccataggaaaacaatgtatcaaaaatggtaatgatataagcaaagggaagaaacaataagaagaagaagaagaagaagaagggtatg

SEQ ID NO: 4860 - DNA, 3000 bp, Unknown; identical to SEQ ID NO: 4852
  misc_feature (1)..( 3000): cDNA_ID_1825841_gDNA_ID_1620736_Annot_ID_49493 3000 nt of promoter + ATG

SEQ ID NO: 4861 - DNA, 3000 bp, Unknown; identical to SEQ ID NO: 4851
  misc_feature (1)..( 3000): cDNA_ID_3100820_gDNA_ID_1620736_Annot_ID_49494 3000 nt of promoter + ATG

SEQ ID NO: 4862 - DNA, 3000 bp, Unknown; identical to SEQ ID NO: 4859
  misc_feature (1)..( 3000): cDNA_ID_1825833_gDNA_ID_1620736_Annot_ID_49496 3000 nt of promoter + ATG

SEQ ID NO: 4863 - DNA, 2327 bp, Unknown
  misc_feature (1)..( 2327): cDNA_ID_1825906_gDNA_ID_1620737_Annot_ID_49498 3000 nt of promoter + ATG
gatccaacaagctgcttcgatgctgatttaagtgagtacaaaaagaaggccacagtaatcgttgaggaatactttggcaccaatgatgttgtctctgttgttaatgaactaaaggagcttggaatggctgagtaccgttattattttgtcaagaagttagtctccatggctatggatagacatgacaaagagaaagaaatggctgcttttctcctctctaccctttatgccgacgtcattgatcccccagaagtttacagaggtttcaacaaactggtcgcttctgctgatgatttatctgttgatattcccgatgcagttgatgttcttgctgtctttgtggctcgggcaattgttgacgacattcttcctcctgcgtttctcaagaagcaaatgaaattgctgccagataactccaaaggtgttgaggttttgagaaaggctgagaagagctatctagcgactccgcttcatgctgaagttgttgagaagagatggggagggactgataattggactgctgaggatgtgaaagctagaattaacgacttgttgaaagagtatgtcatgagtggagacaaaaaagaagcttttagatgcatcaaaggattgaaagttcctttctttcatcatgagattgtcaaacgagcactgatcatggcaatggaaaggcgaaaagctcaagtcaggctgctagatctgttgaaagaaacgattgaggttggtctcataaactccactcaggtgacaaaagggtttagcagaatcattgattcaatcgaagatttgtctcttgacataccagacgcacgccgtattttacagtctttcatctctaaagcggcttctgaaggatggttatgtgcttcttctctgaaatcactctctgctgatgcaggagaaaagttacttgaaaactccagcgccaatgtttttaaagacaaggcgaagtcgatcatccgagagtatttcctttcaggtgacacttcagaggtcgtacattgtctagacaccgaattgaatgcatcttcgagtcagctacgcgcaatctttgtcaaatatctgataactctagcaatggacaggaagaaaagagagaaggagatggcttgtgtgctcgtctctactcttggtttccctcccaaagatgtcagaagcgcattctcgatgctcatagaatctgcagacgacactgctttggacaacccagtggttgttgaagaccttgccatgttcttagcaagagctgtggttgacgaggtgttagctccacgggatttggaagaagtgttaaatcagactcccgaggcaggctcaagtgtgggcgagaaagtgattcaaatggcgaaaacattgctgaaagcacgtctttccggtgaaaggatcttacgttgctggggaggaggaggaattgagacaaactcgccgggatccacagtgaaggaagtgaaagagaagatccagattcttctagaagagtatgtctctggtggagacctcagagaagctagtaggtgcgtaaaggaactaggaatgccgttttttcaccacgaagtagtgaagaagtcagtagtgaggatcatagaagagaaggagaacgaggaacggttatggaagctactaaaagtgtgttttgattcaggactagtgacgatatatcagatgactaaagggtttaaaagagttgatgaatcacttgaagatctgtctttggatgtccctgatgctgccaaaaagttttcaattgcgttgaaagaggcaagcttgaagggttcttggacgaatcattcgcttctgaggattcgcaaagtaagaaacagaacggctcgtcttcttcctctggatgataacatttgagcaccatacctcaaacctcgagacgttggtttcacgcaaaatcaccttttggagttttttttttttttttcttataaacaaactaaaaaagttttggatactttttgatgacgtttcttacagaaaacaaatttatctttatcttagtgacgttttgttatagcacattattactttatgacctgttttttttgttcctttgtcaatgattacattgtcttgctaatattttcatacagaaattttattttatattctatgatattatcctctcttaaaagctggacaaaccccacggaccacgagtcttccagctaagactttttttagttcccaaaagatcgaacttggcgctactttcattttctcatctctgtttttccaacatcctaagaacagagttcgttgctccttttgttttctttaaagaaaaagtcagattcagatacatacatactctgaagaacatg

SEQ ID NO: 4864 - DNA, 3000 bp, Unknown
  misc_feature (1)..( 3000): cDNA_ID_3074402_gDNA_ID_1620737_Annot_ID_166292 3000 nt of promoter + ATG
agtatccgaggctttggatgttctcaggctatctgttgatccaactgatcatgatcttggtttctctaccaccgactgaaatttgcaatgcgtttgctcaactctgttttcttcttttagttttgatatcgactccttttcttttcttttttgggttttagtcttcctttactattttagcagtttttttttgtttacttagtttatggtttttgtgtctttaacttagtttatggtgtttttctttttctttggacaatgatgatttcttaataatctgagtagacttcttcttccgaatccccaaataatccatctctacttgaaatttaagttgttcggtattcatggtcagcaacaagggacaatccttctattatggtagcagccttctattatgaatttattcgaatgtgtctactcataatttgtggtttgtatttcaacttgtagttgatatcaattatatgcacacagactttttctttttgaggggttggaagcaagcgattcaatgattgtaccactcatttcataatagtgtttgatatgacgttaatttgaatggtttatgttgatcgaaaatactctcagtcacaacaagaatctaattcgattaatttatttgaaaaacatatgttggcatggtacatgaaccagctcgttcatatgaaaatattttaaaaagtcaacatcagtgctaatttcaaattgaccatacattagcacacaagaagactaacaaaaaaaatgagtgaataaagaagagagtgagtggggttgatacatgtcaccgtccaaaatgtgtctgacccttctcattggagctacaagagccgaccctttgcctcatcatttgttgacttcactctccttttacatatttaaattataacttgctcatatttccattcattgtgttcggttctagattgttccatccactttcttttttctcttactttgaaatttagaaatatatgaatacttgacaaatatttgaatattgtaactgatttgtttgttcgtaatacttgacaaacttttttgaatatacacctttacatatattttgagttgagataaaaagggaattatgttagtttatggattatattatgtaaataccacatctaactatgatcggatgaaaactaaaccagcatatctctaatcagtaatatttactaaatttatatatcattaaagattttttgaatttagcaaaaaaagaagaagatatcattaaagatttttaaatttaaagtataacataatgaataaatcaagtgttgagcttagtttcgcgttgcaaagatgttcatttgatttttttttttttttttccatttgatttttcttatactaaattgattgatgtcacggtccttctgtgaaaaaagtatattgtactgtataaatttataatagtcatacttgaagataactaatatcattttctaaaggttttgttgacatgaaatgggtgaatgatgaacatctcgtttgctaaaccacaaaagaaataattcgttggactataacttaaacttataatatatcaactgaaatgcctacaatttgagaatacgccttttcaaaaagttttagaattttataaaaatttctccaccataatattactttaataaaagcttgttattaaaatgatatattaacaaaaaaaaaagaggtaggcaaagtagcttttattaaaattaatgttttccctaattggtaaatcataaaccaaaaaattgaggtaattcttaatatatttactatgattagaatgatacattaatgtaacattttatcatcttcattaataatagtaagttctcctcaaaattacaatttgatatcaaaaaatatatttgtattacaagcaattactgaaaaattaaaattacaatttagcccagttacataactccacgtaaggtttgagcccatcacatcacatggtacatgaccaaagcccagttatgttaccatggagtattcttcagacaagagccatccagacagaagtggaccacacaatcacgaatcgtatggagatcattacaatatattgctcacatcttattgcgccacgtctcttatttggcgagtgatcaacgtccacagatctcttgctccactctgattggtacacgtcatcattttattgtgctacttgtttatgtggtacagtagagacaagtggtaagattttaaaatatcttaaaagatgtgtgaggcccatttagatattttctcaacgggctgttcctcaaaagctgcccgtttatctacaaccatcgaacggctcgaaactattctgggctagctgcccgaaatctcttaaaggaatttgttgagtgggcttgaatcaacggtggataattcgaaggtgtacgtaacatctcgtagcatctgaacttagctcccctcaaaatatctgtggacatatgtcactagctttttttttgtgtaatgaaactattaattaattaggcaatcacatgagagatgttatatacttaaattaataactcaataatacaatcatgaccaccaaaccttgaaataaaataatctctctgattacttgtacaaattctttaccaatatatgccatactgtgaatgtaatggtttattttaaaacagccaaatattattgatataattatatgtttaagtagattttaaacttagctcatggttaaaaatagacagaattttggagtaaatctgagtttacaaaatttatttattaggattaaaattaattacttaaattggcaaacatttttcttggtgattgtaacatacaatatacgaatttgaattcgcattgtgattccaaaacaacactaacataaactaccagtaaaattttttaaaataaaatttcatatatatatgcttaaaaaatgtaacaaaaatatggtaaattttttaaccatggtatgggtggagatgtatgtgggatgatgatggttatatggta

SEQ ID NO: 4865 - DNA, 3000 bp, Unknown
  misc_feature (1)..( 3000): cDNA_ID_3074395_gDNA_ID_1620737_Annot_ID_166294 3000 nt of promoter + ATG
aacggaatgaatagtccgtcctatcgattcttcaacgccgcctcaatagactggaaagccgatatccaaaactgtttaaactgggaagctcacagcttgctctccacaactatgcctactcagtttctcgacactgcggctcgggaactcggctgtactatatccttgtcccaataacgagcacccacttttgtttttggtaaattttagttctctagacaaaacatttggacgtagaccaagaagaatatatatatagtttgttgtatgtaatgttgtaatgatgagtgactgacgcaatcactcccaccggcgttggatttgctctcgctcggtgtcttatataactcaacctcttctctgtacattttaaatgacgaagtagctcaatctttttttttgtgcgtctggtgtttagtcttcagtggattctaaatcgtaatgtatagaagtgaaaaatttacaaatttacttatttccgaatactcttaaaacagcaaaaattaatattgcaaaagataatttatagtattttaatctttttcctccaaaaaaaacattaaagggtaaattagtaattaactacaggagcttcatattaggttggaaaaccctaaatatgccgcttataacagacctgagcttaagctgtggtggcgcctccagagtctggtaaaagagcttaatcctcctctcgcgatctttctcggcatccaaaaatggtacgattatcgttcttcaactcttgtctggttctccaattgctcgtgcttcattttgcgtatcgctcgtttttcattgctggttttgggattggagttttaagctcaaatgttttttgtattcccttacacgatttgcgactgacggatctgttttttttttttcgtattcgtgtgtgtgtagtctctagttgcgaacgaggagtttcagcatattctgcgtgtgctcaatactaatgtcgatgggaagcaaaaaattatgtttgctttgacctcaatcaagggtattggaaggcgattggctaacattgtgtgcaagaaggctgatgttgacatgaacaagaggtttgtttcttagcttggttcttaatactttcagttacttaggaattctatggataaggattatgaatcttgcgaggttttggatgttagtagaaaatgtagctctttgactagaattgtacctgctcgatctggtttgattgatttctaggaaatcagatatttaggttttctttgcacatagaacttctctagattgatattcttgaagaagtttggtctagtgtgtgtttttaaatgttttttcctttgctggtatattcagggctggagaactaagtgctgctgagattgataacctcatgacaatcgttgctaaccctcgccagttcaagatcccagactggtttcttaacagacaaaaggattacaaggatgggaaatactcccaagttgtttccaatgctcttgacatgaagttgagagatgatcttgagcgtctcaagaagatcaggtaacaaacaacacatacagacactctcctctgtagtttttagataccatgttaatagtataatgatgcccatcataactttctatatggaagaagctaagtacacaactcttgtgttaaatcatgtatacactcattttcggcaacaaaacctaatctgtagtgtaatgatttactgatgcatcctttgtttctctcttgttgttctgataatcgatatagaactttgtttgtactgactgagattgtcactgtaatgtaaacagaaaccatcgtggtctgaggcactactggggtctccgtgtacgtggacagcacaccaaaaccaccggacgccgtggaaagactgttggtgtttccaagaagcgttaaaaagagtttgagcttggttcaatggctttgttttgttttttttgtattgttgttttttgcagaagagatagtttaagagatgttgtttcatcaaaagacggtcttagcttttacaatatataattgaatccaaaaactagtctctatttattacattctcttctctcaaaatctgctttaaacaaagttaataatagcacactcctccatacgcaagaattatataattagagaaaacttttaagtgtcacaagcggctgtctctataatgcgcaaatacatcgttatcagttttaatcactatcagtaactttactgaacttaattgatcattttaatttttcatgttactctctccttcttcttcacttgttctctttctcatcgcctcttgattcacgcgaacgagaaagcgacgatcgtaaccaccggcgctgaccaaaaagtaatcgattctcttcccgagctgatctctcaggtgcgtgaattcacttttttttttttcgatttttcccgagaaaaaaatccagcaaagagtagtagcgatgaagaagacgaggtttgaattgagattcgtattctttcggtggcttgaagtagcttatgcatgtttaaactcttgttcagttgtttgctcatgattcgaaaatggctttgtagatcttctaatataatctcttctctttatcaattcactagtgttctatatctgaagaaatttacggctacagatccaatctcatttcgtttcgttacactatctctactaagattttgttttttgttttttttccctctttttttgcgttttagatctcctccatgattgaagttgatccatgcttttgagtttaagtgatttatttaagatcctctaaacttttttttcttcacttagtggtggttccagtcaatttagcaagtaagatgttgtatgtgtcaatgctataactgtgaattttcagctattgtagtttgatttttgtctttgttagcttcaggtgtcttgaatctgaatctgtggctatatttggtgctcggtggtgagcaggaagggagggggatattgtcagggttttaatgtacgtcagatgaatagagcaacta

SEQ ID NO: 4866 - DNA, 3000 bp, Unknown
  misc_feature (1)..( 3000): cDNA_ID_1825902_gDNA_ID_1620737_Annot_ID_166289 3000 nt of promoter + ATG
cagaggtcgtacattgtctagacaccgaattgaatgcatcttcgagtcagctacgcgcaatctttgtcaaatatctgataactctagcaatggacaggaagaaaagagagaaggagatggcttgtgtgctcgtctctactcttggtttccctcccaaagatgtcagaagcgcattctcgatgctcatagaatctgcagacgacactgctttggacaacccagtggttgttgaagaccttgccatgttcttagcaagagctgtggttgacgaggtgttagctccacgggatttggaagaagtgttaaatcagactcccgaggcaggctcaagtgtgggcgagaaagtgattcaaatggcgaaaacattgctgaaagcacgtctttccggtgaaaggatcttacgttgctggggaggaggaggaattgagacaaactcgccgggatccacagtgaaggaagtgaaagagaagatccagattcttctagaagagtatgtctctggtggagacctcagagaagctagtaggtgcgtaaaggaactaggaatgccgttttttcaccacgaagtagtgaagaagtcagtagtgaggatcatagaagagaaggagaacgaggaacggttatggaagctactaaaagtgtgttttgattcaggactagtgacgatatatcagatgactaaagggtttaaaagagttgatgaatcacttgaagatctgtctttggatgtccctgatgctgccaaaaagttttcaattgcgttgaaagaggcaagcttgaagggttcttggacgaatcattcgcttctgaggattcgcaaagtaagaaacagaacggctcgtcttcttcctctggatgataacatttgagcaccatacctcaaacctcgagacgttggtttcacgcaaaatcaccttttggagttttttttttttttttcttataaacaaactaaaaaagttttggatactttttgatgacgtttcttacagaaaacaaatttatctttatcttagtgacgttttgttatagcacattattactttatgacctgttttttttgttcctttgtcaatgattacattgtcttgctaatattttcatacagaaattttattttatattctatgatattatcctctcttaaaagctggacaaaccccacggaccacgagtcttccagctaagactttttttagttcccaaaagatcgaacttggcgctactttcattttctcatctctgtttttccaacatcctaagaacagagttcgttgctccttttgttttctttaaagaaaaagtcagattcagatacatacatactctgaagaacatgtcgacgcgaagacgaactttactcaaagttataattcttggagacagcgggttagcttatttttctacctaactgtgttttttttttaatgtttgatccgttaatcattctcttgttgttgtttttgtgtacaaatatcacagggttggcaaaacatcgttgatgaatcagtatcctaactaaactttttgatttttctttctttggattttcttcttttcgtaattttgatttttgtagctgacggtgagaaaaaaaaaacttagctttttttttttttcaatttgtagatatgtgaataacaagtttagtcaacagtacaaagctacgatcggagctgattttgtcactaaggagcttcaaattgatgacaggcttgtcacattgcaagtgagtttttttgtttgtttttttttggtttaaattgttgtcgatcttttaagagaagagtgtatatgaattattattattattgtaattgtgttaagatatgggacactgctgggcaagagaggtttcaaagtcttggtgttgctttctatagaggtgcagattgttgtgttcttgtctatgatgtgaatcacttgaagtcatttgaatctctcgacaattggcacaacgagtttcttacacgggttttttttttttgctttctccatcacattttctcttcatccaaagattctttcttttagtgactgatagttgttttttgtggatttttgggccaggctagtccacgtgacccaatggcattcccttttatacttcttggtaataaggttgatattgatggaggaaatagccgagtggtaagttactattagtcttaagcttttaaatctgaatagtccatttcctttgtttgctatatatttcctttctttgtgttcaggtatctgagaagaaggctagagaatggtgtgctgaaaagggaaacatagtctatttcgagacatcggctaaagaagattacaatgtcgatgactccttcttgtgcatcacaaaacttgcccttgcaaatgaacgcgaccaagatatgtaagtgttattagtctttctttatgtgatcctctcactttgtgaatctcctccatatgatggatccttattaaactcaagatgaaaaaccagaatctctcaattcaaattttcatataatctttttttgcaactcggtgctacagatatttccagccagatactggttcggtgcctgagcaaagaggaggttgtgcttgctgaatgctgaagaaacatttcttactctcttgatttatgcattacttgttgtgtgtgtctataatcttaatgctgagaaggaccaataaaacttgtattgttccctaagtaaggttttgttacctttctggttcttcatctttgacatttggtggttcacgatttgtatgtaacaacagttcaagtgtacatgtaatgggttggttctgtcttctttatgtaatgggaaactaatgatgagtccggttcagccgcgctaaaccgaatccggttcggtttgaaatatcagttagcaatttggcggtgacgtggcgcttccttccccacttgtttcgctccttagaattcagttgaatctctcgaatcgtcgtcgtcaatcttttcgatttctcttcctctcgtctctctctctgttaaca

SEQ ID NO: 4867 - DNA, 3000 bp, Unknown; identical to SEQ ID NO: 4866
  misc_feature (1)..( 3000): cDNA_ID_1825902_gDNA_ID_1620737_Annot_ID_49499 3000 nt of promoter + ATG

SEQ ID NO: 4868 - DNA, 3000 bp, Unknown
  misc_feature (1)..( 3000): cDNA_ID_1825890_gDNA_ID_1620737_Annot_ID_49502 3000 nt of promoter + ATG
attttaaaaagtcaacatcagtgctaatttcaaattgaccatacattagcacacaagaagactaacaaaaaaaatgagtgaataaagaagagagtgagtggggttgatacatgtcaccgtccaaaatgtgtctgacccttctcattggagctacaagagccgaccctttgcctcatcatttgttgacttcactctccttttacatatttaaattataacttgctcatatttccattcattgtgttcggttctagattgttccatccactttcttttttctcttactttgaaatttagaaatatatgaatacttgacaaatatttgaatattgtaactgatttgtttgttcgtaatacttgacaaacttttttgaatatacacctttacatatattttgagttgagataaaaagggaattatgttagtttatggattatattatgtaaataccacatctaactatgatcggatgaaaactaaaccagcatatctctaatcagtaatatttactaaatttatatatcattaaagattttttgaatttagcaaaaaaagaagaagatatcattaaagatttttaaatttaaagtataacataatgaataaatcaagtgttgagcttagtttcgcgttgcaaagatgttcatttgatttttttttttttttttccatttgatttttcttatactaaattgattgatgtcacggtccttctgtgaaaaaagtatattgtactgtataaatttataatagtcatacttgaagataactaatatcattttctaaaggttttgttgacatgaaatgggtgaatgatgaacatctcgtttgctaaaccacaaaagaaataattcgttggactataacttaaacttataatatatcaactgaaatgcctacaatttgagaatacgccttttcaaaaagttttagaattttataaaaatttctccaccataatattactttaataaaagcttgttattaaaatgatatattaacaaaaaaaaaagaggtaggcaaagtagcttttattaaaattaatgttttccctaattggtaaatcataaaccaaaaaattgaggtaattcttaatatatttactatgattagaatgatacattaatgtaacattttatcatcttcattaataatagtaagttctcctcaaaattacaatttgatatcaaaaaatatatttgtattacaagcaattactgaaaaattaaaattacaatttagcccagttacataactccacgtaaggtttgagcccatcacatcacatggtacatgaccaaagcccagttatgttaccatggagtattcttcagacaagagccatccagacagaagtggaccacacaatcacgaatcgtatggagatcattacaatatattgctcacatcttattgcgccacgtctcttatttggcgagtgatcaacgtccacagatctcttgctccactctgattggtacacgtcatcattttattgtgctacttgtttatgtggtacagtagagacaagtggtaagattttaaaatatcttaaaagatgtgtgaggcccatttagatattttctcaacgggctgttcctcaaaagctgcccgtttatctacaaccatcgaacggctcgaaactattctgggctagctgcccgaaatctcttaaaggaatttgttgagtgggcttgaatcaacggtggataattcgaaggtgtacgtaacatctcgtagcatctgaacttagctcccctcaaaatatctgtggacatatgtcactagctttttttttgtgtaatgaaactattaattaattaggcaatcacatgagagatgttatatacttaaattaataactcaataatacaatcatgaccaccaaaccttgaaataaaataatctctctgattacttgtacaaattctttaccaatatatgccatactgtgaatgtaatggtttattttaaaacagccaaatattattgatataattatatgtttaagtagattttaaacttagctcatggttaaaaatagacagaattttggagtaaatctgagtttacaaaatttatttattaggattaaaattaattacttaaattggcaaacatttttcttggtgattgtaacatacaatatacgaatttgaattcgcattgtgattccaaaacaacactaacataaactaccagtaaaattttttaaaataaaatttcatatatatatgcttaaaaaatgtaacaaaaatatggtaaattttttaaccatggtatgggtggagatgtatgtgggatgatgatggttatatggtaatggcgcataaaggtggtggcaaaggcaaggaaatatcgatgacacgtaagcagacgggaaatcttaaaccgagtggagaagcctccaaatctcttttttctctctctctctcctaaggccaccacaatctcttcttctgtgtatgtattctttttttctccgatattcgtcgatctctcaaaaatatcctcaaagccaaaaaaaagcaagagtagagataaccaaccaacaaactcataggaagacatatttactttcaggtctttcttctactacctttttcgtggtttttggttgattgattctcagatgagattttttcccgaatcatttgatgtcttttttttttaaataagttcttggtaaatcactgtttctactagcattttttgttttctcagcttagatttgttgtttgatttgacatcttatctgattgagattttgttcttctgaattgttgttacagggtttagctgtttgattcagcttcgatttagtgtacagtgtgttgattagtataaaaaggatttaaaagaatctgggagatgtgtatagtgattgttcttgctggcgaatgttaacactacgtcgtattgattctcgattgatagtagaagaaaggtgttagttagattgttcgttcatctagttggggtttagtttcggttcctgg

SEQ ID NO: 4869 - DNA, 2327 bp, Unknown; identical to SEQ ID NO: 4863
  misc_feature (1)..( 2327): cDNA_ID_1825906_gDNA_ID_1620737_Annot_ID_166288 3000 nt of promoter + ATG

SEQ ID NO: 4870 - DNA, 3000 bp, Unknown
  misc_feature (1)..( 3000): cDNA_ID_1825936_gDNA_ID_1620738_Annot_ID_49505 3000 nt of promoter + ATG
tccaccacttctcagcgtccttgttctctctttcattttggactattgactgcttggtctcttgttctttttctttttcagccatcacctaagataaaattgtattttaaacaattaatttcatgaataatgaatgtgtaaagaaaatccgtgaatccatgactatgacttaaacaaaaattgaacccaccaaaattttcattcttaatttactttgttgaggaaataaatatgcaaaggaggtttaccatttcttttacaaatcaaaaacaaattgtgaaacacttatataataattttttatctaaattgaaaaataaaagagagaagaaataaagattagataatgccaaaacttaaaacttacctcagttaaagactcattgagcatttgaatacggagctttgtgcggctttcagcaaagtttgtgttgttgtgtcttataacacgccctaaagagtggtcaagtaacttgttaacatttggatgaccaaaagagtatgcttttcccgagggtgaaaacacgattatcgcaatttccgcgtcacataaggtgcaaagttcactgccttttttgaaaagaccagatcttctttttgaaaacgtaacttgaaggtttgattcgttggtcatttttaccaactctatttttctacgaccaagattctttctcgccattttcgagatgttttgaacagaaaaagaaaagcgagttgattatattagagataataggtatttgtatttatagactaaattttacaaaatatgttttgagcattgaaagaaaatatttttttctatagtgatttataagaaacaaaattatgaattaccactctaggagtatatattggtttacaaatttcgtcaataaaaggtatacaatattctattttatctccaacattatcattttttaaagtttacagcctgtcaattttttaaaatatgggaaggatatccacaattttcttaaaaaatattttccatgtgtttattttccactatttttctataatcaatatcctttttgatcttttatatttattttaagtgttcaaattttttatataaaattcatatagtgtatatatgaaatattatgtccaacttacttttgtttttatagagcaaattgacaaaataatatgattgaaagttgataaatgacatgattgaaattttatgtccgactttccaagattttatttaagtaaatagttgttttgatattttaattgatcgctgacttttcaaaaaaaaagttgtgataattaaattagatttaatatgtgatacacaatttgttatatcatctctgaatatagtatacttttacacaatttgttttgggccgtgattaatatagcccatgatcgttacctaatgggctatgtttctctgcctctaattgcttgttatacatgatgatgatatattgataatctataacctatatacctctcctgaaaaacgaatttttaaaaatgtatacacttctcatgtttcttgttatatctttttccttcttgttacaatttatcggtgggaatcaaatctgattgggttcctttttttggtcggtaatggtattcaatagtcaagtatgtaaaagattctagcatatagattacaagtcttaagcccaacaaggaaccaaactaaaactgattagggaaaactaagtaagattctataagctagagtttgtacaaaaacaaattctagcccaggtaatgaaatatccaaatgcaaaagacaacatttattagctcagaatctacttttaaaaaagcccaaataccacatatcataagcttgcacttccaaacgactctaaagtctaaagtctaaaccaaccatcgccgctgatcattgacttattggcatactacaaaatttacttgtttggagcaataatgggttttctcttttagccccacctaaaccctttttaggaggaaacctagattatacgtggccacactaaatattattctctcattaattgctctacttttaagagccaaccaaactttttgaagacacaaatattatgaaatagtaatacatttgacctccgaagtttcaacgaatgatctacacaatccatcgtgtcaaagatacaatttttttatccaccattaaaactgtaacaatacaacattactcataacattgactttcaggataatcaggctcttcatcaccttgacttgcagtttcagtctttttatctacttactgcatatatgatatgagaaatccgatttgtgtgttaatgtgacataaacaaaaaaaaatgttcttcctatatatataacaaatattttttatgaacaaaccaataataatgtgtatcagaagcaaacaaatgattttttggtgcactcatgttcccataacaaaagtgattagtttctcataaagtaaactcaataattattccatgagtatgtttatatccatataaaatttgcaattaaataatcaaacgtcaaggttcaattatagtcaaaacaagaacgaaaaacctaaccaatgtgtaatccacagattggttaattgcactgaaccgtaccttatcataccaccccaacggctatcgacatcgatttattaccaaaaaactcctcaaaactatataaaagactctactatcttccactttccataaaagggtaaaatagacatttcgggtaaccttctctcaccgtcaccacacatgcaattacactcagacaggaactcaaaaagacagctcattcaattacatcaacacagatcactccaaagcctttctctttaaattcgttatcgttttttttattttatcaatttaatctttttatttgttttgttcttcctcgattcaacactcgatgctgtgacaaagcccagattttggccggaaagttttgtgtgtttccggcgaagaatgcgaagaaaccggaagaatctgtaacggaatctaagctaaaagttaaagtacgatg

SEQ ID NO: 4871 - DNA, 3000 bp, Unknown
  misc_feature (1)..( 3000): cDNA_ID_1825928_gDNA_ID_1620738_Annot_ID_49508 3000 nt of promoter + ATG
taagtgacataaaatcaactaagtaaacctccgacacggatcttgagttgcggacatacacatgaattgcaaaatctttatttcagctaaacgttaattaaatattgatgtcagattaatcttatatatgaatgttactttatgattatattcgcctacctaattaagtaattagaaagtgaaatgacaagccccaatcttttcggtgttaacaaaaagaggatgaagaagaaaacattatagccggcctataaatatatatccaaagttagtccaatttctccgacaagatctaaaatcgaacggtgaggaatcctccaaggataaaagttcaacagctgataaattttctcttaaaccattgagaaaaagaacatctactaaagaatgtaatagctatgattaaaattaataatttccgtacggtcaatgacccgaatgagtaaaatgatgttgctttctgaatcattatttactaagatctaaatgtggtctgctttttacaattatacaaaactatatatatccataacttttttgcaaagaaccatatgtagttgacgaaaaaaaaaagtggtctaacatgatttgtagcaattgagctgagtccatatgatttaagcccatttaacggactgtgtggaattgatggcccagttattaaaccttttttgtttgtgtggaaaaagccaaaaaaaactgtcacacgtgcgaatctcacaggtgaggagggtattttatcctgtcggtttcttcttctttgacccctccgtaattacctcgtcttcaatcaaattataattttttgacctttttttaccttcgaaaatatctgaaaccctcaaaaacctaaacacaacaaacaaacaaacaaacaaaaaagttcctgttcgattcctcctctcattcattctctgcttgttcctcaaatccttcaattttctcatcaaatccagatttgcgaatttaggttttcttgaatctaatcgttctcgatgatttcgaaagatcaccttcatcatctggatcctctgggtacaaccaaatcgtaccacatgaatacctccaccgtatcgccgccgtctccggcatcatcaatttcgttgtcgcaatcggcgtggctggaggttcgtttgttctacgtccgtatcgctccttgcgtcgttgagaacgtccctgacttcctcaccctccgtcaccctcgtcgcgaaaccggtgcttctcttgaggttaacggcgttcgcgttccttcgtcgcagacggcgtcgcttaaactccgccgtgacagagtcgaccgggaatcgtcggaggtgacttacgtgagcactgagaccgttcgcgttaccggatgcgttgatttcgaggtttatgataacgaggatatggtcttgtgtgggaacctagatagaatcgaaggtgcttggaacaatggaactgtgagtgatcccaagactggatggggcatggattgttacattgctatgggaaacggacacgtgtcaggtccttctgcctctgtgtttttccagccaaagtttggagtctcgtctccgtccgtcgaggtttatatagctggttgttgtggtggtgtcccggtgatattgaccaagacgattcaggcgagtccgaggaggaaggtggctaggcacgtgacactcgacgctatccctgaggatgaggaagttggcaaagagcaagacattggtaccattggtgatgaattggcccgtcaaagcaaagtacaggtatgattctgatttcacaattctctgtttggtgattgtccaagcccttaagttacgattcttaataacttgggattgagatttgaaaaggttgcttctttcgtctagttttgtgagttatgaatgctgtagcagatatttagttattaagatcactcgcaagtttctggtgaatttagctcctgcttgaatgttttctttgactctacagctgaatttgaaaattgtagaattgttgactgatcagaaattgagatatggatataggtcaatagactctctttgcactttttttggtgctttatcttgtttgtcgtttcgtttatgcagatgatggaatcagaagttgatgaatacgatgactcagatatgaaaatggcacagagatattaccctgaaggaatgtacgttgatgaggatggtcagctctcatggttcaatgcaggagtcagagtcggagttgggataggccttgggatgtgtcttggtgtaggcattggagttggattactcatgcgttcgtatcaagcaacaactagtaaccttcgtaggaggtttctctgatcatcacctaccataaactaaaaacccacttagacatttcgagatctactaagaatgtcggtaacgtagtgggttataaaagagatagaattttggtagatagatgtatagagcttttggttttcacctgtttgtgtccttttgaatatatatatatattcggctctgttcatatactttagtagcacaaaagagagttcccatcttgctccagtcatgttcttttgttctttcttttctcaagtctgtctatgtcgttgctcttgtgtagaaagagatttcgtgttattgttgttgttgtcaaacgctggagtttgtctttcggtttctggtcaggaaataatgtggaatagggaatgtacatgtttcacctgtattcagtatctgtttgcaattagtaaattaaattattacaacaagccaagtggaagacggcgtcgtttatcataaatgtcaaaccgatgacgtcttatcgggggagcatgagcattggactaaaaaattattgtcaatttgtttaaattgtattttgggccctgaaaattattataaatgaaatttagccccttaattttgtaagagtttacaacattgaaccctaaatcattatgttcccaaaatcaaaatttcactcctcgagagtagcgagaagaaggaggagatgagcaagatccgttcgtctgcgacaatg

SEQ ID NO: 4872 - DNA, 3000 bp, Unknown
  misc_feature (1)..( 3000): cDNA_ID_3098557_gDNA_ID_1620738_Annot_ID_166312 3000 nt of promoter + ATG
gcttcaaagagaagaacactaaatggaagatactagaacagcccttaagggagcttctatgggtggttagagaaggagaggcttatgttagaatgtctttagagcctaaacttgggttttgggctaaggctattgtgttgcatagcaatagagattgcacagagcttcacatacataacttgctctcttgtctaccgatcatcgtcgaggctattgagacagcgagtgaggtttcagggtgggatgaagaagagatgagcaagaagaggttggtgcattctaacaagtatatgaagcaatggaatgactctcagatgtttacctggaagtttgggagagagtatttggtgaccgaggatttctgcaaccggttcgagagtgcttggacagaggaccgttggattctgatcaaggagcttcaggagaaaaagcagtccggttcgagcaaacatgaacggaagatggctgatttccttttgaagcatttgggagatggaaatgagagccccaagctatttccttcttctcttctggataacacaaaagattaccaagtgaaaaaaagattagggaatggaagtcagtacaaggagattacctggttaggcgagagctttgcgcttaggcatttctttggggatattgatgctttgcttcctcagattactccattgctatctctttcacacccaaacattgtatattacctctgcggattcacggatgaggagaagaaagagtgtttcttggtcatggaactgatgaggaaaacccttggaatgcacatcaaagaggtatgtggtcctaggaagaagaacactctctccctcccggtcgcggttgatctgatgcttcagatagctttgggtatggaatatcttcactcgaagagaatataccacggagagttgaatccatcaaacattcttgtcaaaccaagaagtaaccaatccggagatgggtatctgcttgggaagatttttgggttcgggttgaattctgtcaagggattctctagtaaaagtgcttctttgacgagtcagaatgagaattttccattcatatggtattctccagaagttctagaggagcaagaacagagtggaactgcaggaagccttaagtatagtgataaatctgacgtgtatagctttgggatggttagctttgagcttctgacaggtaaagtaccatttgaagatagccacctgcaaggagataagatgagtagaaacattagggccggggagagaccgctttttccatttaattcaccaaagttcataacaaacctgacaaaacgatgctggcatgctgatcccaatcagcgtccaactttctcatcgataagcagaattctccggtatatcaaacggtttctagctttgaacccggaatgttacagtagtagccaacaagacccgtccattgcgcctactgtggattactgcgagatcgagacaaagctattgcagaagctttcttgggaatctacagagctaaccaaagtttcacaggttccttttcaaatgtttgcatatagggttgtggaacgggcaaaaacgtgtgaaaaggataatctccgggaaccatcggaatcaggaagtgaatgggcttcgtgtagcgaggatgagggtggggcaggatcagatgagcagttgtcatatgccaaggaaagaagattgtcatgctcctcaaatgatgttggtatgagcaagaagcaggtttcaaatcttctgaaaagagcttctagcctgaaaccaattcaaaaaccaggtgagattatcatcagccaatatatatatatatatataggctccctaacaaatatgaacttggttacttgtactaatttttttgttttgtgtcactagcctttggattctgttcagggacaactccgagaggacgatcaaggcatccgccactaagcccttgtggtgggcaaagcatgagagcaaactctgagagtcagctgatattgataagcccaaggatacgacgatcaaactctggacatgcctctgactctgagctttcctagtctgcagggaaaaagaataggttcataatagcaagttcaaaatgctgtacaagtcaaaagacatactaactcgtatgtggtgacacacactccactacatatctatcgaaaacgataaaattcttctttattcaaagtttcctacagatactactaggctcgtatattgttcaggctagtgactgattgattcagtagctactagctacaatattatcttaaaggaaacaaatcatatgaggcaaaattatgtgcctagactgtagaggctcaacgctgaagtgaagtaaactaggcctgctccactatttctacaatctatcaaacaccatcaaattacactaatcaaattttgggcttcgaatgtggataaaaacatcaaaaataaggaaccttgactaatctgcctgaaaattaccttaacaaaaaaggggaacagcgattccgccggggactagagacatggcgtggttcggagctttggctctgtctctcgtcaatttcaatatctccgccaccgccgactccgtcacatccatcctccgacgcttttattatgtcattgattgtgatatgaccaaaaagtccccactctagttttagatgaatgaagctatgatttcttttttttttttggtgataagtacgttattatgattttaataccaacagatttgtcaaatataacattataagcaagtggagtaaacaaactaagcagctgatttgtacaaaaaatactttacagctataacatttgtcattgtcaccctaatataaaatacaattccaacaactaaaatacatctctaaactttttaaagatgatgatgatgaaaagaattcaagttatgagcacgtctgggaacatggcacaccatctattttgacaagataatattatacaatacatgtataaaatacgtacacattcatcgttataaactaaacccacc

SEQ ID NO: 4873 - DNA, 3000 bp, Unknown
  misc_feature (1)..( 3000): cDNA_ID_1840058_gDNA_ID_1620738_Annot_ID_166308 3000 nt of promoter + ATG
ttttttttttttgggggtatcgatattgatcttatgacaagtttttgtggtgtgtactaattaacgtatgagttatttgcttttatataggagttgaaacagaaaccttgaggagaccaaataaagttgatgtggggtccaaaataaaaggagttaggatttgatgaaacaagtgaaaagtaacaagcgaaccaaggaaaaaatctccatccaaaacaatatttcaaaacgtacttttgttacgattgaattaccatttgggaagggaatttctaattaaaaaaaaaaaaaaaaaattaagatggttgtgttttgctagcatcaatctcccttgtattaaacatatcgtatccgaatttggtagattaagatgaataaattggtcttactccaatagtttcgcattgatttccgtttcagtattaaaatccattgggatttattggtggaaacgggaaaatcatgtgtattttatttgaacccaaggctatttctaagcaacttcttatgaaaaatgttgaccttaaactacttagtcatgcaaaaaaaaaaagaaggttggggatgtggagaatattatttgattgaattcaaataaaaaggaagaaagttatgagataaaatgtatcagattattcaaaagaatagaccaatttgcaacattgtaatttggtttaataaaacatttggtatgttgtagtctgcacatgtataaacgtacgtcctccacataattccaaaatttgactggcgttaagaaatatctaatctagtcattgataaactactactgaatattcatttgagtgttgaggaatttgatttcaaaatttccgtcttacgaaaaataaattttttgtttgtataaccacaacaattgttagtagatcatatatgaattgtaatgaaaaattatattagtgactagtgagagttagttatttatatcttgatttttttttgtagttggtgggtttggactctttggtcaagtcaatcacatgctctacgtgattttacttgcagttcacgccggaaactctcacgcgtcgaccacgtgactagacctagttcataatttttatcgtctgaatgtcaaaaactcaaatcctcctttttataaccgttttctttgaaaacaaggtattttcttaatcttgtttcatgtcttaagactaaagatattaaaatctgattttggctctacttatactaatgtcgtattacaataactaaagtctcaaacaatattctttaagcacgcattgctggaaaaattaattacaggggggacataagatctcaataatatagactgaagatatcaacttttggctatttggagtcgttacatctacactttcaaacaaaaccaacgaacccattgttttttgggatcctacgaatcccttgtgtaaacaataattaaagacagtcctaaactaatattctcttatcaagtttggaaacattgtagctttgtgaatatattattttgtctaagaagaactttttgtttgtaaatagtttttttttttggatgtgtttctcatgaaatgcaggtaagaaacatctaatgaattagaaatagattatgaataaaagaaaataatttgtaaaagaaacaccgaacaaggagttcgtattcgtatactaattggcccgccaactaccaacaccgacatatgtgctttcggcagttttgatatcattccaaaatttcaattattatttatcaaatttattttcttggtaaaagtttaattaatttcaattatttgaatgtcttaattcactgattacaaattatatatgtaatatatacataacaatttcgttcgtggagtgttattatactccttaagcgaatctgtatattttaaataaaattttgatttatgcacacgtacatgttcaattgaaacgttttccctaactatagatgccaataaataataagttgatttttaaaatgtacaaaacaaaaggtaccgttttgtaaaattttgcaaccaaaaagtacaatcggccgttgaaaatcgtggaaccaaacactaattaaagagaagtgtgaatataatctagtgtttgcggatttatattataaaatttgtgtatcactaaaatgtcaaagcatgctttgactggtcaataagtcaaattaactaacaaaccatgcgaggcgtaggtttgacttcttaacataaatgctgactcagtttttccattccgcagctgtcgactaattggacacgcttcttccaatccctttccactaatcatccatcaacacgtgacatgcctacagtgcacgacttcacagtgatcatgtcaaagttttgtttttaagagaagaagattcacgacttcacagtgatcatagtccagttacaaatttgaatgggcttatggcctgtggcccatttaagtttgaccttaatatccatcagaaacccataccaatacgggtcataagtgcattgtccatatagtgtaccgcaatgcatgggagtactactacattccaccgacgtgcatatggggggacatggtcggtccattaatcccttgcgcatcttattccttacgcgaatacttttccctcttttagttttgtataatactttccatttttttggtattaaatttatcgtgtgactatctaaaaaggtatttaattatctagtttagctataactgcaaacaaaatatctattttcatgaatgatatatttttgaaataaaatattgttgtcatgtaacgaaaaaatcaaaaatcaagcagaagacacgtataacccacgctttcactctcactcgtggaaaaccctcacacgtacacaaaccattataaaatttaatccatttacatcgaccgacttcataagaacatcgtaatcccatccgtttatatatatattccaagttaaacttcatatcatacacacaaacctaaaacaccgaaacaaaaacaaagagatttaaacaagaagagttatt

SEQ ID NO: 4874 - DNA, 3000 bp, Unknown
  misc_feature (1)..( 3000): cDNA_ID_1825917_gDNA_ID_1620738_Annot_ID_166307 3000 nt of promoter + ATG
ggtgttttaggtttgtgtgtatgatatgaagtttaacttggaatatatatataaacggatgggattacgatgttcttatgaagtcggtcgatgtaaatggattaaattttataatggtttgtgtacgtgtgagggttttccacgagtgagagtgaaagcgtgggttatacgtgtcttctgcttgatttttgattttttcgttacatgacaacaatattttatttcaaaaatatatcattcatgaaaatagatattttgtttgcagttatagctaaactagataattaaatacctttttagatagtcacacgataaatttaataccaaaaaaatggaaagtattatacaaaactaaaagagggaaaagtattcgcgtaaggaataagatgcgcaagggattaatggaccgaccatgtccccccatatgcacgtcggtggaatgtagtagtactcccatgcattgcggtacactatatggacaatgcacttatgacccgtattggtatgggtttctgatggatattaaggtcaaacttaaatgggccacaggccataagcccattcaaatttgtaactggactatgatcactgtgaagtcgtgaatcttcttctcttaaaaacaaaactttgacatgatcactgtgaagtcgtgcactgtaggcatgtcacgtgttgatggatgattagtggaaagggattggaagaagcgtgtccaattagtcgacagctgcggaatggaaaaactgagtcagcatttatgttaagaagtcaaacctacgcctcgcatggtttgttagttaatttgacttattgaccagtcaaagcatgctttgacattttagtgatacacaaattttataatataaatccgcaaacactagattatattcacacttctctttaattagtgtttggttccacgattttcaacggccgattgtactttttggttgcaaaattttacaaaacggtaccttttgttttgtacattttaaaaatcaacttattatttattggcatctatagttagggaaaacgtttcaattgaacatgtacgtgtgcataaatcaaaattttatttaaaatatacagattcgcttaaggagtataataacactccacgaacgaaattgttatgtatatattacatatataatttgtaatcagtgaattaagacattcaaataattgaaattaattaaacttttaccaagaaaataaatttgataaataataattgaaattttggaatgatatcaaaactgccgaaagcacatatgtcggtgttggtagttggcgggccaattagtatacgaatacgaactccttgttcggtgtttcttttacaaattattttcttttattcataatctatttctaattcattagatgtttcttacctgcatttcatgagaaacacatccaaaaaaaaaaactatttacaaacaaaaagttcttcttagacaaaataatatattcacaaagctacaatgtttccaaacttgataagagaatattagtttaggactgtctttaattattgtttacacaagggattcgtaggatcccaaaaaacaatgggttcgttggttttgtttgaaagtgtagatgtaacgactccaaatagccaaaagttgatatcttcagtctatattattgagatcttatgtcccccctgtaattaatttttccagcaatgcgtgcttaaagaatattgtttgagactttagttattgtaatacgacattagtataagtagagccaaaatcagattttaatatctttagtcttaagacatgaaacaagattaagaaaataccttgttttcaaagaaaacggttataaaaaggaggatttgagtttttgacattcagacgataaaaattatgaactaggtctagtcacgtggtcgacgcgtgagagtttccggcgtgaactgcaagtaaaatcacgtagagcatgtgattgacttgaccaaagagtccaaacccaccaactacaaaaaaaaatcaagatataaataactaactctcactagtcactaatataatttttcattacaattcatatatgatctactaacaattgttgtggttatacaaacaaaaaatttatttttcgtaagacggaaattttgaaatcaaattcctcaacactcaaatgaatattcagtagtagtttatcaatgactagattagatatttcttaacgccagtcaaattttggaattatgtggaggacgtacgtttatacatgtgcagactacaacataccaaatgttttattaaaccaaattacaatgttgcaaattggtctattcttttgaataatctgatacattttatctcataactttcttcctttttatttgaattcaatcaaataatattctccacatccccaaccttctttttttttttgcatgactaagtagtttaaggtcaacatttttcataagaagttgcttagaaatagccttgggttcaaataaaatacacatgattttcccgtttccaccaataaatcccaatggattttaatactgaaacggaaatcaatgcgaaactattggagtaagaccaatttattcatcttaatctaccaaattcggatacgatatgtttaatacaagggagattgatgctagcaaaacacaaccatcttaattttttttttttttttttaattagaaattcccttcccaaatggtaattcaatcgtaacaaaagtacgttttgaaatattgttttggatggagattttttccttggttcgcttgttacttttcacttgtttcatcaaatcctaactccttttattttggaccccacatcaactttatttggtctcctcaaggtttctgtttcaactcctatataaaagcaaataactcatacgttaattagtacacaccacaaaaacttgtcataagatcaatatcgatacccccaaaaaaaaaaaaaaacagctacaaagaagtgagaattgacacagcaaatg

SEQ ID NO: 4875 - DNA, 3000 bp, Unknown; identical to SEQ ID NO: 4870
  misc_feature (1)..( 3000): cDNA_ID_1825936_gDNA_ID_1620738_Annot_ID_166299 3000 nt of promoter + ATG

SEQ ID NO: 4876 - DNA, 3000 bp, Unknown
  misc_feature (1)..( 3000): cDNA_ID_1825928_gDNA_ID_1620738_Annot_ID_49509 3000 nt of promoter + ATG
gatcaatatcatgctacgtggtgcaattaagtgacataaaatcaactaagtaaacctccgacacggatcttgagttgcggacatacacatgaattgcaaaatctttatttcagctaaacgttaattaaatattgatgtcagattaatcttatatatgaatgttactttatgattatattcgcctacctaattaagtaattagaaagtgaaatgacaagccccaatcttttcggtgttaacaaaaagaggatgaagaagaaaacattatagccggcctataaatatatatccaaagttagtccaatttctccgacaagatctaaaatcgaacggtgaggaatcctccaaggataaaagttcaacagctgataaattttctcttaaaccattgagaaaaagaacatctactaaagaatgtaatagctatgattaaaattaataatttccgtacggtcaatgacccgaatgagtaaaatgatgttgctttctgaatcattatttactaagatctaaatgtggtctgctttttacaattatacaaaactatatatatccataacttttttgcaaagaaccatatgtagttgacgaaaaaaaaaagtggtctaacatgatttgtagcaattgagctgagtccatatgatttaagcccatttaacggactgtgtggaattgatggcccagttattaaaccttttttgtttgtgtggaaaaagccaaaaaaaactgtcacacgtgcgaatctcacaggtgaggagggtattttatcctgtcggtttcttcttctttgacccctccgtaattacctcgtcttcaatcaaattataattttttgacctttttttaccttcgaaaatatctgaaaccctcaaaaacctaaacacaacaaacaaacaaacaaacaaaaaagttcctgttcgattcctcctctcattcattctctgcttgttcctcaaatccttcaattttctcatcaaatccagatttgcgaatttaggttttcttgaatctaatcgttctcgatgatttcgaaagatcaccttcatcatctggatcctctgggtacaaccaaatcgtaccacatgaatacctccaccgtatcgccgccgtctccggcatcatcaatttcgttgtcgcaatcggcgtggctggaggttcgtttgttctacgtccgtatcgctccttgcgtcgttgagaacgtccctgacttcctcaccctccgtcaccctcgtcgcgaaaccggtgcttctcttgaggttaacggcgttcgcgttccttcgtcgcagacggcgtcgcttaaactccgccgtgacagagtcgaccgggaatcgtcggaggtgacttacgtgagcactgagaccgttcgcgttaccggatgcgttgatttcgaggtttatgataacgaggatatggtcttgtgtgggaacctagatagaatcgaaggtgcttggaacaatggaactgtgagtgatcccaagactggatggggcatggattgttacattgctatgggaaacggacacgtgtcaggtccttctgcctctgtgtttttccagccaaagtttggagtctcgtctccgtccgtcgaggtttatatagctggttgttgtggtggtgtcccggtgatattgaccaagacgattcaggcgagtccgaggaggaaggtggctaggcacgtgacactcgacgctatccctgaggatgaggaagttggcaaagagcaagacattggtaccattggtgatgaattggcccgtcaaagcaaagtacaggtatgattctgatttcacaattctctgtttggtgattgtccaagcccttaagttacgattcttaataacttgggattgagatttgaaaaggttgcttctttcgtctagttttgtgagttatgaatgctgtagcagatatttagttattaagatcactcgcaagtttctggtgaatttagctcctgcttgaatgttttctttgactctacagctgaatttgaaaattgtagaattgttgactgatcagaaattgagatatggatataggtcaatagactctctttgcactttttttggtgctttatcttgtttgtcgtttcgtttatgcagatgatggaatcagaagttgatgaatacgatgactcagatatgaaaatggcacagagatattaccctgaaggaatgtacgttgatgaggatggtcagctctcatggttcaatgcaggagtcagagtcggagttgggataggccttgggatgtgtcttggtgtaggcattggagttggattactcatgcgttcgtatcaagcaacaactagtaaccttcgtaggaggtttctctgatcatcacctaccataaactaaaaacccacttagacatttcgagatctactaagaatgtcggtaacgtagtgggttataaaagagatagaattttggtagatagatgtatagagcttttggttttcacctgtttgtgtccttttgaatatatatatatattcggctctgttcatatactttagtagcacaaaagagagttcccatcttgctccagtcatgttcttttgttctttcttttctcaagtctgtctatgtcgttgctcttgtgtagaaagagatttcgtgttattgttgttgttgtcaaacgctggagtttgtctttcggtttctggtcaggaaataatgtggaatagggaatgtacatgtttcacctgtattcagtatctgtttgcaattagtaaattaaattattacaacaagccaagtggaagacggcgtcgtttatcataaatgtcaaaccgatgacgtcttatcgggggagcatgagcattggactaaaaaattattgtcaatttgtttaaattgtattttgggccctgaaaattattataaatgaaatttagccccttaattttgtaagagtttacaacattgaaccctaaatcattatgttcccaaaatcaaaatttcactcctcgagagtagcgagaagaaggaggagatg

SEQ ID NO: 4877 - DNA, 3000 bp, Unknown; identical to SEQ ID NO: 4874
  misc_feature (1)..( 3000): cDNA_ID_1825917_gDNA_ID_1620738_Annot_ID_49512 3000 nt of promoter + ATG

SEQ ID NO: 4878 - DNA, 3000 bp, Unknown; identical to SEQ ID NO: 4873
  misc_feature (1)..( 3000): cDNA_ID_1840058_gDNA_ID_1620738_Annot_ID_49513 3000 nt of promoter + ATG

SEQ ID NO: 4879 - DNA, 3000 bp, Unknown
  misc_feature (1)..( 3000): cDNA_ID_1826067_gDNA_ID_1620739_Annot_ID_49529 3000 nt of promoter + ATG
gctgctcgcgctaaagcaattgtagcagctacagtaggagaagaatgccgacggctttcgttgtttatccagtagttgaactttcggaatagaataggctcaatgactttgcctgctttcttgcttgccccgctctccttagaagcgttggttgaaccgctggactctatctccgttgattactattggatggagctatagaagctattttacctacgtgaacacttaagctagaaagaaagtagtatttctcattatatagaaaagccttgaaccgggtaacccgtcatgggaaacttggccgaagaacacctctcacagagtcatcggtatccctgataaaaagaatcaaacgtcgaatggtccgaatgaatgctacatcaggagccgagtttacttcactcccggtgacccgccgtcgtaatagcactgtgggcggaagttactatgtgatcacggcttccgacactgcattcatccagacaagcccttttagatagggcttttcgagtagagaaaggtggaaactcttttcatagagaaccccttctggaccaaagatgggcatcccaatcacttttgtcacaaccaactcttggcaaattgtgttcataatatattcaataatggtctcgagctcatctgtaaatcatggcatgggtagagaagaatggctagctatccttgagtgacacatcgcaatgattgtatcgaagacgggcggaggaaccccttactttactatattatatgtcaccatccaatcttggttatattatgtcaattctgcctcatcgtgaatgaaacgttttctttgagtcacccattctggacgacgagaggaatggtgaaatatactttttaatgggtaaaataaatctctgcttcgttgccaattaccgtcctgctaccaaccaaaaagccacttagactgatgtggaaaattgatccccgagtggctttttcctccggtcgagtcatctttcagttcaatacctggaactgagacggattcggatggagaaggattcaatagttcatcatgagctgtccgaaaccgtacttcttcccgcgaaaactcggaattagctttagctcgaaccttgatctgttgctcgaactctaatacaccgtagtagcaggcggcactcgagttctttgtgccaggtgtcagaaaaaaagtacgcaatttccaagcatcctagttcagcgtgaatcatctcttgtctcaatggaaggccaaggccttcaaaagcggattccgccggaagctaatccagtggcttgttgagtggaggaccgaacatgattatacccataaaggtccttcctacccctattccaaaaccccttcccctctgagggcacgggcacactttcaggaagtaatgtagtaaacagtcgaatttcaaatagaactatggtgaccttgcaaaaaagatcttttcttcgtttgagtgtacctttcctatgactattaatccttatgaaatccgtgaagttttgaccttgttttagaagctttctttggcgttgagtgaatattggtatcactacccttccttatcttcttcttttattcataggaatagaaagcacgattaagcggtttttcaatggcaagtgccggtcgtcgagtggctgaaccaacccctacggcggatccacacgtactgatgaatgccagccatcctttatcgagtagccttgactattcaagtacccttgctgatttgatagcctgaaaaagatcgaccacgatttttatttctgactgcctatgcctctaacgatgcttcgggcaaactgtaactaactaggtgccctactcctacccccccctgttctcaccttcatctctgctgcctccgctccagcttgctctattacctatgcaatcacagctcagtaatggactggtgaactaaaatggatagctgctgggagaattgcgactgatgaatcgcgatcagccgctgattcccctgccgttggattcgtgcctcaagactctgccactgggactcggtcggaagaatctactgcggccttctctacccacctttatctttatgaaattctaacctcaaccagccatgacaaggcttaatttattagaacccgttgttgtttagaaagatgtgttattcctgtgaaagtctcgtttttgactcagttttttttgagcattgtacacgggctttgctgcgacgaggatgccttttttaataaggccaacgtcaagacctgaaacagagccctaccacgttaagggagagcatcccaacttgcttgttgacacgtaaggtaaaataagaatctgaggtggcaggatttaccactataaccctatggtagtgatggttggtcccagtactccttcgagtgccttttgcgcttagcgtaggaaagaggagttgccttgccttaccacaccaaccaccttagcgctggaagttctagcaatgggcagctaggcaaaggataattagctatctaatgaatattcattagataatagattgtggatctgttcttagctcgtgcaatcaataaaaagcggtccttcgccttagtaagctagctttctaagcccggacgtggatcgatcgtgacgaaaaaatgggactaatcctctgtactgtagtaatagaagagtcagagtcccttctcgaccagacgaaggagataggaatggaattctgccttgaccctcctggaggcgcaaagttcataattcagtgtggtggggcctagtagtattataaggatgttggtttcgtatataagaagactgctgcttttaggagagtgatctgttcatctaactcaaaatattgtaagaagaagaagaatcttacgccccaaattcccatctcttttttcttggttggaccaaccggcaccagccatttccgtcttccttaattgggagagtcagaatcagtctctctttgtttggggggagcagaaaatgaaggaacctttgctttgaaaatg

SEQ ID NO: 4880 - DNA, 3000 bp, Unknown
  misc_feature (1)..( 3000): cDNA_ID_2123668_gDNA_ID_1620739_Annot_ID_166317 3000 nt of promoter + ATG
tcccctgcggagagccggatgaggggagaccttcacgtccggttcggagggcggggatatcccgaccctactatcattatgcctttgcaatgttacttggttcaactctatttgtgaccttttctcgtatgtgggactctctatcttcttgggtagataatcgatcgtctttcattttgatagtgagtagtttttatacaaagtcaagtcaagaataataatcgaactggaggagcttgccaggatggcttggtaagcaagcaaccaggcgcccattcccagttctttctcttctctctttttttagtttagtgacagctcatcaaaacaattgtccaagattgctagatcgaagacggacgcgcatagtttcaagttcaagagcgggttgtctcctctcgtttacactcgagttatttaaacctcttgctttgctcgagtcactccgtacctctcctttaagtcgagtccctaatggacctctcgttttactcgagttgcctttaagtctccttcttcaacatttctactacttccttgcctccccggatccatcattctcgagtaggaggaaaaataagtatacttttgatcgaaatggcagcttagaacacagagtcagcacaggacttttcttgctctccatcattcctctttagcttggactgacgcttctcgttgacgttcaatcttattctgaggttaagttgaggcagtgacaacatcaataatagaaggcgcataccttatccgatcgtagctcactttctttctagcagcttttttctcctctcctttcagtcgctcgttgagacctcatcaactagttaatgctcgtcgagacctttcttctttttgattctggaatgcttctttttcaggatagatagggccgacaagatcatcagggaagaagtcaaatcacatccgaattcaattgttcttttccaagaaccaaatgtgagaacctggaagcgtaaaccgggggagatgaagcggacaaatccaagcaaatcctcggattctattctatcgactgatctttccttctgatgtcgtctattctgtaggaatgagagctagatcttctatattcatcacttcctctctttccgagacagccaattatctatgagatgggatcatctgactattctcactttctcacttgggactgggaagtttcttcttgatcgaaatgggggctagcgtgaagcccaatagacagggatgagagggggacaggcattgataccattaatggaggactcacttccacgcaagaagatgacacactgtgactgctttgttatagacccgggaactgactggtaaggaagagtgagaactgatgggctcttctttctctgaaaaaaattaattttacgcttagaatgagacggatgacctttcatattatccgactttctttccgggttgacttcgtcctgctcgatccctctttttcataaccggcctatctatcgtcttggaatccaaatcgcttgaaagcataggagtggaagatctttccttcaagagttaatcccagtatcaaagattcattcaaactactatccagaggcgaagaagcaagaaaactccagcgctaactagctcatctttattctagttggagtgagacgatccttctttagggtcctgatcattccattggggagaaagcaggagtcatccatatatagtatagatgaatagtaccagtggcgtctaggatgaagacggggagtgaccgaattataagttgggcagcagtgttctcacttccgggaagacctacatctgggaggagagcggcagaaagaggcagcgcagcgcctctctacagtgcaggttctaagactaggcgaagatcggagactaaacacgaatcatcaattcctttgaccattcgttttgagcctccaattcttttcgaaatgctaacgaggttcaatgacgccgatgaagggaaccagcggtaaaggctctcaaaggcaggcgcgtagcataggcagactcataggataaggctgtgcgtgtgaatcccaactatttggctccttttaattcattctatttctagaaatggctactcgacctatttggaaagagctactctaaagcctattctattggtaacttttcagtcgaatttcagtttcagagatcacgccaagaccgtaggaataaaaaaaaccacttttcattcaggagcgggaaaggaaagatgaattaagcggtcatcgagatctttacagaaaatataagcattaaaaaaaaattaaaaagcagtgatacaggaagctgtttccagtagaactattgaccgaagagcctgactaccagagctagtaagctagcggaagagctcagctcctactataagctgatgaagagctactatcaccaagagagggcgaagaaactcattaattcattgatgagggctccccattctctttctaaatctgcagtccaatccttcctaatttcgaaactcatccttaagttaccaggggcaaggtggacatgaatcaagagaataagctctttaatcagaatacatagttgaatttagtaagaaaagaaatgatggttgacttcacctccggtgaccggcttcgcgggatcgccttacgtataaggacctgatccactctaggcgaagcaggtctacggtgtccacgattgtatccgactattgattgagtgaggccaacttcccgctattgagtgaggccaacttcccgattgatagaataatacggtatgtataaaaaaaaagatagcaagatagatagcccgacccacatcagcccctctgacgtcgaatgatctacttgcttgtacttctctttgtcgagattcagttggtcttcagtctaccactccgtgggtataagatcgcaaagaatgcattccaagtgagatgtccaagatcaaaggaacgagggtaagaatcgacgaggaatcaataagatataagataagtgaatg

SEQ ID NO: 4881 - DNA, 3000 bp, Unknown; identical to SEQ ID NO: 4879
  misc_feature (1)..( 3000): cDNA_ID_1826067_gDNA_ID_1620739_Annot_ID_166328 3000 nt of promoter + ATG

SEQ ID NO: 4882 - DNA, 3000 bp, Unknown
  misc_feature (1)..( 3000): cDNA_ID_3074477_gDNA_ID_1620739_Annot_ID_166339 3000 nt of promoter + ATG
ttaccagctcggaatcaacccgctaacggaatcctctggctgggttacctaacctccacttactcctaccctaagacaccaaaagattcaccagggtttatttcaactagggctctttacacgtcagtttggtttgagcctacagctgtctcaacttaatgaactggaccttatctatacgcaattcatgccctatcatgatgagtcaacaatcccaatcccaagccaagctttctcaccctatttagatttaagtgcaccgcctgctttctttcatgttggaatttctcctgctgtaatatatagagtagttccccttattctagttgtcttctttctattccttccggagaagaagggtaaaagctagaaaggtaagcattgtcgtgtcgacgcacgcgaaaaaggtacaagtccacttcgatagccaagcaatgagggagtctgaagagacttccagttcgctggacttagttttagatactccaagcctcgttatcttaattctcttctgtaacagtaacggatttcgatattgaatgtactggtcggttgggaccctataagaagacaagccaagcgcttagcttagttcgcggccctttacaagagtgaataccgaaacagacaattccagatgccactaaacaagtaaaggacaacagacagtattcgtggatcgggaagacctactctcattcaaggaagcggaccggttgacgactgcaggctagggtcccgttgaatttgacctggtaaatcccgccacagaggtcgttttctaccgggaaggcatagagtcgcattttagtctgagtctgagcaaacaaacactcacttaatcgaaagctaaataattaactttggaatggtaacgaagatcgaagatcgaaatccttccttccatcgtctgatctcctcctgagacttctgagcctcctaggatacttcgtaagccgcagccacaggattaatatgtggaaatggcaagtacacactgtgcaccacgatctttacgttgcggatgacgtccggcaccttaatcctcacatagttaatcctcatcggcgccgaggtcaaacctccaccggcaccagaggttgtgataagcagcggttggcctcgttccaatgtcggcggagcagtccccaccgaatgatcatttatttgactttgactcttcaaatcccattttttattttttctattgtttgtttgttctttatgcggggacaggattcgaacctgtaatcttcaggtcatgagcctgatgagttgaccaattcctctaccccgcttcttctcttctacaagtaggcttctttcttctagagacaaacgaccgattgaactacaatcacaggagacaaattattcttcttgtcaaccttcttctcttacgatatttcaaaagaaagaagtagagtcgttggaccaacaaccgccaggataaaagtcttctttagtcatcaggaagctgatttgaatgaaaagtaaacatagaattaggtctcacctgcgctagggactttcattgaatcaatctcggtatgtcaatcggaagctcaagaagagatagtatcttcctttcagtagcctctggtcttgcagttgggtttccccgcccaaagccttctaatgattccgttaaggcaaatatcccataataagatatacgaataagacggatcagaccgaactgtcaatgcattcattccatctccaccggaatcacccctatgcatagctccttccctcttctatgaagttgaagtgaagcaagcgagcctctcgattgagggagaccgatctgagtcagtttatccagtattttaggaaatgttcgggatagattcacgttttcccggtcttttttatataaattagcgcttttgtggtacgggtggagggctatgagctcgttcactcaatcccgtggaaacaactcccttagccttagttggaagctaaaccaaagtgaagcttgtaggctcgtagagaaagctattttgcaggtatacccatagatccatgttcctgaacagtctcggagaaggccaccagcacccgacttaccagaatgtcccgttgcagcaccatgcaagaaaaggttcctcttggaagcaccatccgtattgaattttaaccagccaatggaaggaaattcccaaaactcaagaacctgagcttataagaccaaaacaacttggacctgccgaatagactagaagacgatatcatagttctgaatggcgcgcactacctgatgatagggagtgctctgtcgcggttccattcgtttcgatttcatttcaatatagggcaagtcctttttccgacagaaggagtggtcgttttgggtgacagaataagattccccggatctccctcaatctcaaatcgacgacgagagattctaccacgctcacttttacgtagcttcacttcttcttgatcctgctccattggagttggttcattcagtgtgtcgctcccacttgccccaggaggctgagtaccttcgttcctcttcctcaactggttgattaggtgctccaagatctggatcttctatttcataaaactggaagtcttgactcgcccttctcggtggtcgttagcagctgctatttgaaatccattcccgctgctgtcgtcaacggtagaactcttcgggcatccgtccgttcttgcttctggagttcaggagtggattcgattcgatccgatgagagagatcagtaggggtcatccccgagtggacgagcataaagagatcccccggatgacaggcctggggcgaaaactcttcaaaagttctggcgctttcaaccctcgaacgaaaatttgattgatgaaatagtggatttcgcctttttttgggggctatttcgtgcctctcaattctgaaacaacaaagcaggggaagttgttggaaacaaagttaaagaagagacttttaggaacaacagcaccaaagataccttcggggtagacatg

SEQ ID NO: 4883 - DNA, 3000 bp, Unknown
  misc_feature (1)..( 3000): cDNA_ID_3074439_gDNA_ID_1620739_Annot_ID_166383 3000 nt of promoter + ATG
ccattacagttgagtgtttaacacgtaaatattcgaattgagccattccagctaacaatccagggaagaaaccagttgagtgtttaacacgtagaaattcctattagtcaagaaaggcatagagtgtccattccacatagagtatccagttcagatatctccaaatactcagaaggaaagaaagacatagagtatccaatcttgagttccctctattatgcggatattatcgaatcggccaatcatgcatttccaactctcgcgtgtgtgtgcccacggggtacctttatatcttatatgcgtgtgccgaggaaggcaggggaagctctctttattcctatgcgtgctttacttacttgacccatcccttactccctctcttgtactattgtattgccctgtgttggctagcttacccgtgttccataccttcctagcaataacaggaccattcaaacaaataagacattcactctagactcgtacgctcatgacttgactcctaggacctgtttgattcaagctctagctctcgttaccttctcttccttggctcttatcttactggaaagtaagtctatttctctttcccagaactacttcactctctgaaaatcagaataagaaagaccggcacgactgaactcagtcagtgtactttcctatttgagtttcagtttaggaagagagttccgtgacttccgagcttaaggagagctaccaaaggtaggaattgctttcatcaaattgacatagatatgagtagaactgagcttattcaataccttattttttttgcctatgataaatgcatagatcgctttttttcactggaagagttcaaaaatagcacgtccattcgatccttgtttttaagcgaagggcgagaggtgaacataagggaacgtccacccaccggacacctcaatcacaagaagcatcataacgaacgacataatgggcacctccacaagccggttatcgaaagtccgtggaaactggtcaataaaccattcttttttagccttgtcggataagtcggcttctctctggtcgactagtatacagaacagatgttgttctcgactccgtgcctctccagcttctccgagctatctatctaaaattaatttactttacttacgaagccagtctcctctataagactttcattcccaagacctccaatccgaatccataaataccttttagtcagtatatctttggaagaatctacattggaaggcctgtgtgaaggaggaaaatcaaattaacataccactggaatacccctatcgtagatcagaattggtaaaggtcccggcactcaaaaccgtccatactagggctagctcgacttagatcgactccacagaataagactaccattcggcatcccaccacctcatatccttattaacataagcaaattatgccgtctgcaggtcctcttcacgcgaaagcaacgcaacctcctcgcaaacaaaggagacgctcatttccaactactctcaccctgtcgaggcccgagtaagggttttggtggggaaggaattaagccatagagtcttgttattcccgcctgttgcccgcacctcattcattaaaatgtcataagttaaaggtgttattaacataaagttgtttgatttgccagccttggcctagagcaatggagaggactgttcgtatagtagttgggacaaccggctcataaatatgccattaaacgctaagaaaaaaagccttctcgtaaaagtccctcagtggattaatttttgtgatctttccgatgaaacccggatttctgttcggaaagaaagactaagtcaaggcagacaacgaggcgaagatagcagacttgcctctttccttttgcttgtgttgtgccagttgaagggcttgctactccaattcaagtaagattagataaatagattccactgagtctgatttccctcccgaggtacgtaaattgttaggcttgcagaccttctgctcgagctcgccgtaggaaactagctggcttagtaatacctattcccatcgaacaaacagggataggagttataccgcagctgcaaagcaacaggagccgctcactcagactaatggcctcggctatgccttaaccatcccattagtcttccttccccttcttccgcttctcaaggaggggactttctctcccaggtagaagtaagcgaactacaccttccctctgccttagccctgcctccgggatcactcaagaagtaagctgtgattaaccagctcacttctatagggggtgaactacgccttacacaaacgaaccctttgataacgaaacaagctaatacaaaaaagtttcagaaaacaacagaagatgttccggatgatagatgcggattaggttagtggttagcttacgagtagtacgggcacaggccaaccggtgaaaccaggggaataaggaaagaacacagttcaataacagcatattcccagtgaagtaagaaagtatttgaaacaaaactcagggaagtagcatttcgagtacaaagtttgactaatttgctcagttggactgaaagggtaccgtaaggaagaatgaaagctaaacaacttttagttcccaaagaagaaagagttaaatctcgttccaaaagaagagacagacaaaccaggcttatcgattgcttatccaaatacgtatataagaagattcatctcattccagactctactttccgattgatagaataatacgtatataatcagaaggctgctttgtggagtgatctttctctctaactatcactaaacgaaacaaagtggaatgaaataagagaaagagattcagttgagaacaaagtggttcagctcagttggttagagcaaaggactgtaaacccttgcagtggttcgaatccacaaccacttctattgtaagcattcctcggaagagctcgccgtaaattatttattcaaaaatactctcaaataatatcaaaaatg

SEQ ID NO: 4884 - DNA, 3000 bp, Unknown
  misc_feature (1)..( 3000): cDNA_ID_3074443_gDNA_ID_1620739_Annot_ID_166373 3000 nt of promoter + ATG
agcaccggctccacgaagtctgaatcgaatctttctgttggctttcccaaattcattcgtaaatcaaaatcaaagggctagaagcgagcgcttctagctgcttcgcctgcttcttcttattatggcggccatgttggcgtggcgaaaatgaacgaaaagcgagatgaacgtgctattttcaaatcggattgatagattgatctgttctgatagatctaaagagtagaaatagatagagaatagagagggaatcaataataaggtctttgagcctatttctatctattgatgagacaactatctattcttgatccatcagaaagaaattatttatccatcagaaagaaatcgatatgtatctgatggagtcttctacatcgtacgtagagcgcccaagcgctttttgggccagctcagttctcttatccatcggtccaatgcactgggctcatctcatggagggaaaagccaaaatgtagttgtcttgttgttgttcgccgcctcgacgcattcccttctctccccggcatcgtcccacacagaaagaaagagcgcggagccccggcccgagccgtaggtccgctaacgtaaagcgaggagttgagcctgaactggcgaaccgaagtcactttcggaaccatacttcctacagctgctaacatgtgcccagtcctgcggaaaggcgcaaacgaacgtgagctgctataccggaatcccccgctggccatcggggaccgagtggtaaggccatgatctgcaggggaacggatcactcattcttccattggggacaggtgcacgaacgacaactccaaacgtcacacatccgccgcctacttaccgtttaggtggcaccagcgagatccagctaaggaaaaagagtgtcgcggctgctccactccgccgcggtctcatgaacttcacttcgttgccttcccgcgcgcaaagcgaatgggcgctgtgctgtgggtcagtttcggggcggggggcgcagagataccagaataaatgattcatttgtttggatcgacgagctttttcagccccaaaactcagaatcaatggaatgtctgtccataaacatctattctatctgtatatataggggatctctctatacatatcaaagtcttttatggcattgatatgatcgcctagctgtagccgcatatcacagctgcactcaatatgcggatttctgttggatcagatcttttctttcgctttgacggaagctttttgacctagcgaaaagcactttcgcgcaagcaaagtagaagctttgccagaagcaagacgaggaagtggagctgtcgtataagcggtagcttcccccgaccgactaaaatacaagagtcgcggcctactttgattgcgaaggggtttggcaacaagcaaacggctttctatcatagttgcaagggttcaaaaccttagttcgctgcttttcccagtaccagagaagggcttatactgctcgcctttgtttggtttgatatattcattcagtcaaaatacaaactacaacaaagtggaagtggaagggccgctatagaagctagaacttgctttataagtcggcctaaccaaagcgtcacgacaacaaaaaattatccttatgaatggaatcttaagtagggggggctttgaccgcccgcctaccaatcaaagaggcagagagtaaacgtaagctcacccgtaagctcgaagagagcttcccttcattcgcttcgcgggagccgcacaagcacatagctggaagtcagagggcccatactacctgcctaaccctttgttccgagggaccgtagatcggaaagcaccccatttatccaaaagagaagggaaggggcctatgtatttgcatgacccctgcggatttgaccctatcccggagccaatcccctattggtcctgccaccacgccgcagaacgagagctcgtgtggaaccttttctttctggcgtaacagccggtggaacgtaacaaaagattacggtcgcctaacattaacataagggcggggggtacggtaaactcggccaaaatatgacacccgaagggcccgaacgcacaatcctatcccatccgagtccgagtttaccccttgcacttcggacagccgaccgtagcatcataaggaggaccccctttcgaggtaaaaaaaaaaaaaggtacggtacatataggaggttggactttctcaacgtggtgtatagcacgaaaaacttttcgatacaagaaagggccgttctcacatgaaagaagagaagaaatcctttcttctcttctttctctttctcgagaaggaaagaaagaggatggggggagggggggaatggggccggtgcccttcttttacggccgtcactcttatttgtcagccgtgaggaactaccggctcggtctcggtgggaaaggaaaggcttgggcctacctatcccgataagacctcataaaggaacggcgggagtgataggttccatattgccgagctgaagggcaagacttttgtacgtgatcgtagtatgtgacgtcgtctcgtccacgctgcattgaagagtacctacgcactaagttccggttcactgataaggaagatagagttgggcgggggtctacgatgtgatactcaagtatatgacccggggagatacatgctaactatgggtaggaagcaggaacccttatgtaaataatttcgggggggggttacagatctcttatactaccctcgatcgacagagcggaacgaccagaaaaataagtgatgttagaaagccgtatgataggtggtaactatcttgtacggttcggggggtaatcggcgtactccgggagaaatctttcgctctatcgaacatacagggaattggaggtagcattctaccgatgttaagtcatggactggttccttcagccctttttctatgtgttggtgttttatatgaccgacataagactcgacttgttagatattacggaggtttagtgagcacc

SEQ ID NO: 4885 - DNA, 3000 bp, Unknown
  misc_feature (1)..( 3000): cDNA_ID_1825990_gDNA_ID_1620739_Annot_ID_49553 3000 nt of promoter + ATG
aagagagccagaagctgggtccgcccgccggagcttctttcaatttccggggggcttagcttgaaccactcccaagtgccaagaaccggcgaatgaaggctccgtggcggcatcggagctgccaataagctaatccgttcccagtgagctattacgcgctctttcaagggtggctgcttctaggcaaacctccttggctgtctctgcacccctacctcctttataactgagcggccatttgggggccttagctggtgatccgggctgtttccctctcctagagaaagaagttctctagtcactaaagtgcgtttcactctcgttcctctcgtttcactcgggttgctaaagcacctctcctctgccaagctctctgtcttggttaatggttatccaaaaggatatttctcatgttaggcggtgtgagacagggggataaaggatcccccgttgttattttgtattgcggaagatgtcttatcacggggtcttaccgggcttaatcacctgggcattctttcttcaattaccgagacctgtacatacaaagatctaggcagctcatcttcttctaacgaagtcagatctttttccataccataacatatatagaatcgattttcttttctgatcgctagcctgccgggccgcccccgcgatcaaactatcaatctcataagagaagaaatctctatgccccctttttcttggttttctcccatgcttttgttggtcaacaaccaaccacaactttctatagttcttcactactcctagagacttgacggagtgaagctgtctggagggaatcattttgttgaaatcaattaatctaatcatgcctcaactggataaattcacttatttttcacaattcttctggttatgccttttcttctttactttctatattttcatatgcaatgatggagatggagtacttgggatcagcagaattctaaaactacggaaccaactgctttcacaccgggggaagaccatccggagcaaggaccccaacagtttggaagatctcttgagaaagggttttagcactggtgtatcctatatgtacgctagtttattcgaagtatcccaatggtgtaaggccgtcgacttattgggaaaaaggaggaaaatcactttgatctcttgtttcggagaaataagtggctcacgaggaatggaaagaaacatattatataatatatcgaagtcctctccttcaaatactggaaggtggatcacttgtaggaattgtaggaatgacataatgctaatccatgttgtacatggccaaggaagcataaaatgattctttcattctatagatacctctggtaggtaaagcactcgactgtgctttattgaaagttcccatcgcgggggcgaggatacttgccttcgcggttcgactttcttttcaggcttgactcattcgctagcttctcctcccctttagagctctttatgatgcccactgagtaagattcggggacttccggcgcagaagctcattctgaaccgcgggaaccttcgtctcaatcttcataatcaatttatgccatcttaaaaaaattggaatcttgttaggtacccgtacgacagctctaataatgagctaacgtactcatctttagagtggtttgtgcgcaggctcgagaagttgctgcccgcttcagaagaccttagggtgccttcgattcctggacgactttgttcgtcgtgtacaggggacgggaagagatggctgttcgctgtagcaaaattcaacgaaccgacgggcgtcccggacatagccttcaacccgcaaaggttagctttgttgctggacaaccactagggtactattcttcctggcccctcttcgccctatcacatcacatggtggtgtggtatgcggcagaacatgtctatccttcctccttcttctttcagtcgaaacttcctcctagtgaggtgttcgcctatccaggtatggaagtattcaatgaatacactctgtaccatgcatgggtggatgaagctttatctggagtatcaaagatggaattgtatgctaaggcttagtgccagtatagagcttgaagtctttatggatgtgccgatctttatccgtacatattaccgacctgcgaacatggatgattcgttcaggtacgggataatatttaggatgtacgatttggctgtccagttacagtggggcaatgtcatgaaattgctactagtaactaagactcaagtggagaaaaaaaaagcactcaatttgaatgtaagtaaaacacgggatggaagaggaggcctgaaccaacagggatgaaacagtatagattcccctgggcgaagcaagtcaccgattagtaacctaagaaagagttgtcaacgggcgagtgtcctgctataaggtaaactcctactatttcagcttcttttcccgtggtcgaaagctaaatatctcaagatgatattttccaaactctcgacaagcagcaaatagaaaattaaaagaagattttgaaggatctgatttcatctaaggagtggcggttaacagaaggccatttcaacttatgctctaaaaagatagaaagcattgttgataaagccctctctttatataaagagggctttgcgccttcggataaaggaagattccgatattcgcataggtattgaagcggggatatgaacagctagcttcccctcaaatgggagccgtttaagtaatcttaaaagagtcctcgactgtattggaaaaacaaaaagttcaatatggcgggagatccataattttattgagagctttcaatcaaattagattgtaaagtagtagtcctgtgtaaaaaaaaaagctggtggggcggggtccaagcaagcgtaataaggggagggggactaggggtggaagggtcgtcgaaggagatgcatttctggtacaagtggtattggacaagatctcagggaatcatctctttcagatttctgcctttctttccc

SEQ ID NO: 4886 - DNA, 3000 bp, Unknown
  misc_feature (1)..( 3000): cDNA_ID_1825968_gDNA_ID_1620739_Annot_ID_49560 3000 nt of promoter + ATG
gtgatcttgctgtagggtcagagctgcaccgaagaacagttattatcgactcgatggctctgatccgcgtgaatcagacggtgagttactggttcttgaatgggaatcccgagcaccaaagagcagagtgatcctctgctcgagataggaccgggtaaagggaaaaagacagaaaagaccatagaatagcaataggaatcgctgctatccgacaactttctccgtggagcccgcagctaaaggttaacaaaagattgtagaacccatggacttactatctaaacgatacgagacgggtcagtcaagggccaccagaggcacaaagctggcgaatatccgtgagagcggaagatataaaaggtataggtaagtaagctcttttaagatcaagggcaataagacgtcgaaggaagaatccgcaatgctttgacattccttttcaaatgagttgtgcccagcccagttagtccactactacagatagtaactagcacagaaaaacaagatggaatcaaatacggtgttaattaatttactgaagtgaagcaaggaacgtagtaactcgactggttggagagaaactttgttattagggttgaatttccagtcttcgggcctcaacaccggagcttatcctgaggcctaggtaggtaggtagtgacgtctcttgctgggtctttcataaggaatggtcctgttagtcttaatccagcgactggccttgctccgagccgatatccgaagtatggttcgctcgctagttatatgcttaacacatgcatctgaggtcagaggtgccgctaaggtgaacgctcagcttcaactctgactatatattatatataagtgcactgaaggttaactatgtcaatctacaactcaatgtgattggcttcgcccgggctcagtctctttcggccggtatgtagaatcgtcggagcgagcaaagcagcggagcgaagtgggctgtgtaatcattttattttttgacttttttttaatatataagggtaagtaaggagctgaaaacgagtccttcggagggcgaagaaactcattaattcattttgatgagggcccctcattcaaatgttatgcttagtgcttccctcacattttgagttgattatttccaatttcgagagtgagattgatccgaccaagtagtagtgcggaagccagtacatacatggctagtttccaggcaagccatccatattggcataaccttcttctatgccatctagcttcatagccgatagtttccgttgatcattatcttcatccatcggatcagctccttcttttctgatttttttcaatgactgcttcttatgcttgccctcgttcttctctcttctcctagacccaccccccttactgtctgtttaggccccctgccaggtactccagtctcattgcgtaccgtcgtctgcatcttcttgccctgttttcatagttgtttgcttttcttatatggattaggcttggttaaaagcgtaccgtcaagcaagaaaaggaaccgtaaactagctttaccgagttggcttcttcgtatgagccctagcagcatctattccttactctgttttctgctttcaagcccctaagtaggatcgtctaacgaagtcaggtacgagggaatatgttaatgcaaaagaggcgaggaggctggtgaccagagaaggtctgtgatggaagcaattcctggctttctggtctgtgataaaagcaatctctctccggtcggttcgactgttaatggaaaaatgaatagatccttaggaagaaaaaggctcttttgctcttgtgtagaatcagttgttacagagaaggagcggttttcgtttcgcaatggaatcagaattagctacgatcaattaaaatatcgtagtatagtaagagccaacgaagtagctgtaacgtgaacagctaaagctccttaccttatatgggctgcaccgcgctgaatgatcaaatcccatttattcttatttttttacattacaactcccatgcctttccgttggtcaacaaccaaccgtcgatttaccttttccttcattttgagaacaagtctctcttggggggagcagagcatgcaaaatcgagcaatagatggatcttagaagaattccactttgaacggcacgactctttcgatttttgcgctggcatttgagttgtctcccctcctctttcaatcgacacactcgacgcagatagctccggtggccccggcttctgcctctatcaggcttaggctgcccccacccccacagagccacagcatggagtagctgctcccgcgctacaaccaatcaaaattttatacggatcgatatatgatgatgctaaaccgagatagagaaagagggcgaagaaactcattaattcatcgatgagggttgccgcgcctccctttgttggctcttcgagacaaaaacactcataggaatggtgctaattcccatgttccttctagtctcgtttggtttcgaaagcctccccctccctgtctcttactctttgaaagctgtcatcctggatttatttttgaatggtttctttgttctcttatttggattgaaagaaagacaaaacttcattttcttcgacgaatttcggctatgaccaatgcaccaatagctgaataggcgtaacaaagctacctgaaaaggcaaggtgcaccttgggattgaaatcgacgaattgcgttttgcccgagagatttatttagaaagattatccatcggataaagaatgcaaaaatagaaagaatataaataaaggcgtatacacgggaagggggcaccactacttccagggggagactagcctcattacttcttagtgggcgagaggtgcgcctaacccacctacccactcataaatcacggtgttcagctgacttgaactgatagacccttattgtattggaatttagcgcccatcttttgactgttgtcaacaaatctcttcaatgttcgattctactct

SEQ ID NO: 4887 - DNA, 1694 bp, Unknown
  misc_feature (1)..( 1694): cDNA_ID_1826452_gDNA_ID_1620744_Annot_ID_49667 3000 nt of promoter + ATG
gaattcaaatataaagtgaagtccaatcaaagggatatgattttgctacaaaaggatagaaaagctttatgagtttgagacttgtcgtttccgcatagatttgcactaatgaacttattgtggctggcagccaaacacatctgtgtgactttcgatattagtaataaagagtttaaatagttacgttggtttaagaaaagtttacaaatttgatttcatctttgggcagatagccatcaattattttattaatctacatttaaagattgttttaagagaaaccaaagttgaataatctcatcaaagaacggtaggtaaaccctaccaaatttaacaacccttaaaaccattttctgtattcacattcattttttgttatactcatcatggactttttttttttgttttggtaaaaaacatgtacatatttagatgctatcaacaacatgaatgacttacaagttaagaaacaaatctctttttttttttgggataaaaagaaacataaatcttaccaagagataatctctacaaaattgttttttcaggatatttccaagaaatgagaggaggtcaacgactaaaaacaacttgctgaatatttaaaaatctttttctgcttagtggaggcatttattttacattaatttttatgttttaaaaacataatgttattatataattaaatttcttgcacaaacagagaatattattaatatatactgtgaagagtaataaaacagtttcgtttcattaaatatttgattgaattataaaaatagtgaaaaaatagaagatgtgttcgtgttcgtggagcggaggacaacgtagttggtttccgcgtgctgtacgagacagataacttctacagagagaaacaaagatcgagacaaaaagaaacccttaaaggatttgaacggagaagacgaggaaaaacaaagacacaactctgtaagttctgacccaattttttttatgttttgtctggaaagtttcaagatttgatttttgtggttctctttacattttctgggttttgtgtaagcatttgatgtgtggagtgtctctctttttgttattcgaattcattatcaatcttttgtgtgtgtttcatgtagatttgctcaatttttaatctagatctaaccaaattaattaactaaagatttagataagaaaagccctaatttgtgatctactatatgatccagaatctggagtctttgtttctacttgatatatgtaaatcttgaaagtttccttttttttttcttctcttcttgaagtagtaaagactttatcttttctcaattgaatccaagaatgattagagggtttatttattttgggaccaataaacagactttgttcttgggggcagagactgtttctttcccttttcttttttttcacttctttagaagattcttcatttgaattctgtccttcaattttgaagttgtcttgttctcttttttactaaatgtgaatcaaaagaatgttttcttaagttttaaaaaagcctgtggtggttactgcttttggtccattgataagaagaatcttcttttcttctcttctcttctcttctcttctcttccgtgtcattgctttgttattaagtatcattcagaatttgaatcaaaactctacttttgtgtcttgcagaacctttagagagagaaaaacaaatg

SEQ ID NO: 4888 - DNA, 3000 bp, Unknown
  misc_feature (1)..( 3000): cDNA_ID_1826446_gDNA_ID_1620744_Annot_ID_49670 3000 nt of promoter + ATG
tgagctttctactgcttagaacaaataaactctttcccaaactgagcaaaatcgaaatgatgaaaggtagtgagcagaagaacctgttcaaggttgtggtcggcattactataggtcacaagatctgccattccatgtgaaaaacagagcagaagagaaccaccctcttcgatccttacacgaaggaccgttcatcatctacaaacaagagcccacgaggttctagccgcctcggaaaccatcaatttaacccgtaaccaaaccccagttggtgaagagagatagagaaggagaaaaaaggtaaaaaatttgaagatggcagtgcttgcccagatctaaagacgcttctccgagatggaaaaggactagaacccgatcttcaggaacttaattttgagctcggaaacaatttccagcgagacaaaggaggaggtaggtagtggtggtggagagagaaaaatccggcggagaaaaacgacggaaaagcaaaaaggaagaaggaggaagacaatgaagtcagagacagcgatgacagagagaagaatagccaaaaagaaagtgacgacgatgtgagagggagaagaagaagaagaagacggagtcacagacactcgacggtaaaattgttttaccacaaattaattacatctatataaatataaaggaaacactttaatttcttggagttattaataaatatatactttatactttattctatttccttgtttttaacaacaatttatactttaaaataaaaaaattgaggcatccctataactctattgatgcttaggaaaaaagaaaaataaaaaaaaaaagtgaagaggcgttccccatgcagttgtttgtacattcgaacttaaattgtttttgttgtattctttttaaaaaactactatatggtatgggagtggattacatcatattctatgttttagaactaattttagttcgtcgtacgtactttcattgtgatcaatattgcatagttagatttccaattctctattgtgaagaagttgtttgtttggttaatttatactttatataaaagtaagcttattggctaatcaacatacaaatctttacgtgcgtatatcagtatatggtttgaaccactttatctaaaaacttatgattaaacacaaataaaaaaattagataactaagtgcatcatttgtttgttgaccaaattggtaattgtttaattatgatcaatattgatttcttattcaattagctatgtgcagcatttgttttttgatattaggtatttgtttagatatgaataatattgactttataactttcttggtttgattacttttaatatcattgtatagattccttgccattacaatttcacttgtaatcaatttccaaatctccctaacatataaattagaatctgagctggccggttcaggttgtccgggctaacacgaggtcacgcaatggtaatttactagtagggaaggtttattcttttggcgcagctacgttgaatgttggttgccgtttgctatgaaaaagacaaaagtatccctaaggagaggtaagtgggcccatttggtctgggtgcttctctccacattttcggggagttagtcgaggagaatgtatccacttttggtgaaaactataatagtgcgtctcccttaatcttattcttcttatatgattctttatttgcgtaatccttgacattcaccgacaaaacaaaatagttagtggttaactggttatttagcgaatatgaatgtgatttgtttggtagccaatacataattacataggatctagctcttctcgacattgtaaaagcaaatcgaaaccttggattggatgatgcatgcccaactatcaagacactaaagttgtagttcaattttccatacatatatagaatcatagatgatattatactatattcgaaatgttgagttctaagtctaaatcaaatgtacatgagtattatattatctctatgtaagtaaacttaagaataacatgttaatgaataagacgaacaatatttttactgaaacgtaaaatctcatgaataacacttgacaatatcgtttcaagaaactaatacagatcatataaatagttatgtatatatatgtgtgttaaaaccatattacatgtatatttatgaaagtatctataaagttttattatcaagacagtataagatttaataggaaagttctgaagcggaaatatttgataaaatttaaggaaatactaagaggatgcgatggtgatagattgtatgattagactttagagaaacaaaatgaatgatgattaaggcaaaggattaagagttaagagttgagaacaaatgaagttttggttaacaaaaagaaaagctccaaggaaacatggaaacctacttacttttgttgtttattgttcttgtgtttgggtccatctcctcatttcctacatttatactaaccacttaaccagttataaaaacataattctgcttttgttttgtcgtttatatatttaccttgtttttatttttgtcagctattaattcacttattcaaagtttttcattcattatgattttctcgttactcacatataatccgtgattcacacattcacttatctttagacttttttagatccacgtaaatccaactttagttaaatgggccttaaaatagtgatttagcagcccgttaatccaacgcggaaattgagatctgttgccataaaacgggccgggtcatcgagatttcggatctttaagacaaaataatcagaaacttcgaaatcgagaagcaagaaattggaatcaatagatttgagaaaacttttgatttcgagagtgcttcggagcagaagaacgagcaaagctagggtttccatctatcaaatccagctacaatcgaacctattcatcgaaattagggttttttttttggtcccttaatttttcccttctagtagcttctgatccttcgatttccatg

SEQ ID NO: 4889 - DNA, 3000 bp, Unknown
  misc_feature (1)..( 3000): cDNA_ID_1826442_gDNA_ID_1620744_Annot_ID_49671 3000 nt of promoter + ATG
cttctcgatttcgaagtttctgattattttgtcttaaagatccgaaatctcgatgacccggcccgttttatggcaacagatctcaatttccgcgttggattaacgggctgctaaatcactattttaaggcccatttaactaaagttggatttacgtggatctaaaaaagtctaaagataagtgaatgtgtgaatcacggattatatgtgagtaacgagaaaatcataatgaatgaaaaactttgaataagtgaattaatagctgacaaaaataaaaacaaggtaaatatataaacgacaaaacaaaagcagaattatgtttttataactggttaagtggttagtataaatgtaggaaatgaggagatggacccaaacacaagaacaataaacaacaaaagtaagtaggtttccatgtttccttggagcttttctttttgttaaccaaaacttcatttgttctcaactcttaactcttaatcctttgccttaatcatcattcattttgtttctctaaagtctaatcatacaatctatcaccatcgcatcctcttagtatttccttaaattttatcaaatatttccgcttcagaactttcctattaaatcttatactgtcttgataataaaactttatagatactttcataaatatacatgtaatatggttttaacacacatatatatacataactatttatatgatctgtattagtttcttgaaacgatattgtcaagtgttattcatgagattttacgtttcagtaaaaatattgttcgtcttattcattaacatgttattcttaagtttacttacatagagataatataatactcatgtacatttgatttagacttagaactcaacatttcgaatatagtataatatcatctatgattctatatatgtatggaaaattgaactacaactttagtgtcttgatagttgggcatgcatcatccaatccaaggtttcgatttgcttttacaatgtcgagaagagctagatcctatgtaattatgtattggctaccaaacaaatcacattcatattcgctaaataaccagttaaccactaactattttgttttgtcggtgaatgtcaaggattacgcaaataaagaatcatataagaagaataagattaagggagacgcactattatagttttcaccaaaagtggatacattctcctcgactaactccccgaaaatgtggagagaagcacccagaccaaatgggcccacttacctctccttagggatacttttgtctttttcatagcaaacggcaaccaacattcaacgtagctgcgccaaaagaataaaccttccctactagtaaattaccattgcgtgacctcgtgttagcccggacaacctgaaccggccagctcagattctaatttatatgttagggagatttggaaattgattacaagtgaaattgtaatggcaaggaatctatacaatgatattaaaagtaatcaaaccaagaaagttataaagtcaatattattcatatctaaacaaatacctaatatcaaaaaacaaatgctgcacatagctaattgaataagaaatcaatattgatcataattaaacaattaccaatttggtcaacaaacaaatgatgcacttagttatctaatttttttatttgtgtttaatcataagtttttagataaagtggttcaaaccatatactgatatacgcacgtaaagatttgtatgttgattagccaataagcttacttttatataaagtataaattaaccaaacaaacaacttcttcacaatagagaattggaaatctaactatgcaatattgatcacaatgaaagtacgtacgacgaactaaaattagttctaaaacatagaatatgatgtaatccactcccataccatatagtagttttttaaaaagaatacaacaaaaacaatttaagttcgaatgtacaaacaactgcatggggaacgcctcttcactttttttttttatttttcttttttcctaagcatcaatagagttatagggatgcctcaatttttttattttaaagtataaattgttgttaaaaacaaggaaatagaataaagtataaagtatatatttattaataactccaagaaattaaagtgtttcctttatatttatatagatgtaattaatttgtggtaaaacaattttaccgtcgagtgtctgtgactccgtcttcttcttcttcttctccctctcacatcgtcgtcactttctttttggctattcttctctctgtcatcgctgtctctgacttcattgtcttcctccttcttcctttttgcttttccgtcgtttttctccgccggatttttctctctccaccaccactacctacctcctcctttgtctcgctggaaattgtttccgagctcaaaattaagttcctgaagatcgggttctagtccttttccatctcggagaagcgtctttagatctgggcaagcactgccatcttcaaattttttaccttttttctccttctctatctctcttcaccaactggggtttggttacgggttaaattgatggtttccgaggcggctagaacctcgtgggctcttgtttgtagatgatgaacggtccttcgtgtaaggatcgaagagggtggttctcttctgctctgtttttcacatggaatggcagatcttgtgacctatagtaatgccgaccacaaccttgaacaggttcttctgctcactacctttcatcatttcgattttgctcagtttgggaaagagtttatttgttctaagcagtagaaagctcaaatctttgattgaaaaatgtaatctaaggagtttatggattgaaacccaagtttaaatatttgagattttgtttgttcaaattccagcaaatctctaagtctttctcaaattcttctttgtaataccaaagagtcaattagctggatttaaaatcaccattgagactcattacttggtgatgtaaacgaat

SEQ ID NO: 4890 - DNA, 3000 bp, Unknown
  misc_feature (1)..( 3000): cDNA_ID_1826434_gDNA_ID_1620744_Annot_ID_49673 3000 nt of promoter + ATG
ttaataagctccatcatgtaaacaagtagggacgagtaaatagtccccaaaactaattgatggtgctgaaaataaaatcaaactatcatttaatatacgtatcgtattgataaaataatcaatggcttagattatctccgtcgcacgctttccttgataattaataaattcatataagctaatcatcatatataaccaaatgacaatcataccctaaactcaaaattaatttatttatttagttctagaatttccaatatatacatgtcttcaaataaacaaatgttataaaattgtagaaattatatataattgatgcgaaaggcgtgtttaacgggagagttgtgaacaagaagaagactcaaaaacttctctcaattctaaaagctcgatttttttatttttttttggttccttcaaacttcaaagtaaaatcatggcaattttcgatctttcgtcgaaatcattcgatagccatttgaattttccgagaactttcgatgatcattcagattccggcgtctgttcgcctcctctgtggagaacgagtccaccgaaaagtcctgctcatcttcacaacaattaccagaatctctcacctgttacgaaggctcaagtcatcgctcgtggtcagcgtgagcttatggatatggttagtaagatgcccgagtcgtgttacgagctttcgttgaaggatctcgttgaggttaacacggaggaggagaaggtgttcgatgaaatgcctcagagagaaaaaaagccgaggaaagtcgtgaggaagacgaagagtgataaatgggtggatccgattcgaaacggaggtgttaataatagtgggtttcttctgaaactggtgtttcctgttagcttgggtgctaagaaaaagactaataagaagaaagataatgatgatgatgattcttctgtgacaagtaaaaggtcttggatttcttctcctagaccttcgatctctgatctgtcgatgaaacgagaggataaagattggtggaaggatggattgtcagaatctcgtaggagtcaaagtgttgtctcgaggatcaacagtgggagctcaaagagcagtggtggtagtagcagtagaagcaatagtgatcgaagccgaaacagtctaaggtatccacaaactctggccaatttatttaggaatccgttgaggtgttttgcatctagttctagaatttgctttttctgagctttgtttttcttgatagtttcctttagtgttgaattgttttgtgatagtcttctctcttcatcatgtgaatcgtgtaaagagtttgtgaaattggtcgttttttttcgttggtgggtttgaagttaatggtcatggaaagtgtcaatttagttgcgttggttgcacgagattttgacctcaagttttagacttctttgagggatttgaactatatgcctaagtctctttgtctatttttcctaattttgtaacacaatctcttgtgccgtcgctacaacttttggtgttctaaatgtttaaattgtggggtttcttaacacagggatgaaaacaggggatgcttatctttcctctggaatgtacatccacgagattgaaatgaaaaagttcttcaatggttattcacttctttggctaagaagactaaccggttcatatactcgagacacgtttagtggagtctataaaaccagaggacatgaacatcgtcttcaatgtaccacaaagattctatctttcttcttcttcttgtggttctctgagtttttatttttgtaagtctacgcaatgtatctatagagttcttgataatgatttgtagatagatacttcagcgtttgctaacataaaacattaataatagtgtaccaatgttcatcaataaatatcaaaattttatgttttttgaaatcttatgtacttgattcactaccgactacttaataagtaatcgttgccttcacttcaacttcaacaagagtgaatctcttttatgtgtctctgttccttttctggtgagtttgatgatagagtttggtcttcattgtggacttgtgtgagattatctctttgaagtcatcttctcgtttaaacgcgttttcttttgcgtttagaaaacgctcttaattttattttagcgcacaagtcaacgacgacaaacctatagggaaagcgacgccgttttctatttattattttagtagtgcgacggtgactttgtcttaatatcaccgacggtgacattagccaaaagtgaaacaaaacccaaaacacaagtttgcaacttttataacatctctctctctctagaagcagaaaagtcagcagttgattctaggacggcgacttgacttgacacctgaaaaatccttaccgtgtttgatagtttttcgaaaacccttcaaattgtttcattttttttaagtcttgagactttaaaaaatcctcgcttgctcttgttttaggtctcctgacaaggtaaagatccttgcttttgtctcttttgttcgaatctcaagtcttgttccaaagttttcttactcttcgaattctttccttgctagtagctgttttttttcctttttagtttctgcgtaatcacgatcaccggaaagactaatccttgtgagcttattgaattttgttaattccttgctttaaattgttcatgggttctgttgcaatctttctaatgatgtgtgcttagtatttaagctttgaaaagtctttgaatttttgcttgttatagctttggactaaagtagagtatggtgtcttcataggaaaaatttggaaacttgtgggagttgattgataagagttgttaagatggcaaatgatgcggctgcatgtgcagaaagggctacaaatgatatgctgattggtccagattgggctattaacattgaattgtgtgatcttatcaacatggatcctaggtatttgtaatcagaaaactctcagatcgctttgctagttttcagttttctttgtggctgggaatg

SEQ ID NO: 4891 - DNA, 3000 bp, Unknown
  misc_feature (1)..( 3000): cDNA_ID_2993598_gDNA_ID_1620744_Annot_ID_49675 3000 nt of promoter + ATG
gagaaccggtctttctcatctctagtcgaaattcagcatttatctaagtgtaacaacaatttcataattatttcttattaggtttttcggtgagtttgaaccgggatatatattttgtaaaaatttatactatatatcttatcaatataagaaaaagaagaagaaggatatgtatctcagaagattagttacatctagctattgatgctttcaaagccataacaaaaaacgaaagccttggacttgttagacttataataaaaaagtttatcattcaaagatccatttctttataatttttataagaatctttgtaggagtagtgaattattgcaattttggctgattatatgagtactgtttgtggttgacaacaaaataagtgaactgtttgtgatgtatatatgtttatataaagacaaaatgatggtgtagtttagcaaaataaagaaattaaaggaccattggctgggataattttggagaaatgaaataaagagagaaagagagtgacgtcgtaggaatgtgggggaggaattaaagagataaaagggaaaagataccgaatcttctcatggttttgcaacttggtcggttccaattatttttcacacccactttaaatcataatattgtagggaaataatttcaagctacatattgtacattccgagttccgacagtactgcattccgatattttaattgattcaagttttgattacattttttctttttgctgatttggaaaaaaatcttgattttgtatcgtcatcaaacggttgaatttagagatttattgtattttatatattctatataaacttaacttttctcgtgttcaagtagtagctaggtcgccgaccttctgcatgaatcacatgtctcgtaagtttagagtagtaagttaaaattcattaattgtattgtctcaagaaacacgcatgatacaatagtatttttaaaaaaagaaagtaaaatttttattttattttattgttttcatatatttcaggatcgaccatgatcagaagttttctagatgatatcgacacgaaatgtcagtctatagaaaccgttagcagtgatcagtgatcacttatatagttgctaaattgaccgttacttgtcatcgttttatgttttatcttatcacccaaactgttttttatcccacagtaaacacaattgatgacaactaaaccaaataatatacgtgtttcaaacttaaaagaagaaacagcatcgtggaagatagcccattcccagagtggctattttgtaattaatgaagttttccatgtcctcgatcaaaacaactaagcgacaaaaaggaccgcccgtactaactcgtgagatccaaacgctgctactttcacgcgcctctactacaaattcctctttgcactaacccaacatttaatttctcagattattgatgtaaatgatttaattaccagtttcaagctaataatcaacggtacataaccactttagccaaatcggtctggtttgatttatccaaattattttacacaaaccgatcttgtaagctaaccacaatgcaaatagctaaatggagagtataggacacgcgctataaagaacgtgtgtgggagtgggaatagttcatattaataccaccactaactataatgttcgcttcgtcatatctgactaattactcattaatttataaggtttttatttagtttcaattaaattataaaaaggtttgtcgtactattccactagattcctattaaaacctctgacacagaaagaagggtttcaatctcattaaagagaaaagaaacgattagagaaagagaagagggtagagacttcttttctttgtttctgtggaggctcttcttcttcttcttctctgtctctgtctctgtctctctgtaatcttctgtgctctccacaaatttgtctctcctctctctcgccgactccacaaattttgagcttctttttttgaagttcttgaggtaactaaatctcactctctttatagttttactttgtttgattttgtcaattttgactctttgaattctggggttttccattaaaaaaactcagaaagttctaagatttatctctgaattgagtaagttctattgaaattggcgtatggattcgacagatttttgagcacgatgtatgttttaaatttcgatgtcgacgcaccataaattttatatatatgaaattgaaatcttgataacaacagatttggtctcatcttcttcaagttgttgttgttgatgtggctgctgcttagagtaatgtttgttgctgcaagttggcttattgtctaatccgttatattattattttattttatttatatacagttgtgtttcgatttgtaacattttagattccgtctttgaccaattaaatctttcctccaaataaaatatttattttcttgctttcatgtttttaattttgacagctactactactaagttcgttttaagcatcaattcgtttatgcaaatagagagaatatcatgtcatgtcttaaaaaacaaagttgctcagaaacaatctttttttggttttgattttcaagttagtagtaggaggaggaggagatcttttaggaatctattcctctgttttttttctttggttgagaaggacccagagaaactcttgttttgttttcagagaatctctgtttgtggtctctctttatgaaatctttatctctatcttctttcagattctgcttcttctgtctagttacttagtggccaagattcacttatttgactcggcaggcaaaatctaccgaatatcttatcttcttgcaacttgtttatagacttaaagctgtgtacttactttgttttgttgcttcttcttatcctttgtcttgttctgtctcttggtcgtgatatgaattagttctttcttcttggttaaattgcagaacaagtgaaagagcttaatatccacaagactcttgtttctttcttaa

SEQ ID NO: 4892 - DNA, 3000 bp, Unknown
  misc_feature (1)..( 3000): cDNA_ID_1017181_gDNA_ID_1620744_Annot_ID_49676 3000 nt of promoter + ATG
ctcataaaaacatatgaattcactgatatgaaaagctgactcaagtatatgtgagtaggaagaaacacgtgctaaatgaggaagagcacgtgaagactaatctagatgcatttgtctataaatagtgaacgtagacgtgtaattagcttgttgttgttaagtgacatatgtgtcattaagagaatgatatattcagtgatgtgctgagtagttctcatctgtaacagaaacatagtatcattgttgagaaataaatattagactttccatttctcaacattaacaaaatggtgcggtgaactacactagagtttgcaagctgatataactcattgtactctttgcattcgattaatatacaacagaaaagttcattgactaacgatccatggtccaaaatttcaccagtcaaagagttttgggcctttaatcaaattggtgcattgacttgggcatgagaatgggtccattgacttagcacaagcagtatataataatatgcaacatatataatccagtgaataggttatgggtgggtgatcattgtgtttctctgtagtttaattaagtattaaacgtaattatttttatttatgaaatactaagtttctcctattaaaataaggttgagtatatgcccttgaatttggggagggctaatgcaaagtagatatgtgacaaagtggaaaagcaattaaaagaaaacggcatagagtgcggcctcgggtaaggctaacagctagctttctctacatatgcacgacactaagaaaaaagtaaacggcttgatgtttccatctcttatcgaacaatattgtttaaagaatacagcttgtgtattgactttcaaatcttttatatattccgtgaggatgcaaagaaaacaagccgtcgaattcatgttatctatttcttttcttgagcatatgacagattttgatttaattactttttgttgacatgtcgaaagaattgaaactacgatagattccttacatatatgaatatatccctttataaaattagttaccatatgttctctttgttacatgttgttgaatcatagcaaattacaaatggatgataaacttatggttaatgagatactatagagtaatcaaaaccgtaagataacttaactatcagtataaatgatacattgaaaaatgataactacttgattaccatgatcggatgaaaacttggttaattaataacataacttgtactaattatcacagaactaactgaatcttgggttttaggatgatatgggaggtggagggaatgaagaagatttggtgggaagctgccccattagagcaaaaaacgtgcccaccaactcaaaggcctcattagcccccaatgtgcatttttgttatctttaccagttgcgttttttcttctgttttaaaaaaaaaaatatatctcatagtttgttttaattcaaggtgcatttatttcctggctattaaatctgcaattcttgtacaatagttcttgtctttttcatgaaaataggttttgttttatttgcacaagataaaatatcttcgaagctagtaaaatagtaaaagaaggaaagagtccattaagtttataggtgcatgtgggtttcacagagagttcagaaaatacaaatagaaagctatactttttacaatggagattattcttttgtgtaacgtttttatgtaagataatgtcattttataagttactaattcactcttttttattatttttgttggtgttgtttttctacttctatagatacaaaaacataatatttgagttgttttacactgtcttgtaagttctaattgattaatgttatgaacttagtttatgcaacgttctacaaacaaagagctaattttacaccagcaaaaatccctcaagtcctacaattatatgtccatcacaaccgagttcgaacaatcatataataattatttttgttaatgaaacgaggaacgtatgatatgagaaaaggtcatttcttaatttaaataaatgaaacagtgatatatctttggacgttatctctcgacttgtaaacgagtttaattacattatgcgactcaactttgtaatcaattatttaaagttctcaatttttgtcaattccgttacgtaaattattattagattaacaatttcaataagataacttctcttgaatattttccgaatatttcgttttaattagatattacaactatggttataaaaataaaataaaataaccgtaaaagagtcgtcgaatttggaatataatttgtaatagtactgtattctcctgtcagttttagacacgtggcagttcacgtgtcatatagtcataacccgtacgtttactctttgcctctttcccttttatattcaaaactcctttttgattttgtctatcttatctcgtgaatcgttaattcgttatcaaaagagcttaaaaagctttaaaaaattaacggattagtaataattcaaccgaagagaaacccaaggcaccgaagaacacgatttcagaggtatgatccggaaaaaaaaatccaaagttttgatccttttgttttttggtgagcaaaaaaactggtcctacgctagtcaatggacattctcctaaatttttgtctctgtttttttagattgtaaattataaagtaatttctccaactttctggaaaaatccatccagcaaaagaaaagaataattggttttattgatcaaagatcttcagttttcaaaattaagcactaattatggggttttgtttattaatgtcctaaaaaagagttacacatagagagacattaatgcttgcagtttagtttaaagagttttaagaccatatctcactcaatccttatttccttacatttgtcgtcttttgatgtcatagactcagagatatttatttatcttctttctctctcatttctcattctcatatttacttttgatctcgtggtgttagaatcaaagaaaccgcttcaagg

SEQ ID NO: 4893 - DNA, 3000 bp, Unknown
  misc_feature (1)..( 3000): cDNA_ID_1826416_gDNA_ID_1620744_Annot_ID_49681 3000 nt of promoter + ATG
caaccagcagcaccagctgcaatcaaatcctttacggttctttgaatgtttagcgcatttcctccaccggtatcttgaaaagatcaaaagaaacctatgaagagaactataaccaagcaaatccactattttcaaaaagctatgaagagaactataagcaagcaagcgactctaaccaagaaagattgatactttcaatctttggtaaagaatcaacgactcaatgtttttaaatgttttttttccttttttggttttagttaagcttcttgcattctttaatgatgtctttattatactatcaaaattttgcaactttaccagcatctgcaatgatgggtatattaggagctgacgcacacaccgaccttgccgtcgcagccatctccggtggtctaaaacgacgaaagaacacaaataaaacgaaagcatacaaacaaaaaattactaaagaaagaaaaaaaaaaaggtggcgcacgttagcaaaccgaaatcgggttttcccaggagagaagcggataaggcgtaaccggatataaaaccagcggagaatccggtttgctgcacaatagccgcggataaggcatcgtagcatccaggcataagcacaatgccttgttcttcaatcaggcgatgaaaacgtgtttggattctcgctgtcggattcaccaatctcgccgcgcgtgggttccgtcggaatgttggtgaagctgtaaggtttaagctgctacaacagagtgaagttgttttgacagccattaacatcgacattcttcgaagcctcgaacaagttttttcttctctctaatcgagttagactctgacccacacgcttgggattttaatagagagcacgtggttattatatctcggtcttatcttatggtaacagtatctcaaagactcaaaccacaaggtattgtgaaaatgttagaggcaatctaacaataaatgtataatttggttagcttaagctcatcatagaaatgggcctttatgtcaccaaacctatttcacaacataacacaagagcccacaaaacaacgactcctttctccaccagaacaagcacgacaaaggcaagagagttgcaaaagacctataagatgataacaatcgaaaagatgtaaattttgagaaaaatcaaaataaacaagaaagatttcattgtttttcactttttctccatttctactttgattttacatactctatgggccaaccaatttccaacctaatgcttgataaaaaatgattcggttttactatctcaacaaattgggcctacaacatccaatttcatgtagtgacttgtttttgcctttttcacatctcaacaaattgggtcgtttgtatttaagaaattgttacagctttttagactgaattttactttatggctttatgctctctttttccgttttgattaagggtgaatatgtaaactgttgataccatctgattttttttattttttatttttcttgtgtgcaactataccatctgaattcaattgacattttagccaaataaaaaagattggtccacttggatggctgtaaaaaagtttagtggaagtatttatagggcttgttggcaatcttcaccaacggctataatgttgatctttttaaaattaaacttaccgttcgactgtcttctcaacgatttgacaattagccgttagattagtattactgatttattattaacaaacccatttcttttcttatttttgaataagctaaatcaggccaataaaagggacaagtagagatgggctatttctttttttctctttttttttttcttatgtagtagagaaaagcctttattcttagagctatcatttaccacccattaaccagaagctgagaaatgaagcaagccgaaacgaatttgtagttttggacggtgaaattatatcgggcctttaatgggcatgtgaatagagttgagagtctttttgccccaaataatcgtttaagggagtattggctcgttggtttaatattgggccgaaacgagattgggaagaagaacaatgtcggtttaatccggttagggtcgtgggctgattctggttcacctttatagcgtaagcgaacaaacattgaaaatggggaagccaaattagttaccatccctaactcagttttgagacgtagtatgaatgagccacggcagaacctacgacctaactcgataaagtaatggttactcttggagacggaagaaagcacaaagattttgataaggctttctagttggtgaaatggtcaaaatcgctcggagagccatcataggagcggggaggtgctatctgaatatcccaatgcatcaagacaagatggattcagaaaacaaagaaattaaacaaacattttaaaatatgctcttagttttagataatataatgttttcaataccaattatcttacactgatagtggtcaagttactaatcacttttaataaattggtgatagtcaaacgtattgaaaattatcgatttaaaaatatttgaattcaaaaccattttagtgaaagtttgcattgtagttttgattatccgatcaatctttaatataattacgtcaataataactgaaatccttgaattaaccgttacccgattcataagcactactttccgatcaaaaccaatgagataaaataacttttaaaccctccaaataaaaagagaaaaccttaaaaaccaatttctgttcggtggggatgatgatcggactcggaccggtctaaccgactggattaaaaagtctttaacaacgacaagcttaaaaatttgcctcttagtggcttcaaaacgcaatcgtttcgcttaatactattattttctctatctcgtttaaccaaaaaaaaaaacgagttggaggaaaaaaaaaaccaagaaaaaagaataaaaagcaaaaagcattgagcgtctccggagattaggattaaattagggcataacccttatcggagatttgaagcc

SEQ ID NO: 4894 - DNA, 3000 bp, Unknown
  misc_feature (1)..( 3000): cDNA_ID_1826413_gDNA_ID_1620744_Annot_ID_49682 3000 nt of promoter + ATG
aaacaaaatccttttatttaattaggatatataactttctcgttactaaaaattgaatatttgtttctggtaaaggtgcgcataccaccggatcgacggcatgcttctttgtcacgccacggttgacttttttcaagtccttaggttgaagtgccctcgaggcggttacgtgtgcttcaagattcctctggattgggacgggaaattccaattcgacaaccaagtccttaggtcgaagtgcactacaccgcattgaagaatctgtgggatgacttggatggagctagttgtgtcaatacttgccaaaattgcaaatgttgtactgctacttactctgttgccaagcatgccaagatttttaagtttctctcaggcctgaatgattcttactcaactattcggacctggcagagatttacaacctttttatcacagtcaatgcaacattgtcacagtaccaaccaatgcttccacattcaacatttcggtttcacataatgatcagtttgccgtgaatgcgaccaggttatttcctgctaattcaaagccaaaagttcaatgttctcattgcggctacactggacacaacgctgacacctgctataagatacacggccatcgaagtggtttcaagcataaacagaagagtgttataccaccagaaaaagctaagcatgttgttgtgaatcttgctttaactgttgggaaagtgacaatgaataaaggaattagacttgatgggattgcagagttagtgggaagtacgtcaaaaactcagatacaggatgtgatcgcatatttcaatacacaacttcacaatcctgcaacaaagatagatttgtatattcttgaacgtaaatgcacataaccttaaggcagaagagactactatctgtatgtaatatgaattgttttggggcaaaatctgtaatatgaattttattcgttctgtagactcctagtaagtgacattgacacgtgtgaggctagaaaatgattagccacaaatcacaaaagaagttaagaggcatgcgtatcagccacaaaaatcggttagtctcgtccacggctttagactttagtgtttccaggggaaagattggctgtcgtgaaaaaaggtcttcttgccgggagagttcctggtctgtccgaacctgatgatgaaggttcgtttcactctgttcttgattcctcttcttattgtcttgctctgtattttcatttgtatctataaatcatcttgtacgcaaaacaaatgggttcttaaatcctagcccaaatcatgccaaacaccctaaggcccggatataaatgggcctcgtcatcttttgaaggttttgaagaccacaccaaattgcgcagcaaagcaagtttcatctactttaatataatgagcttataataataatataaataaaataaaagagattacgaaatgggattatgtaaaatttattaaaattaaacagacgacgaacaatacacatccaacgtctcatactagataagaatactcattgataagagttattaacaatggatcagtataaatatcttagctcatatagaagtagcgctcaatattgtgtctagtaagtatagttcgatgccctctaattgcaattgttttacatattattatttttcgatattttttattactgcaaaaaaagagaattattatctacatatggattagtgccccaaacaatttttttctttagatccgccacttgcagtaacacgagcttatttgtgggtattcttcgtcgggtgcacaataacctctccggtaacctacacccgtacaatatttattgcattctttgctagtgaaacctttgccacaaggaatatgtagtccaggcggggtaggcacagggtctgttcctaatcctgttcaaacaaatatatagaggagattttatagaaggcttaattgagattgtcaaaaaaaaaaaaaaaaaatgtcaaataaaaaagagaatacttaattgagagaacaaataaaatatcgatagcatgtatatacatgtaactataccattatcaacttaagacgtcacccaaacaattatattgtaaaactctttatatactattttggaataattagatctcttgagtgatatatatataaacttaaatcactcatagatttcagaaattaatttaagtttggacctggaattgtttattaaagataaaaacacgtaaaggaaatcatgataataaacgactgaactatgaattgtattagcgaaaataaaaaacagaaagatgagtttagagaatttagacctggggttagaagaacgctgaggcagatgaagagaaggaccaaatatttggtagaagccatttcacttcgatggatcttaattttgatttagtttcagttcttttctcggagtgaatgtttgaggatgaatcatacacacaaatatatatatgaaggaaatacatacagtatacgctttatcaattttgtacagtcaatattctaagatattcatttactattacttttctcataatccaatatatatggttaaaccaaaaacaaatattgacttgatatcctacttattttgcaaaatacatactatggtttattaattctgtacattcaatattctagtttattttatttatttccttgtaattcaatatgcattcttataatgacagaaaaaaattcaatatgcattttttaagattattttagatttatattaaccaaaactctacttttgaattaatcagcattaaccaataatataatcaaaactgaaaactctatcgaactttttttttttttttttttttttgtcaatcaactctatcgaacttattatgtgatttatttacagtaagtgacattgacacgtgtgaggctagcaaaatggttagtatccatcacaaaagaggtgagagccacgaatctgttgatcaacaaacaaacacatcacaattctcgaacttcgccggagaatgatg

SEQ ID NO: 4895 - DNA, 3000 bp, Unknown
  misc_feature (1)..( 3000): cDNA_ID_2993602_gDNA_ID_1620744_Annot_ID_49685 3000 nt of promoter + ATG
ttttgagcttaagattctataggacaacatgatgaagcatgtaaacaaagcggacccctcataccacccacacacttactatcatcaataaaatcaccaaaatggtcaacatgatgttgacttttttgtttctcatgatgtttttggactcatcaaattaatgtccattctaaagaatttatttgggagattctatcattttcctctagctcacgtgtgtaatcatcagcgaaaccgacgcatggttttctatttttttcttccattactaaatccacaacctttattaacaaaaagagttataactaattagttgctttcaaaatatcaagttttgtcctaactatcactctgtatctgctcacgtgtattttatataactaaggatcagtgccagagaaggagattagcttcagagacgcacttaaggctgcaccacaggctacggcagccggtggtggtgcttccatggaggaaggagccgccggaaaagacacaactccggtggctgcgattggcaagcaagaaatgccaagtgcaattgtaatgatgcgcctcatactaacagtcgtgggccgcaagctttctcgaaaccctaacacttattccagcctcttaggtcttgtctggtcacttatatccttcaagtgagtcaaaaaataactcaaatatcaaaatttcaactataatcattgaatttgtttgttatataactttaactcatattttattttgctaaataatgagcagatggaatataccgatgccaaatatagtggatttctcgataaagatcatttcagatgcaggtcttgggatggctatgtttagtttaggtatgaacatgttcttataaacctgcataataaataaaattatgtataacgtattctaacaaaattaaactataggcctgtttatggcgctgcagccaaagatgatcccttgtggggcgaaaaaggcaacaatggggatgttgatcaggttcatctcaggtcctcttttcatggctggtgcttcccttcttgtcggattaagaggttctaggttacatgctgctatcgtacaggtaaactattcagagtttaccttgatttggcccatatatattattgttggaaaattaaagaaaacatacttggtgatggagaaagtgtttaagattttgggagtgaattaggaagtttaacatatagaagggactaattagttaaaaaaaaatgaaggatagatatgttcatagctttcaaaagtacaaatatctatctcatataaacctaatatagtctaccattatatctagacttatatgttacaaagtatctagatattatgaaaatatctagatattttacatgatgcaattctcctgtattagtctaaggaggtattaatattttaagatggttctaaagagactctttaacttgtttcaagttttgcgtttggtccaagaaattaatgatacctggatcattgacacataattataactaatccaaaatcaagttaaatatttcaaaatataaattacccgtggctataatttaaacttcgtttcttataaaagttttcgattaacttatagtagagatatgtacatctaaatttgatgaagccgatatgttcttttaggctgctctaccgcaagggatagtaccatttgtgtttgcgagggagtacaatttgcatccagacctactcagtacattgtgagtctcttgctcttctttttgttgttcttcatttacatttacggttgaacgtttcaaaatgcggtattatggtttatgtgaaatctctgttcttggtgattttttgttttgttttcagggttatctttgggatgatagtatctttaccagtaactattttgtactacgtcctcttgggcctatgattcacacaacacactgaagaaaaagattacaccggagaaattaaatgatctatgaataaagaggtctggaaatagagaaatgtgagctcttaagagttgttcttgaggagcttgtgagaaagattaattaacggttaattacattgttgaatcaaattactggtaaatggttaggtgaataatttaattttatgtatttgatatccaacattgatcgacgtacgtacgtagtgaggtagaggcttaggttaggaatcaatcgtgaatactatttcaacgttgattcccgcgagctgaatattttttgtgatgtatagtaaaacgcatatgattataggaatcatcataaagattcttgtcatgaagaacaatattaaaccaaattatgcattacgagcaaaataattatacaaaaatactgataattataacttgggtcattgtattttctgtgtaatgtctactatcccttaattagtcggtttaaatcaggaaaaagtataattaatgacactcataattgtatcgttaagacttgaaagtgacggccaagaatacaattaagagccaattagtgatctttcataactttaaaaatctcacaaaagtagaaaaaaaaaattccaacttgatgaccaagaataatactattaaagagctatttaagatgaaaccgcccgaaaccaaaagcattcgatgggtacaccgattactgcttttagcaacaccacggcgtgaccatcaagactaattaactaagaccacattttaaaaaaactattaataattactacaatttgtaattaaaaagatcaacgagaaatgccacgtggacgaatactagcaacgccaagtggaaagagcgttcgagagaacaaggcaaaaccaaatacgcccctagtattctacagatgtcgactggataattacaaaagatttcaataaacagtactaattaatttctagtggtgagtttttgtaaatatctacttcttccaattaccagctgctatataaatccccttctctgtttctcttttcttacatcacaatcacacaaaactaacaaaagatcaaaagcaagttcttcactgttgata

SEQ ID NO: 4896 - DNA, 3000 bp, Unknown; identical to SEQ ID NO: 4895
  misc_feature (1)..( 3000): cDNA_ID_2993602_gDNA_ID_1620744_Annot_ID_166595 3000 nt of promoter + ATG

SEQ ID NO: 4897 - DNA, 3000 bp, Unknown; identical to SEQ ID NO: 4894
  misc_feature (1)..( 3000): cDNA_ID_2127560_gDNA_ID_1620744_Annot_ID_166590 3000 nt of promoter + ATG

SEQ ID NO: 4898 - DNA, 3000 bp, Unknown; identical to SEQ ID NO: 4893
  misc_feature (1)..( 3000): cDNA_ID_1444645_gDNA_ID_1620744_Annot_ID_166589 3000 nt of promoter + ATG

SEQ ID NO: 4899 - DNA, 3000 bp, Unknown
  misc_feature (1)..( 3000): cDNA_ID_2127541_gDNA_ID_1620744_Annot_ID_166585 3000 nt of promoter + ATG
cttgatacgaccagacttcaagatggtatgatcatatgcactttaataccaacgttattaattagaataatggctgatatgtgctagacccaagcaaacgatacttgaagcagaaggtgaagttgccaaatccaaacatgtgaaggtaccctcgctattcctatcttattttccttccctttgtttgtttgactattatagtatttatcatctttctcaaaaatctgtacttggctggtagtttatatgtgtatttctgatatttctttataattagcctaagccaaaccgttttggttcttgtgcagggtcccgctggccaatgggttgatgtgatgaagaagaaaagagctattcatgaggagatcatcaatacaagacatcagcagaatcaaaagacttccaataatcatttggagatggtatttcttgcagtttctaatattaaactgtgccacatgcttctttctttgccattagtttcactcacttaaatgttttgatatctaggaagctgaacctacaacttcttttgttgatggcacagtagagggaagcaaaggtatgcgtgctgcttgtgctcttgttattttaattctatgttaaagtctgttatagttgatcttttgaatagtttgtggtgcatggttggttttccacttctttggttaccttaccttcaaataaactctccattgttttcagtaagcggtaagaaaagaaaggcacaagaaaccttcaaggacgatgaattctttatcagctccataccagtaaatcatgtatgttattttcgttgaataaaagcattttctgtgtcagtacgcattagcagtcaaagctacaatgcttatgatcatattgagatgatgcagagtttgactctttattactcttatgcacgtagcattcagaggcagggctatctctgaggggtaacgaaggatttggatcgaataggtaaaatgatttttgatgtggctatttgtgacattccatagaaggatcaagggattgcatttaaatgttgcaataacaaaaatttctgtcagatattgacgatttcggattgtaggttggacgctgctgttctagatctagttgcagatgatgggcaagggataaagcagcaacaatcaaattatcactgggacaaggtaagagttgtggttacttcataacaattgccccaactgtaatcttaatcttttaaaaatattggatttgtctttcttaacagaaaggtaagaagtacatcaagttgaacaatggagatcgagtaacagccagtggaaaggtagtaaaagtgtctttgctttaaaacattcgatgattctctgggaggctttaagccaacactaaggttcttgagactaaatagataaagacagagagtggagctaaagcgactgcaaagaagacagggatatacaagagatggcaagagaggtctcacaagaaagtatcccgagacagcggtgatgcagacgaaaccacacgaatgtcaggtaattaatgttggacagcgtttttttaacacaagttcagcgttttgccacctttgagttgtcaataggtctaaagagaaaacttggcaggtagaggaggccgagatgggaagagacggcaaggatcagtgcctaacgcacatgttcgttcagagatcaaagatctggaccaggtgcgtaaggagagacagcaaaaggcaaacaaagtttcttatctgcagagcaagagaggcggaagaggtggaagaggtggggccaggggaggccgtggtggtggggccaggggaggccgtggtggcagcagggattttggtggtggaggaagggattttggcagtagcagcgatagaggtggaagaagtggcggtagggattttggtggtcgtcgtggtggtgctagcactagtagcagaggtggtaagagaggaggaggaagaggaggtggaggtaaacgtgggagaggaagatagtcatgaagaagaagactgtcttcaaaactttgagcttaggcaaactattacttgccaaattgttatatcactcaccgaaccttctctactcaaattttgtgcaacactttataatcttgtttttttctgcaattttggttttcatgtatcaataagttggttgacgacaaaaagaaagcgacccaacactagacacttgtactgacgattcgttgtttcatgtcaggttaagtaatgatgacatcaggtatagtacaacaaggttctatggtgtagtggttagcactctggactttgaatccagcgacctgggttcgactcccggtaggacctttatttttttcattagccatttcctttttgattgtgattctgtgatccgtgactcaccttgaaatccaactcaaaagttaagcgtattcaaagtgtatctgtaagtagatagaagttattatccataaaacaggttgggtaaaaatatctaaccggattcatagctaatataataataacttccctgtatcagtctcttgaaatatgtattatttcttctgcaacgctcaacaatccataatgcaatcatgttacgaggtccaaacgcgatcgtgttttaaactctatactctttagggtctaatggaaatgtctaaatcattgcctaacaagtattttgaaatggagaataagcaaaaaggaggaagaagagaaaaagaggacatgaaatgaatgataaaaagcactaagtagacagttaaaaagagagagtgttgttgtagtcccccgctcaaaagcggcgcaattagtttattagaaaagtgcagatcatcactgtaaagccaatctcttttctttttcagcttcttgaagcagatcaagatcaagaaagaacacttttgtgaacttcttcttccccacatctcctaaaagcttcacacacaccaaaccaagcgtttcttttcttatctactcgattatcaacacatcttttcctgaaactccttccacatctttgtctgatcatg

SEQ ID NO: 4900 - DNA, 3000 bp, Unknown; identical to SEQ ID NO: 4892
  misc_feature (1)..( 3000): cDNA_ID_1017181_gDNA_ID_1620744_Annot_ID_166583 3000 nt of promoter + ATG

SEQ ID NO: 4901 - DNA, 3000 bp, Unknown; identical to SEQ ID NO: 4891
  misc_feature (1)..( 3000): cDNA_ID_2993598_gDNA_ID_1620744_Annot_ID_166580 3000 nt of promoter + ATG

SEQ ID NO: 4902 - DNA, 3000 bp, Unknown
  misc_feature (1)..( 3000): cDNA_ID_3074810_gDNA_ID_1620744_Annot_ID_166577 3000 nt of promoter + ATG
aatttaaatcccgtattttatcgcattacgggattgtaatcgaatctagcaaactagcaaggattcagatttccagttatataaaatgataaacaaattttggaaaagatagcaaaatccattttcttgtttaatttttatttccactacgagtttcgagacggcgagagcatttaataagctccatcatgtaaacaagtagggacgagtaaatagtccccaaaactaattgatggtgctgaaaataaaatcaaactatcatttaatatacgtatcgtattgataaaataatcaatggcttagattatctccgtcgcacgctttccttgataattaataaattcatataagctaatcatcatatataaccaaatgacaatcataccctaaactcaaaattaatttatttatttagttctagaatttccaatatatacatgtcttcaaataaacaaatgttataaaattgtagaaattatatataattgatgcgaaaggcgtgtttaacgggagagttgtgaacaagaagaagactcaaaaacttctctcaattctaaaagctcgatttttttatttttttttggttccttcaaacttcaaagtaaaatcatggcaattttcgatctttcgtcgaaatcattcgatagccatttgaattttccgagaactttcgatgatcattcagattccggcgtctgttcgcctcctctgtggagaacgagtccaccgaaaagtcctgctcatcttcacaacaattaccagaatctctcacctgttacgaaggctcaagtcatcgctcgtggtcagcgtgagcttatggatatggttagtaagatgcccgagtcgtgttacgagctttcgttgaaggatctcgttgaggttaacacggaggaggagaaggtgttcgatgaaatgcctcagagagaaaaaaagccgaggaaagtcgtgaggaagacgaagagtgataaatgggtggatccgattcgaaacggaggtgttaataatagtgggtttcttctgaaactggtgtttcctgttagcttgggtgctaagaaaaagactaataagaagaaagataatgatgatgatgattcttctgtgacaagtaaaaggtcttggatttcttctcctagaccttcgatctctgatctgtcgatgaaacgagaggataaagattggtggaaggatggattgtcagaatctcgtaggagtcaaagtgttgtctcgaggatcaacagtgggagctcaaagagcagtggtggtagtagcagtagaagcaatagtgatcgaagccgaaacagtctaaggtatccacaaactctggccaatttatttaggaatccgttgaggtgttttgcatctagttctagaatttgctttttctgagctttgtttttcttgatagtttcctttagtgttgaattgttttgtgatagtcttctctcttcatcatgtgaatcgtgtaaagagtttgtgaaattggtcgttttttttcgttggtgggtttgaagttaatggtcatggaaagtgtcaatttagttgcgttggttgcacgagattttgacctcaagttttagacttctttgagggatttgaactatatgcctaagtctctttgtctatttttcctaattttgtaacacaatctcttgtgccgtcgctacaacttttggtgttctaaatgtttaaattgtggggtttcttaacacagggatgaaaacaggggatgcttatctttcctctggaatgtacatccacgagattgaaatgaaaaagttcttcaatggttattcacttctttggctaagaagactaaccggttcatatactcgagacacgtttagtggagtctataaaaccagaggacatgaacatcgtcttcaatgtaccacaaagattctatctttcttcttcttcttgtggttctctgagtttttatttttgtaagtctacgcaatgtatctatagagttcttgataatgatttgtagatagatacttcagcgtttgctaacataaaacattaataatagtgtaccaatgttcatcaataaatatcaaaattttatgttttttgaaatcttatgtacttgattcactaccgactacttaataagtaatcgttgccttcacttcaacttcaacaagagtgaatctcttttatgtgtctctgttccttttctggtgagtttgatgatagagtttggtcttcattgtggacttgtgtgagattatctctttgaagtcatcttctcgtttaaacgcgttttcttttgcgtttagaaaacgctcttaattttattttagcgcacaagtcaacgacgacaaacctatagggaaagcgacgccgttttctatttattattttagtagtgcgacggtgactttgtcttaatatcaccgacggtgacattagccaaaagtgaaacaaaacccaaaacacaagtttgcaacttttataacatctctctctctctagaagcagaaaagtcagcagttgattctaggacggcgacttgacttgacacctgaaaaatccttaccgtgtttgatagtttttcgaaaacccttcaaattgtttcattttttttaagtcttgagactttaaaaaatcctcgcttgctcttgttttaggtctcctgacaaggtaaagatccttgcttttgtctcttttgttcgaatctcaagtcttgttccaaagttttcttactcttcgaattctttccttgctagtagctgttttttttcctttttagtttctgcgtaatcacgatcaccggaaagactaatccttgtgagcttattgaattttgttaattccttgctttaaattgttcatgggttctgttgcaatctttctaatgatgtgtgcttagtatttaagctttgaaaagtctttgaatttttgcttgttatagctttggactaaagtagagtatggtgtcttcataggaaaaatttggaaacttgtgggagttgattgataagagttgttaagatg

SEQ ID NO: 4903 - DNA, 3000 bp, Unknown
  misc_feature (1)..( 3000): cDNA_ID_2127517_gDNA_ID_1620744_Annot_ID_166574 3000 nt of promoter + ATG
aaacagagcttttaaaacccaaaatagctaacaacatatatttttactgccccacataaaataggaaattaccatcctcccttgtttatatgaatcgattcccacattccacatttccatgttttgtaggaaccaatgatcacaatttcctattttaaagaccctacaaataaagcattgatcatttgtctacaaattaaagcaaattcatcttgaccagagctctactaattcattagacatggagatcattccattgatgctcatttccgttatcatactcttgacatcatttccggctccgattaaagtgtccggcaggggtggaggaggcggctttgttggtagtggcaactctcctagtattggaagcggctattttggtggtggtgggaatcctggcaccggctatatgggtgggggtatccctagcggcggcagcattagggatgggagtaatgttggcaccggttataggggtgggtttcaaggaggcaagccttcaggtggtggtgaccccggtgcggcaattgtggtgtttcctaagaagcccgaggaacctgtgaaggtggtgccaacgccaatgccacaagtttgcgaaccgaaagttagacattgcatcaatgtacatgtatacggacgcgccgggcaacctcaccgaggcggagcatgttgtaacaaatttaggtacgcgagaagatgtgtctgtaaattccttgtgtctaatgatactcacctaaacaaacaatctaatggtgtacttcgaggttgtcattttaaacgcaattgtgtcttccgtaactaagatctagagattatgtatgtaactaatagaaaataataactatgtatatacaagcaaatatatcttggaataattgtacatttttgtaaggttaaaaatgtatatcttaatgtattttgtaaatgatatatgagtgctcggatagacagttaaacttgttcttcggcgatgatcgtcgtttgcttgagaatacagtctgcgagcacatggtgagagacttggctatgctcccgatgggtactctttaatgctcttctacagaggtacaatcctacaccagagcttccaccgccgtacgtttctgctcctccgccggtgccttgttaatccaaatttttgcagtctaagagagttgtttggtcacattatcacacataaaataaacaaggatacagctttaatatatatatttttacatagaataaggtttgtatatctatattttggtcactatttgctagagaataagagattgctggatgatcttggcggtgctttctgatttctgtaacaacataactttacctatctatattgatatgcatggaaagtttataagaattaatcatgatatataatatatgttgcagtttatatagtacatgacatgtataacgaaacttttgtctcgtaatttctcttgcgtagaaaagtctgatcgggaaggactgaggggtattttcgtaattttacagattgcgattctaacccatatgaccatatcacgtaccacggagtctataaatattaatcacccatatacacataacataaagttgtaagaaaaaagagagagacagagatttactcaacggctaagatgaaaagttcatcggagctccttgtaataatgattttcttattcttggcgcttctcataatctcccacgctcaatcacttccaggtacgtttccatttaatagtatgtaatctcacgtattcttatataatttatataatctcatcgtattgtatcaatagtattattattaatatgatttggacctgtgttgcaggtacgccgtatggcggccctggtccgtatccgcgtagttaccctgtgtgttacccaccgtattgccgtccatgagagtttcaatttggtcacatgaatgaattatagtcaaatacctatatcaaggtgatgtatgtgtgtatattattatatgttttcatcatttgatggagaataaaaagcttaggaaatatatccatgttattatatgtttcagtttgtaatatgtataatgatattgctggctctgtccctttttttcgctgtcaccataaataattattggatttcgaagagatcaaagcgaccagaaccatatcgagatggaatgaaactatgaattctgagatctaaattcaacaatggcaaatggtcaccaatcaaacttaaatttcaaaaattaaatacccatgttataaaaactaaaacttaccatttatttcccaactattaaaaacaaaccaaagaacgatttgtaatcaccatcggaaatttcatatttaaactcgtgccttgaattatatattacgagaatcaacgctttatggtttttcgagtgtacaatgatcgagctccattaatggccaactctatgttcaataatgtaaatttcatgaacagaatagtcagtcaataccgatcatgaaagttatgcggacgaaaacaaaagcataaagaaaaatctacgcagagagagggtttgataactactagtagggagtgacaagacatttttgtgtgatgctccatgcacatatttatgtcgtatagagaggttcgatagcagcattgatatgtccatgtcgattagtcactacagttttgaaaatgcatgtagttccaaataaatcgtctaaaatgaaaagccaccacacaagaaaaataacccttaaaaatacaaaattaatttcacaagaaatttaatctatatctacaaaatagttacactaaaaatatatctatatctcatgtaaggatcagttagatgatctacaaaatttctcacataagtatgtgattgtaaatagacaaagatccaccacaaggtctattatctcccgagggattgggaaggacggaggatattattgtaaatttcccaaatgtgttcttaataagtagagtacattaatcaaataaatagataaaaataagaaagagagagatatttgtttaatg

SEQ ID NO: 4904 - DNA, 3000 bp, Unknown
  misc_feature (1)..( 3000): cDNA_ID_2127506_gDNA_ID_1620744_Annot_ID_166571 3000 nt of promoter + ATG
ggagcataactatctatgtgttgaggaaacgtgaaaggactcaggagcttaccgaaatcggaacggggacgtttcataggaccaccaggaggatgatgttgctgtcgctgctggttccagtacccatccgccatggaaatcgaaggatcagaagctactagaagggaaaaattaagggaccaaaaaaaaaaccctaatttcgatgaataggttcgattgtagctggatttgatagatggaaaccctagctttgctcgttcttctgctccgaagcactctcgaaatcaaaagttttctcaaatctattgattccaatttcttgcttctcgatttcgaagtttctgattattttgtcttaaagatccgaaatctcgatgacccggcccgttttatggcaacagatctcaatttccgcgttggattaacgggctgctaaatcactattttaaggcccatttaactaaagttggatttacgtggatctaaaaaagtctaaagataagtgaatgtgtgaatcacggattatatgtgagtaacgagaaaatcataatgaatgaaaaactttgaataagtgaattaatagctgacaaaaataaaaacaaggtaaatatataaacgacaaaacaaaagcagaattatgtttttataactggttaagtggttagtataaatgtaggaaatgaggagatggacccaaacacaagaacaataaacaacaaaagtaagtaggtttccatgtttccttggagcttttctttttgttaaccaaaacttcatttgttctcaactcttaactcttaatcctttgccttaatcatcattcattttgtttctctaaagtctaatcatacaatctatcaccatcgcatcctcttagtatttccttaaattttatcaaatatttccgcttcagaactttcctattaaatcttatactgtcttgataataaaactttatagatactttcataaatatacatgtaatatggttttaacacacatatatatacataactatttatatgatctgtattagtttcttgaaacgatattgtcaagtgttattcatgagattttacgtttcagtaaaaatattgttcgtcttattcattaacatgttattcttaagtttacttacatagagataatataatactcatgtacatttgatttagacttagaactcaacatttcgaatatagtataatatcatctatgattctatatatgtatggaaaattgaactacaactttagtgtcttgatagttgggcatgcatcatccaatccaaggtttcgatttgcttttacaatgtcgagaagagctagatcctatgtaattatgtattggctaccaaacaaatcacattcatattcgctaaataaccagttaaccactaactattttgttttgtcggtgaatgtcaaggattacgcaaataaagaatcatataagaagaataagattaagggagacgcactattatagttttcaccaaaagtggatacattctcctcgactaactccccgaaaatgtggagagaagcacccagaccaaatgggcccacttacctctccttagggatacttttgtctttttcatagcaaacggcaaccaacattcaacgtagctgcgccaaaagaataaaccttccctactagtaaattaccattgcgtgacctcgtgttagcccggacaacctgaaccggccagctcagattctaatttatatgttagggagatttggaaattgattacaagtgaaattgtaatggcaaggaatctatacaatgatattaaaagtaatcaaaccaagaaagttataaagtcaatattattcatatctaaacaaatacctaatatcaaaaaacaaatgctgcacatagctaattgaataagaaatcaatattgatcataattaaacaattaccaatttggtcaacaaacaaatgatgcacttagttatctaatttttttatttgtgtttaatcataagtttttagataaagtggttcaaaccatatactgatatacgcacgtaaagatttgtatgttgattagccaataagcttacttttatataaagtataaattaaccaaacaaacaacttcttcacaatagagaattggaaatctaactatgcaatattgatcacaatgaaagtacgtacgacgaactaaaattagttctaaaacatagaatatgatgtaatccactcccataccatatagtagttttttaaaaagaatacaacaaaaacaatttaagttcgaatgtacaaacaactgcatggggaacgcctcttcactttttttttttatttttcttttttcctaagcatcaatagagttatagggatgcctcaatttttttattttaaagtataaattgttgttaaaaacaaggaaatagaataaagtataaagtatatatttattaataactccaagaaattaaagtgtttcctttatatttatatagatgtaattaatttgtggtaaaacaattttaccgtcgagtgtctgtgactccgtcttcttcttcttcttctccctctcacatcgtcgtcactttctttttggctattcttctctctgtcatcgctgtctctgacttcattgtcttcctccttcttcctttttgcttttccgtcgtttttctccgccggatttttctctctccaccaccactacctacctcctcctttgtctcgctggaaattgtttccgagctcaaaattaagttcctgaagatcgggttctagtccttttccatctcggagaagcgtctttagatctgggcaagcactgccatcttcaaattttttaccttttttctccttctctatctctcttcaccaactggggtttggttacgggttaaattgatggtttccgaggcggctagaacctcgtgggctcttgtttgtagatgatgaacggtccttcgtgtaaggatcgaagagggtggttctcttctgctctgtttttcacatgga

SEQ ID NO: 4905 - DNA, 3000 bp, Unknown; identical to SEQ ID NO: 4888
  misc_feature (1)..( 3000): cDNA_ID_3408919_gDNA_ID_1620744_Annot_ID_166569 3000 nt of promoter + ATG

SEQ ID NO: 4906 - DNA, 1694 bp, Unknown; identical to SEQ ID NO: 4887
  misc_feature (1)..( 1694): cDNA_ID_1826452_gDNA_ID_1620744_Annot_ID_166563 3000 nt of promoter + ATG

SEQ ID NO: 4907 - DNA, 3000 bp, Unknown
  misc_feature (1)..( 3000): cDNA_ID_1826538_gDNA_ID_1620745_Annot_ID_49687 3000 nt of promoter + ATG
attttttcaatttaaaattcccttatgaatatctagctcatgaccgaaatcaggcactaatttagtaagacaatgtaattggtgttgtgagcaaaggagtctctcgaagcttttttacacaagaaaataaattatataatttttgtttcaatttctttcatataactataaaatattccaacggtctctctgggataaaatcgcttatatacttggaaagtggttttagtaaaaatatataatgtgttattgttgggtggtaactaaaaatttctcgaatcggttagttgcttaacagttatctaaaattcaacaatggtctacaagatttggaaatttttaaaattgacaaaaacctcaaaaaatttcaaagacctttccgaaacaaatcaaatcaaattaaattttagagtattcggattagatcaaattaaatttaaattctaatcaaaaaccagtaatcacatttcaataaaacatggttatcggttaacgagatatggtatttcaaataaatatgtcgaattacatagattctaataaattgtgatgtttagtgaattaataataattttctcgattaacaaacaaaaaatatcaaaagtttaagattcaatcatgtgacgaatagaatttggataaatcgtatattctactgttatatttattattattattatataaaaatgcatgaagtatatgattaataacgataagcgaaaaaaaatattttacacagattgttacgactcctactgaatagttaacatttttcacatacttcaaaaaaatatagtttaacagaaacttttttcatatttttatcttttttgtaatacaaatattaaaacaaaatgtttataataaactgtattatgttacatatataaataatatctttaaaaatttgctcatttgagataatctagtaaaatggttgaaaaagtaatatttttatgttagaaaaagtaaaatctaaaaaagctacatggcagactactatacgtttgcaattataaaattaggagagccaaccgacatgaaagagcatttatgtaaataacaatataattgtggaatatgggcacattgttttcatttgttaattaaaaaagacataaaaggtcacctgataaaaaaactctaatacctacgcttttgtttgtgttcgatctaaagtacacattttcgttctattttatacaatcttttggcaaaagtcgcataaactaaaaactcatagaagctacaaatgttttcatttgtattttctttttttaactaggaaatgtcgtaccaaaattcatcataactaagctttattaatttaggcatattagctgctactctcgatgactcgatcaatcgattgtctgaactccaagacataattgcagccgagttatcaacctttgttacaaatgttttcttcatcaattcatcaaatgaagtgacataaaataccgacatgtctctttattcagctaggtactctcattgatttcatgtactttcttaagtcgcacccgtcaattcctcttatagtatgtgtgtttcaaacagtatacacgatatatagagagagaaaagaacagaagatgacatggagaacaaacaactttatgcggcttctcttctttaaaccattgcactctgaagatacagaacaacgacaagctaagaggatatgttgcgagaaatgttttcaactagatattccaaaatcacatacaaatagtctttagactctattttttacttcattttatattctctaatttttttcaaattcaaactcaacacataaggatgaaagatgtgtataatgtaaccatattttatgctgaacaaatttaacattcatacaaaaaaaagaaataaatagctacttatttatattttcttttttatgtgaaataaattaaatttgataaagcaatttacagtagtgaattaccattttactcttttgtacttgtgtcgttctactttctcgttctcatcaaatagctaaccatcaaaaatctctagttatactgtattttctaaacttacaacattagttttaacttttaacaaacagaagttggataaacagaaaaaaaaaggattcaaaataatttttaaataaaggattatcaattatcatttaagtgcacattaatacccgtttaataatttattcatgtaattattaattgttctaacgtctgaaaacataattgccaactgccaagttcttctacacacatgccacatccttggagccttaacgaccttccacgaggaacttcgtccaatcttattatattactaacccttttgaatctgccttttcgttaaaatatttttataatctatgaaaacgatttaaatttatctactgaacaaacaaaaatttgtcttgatattttttaattctaccgttttgttttcactttaactattaaattttcttctacattttgttattgtcaaccaaatacggtccataatcgaaatctacggaacatatatacacaaaagaaaaaataaattgtgaacatgaattcaagttatactatcagttttaaaaagtttaaaattcatgaactataaataaaaataaatctttgcaatcttctctagatacatcaagaacttctctaaagctatatttgacttttcatttcgttagttacatcacccatggaaaaaagccaaaggtttaaattttcatatctgaaaagtaaaacttatataaaaatgcaattaatagaagaacaatatcgaaaaaagaaaagttattcataattaatttgttccggatttacccttcgcgctacgcctatttaatcaaacgttgtggtagccttcgtagaaactactcacaagccaaagaccaaagtaactaaaaagtttacaagtccatcaaactgttcttttacttctcaaacactcaagaaaacttttcagttatcttctataacctaccccaatactttttctttgctcaaaatg

SEQ ID NO: 4908 - DNA, 3000 bp, Unknown
  misc_feature (1)..( 3000): cDNA_ID_1826530_gDNA_ID_1620745_Annot_ID_49689 3000 nt of promoter + ATG
tgttgatgaactcaactggcttgtcttgtataccatcaacatgttgtgaaagtatagccaagaaggctgacctggggatgaaattgggcagtccaacacacttgcattcgtcaaggatcttgatctcatccatcaagaactcggccacttcttttggctttgcttgcagactatcagagaattggcttaacatatcagccaagcgagcagtacaatgcatgttctgatcatctgggtattcagagaagtctccttggactagaatccttaagagggactctttggcagaaccaatgatgtccatcaatgccatcaatgcttccccggtagaagccattaccattggcagtttgttcaactctagaacagcagtgtccaacttctggttgatcttgcttacaattttaggcaaacatctagcaatcatgcttgattggataagcattagcttctgagctaacacagggattcccactatgtcttcatcaattaaacttagcactggatgggtcctgaaaagtaactcttcttgcatccttgcttcttcatatgtctcttctccaatgcggtttctgacgcacacgtaaccaagaacaatactcacatcatctgcagttactttctgcaagagaccttcaggagccatgtctgcctttgtcacaacagctagtgtccgttgaccggttttgtcaacttttctagacatgcgaatggattcgcatgtggtgaagtcgaccgtagctgacagaacattgaggattattgattcttgaggctcaatgtactccataatcatcccagagatctgctcataaatattttccggctgtccattcactggaactcgagttataccgggaagatcgaccatcgtaaggtctggaacaccagccttcttcacatggagggtcaatggagcatctgagacccctttaccagatcctgcagcacatgaattttattagtagttaatcatagtcaatacttgttaacctcaaactcataactttgtatcagtttcatcaaatagcaaaacttgtaaaaaaatcagatgggtaaagaccaaactagtagctcatataacacctctaggcacttgtggtcagataaatgtctctgtcaggttagcagcaaaatacacttaacacttagagagagagaaagagaacataccagcaatcacatctgttgcagcacgaatagcttcagcgatgtgttcctcgtccgtaggaaccactttgtcgttatactcaagccaaatctcaggttcagggctagagcttcgctgaagcctcatgacaagaggaaccctagtgcagattccttggccacgaggtaaactgattcctgccaaggattcaagaacacttgacttccctgaggactggtctccaaccacgacaatggtgggaagatggatcccttctctcatgacattgaggttcctaagtctgtccacagtgtcaagcaacggccttatccgatcgttatatgaagatataatcggtgcttcaacagaaacaacatctttgttgctacgggacttctttttggcaattgcgagagaaggagagttttttttagtggcaactttcttcttaaccattttcttcttgagacaagacaagagtgggagagatagagacagaaaagagatgttttaagggtaagtgatgagattgttctaaagagatatgcaaagatatatattagaagtaaacgtttgagataaaaggatgtgagtaacgtgcatgttgttggaatcttaaaaaaactaattaagtccattattacaatatagattatagctcatagttgaaactaaaaagtctccattaaatccttaattatgtgtatatcaatatttaactggctttaattggctgaattttcctacggtgacgtttggtaatatgaggtaccgtttgaacttgtaagtttgtaacaaaaggcgtacctaacagagcgttttttgttgatctcaagattcgagatcttattgtttatggctttatgctctgcttttctctgtttcttactttgtcttaatttaaaaacaagagtggaagagaaggaacgtaaaagagaagttaatggtcttgtactcttgtagtagttaaaggtaaattcatttcttactaacacatattttcagcagcaagagagacttgagagattttgtagataataaatttgtaatatgatgtaagaatttctcagctcgatgatattatgtagaaaagaaactgctttcaaattgttaaattcttcccatgatgcagattttttcttatgacggacttttgtataacaaatcacatataaatctattttctattatgttcttagttcaaaaataacaaagattactctatcaaacaacagagtaacacaattttcatagagatttattttttagattagtaatgtttgaataattttattattgtaatgaaaaatattgtgtatttaaattcaatcaaccaaacaattttactaaaatctaaagtacatgacatacccaattttaacattagctcaacaaaagaaaagaaaaaaaatctataaacttttggatttacagtctactacaaataacattttattgtttgtcacaaaataagactaacattttaattttagggattttataagattttggttgttatttctgtgttttttttttaaggtttaaaataaattctaaaaggtatattatgatgcaaatcaaagtttatattattttctttaattatgttaaagtaaaagtaatttgtttttttggtagaagtaaaagtaaaattttcccagagtcgtctgcgttcagacttggggacaaattaaagctgatgatctccggtcaagtactcctctcgacgactcaaaaacacacatattttacgaattcgaatttcaagtttccgattctctaaatccaattgatttcactcttcctcaaatgaaaaagccctaattttgatcgtctaaatttcatacatg

SEQ ID NO: 4909 - DNA, 3000 bp, Unknown
  misc_feature (1)..( 3000): cDNA_ID_1826526_gDNA_ID_1620745_Annot_ID_49690 3000 nt of promoter + ATG
tctccactcaatgtccttgttggcggatatttcaaaactctttgaatggatctaaaaatgaaaaaaaaaaagaaaaaaaaaaagaagacatcatctaaccatgagactatatgcgactatatatcataattatatatatgatcatgaagtgaactgtttccctgaagaatgccacacaactccaattcaacccaaaaacaaaaattcattccaacagagtcccacacttacttccgctcgatattacttggctttagatccctgtcgataatgccacgatccaagctccttgccagctttagttgcttgttctctgaaggattagtctttcccagttctgtatcccagacagtaacaaattcatttgttgaacctattggggcagttatgaacaaattggctccagactccttgaaatcaaaagcagagagacataaatccactggtgatttcaatattgcaagacacacatggagacaatttgaatatataagaaggtcacagacagatctaactgcagtagatactgcacctgaaatacaacccgatgttcaaaactacagaaatcaatgaccacaaacagatgtgagcttccatgtttggtgctttcttgctccttaatcgtatccaaggatttcaacataagtcgatccagccaatctatgctttgaatctgccccctctcatacttattcatgagcttctctaaacgctctagctctccacgctcatgccgtggaacctacgagtacagaaaaataacagataacccaagaaaaagtaggtcggcatcaagaacgatatttcggattatataggaagagttgagatgtatcagaaacctttccaggagtagaggttggaaatgaaccatccgcttctttcccctgccagagccttagcttctgcttccctgatttcatttgcatcttgctgttaaaaagaaggactgttgccccaccaatcagtccctcagttttgccacacgaaacatcccatacctgatatgagcataaacttttcgataagcagaaaaaggagagaggtaccataaaagaagcaataaggtcagagagtttttgtttactgtaatcgcaagttgtgaatgggcagtcaagtcccggtatttagaactgagagtgatgagttcgttccagcagtatggtggtcctgtagttttcaatctggaattaagaatagagctagatgaaacacaaagcacttctacaagagtcatcaacatcatcaaaacacaacaacactacagggaataaagaaacataagagagagaaaccttgttctcatgggaaggccaaaaggagctccatcaatgtacaatgcacactcaatgtaaagctctggttttttctcctctgcgatggagacaactcctgaaaacacacataaatcaaaccaatttgcactaaaaattagaacataatcaattcaagcttctttcaatcagtaactgtgggagatcaaaaatatttgagtacccgaatcagacgatttcttgacggggaggtttccatcaagcttctcgatacgaaaagtgaccggcgaattgatatcgcaggagaggaagaaacgaaactcgttcgcacccatgtatgaaatttagacgatcaaaattagggctttttcatttgaggaagagtgaaatcaattggatttagagaatcggaaacttgaaattcgaattcgtaaaatatgtgtgtttttgagtcgtcgagaggagtacttgaccggagatcatcagctttaatttgtccccaagtctgaacgcagacgactctgggaaaattttacttttacttctaccaaaaaaacaaattacttttactttaacataattaaagaaaataatataaactttgatttgcatcataatataccttttagaatttattttaaaccttaaaaaaaaaacacagaaataacaaccaaaatcttataaaatccctaaaattaaaatgttagtcttattttgtgacaaacaataaaatgttatttgtagtagactgtaaatccaaaagtttatagattttttttcttttcttttgttgagctaatgttaaaattgggtatgtcatgtactttagattttagtaaaattgtttggttgattgaatttaaatacacaatatttttcattacaataataaaattattcaaacattactaatctaaaaaataaatctctatgaaaattgtgttactctgttgtttgatagagtaatctttgttatttttgaactaagaacataatagaaaatagatttatatgtgatttgttatacaaaagtccgtcataagaaaaaatctgcatcatgggaagaatttaacaatttgaaagcagtttcttttctacataatatcatcgagctgagaaattcttacatcatattacaaatttattatctacaaaatctctcaagtctctcttgctgctgaaaatatgtgttagtaagaaatgaatttacctttaactactacaagagtacaagaccattaacttctcttttacgttccttctcttccactcttgtttttaaattaagacaaagtaagaaacagagaaaagcagagcataaagccataaacaataagatctcgaatcttgagatcaacaaaaaacgctctgttaggtacgccttttgttacaaacttacaagttcaaacggtacctcatattaccaaacgtcaccgtaggaaaattcagccaattaaagccagttaaatattgatatacacataattaaggatttaatggagactttttagtttcaactatgagctataatctatattgtaataatggacttaattagtttttttaagattccaacaacatgcacgttactcacatccttttatctcaaacgtttacttctaatatatatctttgcatatctctttagaacaatctcatcacttacccttaaaacatctcttttctgtctctatctctcccactcttgtcttgtctcaagaagaaa

SEQ ID NO: 4910 - DNA, 3000 bp, Unknown
  misc_feature (1)..( 3000): cDNA_ID_1826514_gDNA_ID_1620745_Annot_ID_49693 3000 nt of promoter + ATG
tagtgcttcgtcgatggatgatagattccataaggttcacggtgaagttccgacccacgaagtcgtttggaaaaaaactgatttctttggtgaaggagataacaaggagtttgttgatattatttatgagaaagcccttgatgaaggcattgcaaaggtttgtgcttgtaaagtgtttgatgatattcctgagagagttatgtatttggtgaagtgggttttgaattgcatagtttttggtttctggggtttatgtagattactataaaccggccagagagaagaaatgcgttccggcctcagactgtgaaggagcttatgcgtgcgtttaatgatgctagagatgatagctctgtaggagtcatcatactcaccggcaaggtaaagctcttggtatttgaattgatatctgctagttaaatgctatgaagcattaaaatgtaatagaagaactatatcagagttaatttgcgtatgtgtatgaacattgaagatggagtctaggaagaaaaatatggatttaggttattttacttaagtcagtgtgtctagctatgagctttgtgttgagtctcataagtgccaagatcaaatcctacatttgagttgatgactgttgacaaagagttcgattgtattcctatttttttgtttttaatttgtttgtgaaacgattgttctgaatagtgatattgatggtttagggaacaaaagcattttgcagtggtggtgatcaggctttgagaacacaagacgggtatgctgatcccaatgacgttggccgccttaatgttcttgatcttcaggtatgtccttgatggacaagacaataaaaagtttgggtttcctcatccttatcgggctcatgtattttccaccttccttcttctgtttctactcaggttcaaatccgcagattgccaaagccagttattgcaatggtaagtaccttcaaacaactgctcgtttactgtatgcatctttgtactaatcctggattagctagttcctgaggttgatctgtttgattttggactgagtcaggtagctggttatgctgttggaggaggacacattttgcacatggtctgcgatctaacaattgcagctgataatgcgatttttggtcaaacgggtcctaaggttttccctctagcttctgtttcagccttgaattgactgtgtaagtgaagtaagtactagagttattactaatccccactgattatgtggattgacttgatgtctgcaggttggaagttttgatgctggttatggaagttccatcatgtctcgtctggtaattgaactcactattactgcaatgcaatatccaaaatctaacaaacataggctaatcaaagtgtatgaatgtatacaggttggtcctaaaaaggcacgagaaatgtggtttatgacgaggttctacacagcttctgaagcagagaaaatgggacttatcaatacagttgtaccggtaaattttaccagtaaaccccatagtgttgtcacagatacacaaaaaaatcagtctatttgttggtaattgttttgttccttcactgagacctatttttctgttccagctagaggatttggagaaagaaactgtgaaatggtgcagagaaatcttacggaacagtccaactgcaatccgagtacttaaggcagcacttaatgcagttgatgatggccatgccggccttcaggtacctccttcaatcaacttgcttagtctttttccgttctaaaggaacaaaatcctattagtcaaatttgcaatctaagtcacaaaatcacaatttggataggttcagttcttatgcaacccactagcacacagttttttaacggatttacaaacttttcttgctgcagggactcggtggtgatgcgacactcttattctatggaaccgaagaagctactgaagggagaactgcttatatgcaccgccgaccaccggacttctctaaatttcaccggcgaccttaaacacatttctagctctgttcaggtgttttcattagagcatttgttctcattccaatccaagtctcttttttttttctttttttttttccattttttttatttgtttaccaaactatgaattaacgattttatgaaaataaaacgggaaacgttcaacattaaaaaaaactcagcattaccaaacagaaggaaaaatccagagttcaagagatcacaaaagccttgcctcccattgaaaattcattccaggacaagaagttactttaatctctaaaccaaaacgataattatcaatcaatcacatacatttgcagtggtgacatttgcatgtggtgaagagtgattgaaatgacggaacgaaatgagcagagcaactcgttgggaagtagagtgctgctgagtgctgacagatactcatgatacagataaacaaatttacatttacttataatatagatttatacaaaatatgaattgttgtaaactgaagttttttaccaaacaaaaaactgaaaaaaaaagaattgaatgtaatcaaaattcaggctgatgagagggagtttgtttagttctaattatgaagcgaatatgtatgtcagtaacatctatgagattccttctgtgagctacaacttaggttataattccaaatgtcttgtctacctgaaaatagtaaaatattgatatctcacacattcattatattaaaggatttgagagaggcttttttatattcaactatgagctaatatctataggtaataggtgtaatcatgaacttaattaattagctttgttcagttccaatatgctttttacttacgtcatttcatgtcaaacgtctgcttctgtagtatagtgctcataaacacaaagcccttcaaatatctcagtatatatatttgcatatctctttgataaatctcaactacgcttatctcacttacttctattctctatctcattctattctactcttgtattgtctcctcaagcaacaaaatg

SEQ ID NO: 4911 - DNA, 3000 bp, Unknown
  misc_feature (1)..( 3000): cDNA_ID_1807686_gDNA_ID_1620745_Annot_ID_49694 3000 nt of promoter + ATG
attccacatcgaaagaggaagaaaacgctctcgaggcagtctcaaagagtacaagagcgacgagtatttggaatatagactgtaagtttccatttcagtttcaaagtactcaaagatctcatttttcacttgtggttttcatttgttttacttcttattgaaggtattggtgttcatttggtcctgagaactatggagaaggtggtggtgtgttacccagtaggaaatatcgtctcaacactagaaatcgagctgcgagacctcaatctatgagaggatgtacatgtcattttgtggttaaacgactctatgctcgtccttcacttgcgcttcttatatacaatgagagacgacatgtcaacaaagctgggttcgtttgtcatggacctcttgatagagatgcgattggtcctggtgctaagaagattccttatatatgtaatgagattcagcagcaaactatgtctatgatctatcttgggattcctgaagaaaacgttttggagaaacatattgaagggattcagaggtattgtggttctgatgcaactgttgatagtcttgcctctcagtatgttcataaacttgggatgattatcaaacgttccactcatgagctggatttagatgatcaagctagtatcaagatttgggctgagcgcaacaagaaatccatcttcttttatcaggaatcttcggagacggatcagtttatgttggggattcaaacggagtggcagttgcagcagcttgtgcgttttgggcattgtagtcttgttgcagctgattcgacttttgggataaaaagacttaaggtaaaatggatcttgttcttatgtctgtctctgcttttgtgaaatttatgtgctttatcctgatctcctaaacattgtggcagtatcctctgtgcacgcttcttgtatttgattcaagacatcatgctctccctgtcgcttggattatctcgcgtagctatttgaaatctgatgttgagaagtggatgaaaatactactccaacgcgcccagagtgttgagcctggtttcaaaatcaatggctttatcattgacgatgctgcaacggagactgatcccataaggcatgaatgatggttcttcaactttgtagaaagcttcgaaaataggataaacagtctattgtgaactgactggattcattttttgtgtttccagggacacattttgttgccccatccttttctctctctggcgtgttcgtagatcatggcttcgaaatgttgtgaagaagtgcgatagcattgaggttcaaagagatttattcaaatgtctaggagaactcgtgtacagtatttgggatggagtagatacaacaaaggctttagaaaagttaacgcaggattttgttgatcaaaccgcgttcatgcagtatttcacatccacttggttgcctaaaataggttagggccttaacttttcaccttctcatccttattatatagaacctttgggaacaccgcaatcaagttcacatgtactcggtcttagtgcctcatatcttcttcaattattgcaggaatgtggctttcaactatgaaaagtcttccgcttgcaagccaagaagcatgtggtgcgatagaagcttaccatataaagctgaaagtaaaattgtttgacgatacacacctcggtgcccttcagagagtagattggttggtacacaagctgacgactgaacttcattctagttattggcttgatcggtatgctgatgaaagtgattctttccagaatgttaaagaagaatacattgcttcaacatcatggtaccgagcgatggagattcctgactctgctgttacactagacgaaaacaatatccttctagcgaaggttcagtctcagagagatagcgatgtaacacgagtcgtgtggaacccaggttcggagtttgctttctgtgattgcacttggtctttgcaaggaaatctatgcaaacacatcataaaggtaaatacaatgtgtgaaaaccgcgaaggatatggtgactcaatgtccttgcgttccttcaaagagaaactgagaaacattaagatgaaacctatggatgactcgatagctttggatctgtcgatggcattgacgctgcagatgtttgatcagataaagcagttggtgcgattaagcggaacaaatgatatcagcaatatagtcaatgatttgccagtgaaatggggttgtaagaaaggccgaacaaccataggcattcctgcatctattgctgcctttacaaagaaaagaagccagaaaagaaagcgataagtcagagatgagatgagaagtggtagcatagatcacttgtattggcttacaagaacacggcaggttgttgcgtagcttcagagttagagaattcatagacggttagctatagttataggttcttgatagcagccattactttctccgttgctttttctaagtgtaaatcctctaggttaatttgataatttcattgcaatatattcaagtttttgggacaaaaggattttttttgtgtgtggttaacattaataactgtaaacagagtttatttagtagatacatcagaggttattttgaatggaaaataacttcaagaggaatgaaacaactcttttcatataacgaagaagctgggcgtattacagtcaaatcttaaacttttgattgattttgagtattatgcgcataaaagggtatttatggaaataactacaattgaaacgcacgttttcttgcgttttgccttatcttatctcatcgtcaaaaacgtttttatggaaagagacagagcgcgaagcaattctgtccacttcctctgattctgcaaagcttgaaccttcttttaggaaatttttaattaattttgttgtcttttttcaattgaaaaatgtattatcaccaccattgtcaaagcccatgctctagaatctttggtagtcttcatcatctttctctatctctcgtcatcctatccaatg

SEQ ID NO: 4912 - DNA, 3000 bp, Unknown
  misc_feature (1)..( 3000): cDNA_ID_1807690_gDNA_ID_1620745_Annot_ID_49697 3000 nt of promoter + ATG
tcaatataagagaactaagctatttaagtagagattctaggatacaagatcatatatatcgaaatgtactcacgagaagtgagaaacttgtaaaaattgtttcttccaatcacttctcagcattcgacagcgtgcaagtgcgagaaatagagatagagagaaatcgtgacttgcgatttaatacaacttatttagaaggttgatttcttcacatcataactaatgaattattaagtgcgacaagaaaaaaaaagaaaagaagaactgttaaatatgcattttcatataagacaaagaaagaagataagaaaagtttttaaaagaaaagttggaggagttgtggagacaatagcaaagcccgtgaagtggtgcatgtgatcactaaaagagatgttataatcaactgcccattgacaaaaatatagacccaatcacatgtctcatccatttttacatgcacacacacatatatattacatatatatgcaggtgtgcaatgtttctcttggaagaaactaaatacgacaaaattacctcttaagaaactgtcaaggtgagctcatcattaaaagaaaataactttggattcattgaatatcaactaatagggtcttaatagacacattttacgatgaaagcaaattgaatggaaacatgcagttttttttcctttaagttaacatattaaaaggtttaaatcaataatattcttaatctagttaaacattagatacaatattttcatcaacgaaaaacatttctttaaatgaaaaaaaaaaatctatcgatgcaaatggcaaattgcacgtatagatttcttacatttttcatcactgataaattgcaaaaattctgtaattgttggtctgattatagagtgctagaaaaccgcaactggtttgtaacatgtaaatattttaaagtttattggtccgtactaaaaaaaaaaactaactttataaccattctgttcaaagttcttatattatgaattaaatttatgattcaaaaataatgataaggtgtatatttaactcaaaaaagtcactcaacacacttgtaaatgaagataatttacacatgatgaaacgaattcgtgataattcaatatcctatagtaaatatagagaccataagacacttatctgatcaccacgatggcacatcaacaaacacatctatacaaaaatgtttatccctatatgtatacattaaaaaaaaaccacctcattttcacgtagccccactctatggtgcatcatatgcctatattattgtcatatataagtgagtatatatgtatttgtatgttactagatgaggttttgcaacaggaaaggtatatgtgtttgtctgaacaggtgcctctttgtggtatgtttgtcttggcttgctctagtgtatgtttcagccaaccatagtggatgagtctcaaccaacctttagtatacacgtggcgcacacatatcccctgaaattatatatcctaatttataaactaataatctccaaaaaaacagataaagagaaacctaatcatctccaatgctatttgtaaaatcctgaccgcaacttttaatgggttccatgtcatttttcgactcatgggtctaatctcatacgacggccaattcgctacatacggaaagttcaaaatcggggcgttacactatcacatttatgataacaactattaatatgtagatatgtgtttattttgcgtccgaaaaactgattctattggttaatcctgaataacaccaacttttgagttaattagattgttgaaattactcgttaggattagtataacttgtttcctcggataaatgcatggactttaagcctaaactgtccaaaatctctaataattatttaaaggttgcttgaaatatctgaaaatatcaaaacacaactccaacgattattccaattaataagagttggatagtgattagaaggaactacgtacccaaactatttttatgaaccctatccagtactcagaattatacgaaccattcttgaagggtatagttcgatgataattttagatactcaaattacttgtccaatatgtatcacttcttacccgaaatagacagtcctgaattttggcatcaacttgtattttagtttgtgtagggaatatattccaggacagtttactgcagttaagaaaaaaacactgtaaaaaaagttcatagagggttgttttcaataatagttttactgaataataatgattaggatactaagattacgtgctatattataatgaaacttattaaaaaattggatccaaatcagtaatcacacaaaacaaaatttaatgtggatatgtaataatacgatagtagtaaccttggggttttaagcttacagtactgtcaacgcttaggatttttaagtttatggcttaatttggtaaatgacaatagatcagaattttgtattactagaaatgattcccattatatatctcatgatttctatgttgaaactgaaaatttcataagttacttttccaagataacaaaagaaggccaaaaattgggatgaatacaagcctcatattttagtgaatcattaaaaacatactaatattttagtggatcatagaaaataacatgttacagaaagaaccacatatcagtaaaaccgtacaagattattccattttgtttcttgggcaaagaagttccattgtcattttctaaattactatcgtatatatctagtgcaatatttctaagtttatgagaaaacaatatttttaaaaaaactttcgtcataaaattccattttaggctcccgtgagtcgttctatattcttggaccgattccttatataaacccccacaaattcctttatctttttattcattctataacaacaacaaataaaccaaactctcttcttcttcttctgcttttgtctcaaaccattacaaagagaacattttttgtttagtaaagaaaaaacaacaaaaagacatg

SEQ ID NO: 4913 - DNA, 3000 bp, Unknown
  misc_feature (1)..( 3000): cDNA_ID_1826502_gDNA_ID_1620745_Annot_ID_49698 3000 nt of promoter + ATG
taagaaactcaattagaatctctttcagtaccatggaattgccaggttgaaggaactgtgtttttctttttcttttcttacatataaaatggttcttgacacggcgcagatccacttggtcctcccattccactccatctcttatgcattctctacacaacgaacaatcacgcggccgagctactgttgccctcttcctacctgttttccacgtttgcaagtcaaattaatttgccgccaaagttctcaggtttcatcagaatctcttattgttactcaaaagcaagtaaagacatttgaaggaaacttgggaaggcttttacttcaccttggcccatgtcttcaatgtcaaaaactttcttggggcagacttttacgagttcttcggcatgtttaccctcgaattcctttagtagaaccacctaagatattataaacaaaaagcattaccggaaaagcctaggacgagtcaagaagaaattaattaagtccttttcccagaaggcttatggtgaacttctcacctcaggaagcattcgataccaagccgttgctactggggaccactttgcatgtgttttaccaatgcccttaacggcatgagcctcaagctcgatttcctgcaagaagaagatgcaagtctttcatctctcaacggaattaagtcctcaaaaatgtcacaattaaggggaagagtataaatagaaacagtacctggccagggccaagttttgctatcaagatatcttttaaggttggcctgataggattttcagcaaattcagggaaggaatcttggctatggttgaatgaagtgtaagtttttggcgttgtggttgaacctccagattctttgataagctcacttccatttggtaaccatttcaattcgcttgttaagacttcaagaaataaaaaaatgatacctctcatgagatctcgagctaacaataaaacaaagactcttcttgagcaaaccaaagaacatatattacctttacgacgcgggtcaccttttagacatttcacatggagtttgaaaacaatggtgttcttttcatttggctgatcgttttctatgacacaaagataaacaacaacaaaactaagcgtgacacaaagagtttatatgcttaatgagatggatcacattccacagaatatttcttaccagataaatattcaaagagtctcggatctgcggcaattggaataagacccaacctgtgagcaagaacttcgtcttgaataaccgatgtgttgtttgctacatacactttttcaatagccattgaaggaagctgtaatcaaagaaacactattaaccaaagattctaataatcagagattcatcagaggtagtgagacagtgggcagacctcagctaagaggattcttcggaaagcattagcgattcctgcatggacaccgatcatatcgaataccatatctgtctctgtgagactaatcacatcaactttgaaatcctcagagaagttttctagtctcacactgttgtccactcccatagaggaataggcacccgagaaagtgatagccgtaggctacaataaaacacaaaaagaaagggaagaacattaaagacttcaaatttcaaacaatcatcactcaatatcattcggatttcgacaaacccacagtgtaatcttcttaaattgctaagaccaaactcagtaaattcacagctttctacaagcaagttttaaactttactctgtaaatctacacgaaatcgatgaacatagcaaacccacatgggacacactgagaaaagccaataaatttctagttagctgaacttatacatagcttaaaaagagtgtaaattttgatcgagaatagtacttacatgaatattagaatccttcttacagacaacgcgagttcgctggagctcaagatgcggaggaagtccggtaggaacgtcagggagatcaaatatgttgaagttcttcgcttctctcttttcttcatcagtcacaatccttgttacttcgttagtccccatccttctctgcagccaagttcgattgtgagaatccgaaatcagggtttaaggagaagaggaagatgaaaattgcacgatttcacttttcacttcaatttcgttcttcaatttcataaaactggaaaattagggtttatggacacgtgtgaatactagaaaaaaaaacatccatttttctaatagcggcatggcttaagtccgaaccgaagcggctgaaccgtccaaccggagtttggttgatttctgacttttaaaattttcgttaccaccaaaccgaaattctaatcttaagtccgaaccaaatcgacatttttttattttttaattaaccacatattagttaaaagataattatatgattggtcgccgaatatggaaaaaaaatctacaaaacaaatttgagaaaacagtaaacgaaaagaacgaactaaacaatctgtcttataattaaacaaatgagatatatagaaaatcatgaaacgagaaatataacattcgacattttgtttgattttctactatataacttttccaaatataagtagaaatgtcgatttctaaacaaacccgatctgaataatcatattctccaaatttagttatggcagttcaaacccataatggtgaaggttctcactccagtattttttttattatagcataccaagataaccagaagaatgagccaagaaactaaacaaaactaaaaccaaaactagttccaatcaactcaaacacgaaagtagataaataacaaaccacatgtgatttcaaatttagtttagtctaataaaaaacaaaaagactaaaccggacgaccatacattgggtccctatcgtaaattagcaaacaaattagtgttgcccattttaaaagtttgaactcttctttatttaaaaaaagaagaagaagaattgaactggtcaggaagaaaaaaatagaaaaggagaaaaaggacagagggaaaatg

SEQ ID NO: 4914 - DNA, 3000 bp, Unknown
  misc_feature (1)..( 3000): cDNA_ID_2052106_gDNA_ID_1620745_Annot_ID_166631 3000 nt of promoter + ATG
ctttcatagacgagaaggtgaaggacaacagaggaaatgtatcattagtgattcaaccatgctattagatccacatactcattcaagatggcactgatgttatttcttgccatataaaacagactgacgttatcctgtggctgtatgcagaaaataggatgtcaggatgggaattccattacgaaaggacaacagcatgtatcccaaccaaacaataagttgcattgaataaaacattgtgcatgtgaaaaatacattctacgatctttttaaagtcaattttctgctaatgcaatctttttctaccagctagcatttggatcagatacaaatcaattaccttgcacacagaaaggtttgaggagatttgactgaaagcttgagcattctgccgtagacgctccataaccgcatcacttagacctaggagaataaaagtttggaaaatatatatgagaccgtaaaaatgtgacaggtgagaaaaaggtatcaagctaacaagattgagttttcttggcacaactaaggagatgagacaataactgagagagtccaggaactctccaacatcgataatgcctatattcaggcatgaacaagatgaacaacaaattgcctagtacatttgattgagatttcaaacaagatgcagtttgtctttctaaaataatctttctttacagttacaacctttgcaggagagggaaggaaataataccgacaatactgttacggtgttacccaaatagtactaaccttcaaaaggcatgcgtgcactctggcacatatggttcatggcatatgtagcattttgttgtggctcagttgagaacatgttcagttttgggggtaaatccactacctaaatcaaggagaaatcagttacttgtgtgttgggtatctcaaggagaacaaatttgtagctgttttgaacaaaaaaccatttgtagccaataacctcttgtaaagcgaactataacctaggccaccaaccgttatctggttatttactaacattacatacctttctataactaaccttcgtgccagtactatgttcttccccttttcttcgcttttgctgaaaaaaaggatttcaatcttagcccagacaaactcaaaagtcatgaatttaaatagttgaaagatattagatagcaaactggcagttattattaatgttaaaaaggccccgtgtcaagacttatgtttgtatgagtcatatatctgcttgtacaactcaagtcataaaaaatctatctatttcttcagcccaacttcataaaaaaaatatgacaggatagatagtatggataagccaataaggtaatatttggcactataatctgtcaacttttttcccccatttattatatgaatcttaacactacagtgtaggccatactgcagaggatataaccaatgtttaaccatcgctcatagaaatcttatccttcataaaaagtaacatatcaaaataaacttcagaaagtcgaaaaaagcccaaggctatctgacatcactcgtttggcgatattagtttcagggtaactacagaaatcaaatcaagctttagggtcaaatcaagttccaacatgactccagagctaacagaaagccagatctatcgtcagcaatacttgttattactctccttgcacactcttaaccatactttaaacaacctttatgatatggtaaggtgtcttttcatcaatatagcaatagaactttaagcctaccttatagccaaaaaaatataaaagaacttttcccataggactttatctttaacaaagcatacacccaaagtagcgtcactatgtttttcctccttttttcatctcccaagctaaatgacgttaccaagatctctttgaataacaactaataagaagtctgcaagccacttatgaaacttaatgacaatgcattgggaacttaccgtcatccatttacatctcattgctacatcccgtacacttttatctggtagagttgctgcgatctttacatactttgtaacttgtggttcatctttaaatctacaaaagacatgacaaaggttttaggcaaacaaaacaataaaagacaaactcgaaacaacataaaacagcgcaaggtaagaaactaacacagagaaaaactcagccatctttcgtagaaattttctgatacaaaatacatctataagaatctgaatcagcttatgattccagataacaacacgagctataacagttcatatgaaacataaatgcaaaaccttttccttcatctacatataaaaatttatctactctaacattgtataatagctacgaagtgagaaaatttgcagagaacgaagaacaatggagaataacaaaaatacttactttgaaagacctttctccaatatatattgttcctcaacagaccaatcaacagccaaagaagcttcatgtttgagtccagtaaccgaagtcggagaatttacagtaagatgaaatccagaagaagcattcatgctcgaagtcgccgaaaacactaaaccggtcgtgctagtactcggtacgcaataattatccatcggaatcatcactcaaaagctatttcgtagagattaagttgacctacaacgaagcacgcccaaaaacatgttcaatttagggttttagcaatttcagaatcatacggaaaaaaatccgattaaaacccaacagaaacctaaaagagcaaaacctgagcaaaacccacctcggatttagccaaaatagaagatgagtatgcttctccgtagctcgatagatggcgtcgatgcaaaaaccctaaacccccaacgattggtgatgaaagtagagatactgaaatcgtgaagctacaaaattcagagagatcgcaatagagaagaagaagattgaagaatcgtgattcgattcgcgagagagtggtgacagcaagatgatgcgaagaactttcgaattgcagaagctggcgaggagagagagagagaaaatg

SEQ ID NO: 4915 - DNA, 3000 bp, Unknown
  misc_feature (1)..( 3000): cDNA_ID_3074850_gDNA_ID_1620745_Annot_ID_166628 3000 nt of promoter + ATG
tgggataaaatgttgtccactcaatgactaaaacacccttataaaagttacttaatttacaaaaataacctaaaaaccctaaaacccttctctttagcaaagctttccccttttcagtctccaagctctcttctgcggaactcacggtacgaaagtctcctcttttctatttactttaatccgaagtttgctcctttacttttgatttgttggagaatttcgaattctaaatttgggttttgtctctgtagagtaaacacgaagtaaaaatgataaagagacgattttacaagcttgagcatggtgataaagacagtggatccgattcatcgtgcttctcttctgactctgatcctgagacggaagaatcagaacaatctgaagaagaagactctgttgcagaagtttccgaggacggtgatgattcaggagatgatgaatccccaggtttgcttcttcaattgagcaattatctcttttagttctcttgtgattgtactctcagagaacctttggtaaaatctttgcttattctctgttatagctgctggcgaagacgctgatgttgatgatggtgatgataactctgatgctgatgactatggtgggacattggagaagatgtcaatgaatcgttttttagaagaaccacccgaagaagaggaagagaactatattctcggttgtatgatacaatccaaatcggtttataaatgcagatattgtccaaccgttgtttgcttgaatgagaacacaatgcaagcacatgtttcatcaaaggtaaattaggtagctttgaattagcatttgagtgtttggtcctttttggaatcaagtagtagatgataagcacgggattagttttgagcttttcctcatcagtcttgtagttgatgagatagtattttttgtcgtttgactcatttcagaagcatgctcgtatggagaaattagtgaaagaaggaaagattagaactgatgacgaagaagttgacgatctagagacagcatctcaggttacattagagaatttgccaacgagtgctttttgttttgtcaatgagtcctaaccaaattcttgcacaaatcttaaatgtaggagaaggagaaaaaaggaaacagaagatcacaaagacagggaaagagatctcaaaaacaggaaaaggtaaatgtagcttgctcaatactgaagcattgtgaccatggttggtttgttggaaacctaattgattcgtgttttcaatataaacgtctaggattcattgaccaaaaatggagaaaacgaagaagttgaagatccagagacgccatctcaggtgagatttaagacaatgccatcaaatgcttgtgttagtccaatgagtcctaaccaaagtcttgcaaatatcctaaatgtaggagaagcagataaaaggaaacagaagagctcggagagagcttaggagatcacaaaaacaggaaaaggtaaaatttgcctgctctataaccctgtgaccatggttgacctgtcaaaaaccttatctattcgtttcttaatatgaacatccaggattcatcgaccaaacatggagaaaacgaagaggttgacaattcagggacgccatctcaggtttttctttttgacgttcgagcaaatgtcaacaagtgctttgtgttcttcccatgagtcatttactcaaccaaattcttgcaaaactactaaatgtaggggaagcagataaaagaaaacagtagagcacgaagacagcgtaagagattagaaaaacagggaaaggtaaaagtagcctgctcattactgtaaccttgtgacgatggatggtttgtctgaaaccttattgattcgtctttttaatatgaacatccagggttcattaaccaaacatggagaaaacgaagaagttgacaatccagagacaccatcacaggttttctttttgaattctagcaaatgcaaacaagtgctttgttattcttccgctgagacctaacaaattgtttcaaaaatcttaattttaggagaagcagataaaaggaaacagtagctcacgaagacagcttaagagatcagaaaaacaggaaaaggtaaatagcctgctcataattgtatccttgtaaccattgttggtctgtcaaaacccctaatcgattcattctttcttaccaatatccagattccatcgactaaggaaggagaaaacgaagatgcatcacaaaaatctagaaagaaaaggcgtcaaactaaggattgaaactgctgtattgcccaatatggttagccagaaagattcatctttttttacttggatgtcgatgaatagatgaagaaacataggttgagagtgagttaattatgtgctttttaaacttcaagttttgtctaccaaatacggtgcttgttataactgatatgattttgataattgagttatacaattcttttttacaagttgtatccttttttcatttcgaaccatccccctcttactcaacgagagagattgggaaataattgcttgaagcagaaaatcgaataacagattagttgaattaaaaatatgtttacttgaaactatgttcctccaataccatcaatgatctctggcatttccctccaatttctgtcgttttctcttcccaagtcagcactcagcacttgtcttgagaaagttcaaagacttgagtgaaaaagacaaaaactttaatattttcttctcttcttttaatcttggtctccaccataaacaattattgatctacatatctgtgtaaaacagtggaagtgtacacacgaaataatatttttatgaatgcattgaaaaaggaaacaagtgagacaagtgagatttgattaacttctcctactgctcttaaagtatcaagaagcattggcttcacgtgacatcttcgctgtcatgtccgtgatcgagcttcttcatcgatgccacttacaactgctgattctatcatgacttggtaaaaaatctcttgaattccattatg

SEQ ID NO: 4916 - DNA, 3000 bp, Unknown
  misc_feature (1)..( 3000): cDNA_ID_3074861_gDNA_ID_1620745_Annot_ID_166624 3000 nt of promoter + ATG
cgttttctatgacacaaagataaacaacaacaaaactaagcgtgacacaaagagtttatatgcttaatgagatggatcacattccacagaatatttcttaccagataaatattcaaagagtctcggatctgcggcaattggaataagacccaacctgtgagcaagaacttcgtcttgaataaccgatgtgttgtttgctacatacactttttcaatagccattgaaggaagctgtaatcaaagaaacactattaaccaaagattctaataatcagagattcatcagaggtagtgagacagtgggcagacctcagctaagaggattcttcggaaagcattagcgattcctgcatggacaccgatcatatcgaataccatatctgtctctgtgagactaatcacatcaactttgaaatcctcagagaagttttctagtctcacactgttgtccactcccatagaggaataggcacccgagaaagtgatagccgtaggctacaataaaacacaaaaagaaagggaagaacattaaagacttcaaatttcaaacaatcatcactcaatatcattcggatttcgacaaacccacagtgtaatcttcttaaattgctaagaccaaactcagtaaattcacagctttctacaagcaagttttaaactttactctgtaaatctacacgaaatcgatgaacatagcaaacccacatgggacacactgagaaaagccaataaatttctagttagctgaacttatacatagcttaaaaagagtgtaaattttgatcgagaatagtacttacatgaatattagaatccttcttacagacaacgcgagttcgctggagctcaagatgcggaggaagtccggtaggaacgtcagggagatcaaatatgttgaagttcttcgcttctctcttttcttcatcagtcacaatccttgttacttcgttagtccccatccttctctgcagccaagttcgattgtgagaatccgaaatcagggtttaaggagaagaggaagatgaaaattgcacgatttcacttttcacttcaatttcgttcttcaatttcataaaactggaaaattagggtttatggacacgtgtgaatactagaaaaaaaaacatccatttttctaatagcggcatggcttaagtccgaaccgaagcggctgaaccgtccaaccggagtttggttgatttctgacttttaaaattttcgttaccaccaaaccgaaattctaatcttaagtccgaaccaaatcgacatttttttattttttaattaaccacatattagttaaaagataattatatgattggtcgccgaatatggaaaaaaaatctacaaaacaaatttgagaaaacagtaaacgaaaagaacgaactaaacaatctgtcttataattaaacaaatgagatatatagaaaatcatgaaacgagaaatataacattcgacattttgtttgattttctactatataacttttccaaatataagtagaaatgtcgatttctaaacaaacccgatctgaataatcatattctccaaatttagttatggcagttcaaacccataatggtgaaggttctcactccagtattttttttattatagcataccaagataaccagaagaatgagccaagaaactaaacaaaactaaaaccaaaactagttccaatcaactcaaacacgaaagtagataaataacaaaccacatgtgatttcaaatttagtttagtctaataaaaaacaaaaagactaaaccggacgaccatacattgggtccctatcgtaaattagcaaacaaattagtgttgcccattttaaaagtttgaactcttctttatttaaaaaaagaagaagaagaattgaactggtcaggaagaaaaaaatagaaaaggagaaaaaggacagagggaaaatggagaaaagtagagtaaaatggcgtcacaccagagagaaggcacaactcacggggaaatcagcagaaccaataccaccgccaccggttactattactattcttgttatcatcatctcccaaaaaaaaaatgttagtattattttcgagtctatttttcaagtttttgttttgtttttaatatctcgactttgccacccaactcctcccactccttcacaactgtgtcctgtcctctgctgatttctcacctttccatcattcatttcattctttcttttttcccatccgtttcttttattcttctttctccttaaatttaaaatctttgaattaaattattggattttattgtttcaaagcgtttctatcatcaaaacccatcttcttcttcttaagattctgaatcattcattgattgatttagcttctcttcgacttcttaattttacagttttttttgttttttaaactttaattgatgcaaataagcaaacttggatcgctgtgagcctgtgataatgatttcttttaggtttgtaggatctgaaggaagctacggtttatttttttttatgggcaatctctaacaggtacaaatcttctcttagcttctctcttacaagatctttaggttatgtcttgttctttggagttgctatctttcttccatgttccagaggtttgccttattttatcacttttgacataataatttattttgcctgttttttgttacttggtttaatattcagatgaatctttgaccatgatctctaaatttggttcctaggcaagatcaaagaaagttcatcacataggagttgatcatgaaccatagtttcctcaaagatctcaactttgtctctagttggattgtaatctgtattgcttaggacagttaaatcttattacatcttggctcgtcatgtcaaaagctgaagatatttgagctttcatatcttacaactaattagtttcgtatgtctacaggtttcttactgtaatttttctgtttcagttctttacgggtatatatatacacataaaacggttaagctctagagaagatg

SEQ ID NO: 4917 - DNA, 3000 bp, Unknown
  misc_feature (1)..( 3000): cDNA_ID_1807690_gDNA_ID_1620745_Annot_ID_166620 3000 nt of promoter + ATG
tacaagatcatatatatcgaaatgtactcacgagaagtgagaaacttgtaaaaattgtttcttccaatcacttctcagcattcgacagcgtgcaagtgcgagaaatagagatagagagaaatcgtgacttgcgatttaatacaacttatttagaaggttgatttcttcacatcataactaatgaattattaagtgcgacaagaaaaaaaaagaaaagaagaactgttaaatatgcattttcatataagacaaagaaagaagataagaaaagtttttaaaagaaaagttggaggagttgtggagacaatagcaaagcccgtgaagtggtgcatgtgatcactaaaagagatgttataatcaactgcccattgacaaaaatatagacccaatcacatgtctcatccatttttacatgcacacacacatatatattacatatatatgcaggtgtgcaatgtttctcttggaagaaactaaatacgacaaaattacctcttaagaaactgtcaaggtgagctcatcattaaaagaaaataactttggattcattgaatatcaactaatagggtcttaatagacacattttacgatgaaagcaaattgaatggaaacatgcagttttttttcctttaagttaacatattaaaaggtttaaatcaataatattcttaatctagttaaacattagatacaatattttcatcaacgaaaaacatttctttaaatgaaaaaaaaaaatctatcgatgcaaatggcaaattgcacgtatagatttcttacatttttcatcactgataaattgcaaaaattctgtaattgttggtctgattatagagtgctagaaaaccgcaactggtttgtaacatgtaaatattttaaagtttattggtccgtactaaaaaaaaaaactaactttataaccattctgttcaaagttcttatattatgaattaaatttatgattcaaaaataatgataaggtgtatatttaactcaaaaaagtcactcaacacacttgtaaatgaagataatttacacatgatgaaacgaattcgtgataattcaatatcctatagtaaatatagagaccataagacacttatctgatcaccacgatggcacatcaacaaacacatctatacaaaaatgtttatccctatatgtatacattaaaaaaaaaccacctcattttcacgtagccccactctatggtgcatcatatgcctatattattgtcatatataagtgagtatatatgtatttgtatgttactagatgaggttttgcaacaggaaaggtatatgtgtttgtctgaacaggtgcctctttgtggtatgtttgtcttggcttgctctagtgtatgtttcagccaaccatagtggatgagtctcaaccaacctttagtatacacgtggcgcacacatatcccctgaaattatatatcctaatttataaactaataatctccaaaaaaacagataaagagaaacctaatcatctccaatgctatttgtaaaatcctgaccgcaacttttaatgggttccatgtcatttttcgactcatgggtctaatctcatacgacggccaattcgctacatacggaaagttcaaaatcggggcgttacactatcacatttatgataacaactattaatatgtagatatgtgtttattttgcgtccgaaaaactgattctattggttaatcctgaataacaccaacttttgagttaattagattgttgaaattactcgttaggattagtataacttgtttcctcggataaatgcatggactttaagcctaaactgtccaaaatctctaataattatttaaaggttgcttgaaatatctgaaaatatcaaaacacaactccaacgattattccaattaataagagttggatagtgattagaaggaactacgtacccaaactatttttatgaaccctatccagtactcagaattatacgaaccattcttgaagggtatagttcgatgataattttagatactcaaattacttgtccaatatgtatcacttcttacccgaaatagacagtcctgaattttggcatcaacttgtattttagtttgtgtagggaatatattccaggacagtttactgcagttaagaaaaaaacactgtaaaaaaagttcatagagggttgttttcaataatagttttactgaataataatgattaggatactaagattacgtgctatattataatgaaacttattaaaaaattggatccaaatcagtaatcacacaaaacaaaatttaatgtggatatgtaataatacgatagtagtaaccttggggttttaagcttacagtactgtcaacgcttaggatttttaagtttatggcttaatttggtaaatgacaatagatcagaattttgtattactagaaatgattcccattatatatctcatgatttctatgttgaaactgaaaatttcataagttacttttccaagataacaaaagaaggccaaaaattgggatgaatacaagcctcatattttagtgaatcattaaaaacatactaatattttagtggatcatagaaaataacatgttacagaaagaaccacatatcagtaaaaccgtacaagattattccattttgtttcttgggcaaagaagttccattgtcattttctaaattactatcgtatatatctagtgcaatatttctaagtttatgagaaaacaatatttttaaaaaaactttcgtcataaaattccattttaggctcccgtgagtcgttctatattcttggaccgattccttatataaacccccacaaattcctttatctttttattcattctataacaacaacaaataaaccaaactctcttcttcttcttctgcttttgtctcaaaccattacaaagagaacattttttgtttagtaaagaaaaaacaacaaaaagacatgataacgagagagagtttaacgctgagaagcatcacaatgatg

SEQ ID NO: 4918 - DNA, 3000 bp, Unknown; identical to SEQ ID NO: 4910
  misc_feature (1)..( 3000): cDNA_ID_2052152_gDNA_ID_1620745_Annot_ID_166615 3000 nt of promoter + ATG

SEQ ID NO: 4919 - DNA, 3000 bp, Unknown; identical to SEQ ID NO: 4909
  misc_feature (1)..( 3000): cDNA_ID_1826526_gDNA_ID_1620745_Annot_ID_166612 3000 nt of promoter + ATG

SEQ ID NO: 4920 - DNA, 3000 bp, Unknown; identical to SEQ ID NO: 4908
  misc_feature (1)..( 3000): cDNA_ID_1826530_gDNA_ID_1620745_Annot_ID_166611 3000 nt of promoter + ATG

SEQ ID NO: 4921 - DNA, 3000 bp, Unknown; identical to SEQ ID NO: 4907
  misc_feature (1)..( 3000): cDNA_ID_1826538_gDNA_ID_1620745_Annot_ID_166607 3000 nt of promoter + ATG

SEQ ID NO: 4922 - DNA, 3000 bp, Unknown
  misc_feature (1)..( 3000): cDNA_ID_1826456_gDNA_ID_1620745_Annot_ID_166646 3000 nt of promoter + ATG
ttagtgacatctcaaccgcccaaagactagggacagttcttgggttgtgcaggtagagcaaatgtgtaggttccaaataaaattgagtaaatttgaagaccataaaaaaaattgagttattttaaggaccaaaaaaaaaaaaaaaacccaagtttgaaggccaaaacagaatttgactaagtttgagagccaatttctttaaattttgtacatggaacctaaattttttgagacgcccctgcccaagactgttatattgcattacatcagcaagaagcatatacaactaccaaactcataactctccttttggctcaaagagtctttgccgcaagaaacaagaatttaattgcttataaaaaacttttgaaaaatggtggctatgttgattttgatatgcgcgcgatcacaacgatttgggtgcaagcatctcaaatgcacgttgaagagaaagacacaatggcctctgatttattcacctttcattaatggatgtacatacacattcattcttaaacaatgattagagtaaaaaaatcaaaacaacaaataattgtaagaaaaaacctttgacacatatctcttcacatatccacattataactctagcctctagggtaatagatgattagtttctaaaagagtttagaaagtgatcgatatagggtaaagtgcctatcaaacaattaaatttttctcggattcaattaccaaatgtcaaaatatacacctaactatgattaaaaacaatagtgtctgtagagaccaccacttacaagaagtttaagctatgcatgattacacattagtttataatttattaaaaaatataataaacaattcaaggttacaaaaacaaatggagagaatcttacaataattaaaatttgaattaacaatatcacatcaataatataaattaataataacatattttttgttaaaaagttaaatatcaaagggaataaacacatgttttcatatttgatagaaaatgacatatcatacatgcatgattaacccgaactcgaatgctgttcacgatgacaacgtgtagaaatttcacaaccacgatggtaagtgttggctggaactttgacgcattctttagggttcttactagtgcaacctggaattgtgtcttttatcaaatctttatagtttatctgttttattccttctccaaatccgctgaccaatgatattataatcattattgaaacaaagaaaacatggatacgattctttttgcgtgcagacattgtttttttttaaaaacaatgtatttgaatcgtgttgatcttttctctgtgttattatattttgtaattgaataggtgattaattattatttatgtttctttgatttataacgagagatgattctaaaaaaagatggccagtgcataatgtatgtgcatgtagagtttacttgctatttatatgtcatttcagtttttttgtttcatcaaaacagaaatatgtgcaatagatttttagcatggcagcacagttaaactgttcaaccaattaagatgtatagttgtcaaactgtcttgggatttcgtagtcatgaagctatgagctgcacctccctcagggattggtcagggactcatggtggcaacaacttctagttaacgaactagtaatgttatctcattatttcgattattcagccttagcttatactaattatttcattatgctatttttctatatttatctaattcaaagtcatgatttcttgtataataaaggattagtgttttaagaaaggattacttacaagttataaccatttacttgcgaatccccaaaaaaatatatttatttatttatagatgtatgaatgtttataagaaaaagatctaaattttgtattttgactcatggacctattatcacgaacatgtatgcaaaatctcaagatgaagattcattttgatcactagttcgttaccaataagcagaatcccttatagctgaggtctgtccacttcattacagcctatggaccaatgcagaactttttgaagcgagccattatagccatgcttgtttcctagataagcctcctttattagaggtatatatgcgttacacttgaataaaatgttaagtatttggaggataacaaaaattggtagtagttatgtatagcttttataagatgctcgatgattactttaaagttagaatgtaacacatcttgaatttgatggatatttgttacatgtgaggtctactgaagtaataaattcatgttatttagtgttgttcttcctgttcagggaaaactcaagactaataaccctgcagctgattcaggccatggaaattgataccaaaatcgtaaaattagtagctgcattttgtaattggtttgtttaacaatgtatggtggactaactccttttatacaagaaatattatagtaaaaacacatatgaattcatacgtacaaatttgaaatatttaatgggaattgttacaaaaatattggatagaaaaatgaaaaacaaaatcgaaatggttgggagttgaaacgtttgcttacaagttaggtataacttttatgatggaagagtaactccaaaggttttacaactaattttttttttttggtaagtaaggttttacaactaattttgtagtatgatttaatttatctataaaaaaaattagcataaattgaacagattaataaatatgttttgttttaagaaatttttttttttccaaaaccacaaaaaaaaataaaaaataaaaaaaataaagaaaaatgtttaaatataaataacgatcctaaagcgaaaagaggtatcgaattagtttgctaactaacgaagctgtagctacctcctctctcaacggtaagatccgccattttcatcgatctccattttctgaatcaagaggtctcgaatccccactaattgaatagttagtgatctgattcgtattttatcaattttgtttgtatcgttgtgaagtatg

SEQ ID NO: 4923 - DNA, 3000 bp, Unknown
  misc_feature (1)..( 3000): cDNA_ID_2052069_gDNA_ID_1620745_Annot_ID_166644 3000 nt of promoter + ATG
cgccgtaacaagcaaatattttttgacgttaatggttagtatcttgaaatactatcggcttcacatcattttgtgcagagcaaaactgacacttgcatcttgatgattaatattttgcagaacaatatgatccagaagtgagtttagggcacttgaagaggtatacattcaaagagcttagatctgccaccaatcatttcaactcgaagaacattctcggaagaggcggatacgggattgtgtacaaaggacacttaaacgatggaactttggtggctgtcaaacgtctcaaggactgtaacattgcgggtggagaagtccagtttcagacagaagtagagactataagtttggctcttcatcgcaatctcctccggctccgcggtttctgtagtagcaaccaggagagaattttagtctacccttacatgccaaatgggagtgtcgcatcacgcttaaaaggtaatgcagtttccaaaaaaactgctaatttcttcatgctcttttgcaagtttttaatagttccatcttgctacattttttgtttagataatatccgtggagagccagcattagactggtcgagaaggaagaagatagcggttgggacagcgagaggactagtttacctacacgagcaatgtgacccgaagattatacaccgcgatgtgaaagcagctaacattctgttagatgaggacttcgaagcagttgttggtgattttgggttagctaagcttctagaccatagagactctcatgtcacaactgcagtccgtggaactgttggccacattgcacctgagtacttatccacgggtcagtcctcagagaagactgatgtctttggctttggcatacttctccttgagctcattactggtcagaaagctcttgattttggcagatccgcacaccagaaaggtgtaatgcttgactgggtaagtctcttttctctgtttcttgtttcactttctagaatcttgaagctattgttcataattgtggtttggttcggttcagtcttgtttgatagaaaacttaaaccaaaacaaaatataaattagccgtgattttggctaaattttggttctgtttttgtgcttgataaaagactcagtttggttttctgttatctttgatttgaattcggtatagtttgaagactaaactgttattttggattcggtttggttctgtttttgtgcttgatctggaattggtttggtttggtttattggtctgagaaatgagattgttaaaaatggcaggtgaagaagctgcaccaagaagggaaactaaagcagttaatagacaaagatctaaatgacaagttcgatagagtagaactcgaagaaatcgttcaagttgcgctactctgcactcaattcaatccatctcatcgaccgaaaatgtcagaagttatgaagatgcttgaaggtgacggtttggctgagagatgggaagcgacgcagaacggtactggtgagcatcagccaccgccattgccaccggggatggtgagttcttcgccgcgtgtgaggtattactcggattatattcaggaatcgtctcttgtagtagaagccattgagctctcgggtcctcgatgattatgactcactgtttttaaaaaatttcttttcttgggtttgttttttatttgtcgttttataatgttgatatagatgtgaagttgagtgtgtaatttttatgtaaagaaaaaatatgaaatgcaaaagaaaatgttgattagcctgccacattactcaatatttgaattttcaaagtgaggtaagaattttggatggcatataaatcaaaccgaactgaaagtttttgaatcgaaatgaaccgaattgtaagctaaacgtaatttcaataccgaataaactgaattgaatacatcaagtttcaggactacaaaataattttgtaacatgtatataaaaaaaacatttgcatgtataactttttgtaattcttaaataaaattaaatttgtttaaactatgttatctccaatgcaaaaccgaaacaaatctaagattttcaaactgacctaaaccaaaaccaaaacaaaatcgaaaaggttcaaactaattactaaccgaaagaaaattctgatatagtttttctaaaaccgaaaaacctaaaaccttgaaccgagtaaaccggaaaacaaaattcctaaacatatattcatcacttaaccaaattaaagattccaaaccgaaataattcggtataaagagaatcgaactctattcggtcaacgtgtaatgaagcattaaacttcgcctcagacacactatacaaaaccaccgaacataggaattaggatggtctttaaaatcaacgaataatgggtcaagcagagtcgtaaacgtggagactattcaggtgtgaggacagaagcgtgcacctgcagcttgagagaccacacatgaaaccgttagatcacgcggctataagcaatcgcaataaacgagaagaagaatgatgtcggtccaaagtctcgtgagccgttcttatgccacgtgccttagatacagtcggtgccactctgccgtattattttggtcattaccacgatctcattaaattcctcattagtagtaattaccttaatcatctaaaattattaagggaaataattaaaatcatactacaaatgagcacctccatgatttaattaaaagtttagatccacatataccgcattacttaccacaattattgacaaacaaaaaaggataaacatacattaacaatttcattaagaaatggctttcaatttaacttttgacaaacatgaatggtggtttaaaactgaaatcgttatcttcgagagaaaccgctcttcccccaaattcaagttcatcgaaataaaaaatttaataaactctccctcacttttacattctgaaccagaatttaccattttcttaaccacttcagtttcttctccaagtttccatttgaacaaactaagaagatg

SEQ ID NO: 4924 - DNA, 3000 bp, Unknown
  misc_feature (1)..( 3000): cDNA_ID_2687499_gDNA_ID_1620745_Annot_ID_166639 3000 nt of promoter + ATG
tgaagttctcacttggggaactctatacattatttactcttaaaggcatcaacccttgatagttttggctttccctgggaatgaacctaccataatccactctcgaagacacagcacttttattaccttgatctagctgacataacttagaccacttaaatgacatgaaccccacaacaatcagagaaactcagacgattttaagcggctttccaagaagacaatggtggagtctcagagtttttgaacgtggtcaggatgctaatggatctttctcctttcacaaaacctggttgtgcaagggattcgagctcagacatctcttcgggagtaagtttcactgataaagctccaatgttctggttgaggttttcaatcttagtggttcctgggatggggcaaacatcatctccctggtgatgaacccatgcaagggctagttgtgcaggagtgcatcctttcttctcagacattgcagaaaccttctcaaagagaatcttgttgtggtctaagttttcctgttggaatcttggtagagtctgcgataagaaacagaattgaacagataaacagtgagttgattaccaacagttcatcaatcaaacaagtcatataaagcctgtgtacttgcctttctgacgtcattattgtctaggttctcaacaagcttgggtcctgaagcaaagaaacctcgtcccagaggactgtaagcaacaattccaatcccaagttccctgaagaaagagagagaagatgttacatatttaatagatagtgcatcaagaatgaggatgaaatgaaatctggttacctgcaggttggaattatatcttcttccacgtctctcgaccataaggaccattctatttgcagagcggttatcgggtgaacagcatgtgctcttctgatagttgaagctgaagcttcagacaaaccgatatactttattttaccttcttcaactagcttcttcagctctccaatctttgaaattgacagacaaaagagattgtcaagttcagctaaagttgctggctttcaatataggtcatgaagtgtgagctcagagtcaaacctaaaggagtctattcaaacgaaaaattctaagggagatgataagatcatttcaccagacaatggttcttcatgaataagctagtaatttcagaaagagtgacccaagcagaaaacatagttctgaaagctaaactcttcgactctatattagtcccaacatgtctctagccacatgtgtgaagctcactgagaagtgagaggaactatataacttccatttcatttgaaagttgcaaaaccatgaaggaagattgacaagaagagtgcttacagtgatttcgatagggacacgagtatcaattcgatgctgataatagagatcaatgcaggcaacatctactcgcattaaactagcctcacacgcagctcttacataagcaggatctcccttaaactctactttcccctctgcatacctgattccatatttggtcgcaagttccactttttctctcaccccatccttgagagcctgacaaaaatccaaactttcaacaaaaatccaaactttcaacatccaaatcatttatacagctctgaagctcagcgaatcaaggccagtgttcccatatcacaaggccagtgttcccatatctaaatcacgaactcaaatattaaaaaatatcaatatcaaaaggggaattatcaaaatcgaaccttgctgaggagaagctcgttggtctcaggaccgtagatatcggaggtgtcaaggaaagtgacgccggagtgaatggcgtggtggatgagagcgatagcttcggtttccggcttgggagtaccgtagaaagcagagagacccatgcaaccaagaccttgcgccgatacctcaaggccttggcttcctagcttaatccttctcactccgcaagcttccgccatgagtctctgtcagaagtcagaactatctctctctcttgacttgtctaggtgactcttatagagctgtgaatttaaatggagttggattggtgtgatggtgaagataaattcagtgtcaattttggatggctggtgcagttttttttttccctcttaacgaaaacaaaattgaatttgttaaccaaataaagtaatggaatcttcataagtcaaactcatttttgatgtagttaaccaaataatgtcttcactttctttctcaatcaattattaacttcttgtgagaaataaactttcctaataatttgttcacgtataaatgtttttttaggttgaaaatttgaagtacaattttctcttattagtttttgttttcaagatatatctttgaattaatattatataaaaacgcagcatgtagtagtataacattttgatcttgaaaataaaaaaatatcaatttcaaagtcttgaaaataaccttttttttttttggctatgagtcttgtgaagttaacttggtgaactctcgactcacgatgcatatcttaattgagcaacatgattcataattcatcttttcatgtctcttgccaacttccaatagagtgcattgacattatttttttaatacattatacatatatcatgcatgtttgtttctcatccatggagaatcatttttgaaatttttggatttttgaaattgcttaaaaagaaagaaaaaaactcaatttttattgtcatacaatgttttccaaaatatgtgtacatgttcttgcatatgagttaattagtgagggtttcctcaaaaagattgttgtatttttggaaaacaaagtttatttttggatattggttctgcattttacatctaatttgttttttaaatcataattttagaaaatctattactaaattaagaaatctatgaatggtttacttcattccgtaaaacactataaattgtcctaaactcatattcgctctcaagtcaaaactcttctattttcccctgtcttcatatccaacagagatctcttc

SEQ ID NO: 4925 - DNA, 3000 bp, Unknown
  misc_feature (1)..( 3000): cDNA_ID_3074850_gDNA_ID_1620745_Annot_ID_49700 3000 nt of promoter + ATG
caatgactaaaacacccttataaaagttacttaatttacaaaaataacctaaaaaccctaaaacccttctctttagcaaagctttccccttttcagtctccaagctctcttctgcggaactcacggtacgaaagtctcctcttttctatttactttaatccgaagtttgctcctttacttttgatttgttggagaatttcgaattctaaatttgggttttgtctctgtagagtaaacacgaagtaaaaatgataaagagacgattttacaagcttgagcatggtgataaagacagtggatccgattcatcgtgcttctcttctgactctgatcctgagacggaagaatcagaacaatctgaagaagaagactctgttgcagaagtttccgaggacggtgatgattcaggagatgatgaatccccaggtttgcttcttcaattgagcaattatctcttttagttctcttgtgattgtactctcagagaacctttggtaaaatctttgcttattctctgttatagctgctggcgaagacgctgatgttgatgatggtgatgataactctgatgctgatgactatggtgggacattggagaagatgtcaatgaatcgttttttagaagaaccacccgaagaagaggaagagaactatattctcggttgtatgatacaatccaaatcggtttataaatgcagatattgtccaaccgttgtttgcttgaatgagaacacaatgcaagcacatgtttcatcaaaggtaaattaggtagctttgaattagcatttgagtgtttggtcctttttggaatcaagtagtagatgataagcacgggattagttttgagcttttcctcatcagtcttgtagttgatgagatagtattttttgtcgtttgactcatttcagaagcatgctcgtatggagaaattagtgaaagaaggaaagattagaactgatgacgaagaagttgacgatctagagacagcatctcaggttacattagagaatttgccaacgagtgctttttgttttgtcaatgagtcctaaccaaattcttgcacaaatcttaaatgtaggagaaggagaaaaaaggaaacagaagatcacaaagacagggaaagagatctcaaaaacaggaaaaggtaaatgtagcttgctcaatactgaagcattgtgaccatggttggtttgttggaaacctaattgattcgtgttttcaatataaacgtctaggattcattgaccaaaaatggagaaaacgaagaagttgaagatccagagacgccatctcaggtgagatttaagacaatgccatcaaatgcttgtgttagtccaatgagtcctaaccaaagtcttgcaaatatcctaaatgtaggagaagcagataaaaggaaacagaagagctcggagagagcttaggagatcacaaaaacaggaaaaggtaaaatttgcctgctctataaccctgtgaccatggttgacctgtcaaaaaccttatctattcgtttcttaatatgaacatccaggattcatcgaccaaacatggagaaaacgaagaggttgacaattcagggacgccatctcaggtttttctttttgacgttcgagcaaatgtcaacaagtgctttgtgttcttcccatgagtcatttactcaaccaaattcttgcaaaactactaaatgtaggggaagcagataaaagaaaacagtagagcacgaagacagcgtaagagattagaaaaacagggaaaggtaaaagtagcctgctcattactgtaaccttgtgacgatggatggtttgtctgaaaccttattgattcgtctttttaatatgaacatccagggttcattaaccaaacatggagaaaacgaagaagttgacaatccagagacaccatcacaggttttctttttgaattctagcaaatgcaaacaagtgctttgttattcttccgctgagacctaacaaattgtttcaaaaatcttaattttaggagaagcagataaaaggaaacagtagctcacgaagacagcttaagagatcagaaaaacaggaaaaggtaaatagcctgctcataattgtatccttgtaaccattgttggtctgtcaaaacccctaatcgattcattctttcttaccaatatccagattccatcgactaaggaaggagaaaacgaagatgcatcacaaaaatctagaaagaaaaggcgtcaaactaaggattgaaactgctgtattgcccaatatggttagccagaaagattcatctttttttacttggatgtcgatgaatagatgaagaaacataggttgagagtgagttaattatgtgctttttaaacttcaagttttgtctaccaaatacggtgcttgttataactgatatgattttgataattgagttatacaattcttttttacaagttgtatccttttttcatttcgaaccatccccctcttactcaacgagagagattgggaaataattgcttgaagcagaaaatcgaataacagattagttgaattaaaaatatgtttacttgaaactatgttcctccaataccatcaatgatctctggcatttccctccaatttctgtcgttttctcttcccaagtcagcactcagcacttgtcttgagaaagttcaaagacttgagtgaaaaagacaaaaactttaatattttcttctcttcttttaatcttggtctccaccataaacaattattgatctacatatctgtgtaaaacagtggaagtgtacacacgaaataatatttttatgaatgcattgaaaaaggaaacaagtgagacaagtgagatttgattaacttctcctactgctcttaaagtatcaagaagcattggcttcacgtgacatcttcgctgtcatgtccgtgatcgagcttcttcatcgatgccacttacaactgctgattctatcatgacttggtaaaaaatctcttgaattccattatgatctcttcttcttcttgtatg

SEQ ID NO: 4926 - DNA, 3000 bp, Unknown; identical to SEQ ID NO: 4924
  misc_feature (1)..( 3000): cDNA_ID_1839354_gDNA_ID_1620745_Annot_ID_49710 3000 nt of promoter + ATG

SEQ ID NO: 4927 - DNA, 3000 bp, Unknown
  misc_feature (1)..( 3000): cDNA_ID_1826468_gDNA_ID_1620745_Annot_ID_49714 3000 nt of promoter + ATG
aagaacgtaacgaagagatagtgacattgagtgtacattgtatcttttattaaatgtgagagaatatccttttttgtttcttttctcaagcataaagaatgtaatcatggtatttaaagcatatgtttaatgtgaaagaaatacagtattatgtaccctaaatggaacaacttattttgatatacgttcttaagttattttttgatacataatttagtggtgatgccaatagtttttgttttagtcatacaaactgaaaggtgctatagtttttaaagggtggtgcaaaagatatcgatcgtagtcaactaaaaagtgccctaactaatgattacgataatccgttttatattggtcgaagttaggtgattaaaatatggtttctctacaagtattttgtttggacactgcaaataaaaccttcatgcacataaattctggaaccatcttcatttttttcataattaatctctatcatatatagtagtatagaccccgaagtaacttaaataccaattatgtattataaatacggattgataacatttcatatcgaaacatttcatacattttatatctgtaatgttacaaccagtctaaagccaaggattctagaaactagaaacaaattttactaaaattaattgagggaaaactcaagaatgtgtgtgtgatcattgaagaaatgaagaatgtgtgttagagtgagtgaatattcaaaagactcaaataggtttttaatgaacaatagggaacccgaggaaacgcgtgactctaagatatatgaatttattttgcacttattacttttgattaatttttatattctaacccttttttatatactatttttttcagtgcaagtaatgaatgaagtaacgagatgagagtctagtttcaaagttttgaatctttttggtcaatgtcgtctctatttgttgaccatattatacgtttgactttaaccccatttttctttaatctcattcttcttctttgcttcaatggttgacgaattcttaccgtagaagttgcatctaaatataccaaagattaatactgcgaaaatatgataaagaagattttttttttttgtactctctagaaatttgtaaacgatattattagtgtttgattaaagactccaatttttaacataatgtctatatccacataatgaatttgtgtctctactatatgtagtgttcccgtcatatatgcatttttgcgatagtcaatcggatctttgtattgcggttaattgatctggtctttcttgagcgtacaaaataaatagaattgtacgtattattagagatggttacatttggtttacattattagttaaagttaaccaataatgtaaaccaataaagttaaccaataatgtaaaccaaatgtaactatctctaatacgtatgttgactatgatgtacttcaagacaagttcatcatcacttaacgtaactaacactatattagttaagttcaagacttattgcccatgattcatttgtaaactatgaagtaacatatctctgattttttcctcttatgtttgataaattagtcattataattagtgtcttgccaaaaagtacacttctatcttattagcattctacattacaaactattaatttcactacgtatagcggtatagggagaagatcaataaggcgatcacaatattagttaagttccgagtcttgcattaccattgtcctatgaatcacagaacaagaggacgcatatatatatagtatttataaaagactaagatagtcacagaacaagaggacgcatatataattgacaaatactcaaaacatgtgaaaagataagggctattacgtcttcattaagatcccataatctttatgatgagaacttaagagccaaactagctatgtaacaaaatatcaagtttgaaagtaataaactgcttgaataagcttcaagttcactacatggtttagaaaggtttaaaatctattactttcaaacgcttttattgtgtaccaatcaatccaacaaagtatgcaatcgtactaatcaatccaacaaagtatacactcacaccggtaacatcaaaaattcaaaaattcaaaatttcatgttaccaatcaatccaacaaaatatacaatccctgagaccgagttataatttgttggaatgattggtaccagtgaaattgtgttgtcgtgtgaacatcaacacataggaggtaatatacgtaaatatgctagcaatcaagctaagtatacaaaacacttcatgttgcagtgttctattgaaattttatatatcgaactagaatactatcatggagaatgatcaaatgttgcatatcttcatatccacgaaaaatgagtacacaaacattcgatcataccccatgacagttttctagtttatacttgatagtcctcacgatttcatggtggtgacactacacaaaccctagattcccctaaagtttttgtgaaaaacgcatatgttcgattttaggttttacttctatccttgattcattacaaacctatttttatactaattcgtcgttaacctaataattttaacctacgaaacccaacctatatgggcctgactttatgtaatgatccaatgggcctttcttcttcaatgatgactttcttcattgactctccttctactttcgatggtattaaatttgacggaaaaagtaaaacgataccgtctgggtgaaaggcagagctctttgcttctgaatattattattttcttaaattcttccgtttttttttttaatccaaccacaaggatcgataacgaaatcatcagatcgccagaaaaaaaaaaaaaattgcgaaatggagaatctgagctgcagatctgcgtcaatctccatctagatgttgttgctacttcttcctctatagaaccataatttcatcagatctcgctgattaatcatccccatttggatctgatcgaaactcttagggaagaacatg

SEQ ID NO: 4928 - DNA, 3000 bp, Unknown; identical to SEQ ID NO: 4923
  misc_feature (1)..( 3000): cDNA_ID_1826464_gDNA_ID_1620745_Annot_ID_49715 3000 nt of promoter + ATG

SEQ ID NO: 4929 - DNA, 3000 bp, Unknown
  misc_feature (1)..( 3000): cDNA_ID_1826460_gDNA_ID_1620745_Annot_ID_49716 3000 nt of promoter + ATG
cactttcttggagatgaatcctttcacattggttgatggaaagccttatcctctggatatgaggggtgagcttgatgacaccgctgctttcaaaaactttaagaagtaagttttgactcttccacttttttcaactgttccgaagtcaagagctttaagaagtcatgataagtcaagagtttgggcggtatgattaacctcttacgttttgcaggtggggcgacattgaatttcccatgccatttggaagagtgatgagttcaacagagagcttcatccacggtctagatgagaaggtatcataccaataagcgtagagtaattgacgcttctggaaacaccagtttctctatgacttatgacccttttgtatatgcagacaagtgcctctttgaagttcactgttctgaatcccaagggaagaatttggactatggtagctggaggaggtgcaagtgtcatctatgctgataccgtatgtttttatatgaacaccgagaatctcctgcatttttctgcttagaagccttagcctctaaagtgtttactgaaatgttatccaggttggagatctcgggtatgcatctgagcttggcaattatgctgaatacagtggagcacccaaagaagacgaggttttgcagtatgccagagttgtcattgatgtaagatgctgctttaacttctgccaataaagcatctgaaaataaagtcactcctgacttggtcgtggtgctgaatgataatactgcttcttcagtgtgctacagcgaatccggatggaaaaagcagggctctggtaattggaggtggaattgctaacttcaccgatgttgctgctaccttcaatggcataatccgagctctcaaggaaaaagtaagcaagaagagagtagaatcatccacaaacacttcattgccccttgactacaagtataaatgaaccatgctttaaccgtttacaggaagcaaagctgaaagcagcaaggatgcatatatttgtgaggagaggaggaccaaactaccaaaagggacttgctaaaatgagatcacttggagacgaaatcggtgtccccatcgaggtatgtagacacacaatgaataaactcaagacattcccgcttaatcagtttctaactgtttttacatgtctgtttgatttcaaggtgtatggtcctgaagcaacaatgacaggtatatgcaaggaggcaatccagtacatcacagcggctgcataagcctttacaatcttatcacttactttcaaaatactctttagcgtctcttgagtttgagacgtgtttggattatgtttcacttctaatgtatcttactattcataaataaagaacaagtatcttcttttttcttacttggtattttctcttttgattctcatcttcttcttgacttagatcagaagaaaacgtatttaatcaacttttatctagcaactccaaaaattctactaggaaataacgatatggaatcagaagcatttaagccttttacacacgatgcaagcaatttgctgaagtggatatcgacagtcatagacatgtccatttttagacttggctattcaaaaatttggaccatttttctattaatcagggcccgtttttagtgatagctctggatattttcattgagctgggccttttctggtcatggaaagagattgcaatatctatttagccatcccaagtgggcaaaacataatctacgcttacaaaatttgtgtaaacgaattcgtctacgcttacatttttgtgtagtaaagagaagtattatgttatcctttaatcaaaaactcaaaaaggggtaaaataattgaagcctgaaaaagccaacaagataggagacaggccatgaacgtgatctgcccatcaaaaaaaactttttttttttctcggtaactttttctaaaaagcaaaatattaaaataagagagagatgtccttgttcttatgttttttcttttatcatctatgtgacccatctcttcaatctaatcacatttttgtatattaaagtgttttcttgaaacatttgtccgaaagcagaaaataaaaaggattcaaactgaaatcatgaaaacataaacaaaaaaaatgtactattctttttacctcacagtaattttgttttatataaaaagcttataaattaacaaaacttataaaaaagtgagaaaaacagagagtctcttcttttcttgttattctgtcagtatctttctgtgtgtgtttgtggattttttggcattttcattttggattttgcttgtttggtccctttcttttcatgattattatttttaaattccttttttatattggtggtgtgaatgataagagtaggcagatgagagattagatgatttggtaatagtggtgtggaattagaagcaaaccttttttgaaaaaattaagaatgttatagagattagttattcaataacaactactaccaaagtcataaaaatgatataaaatataaaccaagaagcactattagtatcactcatcactcaatagctttttttttttcagatctctaggaaaatttctcagactttcagagcattttggtgcttttgttttgcttggtttctcgggaaaattctcttcacacttttagagttttctctctcttctctatctcttgtcacagctcgtttagcattcattctcttaatcgtttcttcattcaaaaattctctctttctaagctgagtaacttgcaagtcgtcatttttcaattggggtcttctcctttttacttcctttgaattgaaatcacagagaaagagaggttccattgctggaaaatggattgctcaaattagtttctgtgtctaaataaagacagagaagaagaaaagtagacaaaagctaagtttttttttcagatatgggagagagaaaaatgagttggtgggttctttgaaacttgtttttgttcagaccaaagttgattgctttaagaagggatatg

SEQ ID NO: 4930 - DNA, 3000 bp, Unknown; identical to SEQ ID NO: 4922
  misc_feature (1)..( 3000): cDNA_ID_1826456_gDNA_ID_1620745_Annot_ID_49717 3000 nt of promoter + ATG

SEQ ID NO: 4931 - DNA, 633 bp, Unknown
  misc_feature (1)..( 633): cDNA_ID_1826595_gDNA_ID_1620746_Annot_ID_49718 3000 nt of promoter + ATG
gaattcctacatctcagtgatgatggaccccaatgagatgtagatgagatggacacaaaaaaaaaatgggctctaaagatcccagcttataaaattctgattaaacaataataacaattatggaaattttccaatagtgacatagaatcatatacaaatagggttagtgtgtaactggtggagtcattatgaacattgtatccaatcaacgaacatttcagtgcgagaaaaaaaaatgacaacacacaaaattttaggccatttcaagaatacaaaatcaggaacaggtcatagaattaggcattagaaccagctaataaacttcagaaaatataatctcccttcaatgaggtaaaagtcaacttttattccctctctatctgtctctctatctctcgtgcacacaacttttagaaagattgtctcgcaagtcacaatattcctaagttgacaatgaaaggaatcccaagttcgtcaaaccagatcctaaaccaagatcttgttgaggtatgctatttgtgatgatcatgtttataatgaatttggaaactttggtcttgagagagtttgttccgcttttgaagcttgatgtgccgtaagatgataattttgcgtatataaatttgaggaatg

SEQ ID NO: 4932 - DNA, 3000 bp, Unknown
  misc_feature (1)..( 3000): cDNA_ID_2994827_gDNA_ID_1620746_Annot_ID_49719 3000 nt of promoter + ATG
taataataataataataataataataataattggatatttggattagagaaattattgaaagtaatgtataaactattgaaccatgaaaatatatttgcgaataaatcatcaaactgaaactatcaaaatgtataagattttgaaaaacataatttcacgaaatatttttttttttttaaatctatgttttgactttttatcaaattaacaaaagcactatctgattatctcaagctgatttagtagaccgaccaacaattttatcttttaagccaaacaagtaatatactttatcataccaaaaattaatatatttatgatactaaagaaaaaactttatatatctcctctagtatatagtaaaagcaacaaaaaaaattaaaaataaatgttaagagagcgttttatggtcggcttttcacgcgtttcactttccaattttcatttcactttataagaatagaagaactccaaaacattaaaaataaggaatcagaaaaaaaatctataataaagttgtgattaaatcattagttttttttatataataaaacgcaggtgatcctaaaagttttcaaagcccaaagactaattgtaagatccgataaattactcgaattttggtgactaatgttacttaaacccaaatagtggaattaacactctttaccagtagaccaaagcaacttggtttaatttattttcttcaatttaccagatcatgatgccgtttaggaccattggactagtccatgctgagtgaaaataattcactcaaaagaataccgtaaatcagaattttccacgtttatcaaataactgactaaaaagcacacataacaaaattttcatgcatcaacttgtactaaaatttatagaaaactggcgtatattggtaaataaatagcagaaacaaaagtggaaaagttttgtggcgccacttgcgaagtgaactttggagctggagcacagctggacacgagcagtggggctgcagctgctaagtgctgacccaaattggggtcacaacctttcctcttataacggtccaatatatattaccgttatgttacatacaatatagtaatttatatatatatatatattttttatatagtaatttatattattttttgcacactatcgatttgatttacaacaagtccttttgttttttgttttttgttttttttgcacaatatcgattgtttgaaccttcaaaattcatgatagaactcccggggtttttcctttttatttttatttttttactctcaaaataagaaaatcatagtccgacgactccatttaaaagacttaaaaaaaattatggtcaaaatatgaatattttatatagatacttaatgcagaagctatagttgcactttttcctcgacaagactcttgtctcttcaataaaaaatgcgttggtttagttttatactgtatttagtaagtatatatgcttttccccacggcccacactcatgcattgatacataccactttattggtctccagactaatctggttatatgtgcccatcattaattcaaattcattaacttacgtaagaataccacccttacaaaacaacttaaaaaaaaaaacttgaatcaacatttaattaaaatttgacaaacatcgttataaattttatataactattacttagttaatttgaaaaatccgttgcttaatagttaataattaatcaaaaacacattgatttactacatattctttttatgccctcggtttggtatcttgatatatcaagcggcttgtaacttgaattcagaatctacgttttcaatgttgtttcctatgatggtcaagtggccgctacttgatttcagaatctacgttctatgatggtgaagatattgaaatgaatgttggaatttcttttattaaatttttagttggtatgactgattagccatacaaaataattaggttgcagccacttattttaacttgtataaaaaataagtgatactactaatttaaatcacctattattactttttttttatgggcacaaaatcacctattattactaattgatacttttattgatttatttaatattattcaatcaatttggtgtaaatctatattaatttccgctaacatcatcctagtactggagaaacttgatttcgtatctacagcctttctagaacaatttttatccaaaacttaaatttgtttacgttcattttccttgttccaaataaataattttctttttttgacattatgcctttgttgaagtaatgcatgtcacatacagtacaagaaaacacgagtttcagacttcagtgtaaaacaggattacatgtattgtaagcgaaaataattaacatcaagtagtcaaaatattttacactatgtaatgttaatgatgtgtaagattagcaagacttacacgttcgcggaaagtaatctaaattatatatttccattaacaaaaggtaatctagctagaattcttaattgactttgatagctagttcttgtataaacaataattcttttctcgttgatatttatatcaaagtggttatcatctatctaaaaatctatacataagaattagaatatccttaaaaattctaccagtaactttcaatagagagttatcaaatatgaatcatgattacatcagtgtttattacacacatatttacacgtaacacataattagtttcatggtcatcgttaattactctgacgataatgtaaactaaaaccgggtggatttaaccggacccatttgccatcactctccataaatcctaaccgtccatctaatcaagcgtagatctaacggtggatatcaaatcaaaggttaattccctccctatatatattagaaaattgatcctgaagcgtgtaccgtacacacatccccatacgaacactcacaatcgttaaaaagaaagaagagaagagagagaaagcttaaatcggaaaaaatggtttcgtggatg

SEQ ID NO: 4933 - DNA, 456 bp, Unknown
  misc_feature (1)..( 456): cDNA_ID_3074936_gDNA_ID_1620746_Annot_ID_166661 3000 nt of promoter + ATG
gaattcctacatctcagtgatgatggaccccaatgagatgtagatgagatggacacaaaaaaaaaatgggctctaaagatcccagcttataaaattctgattaaacaataataacaattatggaaattttccaatagtgacatagaatcatatacaaatagggttagtgtgtaactggtggagtcattatgaacattgtatccaatcaacgaacatttcagtgcgagaaaaaaaaatgacaacacacaaaattttaggccatttcaagaatacaaaatcaggaacaggtcatagaattaggcattagaaccagctaataaacttcagaaaatataatctcccttcaatgaggtaaaagtcaacttttattccctctctatctgtctctctatctctcgtgcacacaacttttagaaagattgtctcgcaagtcacaatattcctaagttgacaatg

SEQ ID NO: 4934 - DNA, 3000 bp, Unknown
  misc_feature (1)..( 3000): cDNA_ID_1826593_gDNA_ID_1620746_Annot_ID_49721 3000 nt of promoter + ATG
accttttggtatcatgcaacctaaatcagatttggagttaaagccactttggtcaagtagtagtttgaggtcaaaggttagatttttctgtaagctttagatagaggaatcagatatatttgttgctgtaggaagtttctaatagactgttgttgtcttacaacagagcggcgaattgaccaaccgtaacttgttggcaatgccggtaggacttaagcaaaaggataatgttgatgctgttgtaaagaaggtaagtatgcttttgtctagatcagtgaattactgaaaattttctgtttctaatgttagttagtttgttgtattcagtttcttcctgcgaatttcactgtcattctatttcattatgatggaaacatggatcaatggtgggatctagagtggagctcaaaagccatacacattgttgcacataaccaaacaaaatggtatagtgatgtttccaatataaaatctatgaagatcaactatatatatggcttgtaacaatgatatttactcaggtggtttgcgaaacgttttctccatcctgatattgtctccatttacgattatgtttttctttgggatgaagatcttggagtggagaatttcaaccctcaaaagtaaaattccatttacaacttcacttgtgaatttacctgagatcaaatcttggagtgccttttctaagcagtctctctacaggtacctgaggatagttaaaacagcgggactggagatatctcaaccggccttgcacccaaactcaactgaagttcaccatagaattacagtccggtctagaacgaaaatatttcataggtgagttccttgtgattttgtgaaccactttgttaagtagttctcttgataatttgtgtcttcgattacttacacaaaatgataacaaaaccgcaggcgagtttacgatagtagaggcaatatgaaatgttcaaatgctagtgaagggcccccatgcacagggtaaaatttcttaagtagcataacagtttaagacttctctatatgccaaaacacagacattaatgtcattgttttgtctgttttttctctgttttttccagatttgttgaaggaatggctccagtgttttcgagatctgcatggttttgcacttggaatctaatacaagtaattttaagagatgaatgcttataaacaaatatatctgttcttctttaaatgaaattgcatcctacttattgtttttgcggtttgtagaatgatctggttcatggttggggaatggatatgaaacttggatactgtgctcaggtaaagactttttcttctttaagaccttgcaacatcactcgtctccattagcattgtgatccgattgcattctctagatgaatcggttttgaaaatgtcgtttttagggtgaccgtagcaagaaagtaggcattgtcgacagtgaatatatcttccatcaaggcattcaaacactaggtggaagcggttatcccgataagaaggtaagatcatctacttccccacctattctccttgtatgtatacccaaaaccgataaacgaataatctcttcctaatttccacagaactcagctcgcagcggagtaaatagggtaagctacgtaactatccaaatcctcatttgtttactgtaaaacaaacagaaagttcacaactttggtcacttttttcttatgtacagagacgcggttctgcgacttttgattcaagaacagaggtgagttattattacctgatgatgaatctgctttaggaactttctttcgtctatagagcaggagtgtaatgtgtgtgttttgtgagcagatacggagacaatcaacgtgggagctgcaagcttttaaagaacggtggaaccaagcggttgcagaagacaaatactgggtggagcggtcttcaccgagccggaaccgaataggcaataaccggagattaaaaagaagtagtatgattccaagtttattgcagaggaaagctgaagagactacaacataaacagatacagttttaatcagattaaatatagagaaatgtttttttggttggtctcattgttatatataagttaatagttaatcatttacctctctttgattagtgtagttttcatgatcttctttaatggttcagtctctctccattttgattaaattccaattatatgagcatatttttcttgaaaaaagtgttcatattaaaaaattaaggataaagttcaattctttttttctcaataaaccctctttttgatttagatataaagttatgaaatatcccattaaaggttctctcaatcagtttcatataactaaaaagatttaaaaacatatatcttcttgttataaagtaaaagctttcaatcaatcatataaaagacagagaaaacaaaatttaaagtttttgttttatttttctaaaagttatttttttttcaagcttgagcattttttcaaaattaatatcaatttttgtataaaacgaaattgtgccgtatgtgatgggttacttttcaaatgttcttagaagcagacaagatcattgaccaaaggaggacaatttcaattttttcctatgtgtgtgtgtgtactcattagaaaattcaaattatttgaaacttcagttgttgaataactaaaaaaaggctaatatttaatttgtcttacaatggtgataatgacatcaatgtaatgaatctacaaattttacaactaataaaattgaaatattttaaagtgtaaagtactaaggaggattaagaataaattcagataagataaatggtaattagcaatatagcaaaaaaagaacaattatttactaaaaagacacgcttttgtgtcttcatataagcttgtcttcaacgttcggctaatccttggtccgtgctaagatcttagatcgatttctaaagtcttcgtcttcttcttcttctgataactagctttttcaatcttctgaagctttaattttttcatacccatg

SEQ ID NO: 4935 - DNA, 3000 bp, Unknown
  misc_feature (1)..( 3000): cDNA_ID_1826589_gDNA_ID_1620746_Annot_ID_49722 3000 nt of promoter + ATG
atcgcagcagcattactgctggaagcacaaaggttgtggttcttcatcagaaatcgacatctccttctgtccgaacgagtctggcagctaaaaaaccaagaaccggggcgcaccctcttaaaacggttgtgcaagatatggcaaagacttcaagtaggggtaacaaaaggtctgttacggatttaccagtttctgctgtgaaatcctcggcagcgggtaagaagggaactgcggtaagaaaagacggtagacaagcgaatcgcggactcgaatctcctgcattgatggggagaaagcggaaccgggttagatgatttttgtatgaagggtttgtttcatatgttttttgtagttaggcagagaaagcttatttgatgtagtagtttatatttgggtcaatctaatctgcaggcatagacagtgatgaatcatgatcattggtaaaactaattgttaaagaaaatgtatattaatctcattgttagtttctctcattgtcaccttttaatttatttactaatcatagagaaaattgatagaaggttgttcaatagcacgtagggatgtaaatacattagttgtaagtgtttatgatcactaacagaccatttgtgaagtatataatggtttgcaacggtttacatttgcaacgattttgcgtttgttgtcgtgttcgtcgttacatagtcacaaagtagtattaacaacatcacaaatatttgcgactacaaaaagagtaaagttcctcttttagtcgagtcatttcatacctttttctaataagaaggctaaatcacaagaaaaagtcccaaattgcatgttttcttgtagtatttgtctttgccattatcgattaatccgcttccgcaagagacaataactactgaatatccagagactaacgactccgaagacgatgacttcgacattgatgaaaccgagaaaaacaacgtcgttttgatttatatctagccacgtcagcgatacatgtggtaatacagtcagcaaaacgtaatggttgactaacacgacaaaatcaatgttagttttgatctattgttgttaagtttagattgtaaatttgaatagtttatcagttcgtgtaagaaacgaccattcatctgacaaattgttccggttaattttgaccattttccattgcatgtagttaggttgataaatgaatgaccatgtgtaatcgaattttcttttctttttttgtagacgacataaaaaaaagaattttaccggtcaaaataaaaaagcacatcgttgttaacgccgtttagtgtgtcattaactacgtcgttttcattgacacgaccaaagcactactttcctttattattagactcgcgacgttctcgatccagatcacacgaatgcatctcctttggttcgcctacaactgtgaaggttagggctgcttcgatttgaggagcatcgactcgcagggatttagttcgtaactcgaacaaacacgaggtagttttgattttatatccagttggtcgttttggaacatggttttagttacatctcaaaagtgatactgttttatgtttttggttgattggaaagtgatatttgttttatctgttcaaggcaatggagctatatgtttttgattgaattatacattttttcttaacaatatgcttttgattagagagatgaatttgaagagcatctaaacactcggaaatataattattctgaatctgaaagtacttgttattgactaattgtaattagcatgttttgtaaacttgtataacaagaaatttatccaaatgttggtgaataaaaaaacttgatcttcttctctgttttcttcaaattagtttagccccattagttttaaactagatattagattggatcattgacttaaaaggttagtgtttttttactgaaaatgattaacacaagatccttttttcttggtatgaagattcagtaccgttttgctcaaaaaaaaaaaaaaaaaaaaaaaaaagaagattcagtaccgttcagggtgacagaaacattttcgaaaagagaggctataagcgggatgatgaatccgaccatgatggtgttgcagaaatttatgtatgatgtagttattgtccagggatcgaaacaccatcatggtcagatccgtcatcccacttatgttttcttaggtcaacaaatatggacaattgaaaagtgaagctctatttattacggtatgtttatgtatctcttagaagtatattctaaattaaactccctttatttgaattttatgttgatattagcagtttgagattaaccgcctcgataacaaacatcttgaatccgttgaggttgatcacgatgatgccacatccggtttcattcaaggacttctattcagaacaaacttcatgatttctgaactaattggatatgataaatggtaacaagtattcacttgcattcaagggacaaaaaatcattgggatatatgattatgacaaacacgattggaagctgaatggttgcgggaggcaagcagtgggataatgatctgcaagtggaaacttcttacttttatcatatcccatcagctcgaaagtcttgatgttagttttgaattgaagtgcttgaattacaccagatttattgtgctcgtgtatcccggtaaattcgactaatgaccaactcttttgaggtacgttttttttttggtggattaaagagtttcaagaaaagtctttgtcatttgttctccatttgtttgtcaaacgcacgttcttgagcctttcggcctgcaatctttccactattctcttttaaattattttcactattatgatattgtgcaaaatatttgtcgaaaactcgatacttgtatacaatttataagacatgatcaactctcgtttaaagatcaccaggcacgacattactctccactcatcaagtattcttctcgcctcatacacctgaggtcatctctatctccttcagttcacaatggttgaaatg

SEQ ID NO: 4936 - DNA, 3000 bp, Unknown
  misc_feature (1)..( 3000): cDNA_ID_1826585_gDNA_ID_1620746_Annot_ID_49723 3000 nt of promoter + ATG
aagcttcaattaataagttttggaaactaatagacagcgtactttctccaacttcgaaatgtagtttgttgtataattgaatatagtcgctgatgctatacagaaaatatgaaattgctaggattacaaagttggaagagctctgaatacataacaagtatttgatttgtttggcttttgtagaaggaagagcctcagatatctgggagagaggatgatggtgacatttgggagattttaatgcgaactcatagtgaggtcttaaacactcttcaatcacggttgacaaaattacaggtaaattttgtctctgctattattctttttaatatcgttttctcttgttctcttgtcctatttctgtttggtttttcctttacgtgtctttttttcctgcttgtgaggataaactaaatggctgatatcacaaccatgcagattgtaagacatttctgggaacgtagtgatattaaaggcgcgattgcggccttaagaaaactgtcagatcactctgtaagtaccccagtagatatacttttacctgtcttttttaatgcttagatgtttggaaaaagctgactcgcttaaactggaacaggttcaagcagatgtgatcaatattctaacagacaaaacagagattttaacattagatttattttctcaattagcacccgtcctcacaggcttattgggcagcaagactgagaggtaaattattttatcccatattcaaccttctttggtttgcttttagtttgagatatatagtcgtctccatcatttggcttgtgaatgagggaatggcaagaaaattcatttgtttattacagtcactgtttatatgttaatatgagcttttgacttaacagaggaaagcaacatgtgatttcaattttgtataggcctgtaaatgtctccttggaaatgctcttgaagcttgtagcagtgtttggcacagttatacaatcaactgtttcagcacgacgagttgtcggcgttgatcttcatgcagaggaaaggtacttatactttcggctcctcttatatcttcatgtcacacatatctctctttttcgagaaagtaaaacaaatcgagaactgcaggttacagatctgccaaagctgttctgcggaattgcaaaaggttcagaagattcttccactactgacaaggtaaaagaatactttttacacatcttattatggaccattgcgagcatgacagctcttgttgatcggtatttgctttcggttgtgtaattgtttccgtcctcttccatttattacagaagaggtggtcttatagcaagaaaggcacaagaactaaacctagttcttcaaacaccatagctcctggttcaaagtcaagaccactcggaatcacttgcgaactgtaaccccctcctgctgagttttccaatttgtacaatgtacattatcaagaaccatcttcatgttcctcccggtgcttttgtattgaagattcgctgaaaagtcgcaggttcttgtgcggggtttgatatagaattgtgccaggagaacatgaaaagtcactcggggaaaaactcggtatattgctgtaaatcaatctgtctgggattagagttgtatgtgcttcagattcttgattcagtgaatctcaaatgtgtagctgaaatggcaattacaatgtcgttctatgtgaatgtaatgtgcaatcctaatgagaagacgcaatcggtatatgaatttcacttggcaatccacttttggtccctcgacatatatctgatttttggaattggtcatgtgtcatgttgaggttagaatatagacctatcaaagattgtttatctaccaaatgtgataatgacatatttcagatagtagctagtcttcataattacagtctttgttattggtcttcgtctatctcaaaagtaggaaataaattaagtaggaaataaattaaggaatgtacgaagaaacttgttgtctcttttaaatagtgggacatacaaacgaattagcaaatttggattacatttagtatttctaaaaatagttgaaaagtatataaattatgatcaaagatttttttatttaatgaactttccgaaacttaaatctagtgattattaatcatgatattagtttggtgactgaattgaatgatgtattgaaattttgttatattgatcagattataaagagaactaatttaataatatccgttatatcattcattatattatcctcggtgaaactatcaaaaattaaaattattttggattttgggtatacaaaagcactattatctaacaataattattccaacaagttgtggtaatgacggaaaaaatcgaataaattaaagaaaagatagaaaaattctgtttaaattaaaaatttactttatttagaccaaaaaaaaaaacaaaggcacacaaatctagtctcaagtctttcttctttgttcaaaaacaaaccaatcttcttcttctttgccttttgaacaaaacaagaaaaaacaaataaaacaaaccacaaccatcaatttctaatttgttccatttcacaaacgtcgaacaaatccagacccttcgccaactctttctctcccacctcagatttttctttttctttccttcttactaattttgaattttaatttaatttttctcccccattttcttgtcggaaaacagcttttcgtgtaatttacctccgacacaaacccactcgtaacggctttttctggtttcttgtcttatcataccagattacaaacttttatcttggtcttggtttgttgtctctgtctctgttttttttgttttttttgagaattgagtggtcggagaaaaaaagggaaaattaggtggaaagcgctaacatgcgcttggggtgcgtaagttaagttttgggtttctttttctttttcaaaatcgaggagcgcgtaaggcacacgcgtgattattatttttgatggttatggtgatgatgacgacgacaatg

SEQ ID NO: 4937 - DNA, 3000 bp, Unknown
  misc_feature (1)..( 3000): cDNA_ID_1826581_gDNA_ID_1620746_Annot_ID_49724 3000 nt of promoter + ATG
ttccttgctttaccaacctatgccgcgtgtctataactcactgccacaacatgaaggatctgacttcgcttccacatgtgaatctaactctgtttctttttcttcttctttagacaggactaaacaaactttacgctggattcggattcctctctgtctaaaatcggaatccacgcttcttcttctattgctttatatttcttcttctagtgtgtgttgtgttgttcatttggattgtataatttctttatctttctgcagtgtgttgtgttgttcacttggattatgttattattatttttattgtattatttttgcatctctgttttagcttgcagcttgtttgtgtgattcatttgggtgatggtttattttgttaaatcgtgaaaatcataaactcaggtcctctaaacctagctagtatgcagatactaaaactgtgatctaatgtctagtgcatggtaggtttctgatttgggggcaacaacaagagcctgttttctcctgtagtgaatgggttcaccacatcaactaccatttaaaacaagaacttataccaaattcagaaactcaaatttcgatcaatcgttcactggtcttgaacctcgttcatccaatgttacaaatgtctcatagaatatcttctctcttttttttttttttgttcctgaattgtttttaacttgaattcttacaattcaaaacatgttaactactctctatcgtggacaacttttaacatgagacaaaaatttagcataattttctcaatagttaaatgaaatgagaaaaattgtccaataatttgataaattttattatgaaaagataacatattacggaacaaaatcaaatatcccacaacaatcaaatcactataatattatcttcttaaaggggaaaaatgtcgttttatacgcgaactttcaaaaagtggtcatttaatacgtgaacttcttgtgtggccaaataaaacataataaaaacgttgaccgaccatttcacacaaatgttattgttgaccaggccaaaattcccatgtcgttatctttcattaacggatctgttagttccgttaacacacgttaattagtttccattaatactcaaaacgacgtcgtttcattaaaataaaagaatcaaaattcccaaattgatttcaaaatccctaaattccaaaaaatccttaattccttaattcctaaattccaaaaaccaaatccttaaattctaaaaaccaaatccctaacagcctcttattttcagcaagtggtcgtcgtaatagtcatcgtcgtagggatcctcaagggagctaaagaaaggccttcgctttgatgtttcctccttgttcatcatcgatcttgttcctcctccttcataaattcaaacgaacaactgctgtcaatagtcaatgttgttattcatattcaaattggttctcatgtgtgtgtgttcatcatattttattcacaagacaacaaaacaaaacaaaaacagggaaacttccaacatggtaaaataagattatgagagtgagaaaagaaccttggacaacgggattgagattcctaaagaagaacatgttgttgccatgtgaagcagatggattgaagaaaaacgaattggattccattttggaatttagggattttgaaatcaatttgggaatattgattcttttttttcaatgaaacgacgtcgttttgagtattaacggaaattaattaacgtgtgttaacggaactaacatatccattaatgaaagataacggcatggggattttggcctggtcaacaataacatttgtgtgaaatgatcggtcaacgtttttattatgttttatttagccacacaaaaagttcacgtattaaatgaccactttttgaaagttcgcgtataaaacgacatttttcctcttcttaaaatcattttacttcatgatccggttattggttctactcacgcatctttttttttttacttaacacatctttatacaccaagatgttatctattggcacaagaagttaaataataaaaaaataaaaactgatttgtctgaatatgaaatgttgtcgatgtaatgaaacggctcataaactagcaaaatttggttgtttgaattccagttcctacattgatgtagctaaaccgctactttgtcttgaacaacagttgaaattgaattattcaagctcaatataattccatttcgtcaaaaaaaaaaacacacaattatcatcataatcttcttctttttttaacgtcagttagcatccatcatacatctatggattgaaattactataattcattcctaaggttgaaaatgtcttcaagaaacaaacaaaaccaagagatgatgacgtgttgcctcaccaatcaaataatattttcgacaaaagaaaactaacaaattatgatggagttggagaaaaaaactgtaccaatagaagtcaattggaagcaagggttcttttcgtaatttccactcgaattcaatgcccggacaaaagggtgttttcgtcagaaccgagaagaacgaacaacgaagaaactagaggtccactgtccaagaaaaatgcttaattatatttttaaattttttaaaaaattaaaaaacctaccgaccgattaaaaaaaaaaaaaactttcttcgctttatcaaaatttcttcttcttcttctctgtttctttcttaattctgcttcgtgtcactatttgaatctgatttcgtctcgtttctttcaatcttcttccccgaatctgattctctctcacgttttttggatttcaaatctcaacggaaagcgatctcttctcatatccctccctttgaaatctccctaaaatctcgacctctgtcgtttagtgacaattcggatttttgtagctccgattcaccgttttaaatcgattccggaagctacagattcgattccagattcaaatttctatttccccctcacggattcgctggaaaatcgagttaaaaaatg

SEQ ID NO: 4938 - DNA, 3000 bp, Unknown
  misc_feature (1)..( 3000): cDNA_ID_1826573_gDNA_ID_1620746_Annot_ID_49726 3000 nt of promoter + ATG
ttctttttcatgttccagttgttaatgaaaagatttgattttggtaaatcatgaagatcttgtactcagattctctagtgtcaatccctcaaacctattctgaatatctaaaattgtgatatactcctaagctatgtgttaagatttcaatatcgatacctccgattccttaaccaaaccggtacacactaacacaccatacaagagagagactagcacatcactagctcagctctcaatacaccatacgagagagactagcacatcactagctctgctcttaagtctctcataccattcaacaacaaacaacataaacctctctaaacattcagagccattatttatactcgaactgagtttgttcaagatatttttagatcctaaaaatatcttcttcttcaagcaagtttcttctcacgtgcctcctcacttgcacgtgtcttcttttgctttctctcattcacattcttcttgatacatcaatcgtatcactatgtctagtgtggtggcttaatttcttaattttgttgagtgttatggtaaactcttaatctttttttttgcatcttctcacttttgtcaagaagcatatctctcttcacgttctcgtatagcttccatctgtttatgatctttataactagttttaagacttagttcgttttatgcgctatcccttaagcatcaaatgaaggatttgaatattgcctcccctctcttgtctcggagaagttatctacgaatctctttggagccagcacgaaaccatctaaaaaccaaattttgtgctctttttaaacattcaaaacgatgaaaaggttactaatagatgttgactctttactttaaatcgtagattgcatgatcaaagattcaccacagccttctgtaaaagtcgctgaaaactgaaacgtttattttcttgtacattgtcttaacaaaaccttgaacatacctgaaatttcatagttataacttttgtgcaaacctctaaacccatttactagttgggccttaaatacatttgtggcccaaaagcccttttacacttaaaaccaaagtcttcttcttctccctcaatctttgacgcttcgtcttctgacgtcttctcttgtcaatcttcttcactttcccatctagtctcaatctctggttcctcaattcgaatttagataataatcatattttgattccaacgcaaatgccaatctattcttttgacggtagaacattctgttttcagatgaccaaatccttgacatccataccactgtatgttcaacttctcatcttctctagcttcattccacacaataaagctattggatatgcaaaaagattcatgagggtttccaattaaacaataactcaaaatgaaggtttcgttttcttcactagtcccttgagtcatcaaattcttcattgccctggagaagtctgggaatctctctatgagccggcatcaattttttcattaatataaatcttggtgttcattgtctaaatcattcacatctttgtcttcaacaaagtctgtaaaatcttcttccatcttctttctctgatccagaatcactaaagacactacttctgaagcttagtgaaggagctgcagaccttggtcctttggagcatcatctactagttctaaccatgacgatacctacatagttaggtttggatcaaacatttcggcggtcaaaggttggtgaactgcatcacttctctgcatattcatgcttttcaagaaaagctattcaatacatcatcactggctagtatggagaatcttcatcatctctatgtcgaaagtagtcatgtctaggagatgtatatattgcaggaaagctaaatggactagtctaatttaaacaatccgacaattccatgctttaccagtcgtctctcagacgtgcttatacctgagtgcataaatgatctggcttggcttctgtttgccttcagattagatgttcagattatgtgtcatcaatttttcaaaatttaaagaaagatgtgtattctactcttctaatgatcaaatctcacaaaaaaaaaatcttttcttttcctttcaaactataaaatcagttcagcttaaaataagtatagacataggatagacatatatggaggagaaaccttaaaataagttcagcttctttagatattaataagtaattaggtagatggggtgttagggatattcccagcagagaggttatacctctcaatttcattcagttccacaattgtcaagttttttttttgcttcttcttcttattctttagtgatgtgggttagtcataagttgttcactggctaaaagcagagtccatggcttctttttatgttgttctctctttcttcttgtaatttgtgatatcttcatttggatttctttttcactacttttcttttgcatttttttctttctccagtgtgttgttcacttggattatgtttttcatcatttccgtatcgtattacttcaaagttaaaacggattgaattaatccttttcaaactacatatttttacacaatcaacagtgtatgctttttggtcttcgtaatttagaggtcagttctattttcaatttatttagttacaagacttgatatcagagcgacaaaggacttacatagttctaccactttgctgtgggatggtaaaagatactagtctaatagtctacacgaaaatgaaagatttgtcattttgaaaagtcattagatgccatattattgccagacactaatttgtatggactctagctaccaaaaaaagaagagaaaaatcaaagtccttcatatggaaaatgggtggtctgaaaatcagtgacagcaatgtcttttattatcttctatctttctttgataatctcaacccacccgtattggagcaagatgttatctaaaacacttcttcaccttcagctttagctttagcttcgttgttgcttactgaaacttttctctcttaacttcaccatg

SEQ ID NO: 4939 - DNA, 3000 bp, Unknown
  misc_feature (1)..( 3000): cDNA_ID_1826569_gDNA_ID_1620746_Annot_ID_49727 3000 nt of promoter + ATG
ttttcttatcacaaaataattgatcgttgagaagaatgtgtctgtcagtgaactgtagtggtcatgagttttcatgaatatgctattgtcgacctgcctaagcctaatcatctttaagcccgacccaataagcaataaatggtaaagtatattgtacaatgtggttgtgattggtaacatacgtaacatgtgttcaatcataatattacagaagacaccatgatgtgtccccgagaaagaaaaaaactagatctagtcgtaaggttcgtcttatgtttgttctttttggtcaaatgattcgtcttatgttatgatacgattttattttagatctctgacataacctttatttctgaccttcattattatcattggtttttaaagaaacattctctctttttttttcttaaatcaggtcctctaaaaactccaaattgtacagaactaaactatatatcatctgcttttgtagagatttatttgtcaaaattattacctgacagcttaaggacatcctgacaaaaaaaatgttaagttcaatgatatatttaaaggaaatgaactctttgtgggcttgtttagatctctagccatttccgtgcatgtgagtcatgtgactttttagatctttcatttagacctttttcaatgacatctacaatatttatcttatagattttggatccgatcaaattttgaaggatgtaaatggatctcagataaaactcacattagttaaaaaaaatttttttttgtcaatttctacctctcaagtctcaacaacaaaatccattacatgatacatcattttttttttttggtcgtaagtacgtaacagtgtaacacacctcatgactaaaaagttatcataactttgaatgcgtaatatttctacgcattcaaacgtttttaatattcaaaagttttttttaattttcttgactaaaaagttatcataactttattaacgtcattatatcaagaaaattgaaaatttgcatggggtttaatcacagacataattgctgctgaaatcattataaactaaagctactttggggtagttgttgtataattattctttttactcatattatcaactgtcccaaaatattaacaataaatactctcacttcacaatcatcctctgctgtcaccacacaacacaaccaaggagtactactctctaatctccgatcaaacgacgtcgtctcttctctctctctctaatgggtaattgctgcgtcagctccggtaccaccgatcgggaaaacgagaacgtttccgacaagaacacaaccattgtcgaagaagagacagtagtcaaagaagtcttgtcagagacaaccttgttcactccttcctctagtttccgcacttcgacgttcaaagacccggtgaagaccaagatccgagaagatgaggagaaaaaacccggtttcttgaaaatggcttcagacccggttttgatccgacccggttcggttgatcctgaagaaggctctgaggtttcggagatttgtagcttgagtttgagcgagagtgtgtcttcaacggttgtgatgaatggttacgatgaggaacatgtgatgatgaaacagaggaaatctcagagatctccggcgaaaactcggacccaggtcaccggtaataattatccgacccggagaactgatcaatctccacgtaagagaaacaatggtacatgtaatggagcgagatacgggtcgggtgtgagagacccgggtgagagatccggaagaaggtcaagatcgccggcgacgaatagatcggtgatggattcgaatcagagtagtcgggtgggtggggcaaagactaggaagaataatcagtctccgggtcgggttagactagatccggctaaaaacgggttggatcagcaacagcatcagaattacggttataccacagaggaattgttagagaacccgcttgtttcgttagagtgtttcatatttctttgaaaaagaagaatatttcgatgggaataatgtcttctcatttgacgttggattcataattcgtaaagctacttacttaattacgttacctctgtaattcatttctgtgttgtatttgctgatttaaagttataattcggttgaatgatgtaatgttcgagtaaacgaaaattcaagattagaaatgaatacatatgtatgttttaaacaccacgtagaataatatatatccaaaataaataccactcatttataagttctttaattttggaaattagtaattaataatgttctttaaaatcacaaaaaaattactttcacgaagactcgaatctgaaacattgcaagtgctattaccacaaggtgaagctagtattacattagaatcggggtcagacgagaaattatgtaatcaccgaatcaacaatcatttgaataatcattcaaacggttacatgaaaattatattaaattgaaagttctcatcctatttgggatcgtcactagcagtgataggggaacacattattttttttgtcgtaagaaagtggaactcataattacactagttttgaatatttttcgtgttttgcaaagagaaagataatccaagacataaataattaattcaaaagtttgcttttctagatatgaacgttgcttttgtttatttatttattttactttaattatatctattgaaaatttctccaaaacagggcaagtttttttttggggggcaaactcaattgatttattcatagtcaaagcaaagcaaagatgacaagttatacaaacttcataatttaactatcgctttgattggtccaaaaaaaaaaaaaaaaaactatcgcttgacttctcctttcccagatctagagattgtacttagctcttcttctctcttcttcttctcattctcttcgcttgtaaccacagaactttgcagtggtcttgttccactaatattagcctcgtttttgcttactaaaagtttatctctattctcatcaccatg

SEQ ID NO: 4940 - DNA, 3000 bp, Unknown
  misc_feature (1)..( 3000): cDNA_ID_1826565_gDNA_ID_1620746_Annot_ID_49730 3000 nt of promoter + ATG
gaagatgaaaaaagagctccggattcgtgtctagtatctgcaagcatgggttcaaagaagaatcagattttgcttctttattacatcagaaaagtgaatgactactctccacacaagatatgaagaagcattgtacctcaggattcaaatcattaactttttcaatcgcatcctcgacatttccgttttgaacagcctttttaacagccattcgatcagtaatggtcgcaagatctatctctgctgtttctcgataaggaagttcaaaaggagtagataagctaaacatcaaacacaccaattccataaacaaaaactcaaaaccagaatcagaaaaaggatacgtttggttccagactccctttggaatttctcagcagcttcaacatatccttcagtcacaagaaaattcatcaccaaagtattcatatcttctttcctaagcttcacagcatttagtttcttctcccattcttcacgtgtgatcattttcttcgaagtagcctgcgacaagccacgattaaaactaggtcacacaacgtgcataaagattaaagttttccaaaaacccatcatcaagttgtatcaaataacacaaagaacagactcataagaggagtcaaaattaccatatcttcgtcgtcttcttcaagctgattgataaaaatacgaaacagtgacattagaacgccagtgaggctctcatatcttgaaatctaatctaatccactcaatacgaaattaatacctgttcgagcaacactccgatcagagctatttccaaaagaaattgactttgtgatcagatagtgatacaaagtaatttagggctttagtcaaaattcaagctttaatctcaaaacagcacaggagtggtagttctaagaaagagagagtgtgcgactattttcctcaaaaattgaatataacgatgtacctggagaagtggagaatctggggaagattatctgggaacgattcttgcaaataatccggagatttggcgatcgatttgcttctagattgcttgcgaaagtctcttccctaaatttacaatctgataaaacaaaaaaaagttggaggttttcgatagagaagaagagatcgggtttaaattattaggatgttgacgaaccgtcgatgaataatccggtttaaattattaagggaaccggtttgtttttggatttggttctttatataccggatagtattatgtaactcatttccaaatgattttaatacccaaagatttttaaactattttacctttgaagaacaaaatttcgatttaaaatcataatttttttttatttttttttttaaatcttggaggttgtgggtcaaagtccgtaatcccccaggcctgaaaccacagcataaaatattagtttcgtcccaagcgtcactcgaaccggcgacctctaagctttgcataaggtctttaccaattgagctaacgacacttggttaaaatcataattaaataagactgatgttaaaaatctctatattatttggaatttgatacacaatttaaaaccaataactgatactctattatactctattaaaatcaactattaggtaacaaatatgtgacataaacattttgcagtccgatgcaaaatatatctttcaatctcaacaatatgttttttcttggtcaacaatctaacaatatgtttaattgcatcttcaaactaaagtcccaaaacatgttttgttctttgcacatggttgtttgtgtggaaccacaataagacaaaggatcgattgcagaatttgaggtcttctagctagttgaccgactaagaatcaatggaccacttattctttaatattatttttcccaactggtttggaaggacttagtgaagaagttacactaaaacttctcgagtcaatcctcatatggtttcttttggcaattcctatctctgcaaaatcaaaggctcttcatatcaattaatatggcaagcaactactttgagacatggcaagaacggaattgttgatcacataataagcaagctctttctcatcaaactacctacaaagttttgcgctctacaagatatttgatcaatcataaaaatggtgatctcgtataatactagtcttcttttagggctaacaaatgattcagaagattacaaatgtgctttgtagaaattagcaatatagtgctttgtagaattttatgaccacaagattggtaagatcatttagtcaaatatatgttttatctcttcttattgattgagatgattatttttctaatgagtcgatccacatgtctaattccaattgatctttgtgatttagtttcatatttgttttctttaacatatgaaatttttttgttagtgtagaaaatctaattttcacacaattaaaaataatttttacaataaattatgattagcaaacacttcaaaaaaatctccattacttaaacacttcagtttcctactactaattaaagttgtttccttttgtttaaattgtgattttgctttaacaataaagatgacggcgcataaaatataattatatataatcatgcattattaaataatgaaaaaatggaaaaaaatgaaagaaaaagaaaaacaaatgttcgaccgttccttatttaaagccggaagtcccatagccttgtggtgtttactttttccaattcggagaaagccaaaagagagaacaaggcaataaaaagaagccaccgtcgctacaaaaagtcgcgatttttattttctctatcccaactgctctctacctttcctcgaaaattccttcaaaacccaattctcaagccttcttcttcgtcgtacctgaaaattctacaatctctggatctacgcgtctacttctgaatttcgatttgggtttcccgggagctgaaattccgtgacttttgggttttctgatttagggtttgttcctcttctcgttctttctcgggttagttttttttttttttttttgtgatttttg

SEQ ID NO: 4941 - DNA, 3000 bp, Unknown
  misc_feature (1)..( 3000): cDNA_ID_2124042_gDNA_ID_1620746_Annot_ID_166681 3000 nt of promoter + ATG
cactacccggcagttgaaagttagaaaactcttggatttgtcgattagtgtttccgtattgacatacaatatgaaaacgattactcgatggtgctaggacgtatagctaacaatctataagattttgatagattagttgtttatcttaaagattgttttacagcaataattctttaacagtctttatgtctttatgatatcctataaaatttaagttcatcaatgtaatcattattagataagtgctgatagaaaaaacaattgtaaaataatgaaataaagttgcaaaatgatactttaatattatttagtaaattggagagaaaataaagaactaattttgcttatcaaatcaatttgttttttttaaatcatactttctcatttaaaaattgaatattgtggatgtcggaatccgcaattaggaatttgtggatgttgcaagggccttaaaccttgttagtcgaactaagatcgaatcgaacagtatttcagttaatcggaatttttttgtatagtaattttctcgtcccctttacaaatgacgaatcaatcctatttatacaaactaatcgaatatctgcgaagtaaatggacgctcgaatcacgccgcgaatcacgtctcattaatgtttatgtttcacatagccacctcgcgtattaacgcattctcatttactccgcagatttccgttacgtaacgcttaaaatgattcttcaaatcgacctggctctggtgggcttatctcggcccactccatatttgacaatcctggattcatcgttaaggctttgacccaggcccattaaagaaatatgacggatcgcgggtcggagcaaatatacgagatccgacatccacaaatatcaaactttgtaatttttggccaaacaaaagaactactttaactagcaggtatgaaagttataatactgttaaaagaactcagcttgttcattgatttaaaacgatcaaatatcccaaatcttcatttctagtttccactggttttctttgttttcgatatcaattttagacactaagagggtgtattcaatctagtattttaagtgatttgtgtaatatttacaaattatatgttattcaaacatgaattttaaaaactctaatggaatacaatgtagttgaactaatgatttaaaaatctacctttaaatccattgttactgaaaacaatttgtagatttgattcttattaattttgaaagatttaagaggatttgaaaagatttctttagttaaaaatacaaaaattcaaatctcatggttttaggtgaaatttgattttttttttataataaatcatatcaacttctctcaaatcattaaaatctaataaaaactaactaaaattcaaatcattcaaaatttaagatccaatatactcccctaattcgtcttacatatcctaccttacactcttgtgtctcatcttctctgccatttgacacagaaaaaaaaagagttaggacggacatatccgaaacaaccaaatagactgtttttaaacagttatatacgaacacgaaggttcagctttgtgatacaccatttatcgtaacaattaaaatatggtaattttaggctaaattatagagtagatcttgtttcaaatattacaatttgcatgcaccaaattgttttacattttcattttccagagaaaaccaaatcattggttagtcacttcggaagtaccaatcccaatattctttacagtaaatacccggaaccgccgagttcgggtgtttcagaaatgaccaatgatgatcaattagtcacttcagagagcttccgggtgaaacgcgcttaaacgatggccttgacaatgacttcctagtactgatgagagagcggtggtgccaaacgctaggaagctgccgaggatgtgacaagattgaaggaaatctgaggttaagacttaaatctttatggaactggattacattttgaggttgatgaattgtattttgattgatattgaaaacatgatgatgtggatatgcaacggccaagtatcgagatttgaattgagatatggatttgatgcacaagtggtcgaagaaagaacgaagtggacaagtacattacctgtaatagtacataacttgtgtggttcactaattcttagagattatgaatcattgtagatgaataggcaagtctatcagacatctctaacttatggcaatcactagtttcttgtacataaagtactatttgcacccaaaaaataaaaatatgtatataaatttactactacttaatgcccattatttttctgttttcaatattgtgatatacattatgcaagtttacacagggatggatccatagcgacattagcattgtagattactaactacgaatattttttgttttttattgttttacaatcaatgtaactaatcaaatattaggaatttacagcaaatgtatcggtaaatatacgggacatagtcagacatatctcaatattttcctttttttaagtctcagtattgttattgtataaattatttataataataaaaaataataataataatagaaaattaagtgggtatctgtaatatttaaaaaatatattgaagaaactttgagatgagtcttttaactattgaagatattcatttaatttttattaatattttttacttttcattattgtagaactcacaaaaaattattgatacgagttatttagtatgtgactcactaaagatcatttatttagtatttatcacatgggggtttattcgttgtatctccatttattacttggaagaccaggagaagagtagaccattagaatattcaaactattcaaagtatttttcacatggttacatttagacgactcaatcatatgcatactcgattccttctataaaaacacacgcagattagtgacccatattttacactcaatctaaagaccatcctctagacagaaaactttttttataaaaacaatg

SEQ ID NO: 4942 - DNA, 3000 bp, Unknown; identical to SEQ ID NO: 4940
  misc_feature (1)..( 3000): cDNA_ID_2124035_gDNA_ID_1620746_Annot_ID_166679 3000 nt of promoter + ATG

SEQ ID NO: 4943 - DNA, 3000 bp, Unknown
  misc_feature (1)..( 3000): cDNA_ID_1826569_gDNA_ID_1620746_Annot_ID_166673 3000 nt of promoter + ATG
cgacccaataagcaataaatggtaaagtatattgtacaatgtggttgtgattggtaacatacgtaacatgtgttcaatcataatattacagaagacaccatgatgtgtccccgagaaagaaaaaaactagatctagtcgtaaggttcgtcttatgtttgttctttttggtcaaatgattcgtcttatgttatgatacgattttattttagatctctgacataacctttatttctgaccttcattattatcattggtttttaaagaaacattctctctttttttttcttaaatcaggtcctctaaaaactccaaattgtacagaactaaactatatatcatctgcttttgtagagatttatttgtcaaaattattacctgacagcttaaggacatcctgacaaaaaaaatgttaagttcaatgatatatttaaaggaaatgaactctttgtgggcttgtttagatctctagccatttccgtgcatgtgagtcatgtgactttttagatctttcatttagacctttttcaatgacatctacaatatttatcttatagattttggatccgatcaaattttgaaggatgtaaatggatctcagataaaactcacattagttaaaaaaaatttttttttgtcaatttctacctctcaagtctcaacaacaaaatccattacatgatacatcattttttttttttggtcgtaagtacgtaacagtgtaacacacctcatgactaaaaagttatcataactttgaatgcgtaatatttctacgcattcaaacgtttttaatattcaaaagttttttttaattttcttgactaaaaagttatcataactttattaacgtcattatatcaagaaaattgaaaatttgcatggggtttaatcacagacataattgctgctgaaatcattataaactaaagctactttggggtagttgttgtataattattctttttactcatattatcaactgtcccaaaatattaacaataaatactctcacttcacaatcatcctctgctgtcaccacacaacacaaccaaggagtactactctctaatctccgatcaaacgacgtcgtctcttctctctctctctaatgggtaattgctgcgtcagctccggtaccaccgatcgggaaaacgagaacgtttccgacaagaacacaaccattgtcgaagaagagacagtagtcaaagaagtcttgtcagagacaaccttgttcactccttcctctagtttccgcacttcgacgttcaaagacccggtgaagaccaagatccgagaagatgaggagaaaaaacccggtttcttgaaaatggcttcagacccggttttgatccgacccggttcggttgatcctgaagaaggctctgaggtttcggagatttgtagcttgagtttgagcgagagtgtgtcttcaacggttgtgatgaatggttacgatgaggaacatgtgatgatgaaacagaggaaatctcagagatctccggcgaaaactcggacccaggtcaccggtaataattatccgacccggagaactgatcaatctccacgtaagagaaacaatggtacatgtaatggagcgagatacgggtcgggtgtgagagacccgggtgagagatccggaagaaggtcaagatcgccggcgacgaatagatcggtgatggattcgaatcagagtagtcgggtgggtggggcaaagactaggaagaataatcagtctccgggtcgggttagactagatccggctaaaaacgggttggatcagcaacagcatcagaattacggttataccacagaggaattgttagagaacccgcttgtttcgttagagtgtttcatatttctttgaaaaagaagaatatttcgatgggaataatgtcttctcatttgacgttggattcataattcgtaaagctacttacttaattacgttacctctgtaattcatttctgtgttgtatttgctgatttaaagttataattcggttgaatgatgtaatgttcgagtaaacgaaaattcaagattagaaatgaatacatatgtatgttttaaacaccacgtagaataatatatatccaaaataaataccactcatttataagttctttaattttggaaattagtaattaataatgttctttaaaatcacaaaaaaattactttcacgaagactcgaatctgaaacattgcaagtgctattaccacaaggtgaagctagtattacattagaatcggggtcagacgagaaattatgtaatcaccgaatcaacaatcatttgaataatcattcaaacggttacatgaaaattatattaaattgaaagttctcatcctatttgggatcgtcactagcagtgataggggaacacattattttttttgtcgtaagaaagtggaactcataattacactagttttgaatatttttcgtgttttgcaaagagaaagataatccaagacataaataattaattcaaaagtttgcttttctagatatgaacgttgcttttgtttatttatttattttactttaattatatctattgaaaatttctccaaaacagggcaagtttttttttggggggcaaactcaattgatttattcatagtcaaagcaaagcaaagatgacaagttatacaaacttcataatttaactatcgctttgattggtccaaaaaaaaaaaaaaaaaactatcgcttgacttctcctttcccagatctagagattgtacttagctcttcttctctcttcttcttctcattctcttcgcttgtaaccacagaactttgcagtggtcttgttccactaatattagcctcgtttttgcttactaaaagtttatctctattctcatcaccatggggagttgtttttctcttcaagttagtgatcaaacactgaatcgtatctttaattgcttaattggtaaaagttatattcgaaccctcgagaagaatctcagagctctgcagagggaaatg

SEQ ID NO: 4944 - DNA, 3000 bp, Unknown; identical to SEQ ID NO: 4938
  misc_feature (1)..( 3000): cDNA_ID_3074922_gDNA_ID_1620746_Annot_ID_166672 3000 nt of promoter + ATG

SEQ ID NO: 4945 - DNA, 3000 bp, Unknown; identical to SEQ ID NO: 4937
  misc_feature (1)..( 3000): cDNA_ID_3074926_gDNA_ID_1620746_Annot_ID_166670 3000 nt of promoter + ATG

SEQ ID NO: 4946 - DNA, 3000 bp, Unknown; identical to SEQ ID NO: 4936
  misc_feature (1)..( 3000): cDNA_ID_2124007_gDNA_ID_1620746_Annot_ID_166669 3000 nt of promoter + ATG

SEQ ID NO: 4947 - DNA, 3000 bp, Unknown; identical to SEQ ID NO: 4934
  misc_feature (1)..( 3000): cDNA_ID_3074934_gDNA_ID_1620746_Annot_ID_166666 3000 nt of promoter + ATG

SEQ ID NO: 4948 - DNA, 3000 bp, Unknown
  misc_feature (1)..( 3000): cDNA_ID_2994827_gDNA_ID_1620746_Annot_ID_166663 3000 nt of promoter + ATG
tagatgaaataataataataataataataataataataataataattggatatttggattagagaaattattgaaagtaatgtataaactattgaaccatgaaaatatatttgcgaataaatcatcaaactgaaactatcaaaatgtataagattttgaaaaacataatttcacgaaatatttttttttttttaaatctatgttttgactttttatcaaattaacaaaagcactatctgattatctcaagctgatttagtagaccgaccaacaattttatcttttaagccaaacaagtaatatactttatcataccaaaaattaatatatttatgatactaaagaaaaaactttatatatctcctctagtatatagtaaaagcaacaaaaaaaattaaaaataaatgttaagagagcgttttatggtcggcttttcacgcgtttcactttccaattttcatttcactttataagaatagaagaactccaaaacattaaaaataaggaatcagaaaaaaaatctataataaagttgtgattaaatcattagttttttttatataataaaacgcaggtgatcctaaaagttttcaaagcccaaagactaattgtaagatccgataaattactcgaattttggtgactaatgttacttaaacccaaatagtggaattaacactctttaccagtagaccaaagcaacttggtttaatttattttcttcaatttaccagatcatgatgccgtttaggaccattggactagtccatgctgagtgaaaataattcactcaaaagaataccgtaaatcagaattttccacgtttatcaaataactgactaaaaagcacacataacaaaattttcatgcatcaacttgtactaaaatttatagaaaactggcgtatattggtaaataaatagcagaaacaaaagtggaaaagttttgtggcgccacttgcgaagtgaactttggagctggagcacagctggacacgagcagtggggctgcagctgctaagtgctgacccaaattggggtcacaacctttcctcttataacggtccaatatatattaccgttatgttacatacaatatagtaatttatatatatatatatattttttatatagtaatttatattattttttgcacactatcgatttgatttacaacaagtccttttgttttttgttttttgttttttttgcacaatatcgattgtttgaaccttcaaaattcatgatagaactcccggggtttttcctttttatttttatttttttactctcaaaataagaaaatcatagtccgacgactccatttaaaagacttaaaaaaaattatggtcaaaatatgaatattttatatagatacttaatgcagaagctatagttgcactttttcctcgacaagactcttgtctcttcaataaaaaatgcgttggtttagttttatactgtatttagtaagtatatatgcttttccccacggcccacactcatgcattgatacataccactttattggtctccagactaatctggttatatgtgcccatcattaattcaaattcattaacttacgtaagaataccacccttacaaaacaacttaaaaaaaaaaacttgaatcaacatttaattaaaatttgacaaacatcgttataaattttatataactattacttagttaatttgaaaaatccgttgcttaatagttaataattaatcaaaaacacattgatttactacatattctttttatgccctcggtttggtatcttgatatatcaagcggcttgtaacttgaattcagaatctacgttttcaatgttgtttcctatgatggtcaagtggccgctacttgatttcagaatctacgttctatgatggtgaagatattgaaatgaatgttggaatttcttttattaaatttttagttggtatgactgattagccatacaaaataattaggttgcagccacttattttaacttgtataaaaaataagtgatactactaatttaaatcacctattattactttttttttatgggcacaaaatcacctattattactaattgatacttttattgatttatttaatattattcaatcaatttggtgtaaatctatattaatttccgctaacatcatcctagtactggagaaacttgatttcgtatctacagcctttctagaacaatttttatccaaaacttaaatttgtttacgttcattttccttgttccaaataaataattttctttttttgacattatgcctttgttgaagtaatgcatgtcacatacagtacaagaaaacacgagtttcagacttcagtgtaaaacaggattacatgtattgtaagcgaaaataattaacatcaagtagtcaaaatattttacactatgtaatgttaatgatgtgtaagattagcaagacttacacgttcgcggaaagtaatctaaattatatatttccattaacaaaaggtaatctagctagaattcttaattgactttgatagctagttcttgtataaacaataattcttttctcgttgatatttatatcaaagtggttatcatctatctaaaaatctatacataagaattagaatatccttaaaaattctaccagtaactttcaatagagagttatcaaatatgaatcatgattacatcagtgtttattacacacatatttacacgtaacacataattagtttcatggtcatcgttaattactctgacgataatgtaaactaaaaccgggtggatttaaccggacccatttgccatcactctccataaatcctaaccgtccatctaatcaagcgtagatctaacggtggatatcaaatcaaaggttaattccctccctatatatattagaaaattgatcctgaagcgtgtaccgtacacacatccccatacgaacactcacaatcgttaaaaagaaagaagagaagagagagaaagcttaaatcggaaaaa

SEQ ID NO: 4949 - DNA, 3000 bp, Unknown; identical to SEQ ID NO: 4941
  misc_feature (1)..( 3000): cDNA_ID_1826557_gDNA_ID_1620746_Annot_ID_49732 3000 nt of promoter + ATG

SEQ ID NO: 4950 - DNA, 3000 bp, Unknown
  misc_feature (1)..( 3000): cDNA_ID_1826550_gDNA_ID_1620746_Annot_ID_49734 3000 nt of promoter + ATG
cttgagttttcccaaaaaagaaaagattttggtatgattttcccacgtgaaacaatattgtagattaaaatagtagtgtataatggtggcttagtgagtttggttaatatcatttttcacatacccgtagtgagtttttccttgtcgtggttaagtcaggcggcttagccgcagtgctaaggttaccatcagtgaggcgatattcatgcatgatccaatctgtttttatccctttaggaggctttccaccgtaaaaaacaagcgctttcttgacaccaaccttgtgactattgcacgtaaatatcggtttatcggttcccgttgctttccaataaccggaagttgctgcccggtttggcctaaccccatttggatacttccgatcccgaggactaaagaagtaccactcgtgctctccaaaactcgccttgcctaaaccattcaaaatattattatccacaagatagttactatatataccaaatttaaatagtggctagattacagtggtcatagtaaaattaaatcgtacattttaatcatatcattaaagcataaattaggaaatataaatacttggaagctcccaaggatcaaacttgtaaagatcaatctctgcgatgattgagactggaagtggaacagaatctgctttcttcttgaggtaatgaactactagttcctcatcagtcgggtgaaaccgaaacccgggagggagatgcggatggcccggccctatgctcgaatcccccatgttttccatcaacttctaatttgatataatgacgatattttcacgaaatcagtctcatgatcgtcaagagaatatgtaggaaaagtatagattattttggagagtgaatgtgtttcatataagatgcgagaagaaataggtgttaggtttgtgtgagcatatgagtaccgaactgggtccctcgacgaggaaattacacgtggctaatcgtagggcccaaaattagcggccaatgggcattaaattttggagaaaaggcagggttttttcgaactgccttatgtcatgcctttcttatgctacacatcacgcacatacctcattttggtttttgtgtaagattttataaaaactagaaatgtgggaattctctataaatatattttaaaaaattatcgtgttaccaaaatgtgtttttcgttcgcaattgaactctagtaaactatgaagataattaatacaaagaaaatccaaatagtcgactgtagtagttatatatatatatatatatatatatatacatgtataaactttgggtactagcataattttccaagttagtaatattatcaataatcaagagtttcaaattactgatgatgtttttaggaatcgatcgactcgttgcatggaactacacgaggtgtacgaagattcttcgtcgtcgaaggacattgttcaagagatatggtgaggtgactttatcaggagtcaggagatatgaggtcatggggtctgctaggatgttttgttacatttcggtggacatcactaggacgtggtataaaaagactggctcaccttgatatagattgaatctagtggacctcatcctatagtagtaggcccggccataggcatgcatgcgatgctaagactcaaaaggtaaggcccatgatcctttcatctaaattcctttgaagcctaactttaagagtttgggtgatagaattgaggatttgcttctgagatatggactaggctaggattttaggcctctaatggctaaatttttgagaaatttcttcttcttccccctcttcattcttgtgagttgtgacaattctttttgacactatgttagcaaactctccaaattcttcttcttccaactgttccatgagaggattcgaggagactcatatattagtattacacacggttgtggttcagattactgtccactcccagcccagcccagccccgacatctcgaacattaattctatatatatttcgtctcttttttttctgtacgaacaaaatagtttagtatttcacttataaaattaacgagagtaaaaactacgatataatacaaatggccattaaagattaaataaatataaacatcaaaacatatcaaagcggactggttagttatgttacgttgtaccacctttttataactttttttaaaccgttttatttatatataagctgttgactaaactgaaaacatcaaaacatatatcttcctaagaaattggtgtgtctatttaaatttaatatctgagttaatatgaaatttaattttattgatgaatttgtattttgatttaatatctttattctagatacagttggtcatttctctttgcttttactatgttactttttgagatggtgaccgtttcaaagatgtttacacttttacttacttctttcaacggggtttagtataaaaaagaacaaaggaaaagtagcgaatactttttgacgcaaatataactaacaaatattttttgattcaaaagtatatgtacgtctttgaaggtttttttttaatcttttcttcaaaccacacgagaaaagacaaaaatgcttgcaagtcaaagataagaataaattcactcgtttcttgaagtattttcaaatagacactagtattttcttgaagtccaaatgttagaaaaagaagtttgaattcttccttgagtattagcgcgagaagaatcacaatttttatgaatatttacaaaaacaaagtggcaaaatatccaagatccgacatggagttctcggaccttattcacaaagacacaaaccatagctaactataagcgtaaaacgatcacttataaatatagagacacatatctatttcttactaatctaaaatcatttcttcttccacaatactaaaagcaattatcaaaaatatatcaaaaccagtcttcatctctaaatcactctttcgcttaattcaatcatttcatttcttcctcgtctattcaaaactcttcg

SEQ ID NO: 4951 - DNA, 3000 bp, Unknown
  misc_feature (1)..( 3000): cDNA_ID_1826637_gDNA_ID_1620748_Annot_ID_49736 3000 nt of promoter + ATG
aagcaaaacgctgatgagtttatctgttctttattgcctggaatttctcaccctcaagtccaatactcacaaggaggattattagtgaagagtggaggaagtaatatgcaacatgtaacatctttgtcttttttgttactaacatactctaattacctaagccacgcaaataaggtggtgccatgtggcgaatttacagcttctcctgctcttctccgtcaagtcgccaagcgtcaggtaactaaactaaccaacattcctctgttttagcataatagagagattcattaacgtaagtgtttggtggcgtacgttaacataggtggactacatactaggagataatccaatgaaaatgtcgtacatggttgggtatggttcgaggtttccacagaagattcatcatcgtggcagctcggttccttcagttgtggaccatcctgatcgtatagggtgcaaagacggatctcgttatttcttcagcaataatcctaatcctaatttgctaattggcgccgtcgttggtgggcctaatatcaccgacgattttcctgattcgagaccttactttcagctgactgagcccactacttatatcaacgcacctcttttgggcctacttggttatttctcggcccattattgatttcacacctcgaactcgaacgaagcatgaaagtctatttttgttgtgaaacatttttagttgattgttaccgattagtagattcactagattctctaaatctacgaacaaataattgtataaattaatcgagtacacaataatcaatttttaatcatatgggagttaggaaaaacaaagagtaataatgagagaaagggggagacaagagtaattaatattttgatgaccaaactaatcaaaaatcaggaatttgtcttttggactttggtcggctgctttacgcttaacacaaaagaacgctattttgtctcctccacgcaattacctcttctcactctcagacattttgtcaaacagatggtgctcgtttctgaatcagcttaagaactaacaaggagacagacactaagcttggtttttctctccgattagacggaggaaaaagtgaaaacgaggggcttagacgagtgatgtgatagagatggaaggagttgagctagaattagaaagaagaagcaagttcttgaacagtttgatacagaagaagaaggctaaagaacagcaagatcagaaagatgagttcaatgttcgtgttagggcttcagatatgcctttgcctcaacagaacagagcctttagtttgtcgcgtgagattttgaatgctactccagggaaggctgataacaaaagactcgctcatgccctaaaaaaggttagatcttttgtatctctctcatgatttttctgtatttgggttgaattggagtcattgaagtctagtacttggattgagttttgaattttgacacagaatctaaaagtattgagctgcttttgggttctagggctacgtctcaaagtcgcatgctttttgtagaatgtggttatggtcttctctttcttgattggtttgaagatgtgatgaatcttgaatttggattttcgtttgtgtacttgcatattgttgaacttcatggatggtcccatatttgttaggttgcatttgactttgttccattgttgttgtcttttctatttgtagcttcggttagtctacttgactaggttgtttttgtattgcgaggataactgtagtaggagtctcgttgtgaaatgtcttgaaactggatgttcttgttgtttattgagatgattttggagctgtcttaggccataactaatgaggcatagcatgcaccatctgctaagcttctgtatctttgctgttagaaattagttgctacctaatgataactctgaagcatgcttgctttaggaagtgagccttgcctgaatacaaccttttacaaaggacttggttcgacaccccatatatagagttgtccatttatgcagttgtttctcgtgaggatattgttccttcttaaagcggctttgataattagcttttgattttaacttatggagcgaaatggagcagttccctcaatttatgcgactaggtagaggcattgattgatccatacattgattttatgaagtggttgagtaaaacaatttagtgttcacttatctgtgtgcagcttacttgtttgtctcagtgttcatcaatctcttaataatggctacctccctttggcttttaggattgacatacgagtcaatttctgctgttgtcttgttttatcttcttgttctggtaatatagatctcttatctcgaaatagatcttcatatgtttcttgtctctatgttttctcctaaatccagcttctatgttatccactgaagtgaatcttagactcccatctgtctaatgacatgttgcagctgatttaaaactatatattcacgaaacagttttccatctgtcttccatttcaggacttcgattcagcctacggcccggcatggcactgcattgttggaacaagctttggttcatacgtgactcattccacaggaggattcctatattttcagatcgacaaagtttacgttcttctcttcaagactgccgtggagccgttagatcaaaaatgagataaaacgttgatgatcagagcatcttcaatttaatccttttcttttagaattctctgtcttgtatcccacaatgtaattctgcctaagacaaaatctttgtggctcctattgtgtaattagaagtcatcttctctactgtgaatcgtttcaacttcacaatgcaaaatattgttcttctctttctcaaattctaattttgtttttttcgttgttgtgttgttgttgttgttgacattttcttctcttcaaaagagctttaaacccaaaacctctaataccaattttgctcctccgttttataagcatcaaagaaaaaaagaatcagtgaagaagaaaaaaaaatg

SEQ ID NO: 4952 - DNA, 3000 bp, Unknown
  misc_feature (1)..( 3000): cDNA_ID_1826633_gDNA_ID_1620748_Annot_ID_49737 3000 nt of promoter + ATG
agaaaattaggatgcaaagactttagatatttcaatcttattggtaaaaataaattctaataattatttttattattattaaatatagtttataaatattatttatgataagtatgaatttatttgaaaaatagtgactacaattgatttattaataattatttttttgaaaattaaataattcataaataaatgaataaataaaaaactcattttacaaattcactatttaaaatcttcaaatatgatttcaaaagaacagaaaagtaaaactacatttaatcaatcaaaattatttgataataaaatataaatatttttttaaatagttttgaaattatatggaaaaagaaaaaagtattttattttcttttattattctctcttaaagtgaaagtctcgtttatgagactttagaaagaaaaaaaaataaacgaaaagaaaaagagtttacaaacttttaaaattaataaaatcttgaaagggagattggttaaaaaataacttgaagaatttaaaatattttcaaaactaaaaatattaacaaagtcttctttgtcaccgttaatgtcctcttgttcttctatttcaattcgagtttggttatagaaggaattgagtcgggtctctttatcgtttcttggaaaaattcctttatggtggtgtttatattgatctttttcggcggtggcgacaagtgacgactcctctggattcatgtgaatgctctgtaaaagatcgaacacaacttcttttgtaagttcttttaatccctctaatactttctctatagtttctttcgttggcttcaatttttcggccactgaaactatcttcgtgccggcttttctcatcgttgaaaaaaaagctctaaaataacagaaagaaaatggttaaactggagaagaagacggacccaattcaattggaagagatatgtgtatacgttcatttatgagtctaaaagaaaatatccatacatttataactctacatccctaaggaaataatatcccatatctctactcatacacattagtcataaaatcttacttggtacttgtcaaattccctaattgatcataaactcctactaaatatctcataaatgatgtttatacacataatatataccataaccatcgatatttacgtcgtatcaatctcacgtcttaatcaatgcccatatcaaaacttcatgcataccttatatagctagcatctctcccatgttcgaacaacttcacatctcgaattaaatcaaatctttagacgatcaaaactattatacaattttatccaattatattagtattaattaaataaattatattgttataaattttagtggcctgttaaattagttattatccatactgaatgtttgttaaaatatataacatatgctaagtttaattcaccaataacacatataacaaaaagttgttaaaaaaattgggagatttgcaaaactaccatttttttactacctttttgcaacaatacttttttatgttgtccatttttaaaaataccctttcccttgaacaaaatgaccaaattaccctcatctaatagaaacatgtaattggaaactgaacttttcccaccaattttttggcgccaaaatttttttttcccgccaaaaaaaaagtttccgccaaacttttttcccgcaaaaaaaaaaattctgccaaaagaaaaattttccgtcaaatttttttttcgtaacaaatttttcctcagccaaaaaattgattttaaaaatccttataaatattttctggcggcaaatagatttacaaggaattttaaaagggttttaaaagatttacaagagatttaaaaatgttttaaaagatttacaagagattttaaaagagttttaaaagatttacaagggattttaaaagggttttaaaaaatttacaagtaattttaaaaggttttaaaatctcttgtaaatctttcaaaacacttttaaaccctttaaaaatctttacaaatcatttgtaaatcttttaaagccctttaaagttccttgtaaatattgtaaaccccttttaaaatccattgtaaatattttaaaatccttttaaaacaattttaaaccctttaaaaatctttataagacatttgtaaatcttttcaatccctttaaaatatcttgtaaatcttttaaaacccttttaaaatcccttgtaaatcttttaaaaaccttttaaaatcccttgtaaatcacccttttaaaatcccttgtacatcacccttttaaaattccttgtaaatcttataaaacccctttaaaatcccttgtaaatcttttaaaactcttttaaaatcccttgtaaatctatttcccgcaaaaaaaaaaattggcgggaaaaatatttttgaaaacaaaatttggcgggaaattttttttcgaaattttttggcgggaaatttattttggaatattttaggcaaaaaatattaatatttcattttgtaaacctaaaacaatttccaaataagagtaaaatggtcgttaaaaatttaaagagggtagaaataaaaatggataaaataaaagagtatagttgaaaaggggcatcataaaaaaggcattagaaataatttttcatgttttaaatgacaataatttaaaagttaactaaaagagtctataatgggtaataacaaacgtataacactagtgaaaataggacttgtcaatccatgaattaaatattttcatggatacggtcgtagggaaataaatctttccgtcagtcctaaaaagcctaaattattggatagacaaaaatctgaaaatcttaaatcacacgtaaatcaaacgtatttacccccacatggaacttaatccaatctattaaattcaggtggcgaccgttcattggttcttgtctctagaatcccaaaggactcgtttccgagtataaaaatacgttcctcaattcaaagtacaaaccaaaaacagaaccgaaacagaaaatg

SEQ ID NO: 4953 - DNA, 3000 bp, Unknown
  misc_feature (1)..( 3000): cDNA_ID_1826629_gDNA_ID_1620748_Annot_ID_49739 3000 nt of promoter + ATG
tttcttcttatactatccaagttacattataagaataattagtctcagggagaatttgtatttctcatcagaattctgaacaaccaagactgatttcttgagttgttgtgaggcttatacttgtacggatttggctttctcagttttgttctctcttgtttccgtattttggcgagtatactctcttaacatctaagttcattgatacctcaaagcatgctacgaccatccattgacaaatctcagagttgtctaattacttcaaatgggtactcatgaaaatgcaccctctcgtgttttggtttgatgttgcatggttttcaatgcatgataccataatatatggacgaaagccattttttattacttctcttttgaaaagtgggagagacgtcgaacttgaaaacgaaagagaataaatggaagattcaatatatgtatgtgttgctttcgaaacgaatatagagaattggaacaaggaaacccaaagatttggttagagtcgtacacaaccctaattctcccaccggaccttccatatctagaacgaagcttcattcaactttctactccacttaaaccacactatcctttatttcgtgtaagtatatctttcttatactcgatttctttctcttttgagttttagtatcaaatatttgtatcattgacctatcagtatatttcaaatccaaattcagacataatgagttctgtcaagtatcaataacatgtgactaattgagtggtcgtataaatcatattcatatacataatatatgaacgtgagaaaaaaaagaatttgattatataatcgtgcaatatattttgttttctcgaaaaagctatgcatatgaaaaagctagctagtgagagagttagcatgttctgttgatatgtccaaaaacaccaaactcatcttaacgaactaccactaccactacccgcactacttcggtctatcacattcataacacacaataagcaaaacaaaacctatatagtgactcaaaactgattctagtgaatcatagatgaagtaattaagtcgacttttaagtaacaaaaaacctcgaatcgatggaagacaaactcccactcccaatagtacgtacccacccccatctatcatctctagatttcaactagtggtcttagcttgtactcttaatttgttatcactttcacgattatgcatatatccatattgttggcaaatatttttttttgagataagttatacaatttttcttaaaacttcaagatttcattgtcgatatgaattcaagacaagtctttcgtaacattaacatctatgaaaatgtagctcattcacttacatttccaacactcacattcgtatttacaattgaattgattttgattttttttaataaatcacccaatctttcacaagtaacgtatatttcttttggtacaaattaaataatgatggaataccaaacaattagtaccaaaatatagtaacaagttaatgacgaattaaaagatgtatatttcctcatcgatgtcgacaaaaatattaatgagatattagttataccgccgtctatcaccattgttagtgtgggatttttttcctgctgtagtgaaataatatgacatgatcagaattatacttgttgtttattggcagtaaatgttctttccatgcaaatgaaatagaaatttgaatgtgaaaatgcttaactacatgtgtaaatagatcttctcaactgtatgttacgtagatatctctagcattcagttaccaaaatatatatgttggaaattttttttttctattgtcaacaaggaatttgaaagttagtcgtaagatttacatactttttggttaaactcatgcttaattgttatgatctaactacgtgacagaaattgcagaaaatgtcgcttttgtaaacctaaaccattaattaaacgatagagtaataacaaaacttgttaagtgagaaaacatattacaattcccacaaaagacggacttaatcaaacttttcatcaaaaactttaatttggtcaagctcacacgaaactcatgtgaaagctagccttttgacctttgattttgatatttacttaaaactctttctgggaaactccctaacgcttggttggtagatttcacatcattcaaaatttatattttcaatggtgatcgatatgtaattttgtggttggagctgcagatatagttgtaataactttatttaatcattattcacaaaattttgtattgttaccattatacgtataggcgttcttttagaaaaagaaaacaaaaactgaaaattaatacactaatttaccttggaacaaacatataaaaattaacaaaaaaaattgaaagagttttatatgctaaaatttttacatgaattatattaactgaaatagttaaatttttgctaattgttatactatttcaaatcacattttctgtacgtggattgttcttttccttatgatatgttatctttcatttggagtctcagactttctgacatgtggcattacgggaaaggtgtgtgtctctcaaacttcttacacatgtggcaggccattagccaaatctcatttgagtatctatactaatttgattattagcttgagttcctttcctacgtagttgttttaatttacataaagctctaaattatgttgtgttcaatgtttatgcaataagttcgaaccaatggccattgctaacttggattctataacatataatttgttcttaatttttatttttttgttcttaattttcgttttcatatgtttatatcaaacataaatcagacgctttgacgtggctgcatacgtgtatacattttcatttatgagattgaaagagagtatccatacatttgttacttatacatgcatttatatataactctctacttccctaagaaaacaatatcccacatctctactcatccacattagtcaaagatctctattggtacttctcaaatg

SEQ ID NO: 4954 - DNA, 3000 bp, Unknown
  misc_feature (1)..( 3000): cDNA_ID_1826625_gDNA_ID_1620748_Annot_ID_49740 3000 nt of promoter + ATG
ttattcgatgttttgtttttttcaggtgaaagaacaatgcatatgtgctctgtggaatctgactgtggatgaagaaattagggagaaggttgctgactttgatatccttaggctactcattagtttccttgaagatgatgatgtaaacgtaaaggaagcagctggtggcgtcttggccaatctagcccttagccgctcgactcacaagattctggttgaagtaggagtcataccaaaactggtaagaccttgcttttcaccttatagaatttaacaatatattagatatgttagattgaaatgattgctaatagtcaagggtgagaattgaaattactgaaaggatgtgaaattggctgagaatcacttaggctttaggacaatgatattatatatggaaaaccgtagaattgttggtcatgcttcagcttgcttattaccttcccaattggaatccaggcaaaattgttgaaagccgataatacagaaaacaaagggtctaaagttattagaaaagaagcaagaaatgtgcttttggagctagccaaagacgaatactacagaattctcgtcattgaggagggagttgtacccattcccataattggtgcagacgcttataagtccttcagaccggatttgtattcttggcctagtttaccagatggtataaatattgagcagacagcaaaagctccttcaagatttggtgcctctgagctgctccttggtttaaatgttgacaagaatgttgacgacgtagatgaagccaaaatgaaagcaatagttgggaggacaaatcagcagttccttgcccgtattggagcaattgaatttgagaaggaaattaagtccgaagggccagggaaatctcagcagcttacccttcttccttgtgtagatggtgtggctcgattagtcttgattcttggattggcagatgaattggcagctacaagagctgcagagtcaattgctgatgcatctatcaacgaggatatgcgggtttctttcatggaagccggagctgtaaagcctttggttcagcttttagccaacaacaacaaagagactgttaaattacccgtcatccgtgccttgaaaaatttatcacttaggtgtttatctttgagcattctttacatttttactaagcagtttctcctcagaggttgagattatttatacttgtaatgcagccgcactgtttgccagaggattgaagctgaaggtgcagtatggtttcttattaatcttctgaagcagccagagatctcactaaacgttacagaacacgtatgacttcattttcttcttcctttgttctttgatatctttgtctaggctattatggaataactggacgtgaaatggtattttgtgaactatgttatgcaggttctggatataattgctcatatcttagatcctagcaaggaaatggaatccaaggtgtgtttattttccaaggttgattattatacattaaatctgctttcatttggcttatgctatttctctacatgctacagttttatgaaggaccggtgaacggatcaaaagcagactccaggtcagtcttcttctcgatcttcctatcttcagctcattcattctttttgtttttttagaagtattaattactcaaaacatcggatgggaatgaacagaaaggaagttctggacgctgctgttttttctcggctcgtccagattgcgaaaacagcctctccgaacctgctaagaaacgcaatctctgtcatcgagtttggtataatcagtaatccaaacatggacacgatcatctccaaggatatcacaactgttcttgatcttgctctccggcagaaagtcctggaaggtacaaaacttatcttttgatataactctgtttgaattttataacagcatacaatactttttatggaaatgcagaacctgagaatgaagctgaggagttagagaaacatctgcttaagctagaagaagctggtttgacgatttccgctgcttcaaggctactgacaaaacttcttgactccgagtcctttcgccaaacaatagataccgcggtcttcatagaattagtaaggaagatcctaagatcaagcctccctctacactacaaagactgggttgccgcttgtcttgtcaaactcaccgctctctcctctccctctcaatccctcaacaatccgatcaatcttgaggtaactctgtacaaaacgatcccgagcctcgtggaacaaatgagcttttcctcatcaccagaaacgaaagaagcagcggttttagaactgaacaagatagtctccgagggagttccagaatctatccaaacacttgcttcacaaggaggtatcgaaccgctggttaagcttcttgaagaaaggaacgagcggtgcgttgaagcgagtttgtcagtattgtacaacttaaccatggacagtgagaaccacacagccatcataagagcaggagctgtaccagtattgagacgtatcgttatgtctcaacgaccacaatgggagaaagctcttcggttactcagaaatttacccgtttaagacatttttacagattattgtcatgtaaaattttggaatcaattagaataatataatgtatgatttgtcatgtgagacgaatatacgaaaagttaattacattaagataatcggattacgtagcacgtatattactattaccatattctagagattacacatgatcaatcaaatatttaatctttgaaatgttacgcaagcaaaaatgaatttaaaatctgaaaatacaatccaacggctgagattttcttactgtgtcagtgaaaacgagagaaacgttctagttcactcacttggttacacgtgtcttgggatcgtttagcttttaagcaagcttctcttttgcgtaatttatttaagagctgcttgcttttatcatcatcactctctctgcgtccaaattttgatctttgttcttctcaaagcgaatatg

SEQ ID NO: 4955 - DNA, 3000 bp, Unknown
  misc_feature (1)..( 3000): cDNA_ID_1826621_gDNA_ID_1620748_Annot_ID_49741 3000 nt of promoter + ATG
atttagacaacttgaccttcatgtatgatcttcgtatgcatattataagcaagtaggtccatatatatatttaaacgaaaacttacgaatgataaaaattattgataaaataaagaaataaatcattgattctattcgttaatttctagtaatgtgaaagatgtggagaaaggaaaggcgatgatgttttacttcactaaactcgaatccatcactccctctggcttgcctgctcgagtcgccagcagtagctatttaaagagcaactatttcaagaaccgtccatcaaactggtattactcttacacaagccctgatgaagtcactctatgtccagacaacaaacaaaatctctactgccatttgctttgtggtctggttcaaagaaacgaggttacaagaatgggttctatcttcgcctccgttatggtccgagcaatcaagtttcttgaagattcatgggaagagttgtgttcaaacatccgatcagggcagctcagcgagtggatcacggacattggttgtcgagattcggtgtctctagttcttggtgggcctcatcctgaagcggcagacaccattgaacaaatatgcaaccaaaaatgttggaaaggtataatcacaagactttggccaaaagctaaatatattgaaactattgttactggttcgatggtgcagtatgttcccacattgaactattactctaataatatgttacctctcatttcaacaatctacgcttcttcggagactcaattcgggttaaatctcaatcctatgtgcaagcctgaagatgtatcgtacacattcatgcccaacgtgtcctacttcgagttcataccagtggatggagacaagaacgatgttgttgaccttgctgatgtcaaacttggatgttgttatgaggctgtcgtcacaaatttttcaggtgagctaaataataaaacattatgaatattaaaaaccatgaaattaattaatccttttctttgttgttgtggatgtgaatgttttttcatgctctttcttgcttcaggcttgtatagaataagagttggagacattctagtggtgactggtttccataacaaagcacctcagtttaggtttataagaagagacaacgtggttttaagcattgacttggacaaaactaacgaagatgatctgtttaaggcggtgaataacgcaaaactcactcttgactcatcacatctcatgctaatagacttcactagctatgctgatatctccactatcccgggacactacgtagtttattgggaagtaaagaacaaaaacgaagacaagaagagcaaaaagcacatagagctcaaagaagagacattctcggagtgttgtttactaatggaggattcattagacagtgtttacaagatttgtcggtttaaggaggaatctgtaggaccattggagataaaagtggtgcgtcaagggacatttgattctctcatggattacttcatctcacaaggtgcttctattggtcaatacaagactccaaggtgcattaaatctggaaaagccttagaggtattagaggaaaatgtggtagccacattcttcagtacctgatagataataatgttgctaagttatcaataaatatgcatgtgcatatgctagctgcgtattagttttctaaattgttggagtttctttttctttttctctttattggaaaaatcaatgttaaagtgtttttagtccatacaaaaacaatgtcgttttcgatagaatttcgtatgaatatttatgagcttaaagcctcaatcaacaagtttgagcctaattttaacaaaaaagtataagccataaaagacctcacatgatccattaatttctttttgattggcgtatggctaatatgatagacaaaattccaattcactacatgcaaacacgtaagtaggataccagttcccatatttttttttgtcacaaaaaccagttcgcatgttattatcacgttgtgttcacgtacttattaaatttaattagtttgtcacaaaacgtaagtagtgatgaattagagagtcaaaaccacatgcatgctggttttgttatttagccctttaattttgttgacattatgagagagtaattgtttggcgcttgcacgaagtcacgaacttcaacaccgttcaccaccaccgccaccggcaccaccactttccatttttctctttatcactaaaagtcatcttgacaaaaaatcaaaaaaatcaaattattaaagaagacaaaaatttttattcgttaatttgtataattgaaggctgtaattttctagatcttgctacggaaacaaatgtaggtaaatattaatgagagtatattgcagagcaaaatagcaaaatgcgaataagagtggtggaggtatccaaagaaacaggttttcaagatttgacttttacagttttactaaaaggtttctacatttatagcaaaatataaaatgatttttcattaaaaaaaaattagaatttgcttgtcagggaaattctaataaaatgttccaccttttaaaaaataaacatataattttaaataattgtctatcgattataaaaattacatattgatacatatgaaaagatttggactaaatatggatatttatccagattcggatcgagaaattcatataccacactttaagcattcttatgatataattttgttattccgactatagtaaatattgtttcttattttggtcaaacagtaaatgctaataaaatacatcacattatcgacaacgaaaacaaaatataaaataataattgtcatattatcgacgtcataaaaaataatataaaatgtcatatttttttgaataaaagatattttaacctatttatacttctccgtccagtcatcaaagtcgtctcattgtcgtcgtcgttatttttatttctcgccgggaaacgaaaaaacagaaaaagtttgaatttttaacttcgaaaagctatg

SEQ ID NO: 4956 - DNA, 3000 bp, Unknown
  misc_feature (1)..( 3000): cDNA_ID_1826617_gDNA_ID_1620748_Annot_ID_49742 3000 nt of promoter + ATG
aaagattatagttatccaaaaatcaataatcattaaacgaataattatatggtttatcataattatttattttaagatagtctaatagtcagaaaatctgaattgaactgttacgtgtatttcgcttatgcatacaacaaaacaaacttatcacaatttaaggttgttttgagtttttctctatttacttaaaatacggtaaaaaaagcaaaacgcgtttaacaaaaataaaatattcccaaaaaaaacttttatgccctaaagttgattaaagacctttctacacgcatctaatcatctcttctcatcaaaatcacaaaatcacaaattcgattttcctcttctcttcttcttcctcctcctcctctcggattcttccttaaagtttccacctttcgccaccgagaaaacattccggcaaaccctcgtcggaatacttaatctctttgataatctttctctctggtgacgttttgtgaatggtggaaactaatctgattggtgataatcataggctcaccctttcaactaaaagggcgagctttctcatcatccctctctctcaagactctgttttctcattcggttcttgcaaagaaggctggtacttccgttgcattggccttgacccgtgaaccaatcaatcatcatctccgatcatattttcaataataatttctgtgttttgattttttgagaattttgaaaaaaagatgttgctttacaagaaaaagaatcagattgttaaaggaaacagaatcttgatcagcgtaacgtttcttggtagtgctggtccgatccggttcgttgctaatgaaggtgatcttgttgcatctgtgattgatactgctttgaaatgttatgctcgtgaaggtcgtcttcctattcttggatctgatttcaacgattttgttttttattgtccaatggttggacctggaggtaacttgtcaaatacgcaaagtttctcctctgttttgtgattatataaagattgttttttttttaatttttagttttcttggtgtagctttgagtccatgggaagcaattgggtcggtgggagtgaggaactttatgttgtgtaagaagaaaccagaggagaagaaggttgaggaagataagggaagatcgaattttccgattaatggagctagaaaaggagctggtggaagttttaaggcttggattaataaatctttaagacttaaagtgactacccattagagagactacttatatgttgtcttctctgtttctttgaatgctcatgtttggtttgtgtctttgttcttttgatcttcttattttatgaacttttgatttgttttttttgtttcttatgatggtttcaggaaataaaagtttcaagttcatttgaacaaaaaaaaagaagtttctttcgctatagatttttagtatttgtcctttttgtttacaaaattagtttagaactttgatcaccagaaatgtgaaaatagcattgcttaaattagttaataaatttagatttacgaaaaatgtgaaaattgcatggttattctttagtatattcgactttgcaagtggttcagaaaaaatgagaaaaaggcagaattttaacaagagaatcacaactttgctttaggcgcaaattgtggaatggttgttggggaaatttgatcattttcttctccaagagtagactttattggttattgagatttgagatgagatactaaaatagcagatattaagggattcgaattttgaattctttcaatgtttcttttctttattatctgtagacagttagttaaaatatatcccttggagtaactaatcaactactttcattttataaataaagtctatattacataaacatgacatatctgatatctcctaaggccctatttaaaaatatatatatctggttggtcttcctctaatacaaaattcacaactagtaatattttgagagtagaattctcctatattagaatatagaggtaaaactgtgacaattatattgaactcggatgtgaccttacaagtgaataaatacattatacaagtagatttggtcggtttatggcgtgtgaactcgatccatcttcttataactcttgaaaatctcatgaggcatctacttcaaatgatcatttgggttttctacgagaagtttatttgcctcaacaagaagccactccaaaaaaacaaaagaccaactaataagacaagttgttgtagtgttgtagcaaattaatgacgagttcataaacgaatattgaccctttcatattacccttttaagttgtaacaaaaaaaaaacattgaccttttcatttttggacgcagatatcgtaatgaattaatggaaatggataaagatgaatatcgagatatactagaagatttcaaaaaaacaaaaactagaagatttcaagaagaaatccaaatggatgaaaaggtactatacaatgtgatgatctgttagttctatccaactaagcttaataaaccaaatgtacctcaataatgtttgcgactaatatactcaaaatagggtttagaaaagacagaaaaatattaatgaaacatgtatgtgtgatacactcaaggtaattttcattcataatttactgatatgcatgtgattggtaagttaagataatattagtaaatcaatgtaaagtttaagcttccattcatttctctcatatgcatgtgattcggaggatccgaggaatttgagtccataatatagaatttcttgttttcagagatctcagattgtcaagcatatgttagtatatcccaagttcttaaggtacaaacatgaagaatcttttggtagcttaagatctttccaaaatcgtttcacacgtttcccaatatttctgatttttaatcaaattttcaggtgcttcgtgatttattaatcttttgtccttgctctatttatagaagcaagtgtgcagttcttagtttcatgtgaattaaaggtaaccaaatatg

SEQ ID NO: 4957 - DNA, 3000 bp, Unknown
  misc_feature (1)..( 3000): cDNA_ID_2052198_gDNA_ID_1620748_Annot_ID_166716 3000 nt of promoter + ATG
agacgacgtaaaaaccaccctattaaccgtactgcattgctagcttgtagagtcgtagaccatataacatataatgacaaaaacaaatttttaacctctttgtttttaattgtcaaactaacaaagtgtagcttagaatctaattagcagaatatatatatatatatatatatatatatacatcattttacaaaattatgcattcaacataataaattagtaatagcaattattaatgaaaataaattagaataatatatagacaagatggtaaattaatgtttagtaataaactaaataaatggatagagtttcacaaccagtcaaactcaatcttcttaattatataagaagaagaaagaaggctaattatgatggaatggccatttttgaatgattcaactgggtttatatatatttgtataggcatatagccaatgctttttttgataacttttgagctaaaggtgatagatatttgataatttgcttggcatattagcacatgtaagaagataatcaaaatgttgaattaaattttgaaggaaaatgagaaggtgggacaaaggcggcaaatgtcgaatgagacaatgtgttatcttaagtctgaattaacgctgattagcaaatattcaaataagtgtgaaaaaaggaagaggtcaatatccatttccttgcaagttgcaaccatacaatctgaccggtgtgacccaattgtccaatagtaaaatatataggtccctaaaaataataatgcgacttgagatagtgacgactgacaagaacggtcctccgattttattatttcaaccttctttcaacccctattcggaaccaacttgatagtacatcaaaccacttatacggatttgtctttgatatgtttttttggtttttgcattatcgtgatgtgttgatgcaattttggtttttgtttgttagcatcacgttcttatcttcatgaaaatatacgtaactgtgaccgaaaagagctgtacgtgggtttcatccaaaatgtgatcaagtcctaacactttttttctttctttttttctgttgttgacttctactatagaacattatacttaagaatttagatgctgtatttttcttttcatatcttctactacatataaactgtacatatacaacctaaatcgtcaaaccaatctacccacaatcataacaaataagcacgaactcaaatggtcttaagtgaaacatgacatagacttatatactagcgtggcacctcaagaaagaacttcaaacccaccaatgattaaaacttggctcttgtcctattaggcttcgtgaatgatctcctcctaatcttccaaagtaaaaaggtcggtgcacgatgcaaggcttgtaatgttctctttgaatttatggtgagattcgatacgatgttagtgtcaagatccccttttttcttttagactcttgcttggatgataattaaggtgaatatttatgctatagtgcctatccatttcttcatcattgtcacgagatctaaaacccatacttattatactttagggacctcctaaaagacacattgagcttttgatcgcgtgttgctttgttatcatctttgcccactttagggacctccaagtgtcagaatttttcttttgaatagttagaggtttcttatcaaaacaaaaaaacaagaatagttagaggttttgaccccaaaagagaaagaatagttagaggtagggacattcaatacaatttttcgtttaagctctttagttttgaaatttcaagatggatataaagttgaatgtacttttggataagtttaacacggtttggattttttcgtttcaatatttttgaatcattattttccaattggttgtcaattcatttaatttagagctgacctagagatatcactatgtaataaagtaattgttctattcaaaattgttagctcaaacctatgtggtctaaaatgttttgcatacgtgcattatttttccacaaacttttccatcgatttagacatcaatggtctgctgaatgttgacgacatctagttttatatttgtattcaatgtctattttttgaaacgaacccgcaaccacaacattgagtattcgaagtattttttttttaactgtaaacccaaacgcaaaactcatgaaatatttttaccggctgagcaaactattatccatatttaaataaattttagatgttgagagctgatctcggattgcgtcactaatggcaacaatgatttacactttcacgtttgggagcttcaattggcaatcgaataagcttgactctttgtagttcagtatggagatacaaaaacagttatattttgctagtcaagcaagttccacaaaataagctttttgtatctccgacttaatattttcacgtttgggagctcaaacctatgtcttcttccgccaaggcatgttcctaccattgattatattttgttttgtggctttcttttgtaatatgatcattttcgtaaatttcgatttttgttatctattcgtagtgtctccgtttttcttataaaaagaacaaaaatggaagattataaaaaaatgaagtggttttatgatatgacgtgatgtttagtaaaataacgttttatcgaacggtttcacaaacacattgtacataaattactgaacgagaaatgttatttgtctacatcacgagtaaaactttaatgcatgtcaataccattgacctaattaatgaaaaatgttgaattaattaatgcatataccctactttttattaacatgaaacgagtcaaataaaaagggattgactcaataattttagaaatactgaatgggcctgggccacgtaaagtccaagtaaccttaataacctaaaaacccggaacacctgttgtgcttaaaccctagaccctaaatcttagcgaaattaagcagagcaacattttcgtaatccgatctccgtcgtcgtcgtcgaatcagataaaaatg

SEQ ID NO: 4958 - DNA, 3000 bp, Unknown
  misc_feature (1)..( 3000): cDNA_ID_2052200_gDNA_ID_1620748_Annot_ID_166715 3000 nt of promoter + ATG
atattataaataaacgtttgtgtttaccaatagcatagttccagaatatgacactgccaactttgccaaactctccctcatgcaaagcacatccctggatgtcaggagtggctttcgcaacatcttgtggtcttccagagagcatgtgatggaacttctttgccgatgctttgatctcaatatctacctcaagttccccttgtagagaagactgacgcgtagcttgtgccatttttcttatacggatgttttgcttctctaggttttaatgagagtgagtgagagtctctttggaaattcatagccacttttatagaggaaagaataagcaatctgtggcaagagtcattattctaaaacaacagagtttcggaatgttggaatatatatggtcccttacggaagggaaggaatcagaccaactagctgataacaactacaatttcttttagtcagttgtggccttatgggaatcgattcagtgatgtgtccacaaaaaaaaaatatgtttcaagattgttataggctgctattatcgaccacatataccaacgacaaaagtaagcccgttcagaagaccaatatcgttattcgaaagcatgtacgttgtcttgaagccctgcttgtagaatctgcaaattaaataacttctcgtatagtactattcacatatcacaacacaacttccattaatcgatttttgggagcgtcatgtgtatttttatctaataactctaacaaatcattgtaaggaaggatgagtaattcctctaagctttttacgtagaaacttttgcatgtaaatacttatatgtaaaatttatagcgaaaatgaaaacatttgagaaatgtatattagtaaaagagaatcacttttttcatgtcaattttctcttttaggaaattcggtgcatggaattcatgcttagttagctttaggaatataaattcctcatcattgattaatcaataaaatagatagtataataccatactattagaaaataaatttatccaataaatagagtcatttaaaaaaaagacgattgtgtaaacatttaaaaatttaatggttggccatttgtaaaagtaagtgcacacaacaattgaaataggtactttgtgtcaaggatatgatatccttgacacttcagatctattctgtgagtaaaattaatactgtattttcatattagttaatatgcgatttgtttcatgtcatcatttatgaaaatttataaaaatattattttcatagcaagatctgatttatttgacaaggaactcggagacattgatgatatattcatgattcagacaacaatctagtctcgaggtcgcgtgtgtaatcttcaacgaacgcagtgtatctggtagggggaggaacgtcgtcatttaacttctcgtattcccatgtccactttgcaatacaaactttatgatccttaggaacaacgtcaagtgttatcttatagctcttatattgctttaacacatctccttcaagagctaagaaagacaccgacttgttctcttcatctacgtctatcttctctttgatctgctccatttttccatctataataaacccaaagtaaccgatggaattcaagaattagaaaaaaaaaaaaaaaaaaaagagagaaaaaaccctatttttcaagactccttaaaaaacatagacagctagttatagtacataccaacgatgaaattccagatctgaatagaggagttggatgtgggatcgtcacgatgaacataaactgcctctgtcttgtccgtgaaatttccttctttcttcttgaaagtcttgaagaatctctcggcggtcatattcacttggatctctaattcgagagtctggacaccagccatggctctaagataatccagtctctcacgctgacttttctgttgtttatctttaccataacaaaaagcatagagtagaaaaccaagagaagaaaacaaaaatagaggtaggcaaggtaggtgccttatgcgtagcagtttcttgataagcataacacgtgttgttaattcatattttaagtattgtctaagtgtattatacaatatgtattttcatttttgtgtttggtaagaacagtatttattttcatttaacaagtaacaggaagcgtaattttgttgttggtaaactaaggaagcgaaaattattttattaactaagaacaatatttaaatgttttcttttcaccataaccaaagaggacacatttcataagaatgaatatgcgacacacactacacgttggtcttagcccatatttggcccagacctataaagtataaaccatgcatgacgctgactctgagatacgttcttggttcggatcaaaatcaaaccggtatataaaccggataaaaccgggactggtaactgagtaagaatattgatgaagagaatatgccgtggaacagagagagttaaggaaaaagattcgtgagtcattcgcatctctctgactctgattctctctgcttagttctcctcgttccttctctctctctctttatagcatttcttctccaacaattcttttcgagtttttacggccattgcttcaggttctatctttctctataggtttgcatgttttctatgcaatcattttctgtaatatagctatgtgtgtttgcttcttcttagcttttccgttgaattttatcgaaacgctatatgctttgtggcccttattcacataaaattcatacgaaatggaaaagagaaaaagcagatacaattctggtcattgataattcagcatatcatgcagcaatcaaattttaggtgttgacttgtaaccaatatttctctctggaaaacacatgtatgaccaattattatggtttaatttatgaatacatttttatttttgtcatcagaacagaacaagggagacaacaaagtagtttgattattctggtggcgtatagataaatgttggttgtctgtggtttagcaagattacc

SEQ ID NO: 4959 - DNA, 3000 bp, Unknown
  misc_feature (1)..( 3000): cDNA_ID_1808979_gDNA_ID_1620748_Annot_ID_166714 3000 nt of promoter + ATG
cctaaatcttagcgaaattaagcagagcaacattttcgtaatccgatctccgtcgtcgtcgtcgaatcagataaaaatggcgaagcgtttgatcccgactctcaaccgtgtattggtggagaagattctcccaccgtcaaagaccgtctccggcattctcctaccggagaaatcatctcaggtaaacgaatttctttaaaattctcatctttacccatttcttcgattggacgaactagaaatttgttggatttgattaaacacagttgaattccgggagagttatagcagttggtcctggagctagagacagagcagggaatctaattccggtttcggttaaggaaggagacaatgttcttttgcctgaatttggcggtactcaagttaagcttggagagaaagagtatgttcttaacctgttcgatgtaattcctctaagagtgaaatttatcagtattttcgatttctcactgtgtgtttcgttctctttgcaggttcctattgtatagggatgaagatatcatggctacacttcacgagtgatgtgttaaagagatagaatttatgattcctctttgttttgttgtctgcaattgtctgacatttggatcaattgttatgattgttcttcactgttggcaacaagttcttataattcaataatctcttttgtttgggaatgatgatgatctacttcttacatagagattactgactataagtctagaaatgcttcttagtaatgtcgactgattaggagaaacagagaaaccatttgtttcactgttctaagaatagcaattttggaaatgatctactcaagaagtttattgcatgttccaactccaatggctgcagcgaggtgccagcctgcgtgaaggaaaggtgtctcggggaagaaatcatcagctatgaacagagcacctcctagcaaggaagacatcttgtgtacgttatgagctgttttgagatctggatcctttaagcttcttttagcaaatgcgacctccatcattccagtgtgaacggcagagaccatgagaggttgaaaaggtagaactaaagctgatgcagccatcagaaattttgggttctcattccttagagcccttgagagacactgtccacataaccagatttaatcggttatatttggttaaagaagaatttggagatgggttaagaagagtggaacttactattgttgttgtggctatcattgtgtaatctacccatctcaggtacttcctcaactttcccctagaggcatgatacagactcgacgcaattccaactccaattagggagtttgcgtacacctttgtgttcagattcttcctacatgggatagtatcttgtcagagaaactctacttgaaatgatatttgcaaagagaacattttaccttggtgcctgcattccgaggaagatgaaaggaagtgaagtagccacattagcagctgtttctaagacactctggtcacctgtcatatgtttcgattgcataataaaaagaccgatcaaccatcttgagattggaaagataaaagatcgaaaacaagaagcgtaccgcgaatgctgcaacagattggccttaagcatggaggtctttgctgccaaaaacgtctgtaacagagaaactaaatcagtaactgaaaccgtttcaaaagctgagaatgtcacaacctaatgttatgtaacatactcgatggaaagtctttgatttgattccatgacagaggatttggtgttggtctgaaagtcactaacttgagttgtcttctcaaatgagaaaggagaatgagacgtgacatgaaccccgtggataccctcaagggcattgctcgactttgatacattttgcagactcatggtaatcttgctaaaccacagacaaccaacatttatctatacgccaccagaataatcaaactactttgttgtctcccttgttctgttctgatgacaaaaataaaaatgtattcataaattaaaccataataattggtcatacatgtgttttccagagagaaatattggttacaagtcaacacctaaaatttgattgctgcatgatatgctgaattatcaatgaccagaattgtatctgctttttctcttttccatttcgtatgaattttatgtgaataagggccacaaagcatatagcgtttcgataaaattcaacggaaaagctaagaagaagcaaacacacatagctatattacagaaaatgattgcatagaaaacatgcaaacctatagagaaagatagaacctgaagcaatggccgtaaaaactcgaaaagaattgttggagaagaaatgctataaagagagagagagaaggaacgaggagaactaagcagagagaatcagagtcagagagatgcgaatgactcacgaatctttttccttaactctctctgttccacggcatattctcttcatcaatattcttactcagttaccagtcccggttttatccggtttatataccggtttgattttgatccgaaccaagaacgtatctcagagtcagcgtcatgcatggtttatactttataggtctgggccaaatatgggctaagaccaacgtgtagtgtgtgtcgcatattcattcttatgaaatgtgtcctctttggttatggtgaaaagaaaacatttaaatattgttcttagttaataaaataattttcgcttccttagtttaccaacaacaaaattacgcttcctgttacttgttaaatgaaaataaatactgttcttaccaaacacaaaaatgaaaatacatattgtataatacacttagacaatacttaaaatatgaattaacaacacgtgttatgcttatcaagaaactgctacgcataaggcacctaccttgcctacctctatttttgttttcttctcttggttttctactctatgctttttgttatggtaaagataaacaacagaaaagtcagcgtgagagactggattatcttagagccatg

SEQ ID NO: 4960 - DNA, 3000 bp, Unknown
  misc_feature (1)..( 3000): cDNA_ID_1826607_gDNA_ID_1620748_Annot_ID_166713 3000 nt of promoter + ATG
aatcagtaactgaaaccgtttcaaaagctgagaatgtcacaacctaatgttatgtaacatactcgatggaaagtctttgatttgattccatgacagaggatttggtgttggtctgaaagtcactaacttgagttgtcttctcaaatgagaaaggagaatgagacgtgacatgaaccccgtggataccctcaagggcattgctcgactttgatacattttgcagactcatggtaatcttgctaaaccacagacaaccaacatttatctatacgccaccagaataatcaaactactttgttgtctcccttgttctgttctgatgacaaaaataaaaatgtattcataaattaaaccataataattggtcatacatgtgttttccagagagaaatattggttacaagtcaacacctaaaatttgattgctgcatgatatgctgaattatcaatgaccagaattgtatctgctttttctcttttccatttcgtatgaattttatgtgaataagggccacaaagcatatagcgtttcgataaaattcaacggaaaagctaagaagaagcaaacacacatagctatattacagaaaatgattgcatagaaaacatgcaaacctatagagaaagatagaacctgaagcaatggccgtaaaaactcgaaaagaattgttggagaagaaatgctataaagagagagagagaaggaacgaggagaactaagcagagagaatcagagtcagagagatgcgaatgactcacgaatctttttccttaactctctctgttccacggcatattctcttcatcaatattcttactcagttaccagtcccggttttatccggtttatataccggtttgattttgatccgaaccaagaacgtatctcagagtcagcgtcatgcatggtttatactttataggtctgggccaaatatgggctaagaccaacgtgtagtgtgtgtcgcatattcattcttatgaaatgtgtcctctttggttatggtgaaaagaaaacatttaaatattgttcttagttaataaaataattttcgcttccttagtttaccaacaacaaaattacgcttcctgttacttgttaaatgaaaataaatactgttcttaccaaacacaaaaatgaaaatacatattgtataatacacttagacaatacttaaaatatgaattaacaacacgtgttatgcttatcaagaaactgctacgcataaggcacctaccttgcctacctctatttttgttttcttctcttggttttctactctatgctttttgttatggtaaagataaacaacagaaaagtcagcgtgagagactggattatcttagagccatggctggtgtccagactctcgaattagagatccaagtgaatatgaccgccgagagattcttcaagactttcaagaagaaagaaggaaatttcacggacaagacagaggcagtttatgttcatcgtgacgatcccacatccaactcctctattcagatctggaatttcatcgttggtatgtactataactagctgtctatgttttttaaggagtcttgaaaaatagggttttttctctcttttttttttttttttttttctaattcttgaattccatcggttactttgggtttattatagatggaaaaatggagcagatcaaagagaagatagacgtagatgaagagaacaagtcggtgtctttcttagctcttgaaggagatgtgttaaagcaatataagagctataagataacacttgacgttgttcctaaggatcataaagtttgtattgcaaagtggacatgggaatacgagaagttaaatgacgacgttcctccccctaccagatacactgcgttcgttgaagattacacacgcgacctcgagactagattgttgtctgaatcatgaatatatcatcaatgtctccgagttccttgtcaaataaatcagatcttgctatgaaaataatatttttataaattttcataaatgatgacatgaaacaaatcgcatattaactaatatgaaaatacagtattaattttactcacagaatagatctgaagtgtcaaggatatcatatccttgacacaaagtacctatttcaattgttgtgtgcacttacttttacaaatggccaaccattaaatttttaaatgtttacacaatcgtcttttttttaaatgactctatttattggataaatttattttctaatagtatggtattatactatctattttattgattaatcaatgatgaggaatttatattcctaaagctaactaagcatgaattccatgcaccgaatttcctaaaagagaaaattgacatgaaaaaagtgattctcttttactaatatacatttctcaaatgttttcattttcgctataaattttacatataagtatttacatgcaaaagtttctacgtaaaaagcttagaggaattactcatccttccttacaatgatttgttagagttattagataaaaatacacatgacgctcccaaaaatcgattaatggaagttgtgttgtgatatgtgaatagtactatacgagaagttatttaatttgcagattctacaagcagggcttcaagacaacgtacatgctttcgaataacgatattggtcttctgaacgggcttacttttgtcgttggtatatgtggtcgataatagcagcctataacaatcttgaaacatattttttttttgtggacacatcactgaatcgattcccataaggccacaactgactaaaagaaattgtagttgttatcagctagttggtctgattccttcccttccgtaagggaccatatatattccaacattccgaaactctgttgttttagaataatgactcttgccacagattgcttattctttcctctataaaagtggctatgaatttccaaagagactctcactcactctcattaaaacctagagaagcaaaacatccgtataagaaaaatg

SEQ ID NO: 4961 - DNA, 3000 bp, Unknown; identical to SEQ ID NO: 4956
  misc_feature (1)..( 3000): cDNA_ID_2052218_gDNA_ID_1620748_Annot_ID_166708 3000 nt of promoter + ATG

SEQ ID NO: 4962 - DNA, 3000 bp, Unknown; identical to SEQ ID NO: 4955
  misc_feature (1)..( 3000): cDNA_ID_3074958_gDNA_ID_1620748_Annot_ID_166707 3000 nt of promoter + ATG

SEQ ID NO: 4963 - DNA, 3000 bp, Unknown; identical to SEQ ID NO: 4954
  misc_feature (1)..( 3000): cDNA_ID_1826625_gDNA_ID_1620748_Annot_ID_166706 3000 nt of promoter + ATG

SEQ ID NO: 4964 - DNA, 3000 bp, Unknown; identical to SEQ ID NO: 4952
  misc_feature (1)..( 3000): cDNA_ID_1826633_gDNA_ID_1620748_Annot_ID_166701 3000 nt of promoter + ATG

SEQ ID NO: 4965 - DNA, 3000 bp, Unknown
  misc_feature (1)..( 3000): cDNA_ID_3074947_gDNA_ID_1620748_Annot_ID_166725 3000 nt of promoter + ATG
tgatagaaaagtttggtctcgttcaatatgtaagtcaagtgattcggctcttcttgcaacctaattattgcatgtttttgagtttttgtgataattgtgtcagatgatcctcaaaaccttttgtgccttcttgacatttttgttggagcttcttggtgtctatggtgatggtgaattcaaatggtattacgggtatgtgaattaactattatatcatagtatttgttatttcatcagatggaaagacaggtgatgagtctttgattctgtagatatccatacatagtggtggtgctaaacttcagccaaatgtgggctctgttttgcttggttcagttctataatgtcactcatgaacggcttaaagaaataaaaccgttggctaagttcattagctttaaggctatcgtgtttgcgacttggtggcaaggcttcggtatcgcgttgctttgttattacggtatacttccaaaagaaggtcgattccaaaacgggctgcaagatttcctcatttgcattgaggtaacttaaaagctctttcccaagtgccactcgaactagcgatctctattctatatgagctctttccaaacataattatgtttctaaggattctactacttcttggggtgtacactggcagatggcgattgcagcggtggctcatctctttgtttttccagctgaaccttaccactacattccggtatcagagtgcggtaaaatcacagccgaaacgagcaagacggaagtgaaactagaagaaggtggtcttgttgagaccacggagactcaggttgaagcatctggcacaagcattaaggagagtgtacaggacatagtgattgacggtggccaacatgtcgtgaaagatgtagttcttacaataaaccaagcaataggaccggtagagaagggtgtaacgaagatccaggatacgattcatcaaaaacttttggattcggacggtaaagaagaaacagaagtgaccgaagaagtgaccgttgagacttcggtgcccccaaaagagtgatcgttgaaatttgccctttgttgtgtagttttgtttcacagttttcttttaacgatttgtatcttttataaaagatagtatattagtacttgcactgatttttatttatttttacaactctcatacttatcttatattgagaagtagaacaactactctttgacttctacaataaatctatcttccgtaagcctgaaaatcttcaataaatctatcttccttaatatgcataattcacagatcaatttcgaatttggtaatacaatttcactggacttctagaaaatagaagagcttcaaagtgagaatcatatgcaaatgagctaaatatggtatacgacttcgacttattcctgcaaccgcgggagaagtcacatgcaattgccatgctataagtctcttaccaaaaacgacatttcttattaatgttatcacatgcttggactgtgataaggtctcaattattatgtttccttgttcactctccatgatattattagtcctaaatggttttctatttttatcatatagcactaatattattttgaccaatagataaatgatcatgatgtatatataatttttatatatgaccgacgcaataatttggttcgtattgctaacgttatcgtgtcacctaaaattaaatcgacataattattaatgttgttagaataattaagtttataaatatacattaagcagatgtaatggtccgttagatttggaaacacttgaacatgtcgtttgtgctttgttgaaagtatccatacgatcaaagatccataaacgatcgaacggttgatcttgatgttaaaaaaaaaaagaaaacgatcgaacggttaagaataattgccatcacattggaaactctcgacgttgatcatgaccctccgaattaaacggccttgataatggagaacgtgagaaacgtccgttcgagaacaagacaaaacaaacaagaaacgaaagcacatgtgacatgacatgattcatgaacatgattatttgattagtcagctttctttgccaaatctgaattcgacgttttacttacagacttctcttgtccaagttcctcattcgtgctccaaagttacttcatcaaattcgtatactactctctgttttttaatgctctttgctccaacatacggactcttttaggtatggttttgattttgggttctttatttattttcttcgacaaaaagatattaaactctgcggacattaatctcaactcgtcgaacattttactagattatataatggcgggagaggtccaagatccgtttaacctaagccttttggtaatttttgcaactttattgtttatttcatttccagatgatatacgttcaattcaattattattaattatgaattgaacatatataatctagggcacccagaatacttctatagtagcttgatatacacgaaacttatttccagtttatatatgcatagacgtttttcagcaagaagagtgttcctcatctttttctaaatgatttcacaatcttaaacatcttgaaagaaaaaaattcacttttgattcgttcggagctttctttattcagattagctaggagcggctgataagcctaacggttctaaaactattttgcaaaaacagtttattcgagtttaaaaaggaatcattttatttgtatgtgtgtgtagatcttttagtaactctgttttatgaaaaacagagaatgttttctattccaatagtatgatttccttttcaagtttttttatacaaacgaaaacattgtgtttgaaacaatgatatttattttgaatgggctctgcaggagaattctatacactcgggatcagtatcatttggaagattcgagaaggaatctttatcatgggagaggagatcatccttctctcgcaatatatatcttgaagaggcagagagattctctaaaccaggctctgttactcag

SEQ ID NO: 4966 - DNA, 3000 bp, Unknown
  misc_feature (1)..( 3000): cDNA_ID_2990883_gDNA_ID_1620748_Annot_ID_166721 3000 nt of promoter + ATG
tcttcctaatgccgcttttcgaatacactcccaatgtggtcctcggtgccatcattgtgaccgcggtcattggtctcatcgaccttcccgcggcctgtcacatatggaagatcgataaatttgatttcttggtgatgctttgcgcgttctttggtgtcattttcctatccgttcaaaacggtctagccattgcggtggggctatcgttgttcaagatattgatgcaagtaacaaggccgaaaatggttataatgggtaatattcctggaacggatatataccgagatcttcatcattacaaagaagcacaaaggatcccgggatttcttgttttaagcatcgaatctcctgtcaatttcgccaattctaactacctcactgaaaggttagctatgaaactacgatcctttctatatagattttggaagttcggatacattagactttgatctcttaaatgtttatgaaccctgatgtttattagattgtaaccacatttcttaatacattttttttgtcaacaccacatttcttaatagctatgtttcatttactaacattctctgcttttgtgttgcataaattttttgtagaacatctcgttggattgaagaatgcgaagaagaggaagctcaagagaagcattctagcctacagttcttgattcttgaaatgtcaggttagtcttgatagaatctattagaaacccgtataggaaatgtgattagacttaaaggcaaattcactcattgctaattagttttaattttctaatgcaaaaccataaaactcaagaaaaccaatatatttcaactagctaactttgcttttatatatgttaaagccgtgagcggtgtagacacaaacggagtgtccttttttaaggaacttaagaaaacaaccgccaagaaggacatcgaggtaaaaatagttgttttcacaatccgattttgtcacttatccaaggaaactaattagattttgatctaaactggatatttattttatgtgtgaagcttgtgtttgtgaaccctctaagcgaagtggtggagaagcttcaaagagctgacgaacaaaaagagttcatgaggcccgagtttctcttcttaaccgtcgctgaggccgttgcgtcgctctctcttaaagggccatctctcagtaacgtttaactataattttttgtatcggtccaatattgatatttaaccgatggttaaatttttctttttgtctctttttcatcttttaatttcagtacagatgtaatattacgttcttctctctctttcttcagtgatgattttggtcaagatatgtttgtatgatttcgccattttgtagtttactaggccatgtttagtctccgagaataaaattgatctagaatcgaattgatatcttagctagatcaaacggatgtatatccaaattatttatgaaataaactgattaaataaaaaaataaaaataatatttttatttaagataattatgttttataatattagaaaatatgaccaaaccatgagcagaattgtgttaagaactttgccaagttagagcttacattatatatcaaaagtcaatgtgtaattgtcaagagggataaaccgacgcggatgaatcgaagaagcaattgctttcaagaagacttcaaatcagctatgtgtctgcgattataattgtgtaaacgttataagcaagaaatttatctcaaaataaaactggtctataaatcaaatcgaattgaaaatttagctagattaaaagatgaaatgaactgataacataaactaatagatatttttaataagatgttactacttttgtgaaatgataaaatatttctgaagttaatcgaattcattcaaagctatgataacattgtgacttctaggaaaaaacaattcttgatacggtcgcggaaagatcttgataacattgtgacttccagtcttccatatggcataaggtattcttttacactaatactttcccgacaacaacaacgaaaaactccaacctttttttaaaaggccacatagaatgcatgatagaccatctgaaagaaaatggacagggtggcttaaaagtgagatttcttgggattgcataggatgttataattaaccctagcttgaaaaaaaaaagacgattagacaataagaaatagaatttaggtcaacttagttcggcgaatatgatcttgcattgcaccttctttaccaatttatagtgatcttttgctccttataagcacatgtttaaatcaccactacgacattgtttctgtttgggccaaatgcacacttgtattttatctcacaacgagcttatgagaaatcaatcctagtaatacgttaagtggcccaagaagttttggaccggcatttacgtgtatataaaaaaatattatgattacttttagatgaaaccacacttaatttcttcttttttcttggtaaaccacaatatctctttattgtttttatcaaggattcacaaaattcattgaatggaaattttcatttatgtgtgacatgtagacagtcagtccactctaaaaaatctcagtcaatttcgtaacaaattcataacctatttcaaacacaattcataaccataacttataaatactacataaatgatatttctttatatcatcttaaatggtacataaattaggggaaagctaagatatatatagtattaaaaagtacaaaaatagataaggtttataaatgtttaaagaagtaataaaatagaaataagaactaattaggtcgtcatgtgtttgctgtataaaaagctgtaaagggacatctctcgtaaatctaaaaatcatcaaatcttctccttctctctctctctctcacacactcactagcttctctgttaaaagcttccgtcatcacatagagaacagagactgacactaactcacttcctaacggtttccacactcaaaattacacttttgccactccggcgaacaacaat

SEQ ID NO: 4967 - DNA, 3000 bp, Unknown
  misc_feature (1)..( 3000): cDNA_ID_1807205_gDNA_ID_1620748_Annot_ID_166720 3000 nt of promoter + ATG
gcacccaaccaagacaacgttataagaacttaagaagagcaaaccataagcatacttagttaaggtttttaacgaggacaaggaaacgaggaaattaacagtgcataaagaatatatagataccaaatggaatgaatgttttttttatatataattaaatcgaataaatgttattagtaatagtattactaaaacaaaactggtgaaacgaaacagaaatgtgatttaaatggatataataactagaaaatttgatcaaatgcttcgtatgatttacctataggcaaaacgttcgtgttcgatacaaaactaaaaacaaaaatctttgaaaaatacattgttatatcaagctaattttctaaagatgcgggagctagtggaaattgtgatttcaaactccttggttgatcattgtaaagaataagaaaaaaaaaacacgatcagaaatcataatgaaaccaatgctcactttttgttccaccattttttagatggacccggtaacaattagtggatctagaatcttcagtttggattataacttatcgaaaacagtttagtattttgactcaattctgtacattggaatcaattatgaacaaatttcattatatatagttagctcatcttattcttcttaatttgtgttccgacataaaaaaacatagaaaccgaaatagattcagttagcattcacttcttattgagaaaatatgtaggttaaaattgtaggtttttgccatgcatattaccgacgtagataggtttggtcggaattttttctacttctttaataagtttggttagatcattcatcttatatgaatatgtaaagaatgcttttaattatggtcgtttcgtttctttcaccagaaacaaggaatgtccgagattcacttattaaattaatatatacttgatctgattcacacgaaaagacaatcttggagtatcaaactataatatcacttattatactttgaattactaggaatttttatcctccgatttcataatgatcctactaacattggatcacaacaagttggctcggttatgaatttggtttgcaacatatacagtttttcaaccgctgttaattttagtgttaatcaattatcttggataattgttgatgcaagatcagacattatatccatatatataaatatgttatatagatatgtattaatatctttagccaaagacgataagtctaaaatcatcaacattttttgtccgggtcaatgtaacaactaacaactcctactgtagactagctagttggtcgtctgatcgtctctctgtttgttagcgatctcaacgggtacatgaacagatagttatgcattattgatactcaaattttcttagttgttatgtttttaatatgtaactagattttaatccgcggtacaccgcggagataatttatttttttaagttaatatatataaaaattttgcaaattatatctatttataaattatttttattttatagtttacaattgttattaagtaacgtccttccaaacccgttccgccaaacccgtcctgtaaaaaaagctcgcggtaccccgctaatttaaatttataattaaaataaatattttacgggattgcaattgtgttttagtttgtcaaacaaaattttgttttaaatagttgtcgaaatctagttcaaattttgaagaaataagatttagtgaattgataaaaaatgtatttagttgcgttttgctcattttaagggattgcaattgtcttttgggttgtcaaacattttttgttttaattagttgccgaaatttagtttaaattttggaaaaatctgcgtgatatatgggattggaatatatttagaatgtttttcgtttgttaatcaatttattgctaaaaaactaataattaaaagtcagtggcagcctttgtaaataagttccaactccaggatttatttcacaaaatggctgcaaaaatgtatatatagattcacccatttatttattattcatagtattatagtactatcttcgtgtctttttacttggtgtttaaagtttttgtacaccgattgaatcatttttaattttatttttttaaacatcaatttatctaattaaccaatagaaaaaattatctgtatattataaatcatcaaaaccaataaaaaaaaactaattaatattgcattaaaaattaaaaacatcatctaatttagaacattttttcctactataacattaacatcaactaaatacggagaaaacgttgtactgaggttcttgcattttaaaattttggaaactaagaatgttaaaaaaattatggttacaaatatatatatagtgttataattagtacttatcgtacttaataaaaaagatactaattagttgttgttatattattttctacaaaaataaaatcattcaactaaaatgttctatttgtcagtcgcttcacaaaactatgcatctaccataccagtgatcataattataaaactctgtttttgttttttgtctttacaaccacttaaatacgtcatagctatatatgcattattacaagttctcaaggtggcgcgcgaatgttttaattaaaatattatgtttttcttatgtatttcatctttaatcgaacatagaaaatgtgaaagatttggagcatagacacgaatcagttttttttttttacacgaatcaatattcatagggtaaataatagacaaacgccaacaaaaaaaaaaaagagaaattcacaacggattatcggctcaaattacaaaacaaaaaaaaaatacagagacaacagtatacgtgtaactttccgaatttttttttttttcatatcaaaaataaaagataggccaagataagaccattataaaatgtaaagaccgacccgaaataatactcatgtttaaattatcagcaaagagccaagagaggaaacatcacacattggtgacaaaaattcttaggaaaaccaatta

SEQ ID NO: 4968 - DNA, 3000 bp, Unknown; identical to SEQ ID NO: 4951
  misc_feature (1)..( 3000): cDNA_ID_2161213_gDNA_ID_1620748_Annot_ID_166699 3000 nt of promoter + ATG

SEQ ID NO: 4969 - DNA, 3000 bp, Unknown; identical to SEQ ID NO: 4960
  misc_feature (1)..( 3000): cDNA_ID_1826607_gDNA_ID_1620748_Annot_ID_49745 3000 nt of promoter + ATG

SEQ ID NO: 4970 - DNA, 3000 bp, Unknown; identical to SEQ ID NO: 4959
  misc_feature (1)..( 3000): cDNA_ID_1808979_gDNA_ID_1620748_Annot_ID_49746 3000 nt of promoter + ATG

SEQ ID NO: 4971 - DNA, 3000 bp, Unknown; identical to SEQ ID NO: 4967
  misc_feature (1)..( 3000): cDNA_ID_1807205_gDNA_ID_1620748_Annot_ID_49748 3000 nt of promoter + ATG

SEQ ID NO: 4972 - DNA, 3000 bp, Unknown; identical to SEQ ID NO: 4966
  misc_feature (1)..( 3000): cDNA_ID_2056946_gDNA_ID_1620748_Annot_ID_49749 3000 nt of promoter + ATG

SEQ ID NO: 4973 - DNA, 3000 bp, Unknown; identical to SEQ ID NO: 4965
  misc_feature (1)..( 3000): cDNA_ID_3074947_gDNA_ID_1620748_Annot_ID_49751 3000 nt of promoter + ATG

SEQ ID NO: 4974 - DNA, 3000 bp, Unknown
  misc_feature (1)..( 3000): cDNA_ID_1826842_gDNA_ID_1620751_Annot_ID_49807 3000 nt of promoter + ATG
acaggcgttagctcaagaaggcctttactatacccagcgatgcatgaaaatcccgagctccggtggggatttatacgcaaggtctactctataatcgcctttcagcttctagccaccgtcgctgtcgctgccacggtggtcaccgtccgtccaatcgctctgttcttcgccaccaccggacttggattagctctttacatagtcatcatcatcacacctctcataggtacaatcatcacgcacacttgttttacaaatcaaaagtttcaatctttttcgaagtttggtaataatctcaaaagctgaaacttggatttgtgtttctctccgatgtatagtgttgtgtccgttgtactattaccatcagaaacatccggtgaattacttgctcttggggattttcactttggctctggcttttgttgttggattaacatgtgccttcaccaatggtatgacttgatcaaccacttttggttacctgttaaggatccattaggcaacaaagttctgtttttgctattggggaactagctcttagcaaatttcatctctcagttttttctatgattctgattgtgtatatgtttaaagcttattctgtgttggacacagggaaagtgattctcgagtcagtgatcttgacatcggtagtggtgctttcgctcacattatatactttttgggctgctaggaaaggatatgactttaatttccttggacccttcttgtttggcgctctcaccgtgcttattttcttcgccttaatacaagtaaagctacttattccaatttccattggagagagtgagagttgtagtctttagcttatgaaatgtggtagttttggtatcattctttaggctaaacagttaacaacttcattttatattagacattagagagcacaagatttaagcgtatcggatatggtagcatttttacgagactaagaagtgagatttcacattagacattacagataagggatttagcctatgaaatgtgttagttttggcagcattgttttacacttagaaattagaaaggcttgatttgtcactgctaaaggcagtacagagaatgagagcttttaactttttgaatgtggtgctctttatagtaatctttaggctagaatttgacacttgatatcactataagcattgcataaaatgagaaacttgaaacttgattttaaatgtggtagctttttgattgcataaccaggtttcgtaacttaatttggggtatgttgtgcagattttgttcccattagggagggtatcagtgatgatctatggttgtttggtatcgataatattctgcggatacatagtttacgatacagacaatctgatcaagagacacacgtatgatgagtatatttgggcagcggtttcactctacctagacatcatcaacctcttcttgtatcttcttactgtgttgagagccttacagagatgatgattattaggatgaggtatttagcttatcggtctctttaaaaatatgtaaataagaaaataaaactgtacatttttgtggttacagttcacatgttcatgtgagtgattgtagagggaacacaggaactgtggatcatgtaataatttataacgaaaatgccaaggatgtgtcatgtgtgtaatgtcgcgaaagacaccacgagaagtgcaagtcttttgttttttctcataagaaaaaagggataattgaagctttttgttaataatatttatttcaaacttatgtagaccatattacattttatggttaaaaaaaataagagttataagggtttaggatttatggtttagtttttagagtttagtttaggtgtagaatttggagtttcggattttaaattttgacaattttagtaatggaaagcagattatttttacaatttgatataaaatgaagaatattttgatattgaaaacaaaaagagaagcaaaacatgggaagcctcgaagtgtgtgttgaggaaaagggaaacgaatgtttgaaattctggaatgctccaaatgcaaatggacaaaacaataatggtaacgagagtgatcaatccaaattggggaagtcttgtaagttgtaacagctcatgctgctacttcgttttaatcatgtatcttaattatttagtcttcgcataagtctaaatttgggaaaacaagtaggaaaataaataactagatttagaaactcaaattcctttgataattctttttctttctatgtgtgactggattttggactttgtggtcgcaatgcaaatgttatgatacattacggtcaaatgtatgtgtgtaaccactaagccaaggaggataatgggcaagtggtctctggcgtgagggttcgacccatattctttactatgatgaaaaaaggctcacgccatattctcgatcaacataacaatatcattgaattataactattattgtcaactggatttgtagaatttgggggcaatgcaaaatatgatgttacattacggtgaaatgtatgtgttgaccaatatacaaaaatgccacacaaaaaaatacatttaactgtgaaagtccctttaacattcttgtttttttttctatatgtaactggatatatatataggtcgcaatgcaaataggatgatgatacattacggtgaaatgtatgtgtagccaatacagaagagtggatccatattttctcaatgagcttaacaaaattatgggttacaagcatttctggattcgtacattgcaatattttcttatgaccatttcaaaataaagttaccatggttttgttctctagatatgaacaaaacaaagaccaataattttgtgggtccaatgaaaatgcaatcatgaatcacctatgttcccttcctatataaaccctatcttccttctctcttcctcatcacttccaaaatccaaatgagactttattagcttttgatcaatctcattaatccaaattaaatagttaaactagaagatg

SEQ ID NO: 4975 - DNA, 3000 bp, Unknown
  misc_feature (1)..( 3000): cDNA_ID_1826835_gDNA_ID_1620751_Annot_ID_49809 3000 nt of promoter + ATG
tctgcacaacataccccaaattaagttacgaaacctggttatgcaatcaaaaagctaccacatttaaaatcaagtttcaagtttctcattttatgcaatgcttatagtgatatcaagtgtcaaattctagcctaaagattactataaagagcaccacattcaaaaagttaaaagctctcattctctgtactgcctttagcagtgacaaatcaagcctttctaatttctaagtgtaaaacaatgctgccaaaactaacacatttcataggctaaatcccttatctgtaatgtctaatgtgaaatctcacttcttagtctcgtaaaaatgctaccatatccgatacgcttaaatcttgtgctctctaatgtctaatataaaatgaagttgttaactgtttagcctaaagaatgataccaaaactaccacatttcataagctaaagactacaactctcactctctccaatggaaattggaataagtagctttacttgtattaaggcgaagaaaataagcacggtgagagcgccaaacaagaagggtccaaggaaattaaagtcatatcctttcctagcagcccaaaaagtatataatgtgagcgaaagcaccactaccgatgtcaagatcactgactcgagaatcactttccctgtgtccaacacagaataagctttaaacatatacacaatcagaatcatagaaaaaactgagagatgaaatttgctaagagctagttccccaatagcaaaaacagaactttgttgcctaatggatccttaacaggtaaccaaaagtggttgatcaagtcataccattggtgaaggcacatgttaatccaacaacaaaagccagagccaaagtgaaaatccccaagagcaagtaattcaccggatgtttctgatggtaatagtacaacggacacaacactatacatcggagagaaacacaaatccaagtttcagcttttgagattattaccaaacttcgaaaaagattgaaacttttgatttgtaaaacaagtgtgcgtgatgattgtacctatgagaggtgtgatgatgatgactatgtaaagagctaatccaagtccggtggtggcgaagaacagagcgattggacggacggtgaccaccgtggcagcgacagcgacggtggctagaagctgaaaggcgattatagagtagaccttgcgtataaatccccaccggagctcgggattttcatgcatcgctgggtatagtaaaggccttcttgagctaacgcctgtttccacgtcatctttccggtacggtaagttccactgatacattatttacgatagcagagtctttataaagtgaaggaacgcgcgggaaaattcgaatcctttcgattactactgtatcacgatctacagagagagaaccacaagcgagagagaaaagttgatgcggtgctttgcttgagcttcttcggattttcctgggagaagcggtgatgccaagaggaagaagaaagttcatgaaagctctcggctaaaccgtagatgacgcgtggcaaccggagatgtcgcataagcggtgacaaggatttgatgtgtccaaagggaaagtgttcttttttttggctcaacacaatacttgcttaaccaaacttcacagtacatttcaaatagtaacgaaattttttatatatatatatatatatatatatttttattactatttaaaccgtacaatattttatctataattaatttgcatttttccaattagaacttaactaaaaaaaattagttgatcaatagtatcattcttgcatttaatatagagggttttcaatcaatatatgtaagatatttttaatcaattatttaaactgaaataattaaaagtaaaaattgatttgaaatttggataaaaagtaaacaaaaataaatttttagagaaattaatttgggatatattttcatcgttgataaataatattgaaactgaaattacttaaaatgatgcagttttaaattttaacgctagtttttataaactttttttttggttttggtggtgttaaatgattgagttgatagtttaacttgttaaatgaaaatataattataatgtagattcttgactaatcatagtttatatttttaatcgtaattgagacacaaaaggctgttatgcttgatcatttttgtatacattattgtagaatgtaaaaacttataattaatagaaaaaataataatttagttcaaaaaatagaatttttcacaatctcttgaagagtggcctaagaatccgatagtggtggttactgtttgtgttgagatatagcatatgagcaaaaacaattgaaaagaagaaaaactttcccttttaccaatgaaacaaaagagctctcagataattagaaaagtgtcaatttgtataacatttcccactctctctctcacttcgattcacttttgctcaaacttgacaacttgtccgaatctgtccatagcacacctctctctctgttttagggttttctcttcactggtgctttcttccttgtctcgctggttcaaagattcttactttttgatgtctaagacatcttagatttgttagactctctttaatttttctgggtttagccactagattatgttatactgctagaaggttagggtttggtcgagaaagctctaattttggtgatttatcctcttaatttcgcaaagggttatcttttcaatggcaattgcgagtgagttttgttattctcacttatgtatttagtaattgttccgtcagctgtacataagtggttggtttcatagagaaatgcttttagctttaggtgttgtaagatctcataataccaaagttcagatttttttgtataggattccattaagtagcccatctccacttagtttctggtctgggtagtgtgtaaccgacaagaaaatagtgttttgactatcctctggctatcctggagatctgggatttgtttcatctgttatgtcag

SEQ ID NO: 4976 - DNA, 3000 bp, Unknown
  misc_feature (1)..( 3000): cDNA_ID_3075075_gDNA_ID_1620751_Annot_ID_49810 3000 nt of promoter + ATG
catctccgaaaaataattggcttaaccgaaacttgattattcgttattcttttgtgggttttgatagtgttgatggatagtcggaaagagagagaggctatcacagagttatcccgagctatcgcctttaaagcagatcttcatcttcttcacttacgagcggctttccacgagcatatcggtgatgtcacgagtgcgttgcgggactgtcgtgcagcgctctcggtcgaccccaaccatcaggagatgctcgaactccatagccgtgttaatagccatgaaccttgaaccgcaaccacacacaaaagagcttcgatatgaaagtaaagtgtgaaaaattgtaatactaaaagaatcattgttggaaacttgtaatctcttgtaactcttttattctttgttgctgttttccatatatcgatttcgtattttgtccttccatcgtaaacttcaaatttctctgggcctaaaacgtaaacttgatttaaaacaataagtagatcgtttgagttcttggtgacaaacctaaagcattttcctttattattcttgcacctaataaagccccaatgagctatcttattttcaagctttaggtttgaaaatgtgaaaaagctttgggtttgtcaccaaagactcaaatgatttcgattacgttttatagaaggttgaatgtttgtactcttgttacattaacccatgacatacattacatatacatataatatataagagcttttactacaagacctattaacatgggcttagatgggcttctagagttgtagtgttaataacttgggcttaatgggtactataatactgatgactagttttctttgtcctcaaatgatctagtttcttccctgttttactttaaaatataaaattttccctttgtttgttacaagaattcgaatattcatgtgtttatttccttcgtatagcatatatattttcagaatatttcacaattcaaaaaagcctttatgaaaattttaaaagaagaatattcggtgttgcatgggttttagttacgctcgtgtctcataatggtcacacgttttgttttgttttggcctaaagggattccatcataaactgaattttactacagtagacacgcctatcccaatgaatcaaatggtacaagacacgtctaaggacaaaatcgacttaacaaaatgttcttcattggaatatttttctatagaaaaatttcaacagataaaaagttaaagaacggatgaaagagtgcgaaaaattcttgttggtggggtaagtattttctttttggacatgaacaattttcaaagggatatattaagaatattaatcaaaaacttataaaggttggaaaaaaaggaagaggaagatagcacaaagccacaaagtcatccacaagagtaaatcatatgaagacgaaacaaaattcaacaaagtgatatattccattttgatattcaaagccaaaatgcttttagggcattggttgctttgagtgtatgtatttttctcccctacaaatacaactctcttttatctttgtgagtgattcaaacttaagttaggaggcatgtaaggatgttgtataatcagaatttaaatttaaattagagaaatagacaataaagttgtttaattcgtctttagggcgaaatagctttaaacctaaatttgttttttttttgttagaatctttgtatgatgttccctttttacaatgagtttctatttccttacgttgttttaatttattttatagcttatgataagtttcattcaaatcagtgtgcctttttaagaattttgggtatattatgggaatgagagaaactataaggaaaaaaaaagataaagctttagcagccttggtagagaaagtaacatcactcaaattcataataacacacaagtaaaatataataatatttaaagacaaattcagaagaaagttatagctttttctacatgaaataaaatcgaactagaatccctagctaaagtaataaggaaatacaaatagaaaatagcacaattgaacaagtatacttatactcttggcaataagtcaaacaatttcatcttggatacttaattttccagtagatagtttcctattagatattcctcaatggttgtattactaaatttagttcttctattataagaacaacgtttattttggctaagtaattgtgtgtttagattctctttacaaacttaaacaaaacaaaaaaagtttccattattcaaaccccaataaattgaaaagaggcacacttttcttgatataaaagtgattattacttccatttaaggaaattaggcctgataagtctcatctcacaatattttccattaattgcacaaattgatagcttgctttttttctttctgggtctactcttcttttttagtagacaatttcaagtaaatgcttatagtctgaacctgtaatcatcactcttctctgtaatgcagaacacttaaaaaattacataaaataaagaataaaactgaggaataaaaaataaaaaacagttaaagatatatgaaaacaaagtcaaagtctcactttcaagcacaatctctttcctctgtggtatttatctgcacatagaaaaactaataaaaatgggaatcaaacagtctttgcatttattgtaagcacacacatatatgtgtacatgatagtgacattggagaataatccatcatggtcgtcttcttgcttttgagactatacatatacatgtgcattatatacactactcaagtaactaaattatttaattttgcatatatagccaaagaatgatgtctttctgtgtacacttacttcttactctctaggtacttgcagttccttattttaagagatcagaagaaaccaaagtttggatctttttatagttttcttccaagttttgtttttgttttttcttttgttggagtttccttcttcatatagctataaccatatagctagccatggat

SEQ ID NO: 4977 - DNA, 3000 bp, Unknown
  misc_feature (1)..( 3000): cDNA_ID_1826829_gDNA_ID_1620751_Annot_ID_49811 3000 nt of promoter + ATG
atagagcgttttgtgatgcattagcagaagaaagtgcaagactccactcaacttcttcctccaatctcacaaaccctaaccctaatttccaaggccatcattttatgttcaataaatcttcctccttgctcttcacgtcatcacctcttttcatcgaaccatcactttccaccgccgctctttcaacgcctccaacggcagctctttccgcgacggctcttctccaaaaggccacctctctcagctccactactttcggcggcggaggacagactcgatccattggtcatcaccgacatttgacgaacgtcaacgagtttcttggtgttgaccgagtcatgatgacgtcagcttcttcgtctgagtacgaccagttagttgttgatgggtttacgtccacgtggcagaaagctgaccgtttgaccagagactttcttggactcacgggtcatgggggacacgttagcgtcagacctggggatatgctagagtacgcgggtggagtggcgtttcctatgtcggcgtacgataccgaatctcatgatcactcgtttcagaaggcttacgatcatctgggattctcaggggcccatcgtatgtaaaagggcaaaactggaatcttgttactttctttattttgtttctctcaaattacttaaataccctcgtggacaaaaaaaaagacacagagcatttctttctggggattattaattttctaaaattgttgctagctttgaatttttgtctcgtttacgttggattttcttgtaaaaatatattcgtacaaggaagtaaggaacatttagaatttccttagtcaatattatgtccgttaaaaaacctaaaaaagtttttacttggacattacatgaaaaatcaaaaataatatgattttccttaaaaaatggatcggtaaaagtcccacaaaactgcaacgtctctagggattgacgaatgtgtcctctcaaagccagcttatttgactgtgatagatactatacaagtatacaacttctttcatcatatccacgttacatgtatacatcatgtaatatgcacttttgtcttctgaagatatatattgccaatcttatacacattgagaaatacatattcatcgtaactcaaatttggcaataggtgtcgacaaacatatttattgttgttctgattgttgttaacaagtttctatcgtaatcactaatcagtgacaaggagcttatactattgatggtcatttatgttgccactatggcattagtaacgaacactaacatgtatgtatcattttcatactgtgatgaatagtcgctataccaatcacaattaatttagtgacaaatcattacaatcttatgtttttttttaatagacggtttaattacgtaccacaaaatcaaaaggaactgaaaacacataaagatatgagggtgaggaggaatcaaataaaaaagatattatatagaaaactacgaggaataatataaagtagaaaagattaaagaaacgaattaggtcaaagagcttgttgatgaggacacgcatgaacatgcgaacactttaaaaccaaaaaacgaaaacaaaaacaagaacatgcgaccactaaaaagttaaaaagatagattaaaagaacattgttaatggtatcaatatagtttccttttatgtttttacgagctcttatagtccccattctatacaactttgttttgctttccttttttcttttggcttgtgattggaaattgaaggttggtataaaatgtacaattcagacatcttatatatctccagagtatcctttggtttggctgatatataaatgatttgcaatactgttatgatcattgtgtattgaaacttaggatgtgattggtaatcgtgggtttaataaagcaaaaatgaaaaaaatggaaaataaagaaaataaatatttaaaaatcagctcaaactaagtattctttggtttggctgatattagtatagtgagatgatgaattaatttaaaatatcatctcttttctgtttttttctaaagtcatcataaactattctcatgtagatttgaaaccagaagataattaacacaacacaaattctattacaaactactagatacattctaaaacattctacattagagaaaaatagttggtatataacactcaagcagtcaagctatttcaaaataattggtacaacaacatccatgattaaaaaataacaactatttgggttcctaaattttatctttaacaatcaagctatttcgaaattttatgcaagtaatttcttaatagttaatagtaatataataattacgtctagatggaccccaatgataatttaaagacttccgtggttataatatgaaatagaaatatttcaggggcaataatgaaaacaattaggaacttaattataattagttttgttttaagtatctattttagggaaattaaataaggaaaatcgcgtgagtgagggagaaagtgagacgactttgactatgtttgaagcgagaaacaaggcgcggagacacgaagacgatgatgatgatgaagaacacagcacaaaaaccaaacgacgaaattgatatttatttttttatttcgttaatcgatcaatgaaatagttttcttcagcgtaaatcgatctctaaatctcgattttctgcgttctcctttcaaaatctgtttcagtattcttctcagattatcaaggaggaaggagaaatgaacttgttgttggtggtgtgaatctcgctaatcgcaattttggatcttagattttgttcttgctaccaaaccctaatctcacacattgcaccagcatacatagttttgatgtctgggttgttgttcgtctttattgattccgtttccttaatcaaaagaaacgggttgatttctgagccccgattcggatccgggtcgtgtccgaccgattcaggagtggttatcggatgaatgaatctggaatcgaaactgtggaaca

SEQ ID NO: 4978 - DNA, 3000 bp, Unknown
  misc_feature (1)..( 3000): cDNA_ID_1826825_gDNA_ID_1620751_Annot_ID_49812 3000 nt of promoter + ATG
tttttgtggtaaatttagatttttaaaaaactccatatattttttttttataatttaggcttgtctattgtaaatttgtaatatagcttagtgatttatttgtttagcttctggtgacattttataaatttttaatgaccagtataatatagtatttttttataaattaaaatataatctaatgttttatgtcaacttcgttgttcattgaataaatcaaactttgaagaataattaaataacaatgtttgcaaaaactgttacgttttttcatgtaaacattagtggacgttatacaatagatatttaaattataaaaactattcaaagaatattgtaaagaaataaaacagaaatgtgtaagaaaaaatgtttattttattgtacgtaataaaaaaagagaatatacttgtgtgggtggacctaaatgcaaataggcaaagtaccgacaaaaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgattgttgattccgatgattatcgtcgtgttcttaagaacaagcttgagactgagtgcgctactgttgtttctcttcgggtgtgttgttaatcttctatttttcttatctatatgtgtaatttgtgcgttttgatctaaatctgaagctctgatgttctcttcttaggttgggtctgtgaagcctgaagattcgactagttctccagaaactcaacttcaaccagttcaatccagtcctcttactcaaggtaagagtctcttcttagtttcaccaggatagatgagcgatgataaacctgcagattcgtttctctgttctgtgtttgttaatttagatgcctaggttaaggaattagaaatagaaaatggtacttttgttggatcaagcgcctagttttatccgtcaagtttcaatctttttgtgactgactttctcattgaaattaaactgctttctggaagaacaataagcttgggattgagatgagttctggtggttagttcaatatatgggaaatcattatttcagcgctcgtctttctctttcagatatctcttctgagtcttagacatagtaagttttaatcgtggtaggttctttgatgaccccaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggtaatcattactttttctccaatttcttgtcgtttgaagattacatttatagagccttgttcttccttttaatatttgtaggatgctgtcaaatcgtgagtcagctaggcgatctagaaggagaaagcaggagcaaacaagtgacctcgaaacacaggttttgtgttgtatcctctcaacacctcatttttgtgttgaaggatattaatgagacctaatttgtattttgataggttaatgatctaaaaggtgagcattcatcacttcttaaacaactgagcaacatgaatcacaagtatgacgaggctgctgttggcaatagaatactaaaggctgacattgagacattaagagctaaggtaagaagacttaagtattatcctcctctcctttttctgaactaccctttttttgtatacagttttagtaactcccatgttatgttaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggtaagctaaaacatggctctttcttttaagaccattgaacaatttaaaaccatttgaagtactatgatccctgtttatacatatcagattcctgtctcccctttttttgctcattttacaggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataacagagtgtatatctgtttttatccaattttaaaaaagatagctcacatggctttactaatttcccctatcattaaattccgacaacctcggcgatttccatggtagatcgatcaagcattcacattttctcgtcagaaaacacaaaaaaaaaaaacagaggagaaaaagagacgacgacaaacaagtgaaagaaaaaagtcgtcgttcttccaatttttttctcctctctcttcctctgtttaacggcgtacgtaagtcaaaatg

SEQ ID NO: 4979 - DNA, 3000 bp, Unknown
  misc_feature (1)..( 3000): cDNA_ID_1826817_gDNA_ID_1620751_Annot_ID_49816 3000 nt of promoter + ATG
tgtttctttaaagcttaagtgagatgtgactgtgtctgattataagcagcgctttgagtatttaaagttcaaatctttcactttttttttttctttgtgttgctttagtgcaaatttgtggatgtatgatgaatcattttggtgaattgcagagctgatgttgttagggtttatatcgctgttactgacggtattccaagggctcatttccaaattctgtgtgaaagaaaatgtgcttatgcatatgcttccatgttctctcgattcaagacgagaagctggggcaagtgaacataaaaacgttacagcaaaagaacattttcagacttttttacctattgttggaaccactaggcgtctacttgctgaacatgctgctgtgcaagttggttactgtagcgaaaaggtaaattcaaataccttcagggcctcactatagtcatattaggtgttgctcttgctattacttgattgaatcagtacttacttctctccctcttgttttcagggtaaagtaccattgctttcgcttgaggcattgcaccatctacatattttcatcttcgtcctcgccatatcccatgtgacattctgtgtccttaccgtgatttttggaagcacaagggtgagcacaaaccaatatagaaattttctacattcaatgtatatataaattaagttctcaggtgtgaaacctctggtttatctatgttaatgcagattcaccaatggaagaaatgggaggattcgatcgcagatgagaagtttgaccccgaaacaggtactaaatcgattatatgctagcggaacattatgcatattgtttgattatttattgtgctttgttgcagctctcaggaaaagaagggtcactcatgtacacaaccatgcttttattaaagagcattttcttggtattggcaaagattcagtcatcctcggatggacggtatggtatctttaaattacattactagttttatattggttatttgtcctttggaactacccgatgttgagagtatgttgtttgcatgacagcaatcctttctcaagcaattctatgattctgtgacgaaatcagattacgtgactttacgtcttggtttcattatggtaaaatcttgattacttacaaaaattgagatttggtaatcaagaacatttgctttgatcttttagtctaacaatctatatggtttaaatacagacacattgtaagggaaaccccaagcttaatttccacaagtatatgatgcgcgctctagaggatgatttcaaacaagttgttggtattagttggtatctttggatctttgtcgtcatctttttgctgctaaatgttaacggtatgcttttcacaaaactcaaatctttttcttatgtctagtttcaatagaaatgaaaagaaattgttattacgtttcctttgatatcgaagctacaattatgtatcttgcaggatggcacacatatttctggatagcatttattccctttgctgtgagtcatttgtttttgtcctcattttacttcgttggaatgtgcttaaatcttctttcagttgagctgaatttgttttttttaatgtaaaatttgaagttgcttcttgctgtgggaacaaagttggagcatgtgattgcacagttagctcatgaagttgcagagaaacatgtagccattgaaggagacttagtggtgaaaccctcagatgagcatttctggttcagcaaacctcaaattgttctctacttgatccattttatcctcttccagaatgcttttgagattgcgtttttcttttggatttgggtaagtctggttctttaagaaaagaaaaaacaaaattttaagattcacctaaaatggttaagactgatgactttattttaggttacatacggcttcgactcgtgcattatgggacaggtgagatacattgttccaagattggttatcgggtaagcataaagattcgacattttttcttttgttctttctcatattgtttcgttgagtataactcattgtagactggtatctttcttcttctctttagggtcttcattcaagtgctttgcagttacagtacactgcctctttacgccatcgtctcacaggtaacaagctaatttttactaaaaagcttgagaatcttttggtttggttttttggattctttctgaaaagttgacccttttcttatattacaacagatgggaagtagcttcaagaaagctatattcgaggagaatgtgcaggttggtcttgttggttgggcacagaaagtgaaacaaaagagagacctaaaagctgcagctagtaatggagacgaaggaagctctcaggctggtcctggtcctgattctggttctggttctgctcctgctgctggtcctggtgcaggttttgcaggaattcagctcagcagagtaacaagaaacaacgcaggggacacaaacaatgagattacacctgatcataacaactgagcagagatattatcttttccatttagaggatcatcatcagattttagcttcaaggtccggttttgtggtttatacataagttatagtgacttgatttttttgttttgttacaaagttaccatctttggattagaattgggaaattgaatctgtttgtatattgtattatttggaacattgtggatgcccatggatatgtttctgttcaattattttggttttgggtaatgaaatttgaaaccaacgaaaaaccaaaaatattcttcagttggaatttggtttcttacaatgtgttggaaaaagtacatttaaatttcaagactttggatttgttgtacagtaagcaatcaaatatgatttaggttaaaccggttaattttactttggtttggatgattaaaccggctccaaattaatattccttttatctctctgctttttacttttgtacgagagttaaagccacactagtcactcgcgctagtctcttcttcgaacgcttgcaatg

SEQ ID NO: 4980 - DNA, 3000 bp, Unknown
  misc_feature (1)..( 3000): cDNA_ID_1826813_gDNA_ID_1620751_Annot_ID_49817 3000 nt of promoter + ATG
tctaatagcttctggttctttccgttctcatatatctagcagatccactacctatctaccatgacgccaagtagtgacggtactgtccgtcgtacttattgctctctatttttagaacatgacgaatgaattgtagttatctattattgtatccctcctaattctaattaatgtattcaactattagaatgtattgaaaaaatcgcttatttttctgtttgtaagttaaattttcctatatcacttattgagatgtttacataattcaaaaacgtcacataattatcttgcgagatataatcaaattcgagatatgcgctaagcaaacaagctccaaataaagtatttcaaattcaaaagagacaatttagtttcctagaaaatgttttctctcttctatcacaattcaggttgattcccaagcttgtcgatatggaagattctgtttgctagcttatcaatctcagcgactcctctctctaatttgagtctacaccaacaaaaactaaagggttcacatcattatgcctaaatggagctcatttataaaggaacaacttgtgcttaaggaggtaattctcagaccaaacacgaacatccaacataagaagtaataaaagctaagaaaaacagttatttacaaaaatcaataaataaaacaagttttgttttggatgaaaaaaaaaaaaaaaaaaaaacaagttttgttttgataatatattaacacaaaaaaaatcagttaatcaacttaatagtttaatatattaattattatccctttaagaatttttttttctaatgcccttttcatgatgccctttttcaactttacccttttgttttatccaattttatttctaccctctttaaatttttaatgaccattttacccttatttggaaattgttttaggttaacaaaatgaaaaattaatattttttcgccaaaaatattccaaaataaatttcccgccaaaatttgttttcaaacatatttttcccgccaattttttttttttggcgggaaatagatttacaagggattttaaaagagttttaaaagatttacaagggattttataggggttttataagatttacaagggattttaaaagggtaatttacaatagattttaaagggatttcaaaaatttacaaaagtcttttaaagatttttaaaggctttaaaattgttttaaaaaattttaaaatatttacaagggattttaaaagggttttacaatatttacaatggattttaaagggctttaaaagatttacaaaggatttgtaaagatttttaaagagtttaaaagtattttgaaagatttacaagggattttaaaaccttttaaaattacttgtaaattttttaaaacccttttaaaatccattgtaaatcttttcaaactcttttaaaatcttttgtaaatcttttaaaacctttttaaaatctcttgtaaatcttttaaaacccttttaaaattctttgtaaatctatttgccgccaaaaaatatttacaaggatttttaaaatcatttttttggctgaggaaaaatttgttacgaaaaaaatttttgccgggaatgtttttttttgtcgggaaaaaagtttggcagaaacttttctttttggcgggaaaaaaaaaatttggcgccaaaaaattggcgggaaaagttcagttttcaattacatgtttctattagatgagggtaatttggtcattttgttcaagagaaggggtatttttaaaaatggacaacataaaagggtattgttgcaaaagagtagtaaaaaaagtgtaattttataaatctcccttattttaatatacaaacaaatattatttttacttgtgtataattttgtcttttgataattttcattttttgataatgttaacaattttctagttttgttttaaatatattgtttaatttagatttgacatgtaatatatataaacagatattattttttacttgtataaatctaatattttaattgacacatgttccggtcattttaaaaaccaaactttatataataagataaaaatgataaatcttattctatttataaatacattttattaatttataaagaatacaacacatatacattcgttctaaccgtatcaattttaaagacacaaatacaaactaaaaccaaattaagttcaaccgaaccaaacgagataaaccgatctattctaaaaaaaaaaaaaaatacttcctttgtagccttttgattgttcgagcatcatcaagtttacattgttcgagcattatccaatccagtataaaatattattcacaccggagaacggtacaattcttcaataaaagatgagtcgacagcgaccgctctaatcagtggaactctgaagtttctgtatttttatctttcttacatgatctcattttttttattttttattttttcacaatcttacatgatctcctagtatcacttaattatatacaacgaaacatgtgaactggaacatagttgatagaaaggaaaaagagggaaaatgtgatttgattatagatttaactcattaacaatgtgtgattgtgtgtggatgctttaagtaaacacggaatagaaacgaataatatggaaactggaaagttgaaaacgcgtttcctaatttgtctcacagatttttaatactaaaaaaaagtggaatatataaactctataataaggtcgtaatcaaattacatgaagataatagagatcatttaccataattaatctaatcaaaagcaattagtattattgacaatgacaacaaatcatcaacacaaagaggaaaataaataaataaaaaaactcagaagaatctgtctcactgatttcttcatcttcttctcttcctggacccgacattccagtgttggtacataaaagactcttcctttgtctgttttttgttcccagattcatctttacttattgactaaattctctctggtgtgagaagtaaaatg

SEQ ID NO: 4981 - DNA, 3000 bp, Unknown
  misc_feature (1)..( 3000): cDNA_ID_1826805_gDNA_ID_1620751_Annot_ID_49820 3000 nt of promoter + ATG
ctatgagtaaaatgtcactaaacaacaaaatgagaggtaaaataagtattattcgacacataaaccaaaacttgcctctgtttcagaagcaattgactctgcgaatcaatttgcgaactgttacgattttgtttcttcatagcttggattttcgcaaataacttggtccaccttgataacaaaccttttgccctgtttgatatgtctgatcttcaaatcagatgatgaaatcgaataaatcacaacaagaactttggcattgatgaaagctacgcagcatttaggtttttcagaaattacacctgatatcctatagaaacgaagtccattaacgctttgtaatatggcagacatattttcaggagatgctttgtggagaggtaaatgacaaagaacctgcgtgttaaatgtcaattatccataataaaacaatctgcatatttttacagccatccagctgcaagtaaattaatctcgtaccttcaggataagaagtaagacacttgtttgctcttcactagcagcttgacttaaccatgttgtaagtatcaaaacccctccttttgataaaaacctgtggcacatatagaaaatgactgtcaagacgggaatataataacaataaaataaaataagacagtgggtgaaagagaacccccaactagtaccagatcagcacagaagcatcttgtatctgcatgatccactccattagtttcacctggcctgaaaatgtttcctctttacgcagcagagaaaatatattctcaacaaagtatttgtctgaatcgctgatgtcaggtggaatatcttcaggtggaataagtgccactgtttcaccttcaccccagcttatagaacatgcctccggatgtatagagttcaagggaacgggttcaacatgatttgtggcattgttattttccggaacaccatcatcttgtaaagcatgcgtattggacataactactttctcccttgaaagcctcacctgtttcctcactcttgtcttttgagtaacaaaaaattctcgaacctgccattgaagaaaataataaagagacaaaccaaagtctcatgagtacctcaacatgacagatctaaactgacatggaattctaaaagcatggcaaaaaagagtacatatcatgtagaagaacaatacctgggcgactgtgatgccaaataaagcacttatctcccgagattccctcttactaatagcatctttaattgcgaaaactgcttgtagatacttaacagccttaggattcaacaagtctcttggccgctttcctgaaatatttacaaattcatcagatactaggcatcgagcacgtaaaagttgggtatgcctttaatgaacctagagagcaacaatgaattgaaacattctctgtgatatacgtaattatgccaaaagatctcacgaatcctaagatgactcaccaattttaatggacaaagcaccagcagcctgaaacaacaaaaaaattaaacagattaatgtctttaacagagatgattacttgatcagagaaatgacatataaacagttgaagcatcaccattacagttcacagaagaaacggagaggtcgagctatatgaatttataccaaaaacacctctaatttttgctagactcaatacccttcaaagaatttattccaaaatccgaatgacctgtccctctcagctttgcccatatcaccataccccaataaaacacgaactttagataccaaaaaacatagaaacaataacccaccatttcttgcgcaaggggattaacgccggtaagtttgcattgcgcaacgacgacatcttggagctgatcgatctggctatgaaaaagcaccttctgcgaatccaatagctccattaaagactccaccgagctcccgatttctatctcctccttgaacgcgtccatggccgccgacggaaaactcgaagaccaatacgcaaaccgaattcaaaatgtgcatcagggaattaaactgaaacgtaggactcagtgattcgaatgtgttgaaacgataaattcaatgaacatggttacctaatttcggattgtcaaaaagccgattcgggttagggtttgagtaaggaaggcaaaataaaggggcataaaagtaaataagttactttacaaagaaaaattataaaacgcagcgtcttgatgtagatctctgaaaaggtaagaaattaaatttgtttaatattatactaatatattagttgacataaaataaaaataattaaatctataagacctgaaaataatagaatagaagagaacgagtttgtttcctgagatatcttttcaccgcccttctcataggtctcgtctctctttctctctattttacgcttttttcctgaacgattcttagggttttgattctctctctctctcgcttctttttcgatcgcagcagctctcgccgatcctgtgtaatcgggaatcggtaatcgtcagggtctgtttggggtacggcgacgcgattttctgattattagggtttaagatctcgaggtatcactatttctgtcggattctcgcttgttttgttccatacgacagttgatttttttatcattctgttgattgttcgtctttctaggtttttatttgaatttttgtgggatcgagattgttagggttacgtcggagtctctggattgcgtttctactgtgtaatttcgtgtttatctcatggattgattgtttctcgagtatattctgatgcttatgtcctcgtttgcgcacaatctgatagtttgggtttgatttgggtgataatactcgtttcgcattcgataatgtgggtgttaacgtgttattataacctctgaagaatgataaatattgttgactctctcgcttcagtcatttcattgtgttgcttaatactgctgttctaaattttggttttctccttgttctttggttaacttaggttgaggagagcttgaaaagttgtttgtcaacatg

SEQ ID NO: 4982 - DNA, 3000 bp, Unknown
  misc_feature (1)..( 3000): cDNA_ID_1826801_gDNA_ID_1620751_Annot_ID_49821 3000 nt of promoter + ATG
agagttatccgaatataacaagtaagataatatgaacctgattagtagccgtgtcttcggcctgttggacaagagcgttaccctctgctgtgacatgctgtgaacgaataacaagttacagttaatgtcatacagtaattaagagactgcaagtagaccatgaagaaaagactatccatttgctaatcataaacaaaagaatgaagataggtaataaacctgcttaaagatgtttgcaacaggttccaagcctcgcaaaattttatggtaaagcctgtacatcctggagagatcatccacctgaaagtagacaaatataaccattaaagaaataattaagtcactaactactcaacaataaaaacaaaaatacttgctctaccttgtcatctcttagcaatgcacggcaccctgagtgttctttttctagaagctgacttgcaaacacaaccagcaattcatgttgtactttctgcatacaaaagattactatacaagtcaaacagatatcaatctttaaaatcaagtatgcctggactacgcatttaaaaagagtctggaaagtatctcaatacaaataacaaaattcaaaatcaaggcttatgcaagatctatggtttcttcatcaaacctacaagtacaggcataattacatagtgcataataaccaacctcaaccagctttggctcactgcttgagtgtaggtagtgagccactctctccctctccttctttagacattcttcagactgtaacatgaaagcacagaagttaataaataatttcaactattgtgaaataaaaacaaattttagaaaatgatatcacgagtcatgccttcaacatgtaatcagggcaagaatcttcctgaatccagcttgatgccttgcgagaataatacgaagaagtatcttgaagcatgaagctttcaaaatcttcttcatacctctccatctgccccattccaatctctacatagatatctaatacgtttttcagcagggccctatcaatctgctcgccctcccgttctttatcaacctgacagaagaacaggtcatgttagaccttgaatcaggcaaaagccagagttggatgtaactgcacaacaatattgacgccatacttacaagagctattacagcttgtttgaccttagaatgtagctcattataaacctgaagcgaacagaatcaaggaaaagttaaaaatatttcaatacaactgaaagctataaagccacaggaatgaatgccataccaggtcacggaagcatgtcaggccaacttcattcagtggtggaagtgatctccgagcaatgaagtaacggtcaaggtagtagaagaagcgggatagccatctgaccattactttatggtttgaccatcttttaaatagctcccgcagcataaactcatcatgcttctccctcaacgcaggcaaaacctaaccacagacaacaagagagcaaacattcaaaaccgtttgaatcaacttaaaaccaagaggggacaggacttcttgacatatgaaaccatgcacaaaagtggcatcttaaaattcagaggtagtaaaaacgagaagtttataagaaagaaactaaatatcaatcagactcactgttgagttaatatattcctcaaatgcttcccgatacttgtcataaagctgctgtgagtaatcatgaggaggtttctgggtgcacatgttgtagatagtcctgagaatcaaataaattccccatcataagtatcaggacaaacagccaaaccgctatataaggtaataaacaagtataaaacctacgtataaagcatcatatattgctcagagtcaaatgctggctcattcaatccttccagaatccgtttcagcttagtaattccagtctgcatatagtcccatccttgctccaagtcaatagtcttgcgctccatgttgacaaacaacttttcaagctctcctcaacctaagttaaccaaagaacaaggagaaaaccaaaatttagaacagcagtattaagcaacacaatgaaatgactgaagcgagagagtcaacaatatttatcattcttcagaggttataataacacgttaacacccacattatcgaatgcgaaacgagtattatcacccaaatcaaacccaaactatcagattgtgcgcaaacgaggacataagcatcagaatatactcgagaaacaatcaatccatgagataaacacgaaattacacagtagaaacgcaatccagagactccgacgtaaccctaacaatctcgatcccacaaaaattcaaataaaaacctagaaagacgaacaatcaacagaatgataaaaaaatcaactgtcgtatggaacaaaacaagcgagaatccgacagaaatagtgatacctcgagatcttaaaccctaataatcagaaaatcgcgtcgccgtaccccaaacagaccctgacgattaccgattcccgattacacaggatcggcgagagctgctgcgatcgaaaaagaagcgagagagagagagaatcaaaaccctaagaatcgttcaggaaaaaagcgtaaaatagagagaaagagagacgagacctatgagaagggcggtgaaaagatatctcaggaaacaaactcgttctcttctattctattattttcaggtcttatagatttaattatttttattttatgtcaactaatatattagtataatattaaacaaatttaatttcttaccttttcagagatctacatcaagacgctgcgttttataatttttctttgtaaagtaacttatttacttttatgcccctttattttgccttccttactcaaaccctaacccgaatcggctttttgacaatccgaaattaggtaaccatgttcattgaatttatcgtttcaacacattcgaatcactgagtcctacgtttcagtttaattccctgatgcacattttgaattcggtttgcgtattggtcttcgagttttccgtcggcggcc

SEQ ID NO: 4983 - DNA, 3000 bp, Unknown
  misc_feature (1)..( 3000): cDNA_ID_1826797_gDNA_ID_1620751_Annot_ID_49822 3000 nt of promoter + ATG
taatttagccggccaagatatggtaaaactgcttgatgtgattaagactggtgcaccaaactcaagcagtagctcaaataaacaggttgaagaaagggtcgaagtttcccttccatctcccactccatcaactaatcctggaatggtgcgttacttgaaacctattcaccccaaattcctcggacatatccaaaaccctattaatagatcatgttgccaaattgaatctcacgacatatagaaaaaaggaaagaactacaacaggctctagctaacaccaaactggattatgaattccagctgttagatctaacctgatgagtacaatgcccccattagaagatgttaatgtctgtttcttattctcttactgagttaagtgtattgttccaattttacagagtggatggggacaagaagggattcggaatccattttcaaggcaaaaccaagttggtactgcagttgctagatcgggtacacagcttcgtgttggttcaatgcaatggcatcaaacaaatgaacaatcaatcccacgacatgctccatcagcatacagtaactcgatcacattggctcacacagaaagagaacagcaacaatatatgcaaccaaaacttcatcacaatttacattttcaacaacaacaacaacaaccaatctcaacaacctcgtatgcagttagggaaccagtaggacaaatgggaacaggtacatcgagttcatggaggagtcagcagagtcagaacagttactactcacatcaagaaaacgagattgcatcggcttcacaagttacttcataccaagggaatagccagtacatgagtagcaatccaggatatgaatcatggagtcctgataatagcccaagtaggaaccagcttaacatgaggggacaacaacaacaagcatcaaggaaacatgattcttctactcatccatattggaaccaaaacaaaagatggcgttaaaccatatataagactatggttctttggtcctcaatatttgcttgtcatggttgaattagcattatactctgttcagacacagattttcatttttaactcacaacagattcatcagagataataaactaaaagaaagaatgaatggataaagttattactgtctcaattggcttcaaggcttttcaaaaacaagtcttgtcttcatcattattcgactaattccaaatctgattcaatttagtaacagtaacactggctaaactggactgcttcggtaattggagattttggtatacaatatccatttctgtgaagattgatagaatgtggatactgttcttattcgtacacaatttttgtttacaaagggaacactatatactgttcctattggtactctcagtttaaaccgatatcttaaccggttgggatggataaccgggtttacttttgataactaaaagaacccagcatatagtttaaggccacaatctcaacttgcaaatacagagttaacagccgtttaattatcgttcttatgatttgttctttgttaaatgataggtcaaaaattatttatgtcttttctaatttcataactgtgaatgtttattgaatccacattactcgtcaccgaactaagtaagcagtctctaaattaagacggtgatagacagtgctcttcataaatcgttcataagtcgttcaaacttgtattagccaaatcattcaaaaaacataattaagagatccaaaaacagaagattaaaattaagaataacagattaatgagagaaagagccaattagtcagataattgtagtctgagttttggtcgacagaataaattaatatatccgaaaaatcgttatcatcattccatcggctctttctcatcgtcatcaatcttaaacagtaaaaaccaaaccctaattttcccgagaaaactgaattgtgaatacaaataagcagtgaaggctcagaaggatccattggtaaattttctaatcagagaattactcataaaataggtagtttttaatcatcactgccttcactctaaaccctaatctagccgaaatcgaattgaaaacaaaaatggattcaaatcttcagagaaaatcaaaaattgaaaaccatcgaaccaaatcaagcaacgaaaaaagaagagaaaaaccgaaacatgaaagaactactttgtggaataatcgatcattagaatgagttgattgagaaaagtaatcacaggcggcaatatataagacaatggaggaagctagggtttacgttttcgaaagaatcgggtcggtcccgttaacccgatgagtttgggctttgtgaattacatcaaactcggcccattgagtatctagtttcgggtttgacccgttatacatgatgccacgtagaccgagacgaacaaaaaaagccagagaagaagaagtttcagagaaattttccgggaaaaggcgcaagaaaatatcagacaaaaaccgattattattctgggtccattttttcaaaggtttattaaaaacgcaaccgttttgtcaaaagcgataatgagaaaacttcttcgacgactctgggtttctcgggaaacaagtactcagagagagagagatatttcgagaaaagaagaaacactcctccgatccatacgaaataagataaaggggaaaccaaaccctaaatcgagcttctccttatcggaaatgtcgcacttccaccacttttgactcctccgttcatcggcggcgatctgaatcaccgtcaatctgatttcgtttctgtgaaggtatacgcatttgatttctactactgagagctgatttgagttcttttttaaaaatcattagctaagttagtttcagagctcttcttcgaatatctggaagagagacgagtttaggtcgatcgattttgaaaatggtatagagcttcgtttatttgtgagaacgaccaagctttttctattgtgatgttatggtataatgatatgcatagaattctacgtgaaccagga

SEQ ID NO: 4984 - DNA, 3000 bp, Unknown
  misc_feature (1)..( 3000): cDNA_ID_1808696_gDNA_ID_1620751_Annot_ID_166807 3000 nt of promoter + ATG
gggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatgaaaaaaatattgagagtgagtgattggaggaaaataacacaacgcaacaatctaacaaagagagaccttatcatcatcagcatcaccttaacccatataacattcctcttcgaaaatgccaacaacaaatttcatagagaagcagaaatggcgaaatcactcctttgttcatcaaccttaaaccctttcttctccaccactctctcctcttcgaagaagaaccaaattgcatactcgggaaacagcaagaaccagacatcgtcgtctctgttatggaaaagaagggaactgtcgcttggatttatgagcagcttagttgcgattggtctcgtgagtaatgacagaagaagacacgacgcgaatgcagcgattcttgaagctgatgacgatgaagagcttctcgagaaagtgaagcaagatcggaaaaagaggattgagagacaagctgttcttaattctgctgtcaaggaaaagggtacttcttcaattttcctctaatctttcatttatgttcctcccctgctacatgaagtaaattgaacaaattgatggaaaagtttactcttttatggaaaaatgtgtgttctttgtgttatggttcctaggctagttacattgaaccctagtctggttttgtttcatttatcttggctacatgaagtaatcagaacaaactgatggagaagttttactcttttgaggacaaatgtgtgtcctctttgtgttatggtcccatggctagttacattgaaccctagtctggttttgtttcatttatcttcattcaaggccgtatgaagtaatcagaacacactgatggaaaagttttttactcttttgaggacaaatgtgtttcctctttgtgttatggtcttcacagaatcatagttaaatggtttgttccagtgccatttacattgaaccctagtttgattttgtttcatttttcttccttcaaggccacatgaagtaattggcacatattgatggaaattttgtgaactcttttggggacaaatgtgtttcctctttacgttatggtcgacatagtaaaatggtttgttccagtgccatttacattaaaccctagtctgattttgtttcctctatcttcatccaatgctacataagtaatcagaacaaattgatgggctcttttggagacaaatatacttaggtcttcttggttctctaactaaaagtatatagtgtacagggtatttgcaggatcttgtttacaagttgagcaaggtaggacaagccattgagaacaatgatctaccagctgcaggtttggttttggggaaaggcattgataccgaatgggtcaaaaccgttaatctggctttcacaaaggtctttcttgctcattttaactttcactaaggtcaaatctattggtccaatgtagaaacaactggttaaaacatcaatattgtctctccctctctttacataaggtagacttttttttaatgtttatgttactgtttgttgaaaagtccttgtttgtgttcttggaacagttgagtacaagcccagaagagaatacagaggtggaagcattcaattcatcattggcttctcttatcacatcaggtcttgtacttgtacttgtacttaactttttcattcacaagaatcaaaattgtcattaaaacattgcagtgatctctttgaaatgtggttttgattccttttttcgcagtgaacaagaacgatatagagtcatcgaagctcgctttcgtttcatcagctggtgcatttgagaaatggactactttgacaggtcttttggaacagcttaagggactgtgataggctggctacaaattctttactctttttttgtattttccaacagatttgtcaaagagggtcttttttttctccaaataatcctttgaataatcatcattcactttcttaacttctttggttattatttacctttatacattttgttcatacttactatgcatcaatatcaacaaggttgatttttccatcgaattccaccacaccaaaaggaaccaagaaaccataccaaaacttctttggttatttatctgaaactaattcaaaaagatctgatcagtaaacctttgttctattgaatctcacattaagagaaacccttttaacttgagaaggcatacagatatagagcatcacaaaatccccgaaacaaaaccgaaccagtcataaccaagaagggggaaagctactagatgaagctagtaggtggaagtttgagtcatttggcctattactacgcactagttatgatcttttctctgatacattgaatactttattaaaaaccattacataaccaatgtaaaagcaaatatttaaacgttaaacagtccaattcagctttgaaaaatcctcccagaagaagaagactagtcaatattggttgcgatggccttgtagaggcattattatctgttagataatattaaacattaatgagaaagtagaaatgcttctgtataaataccttcattacttgtgtcttatttcatcaccttcaccttcaacatcaaacatcacatttcttcctcttttctctcttttttctcagtcttcaaagagtttcttagtaacccaaatca

SEQ ID NO: 4985 - DNA, 3000 bp, Unknown
  misc_feature (1)..( 3000): cDNA_ID_3091622_gDNA_ID_1620751_Annot_ID_166806 3000 nt of promoter + ATG
catgtgcaactttcacatattttctggagaaatcaaatataataataatcattatcattgattgaatgatcatttttgacttttgatggcgctcctcctatcttccaattagtagtaacttttaagggttaagttgtatactagtcactttttaaaatttaattgaaaaaatagtcactttactatttataatttgcaaaatagtcacttttcactgtttgattcgtacacttagtttgtacaccacttttagtgatcagatgtatataaaaaatacacagcgtacactttacatttgtacaataaaagtgatgtacaatccaagtgtacgaatcaaacagtgaaaagtgactactttgcaaattatgaatagtaaagtgactactttcctaattaagtttgaaaaagtgactattttgccaaaacaccccttgaacgagatttatttaataaatactgtattaattaacgaaagaaattttaaaactttaatgacaaattgggtcaagtaagaggaacctgagattctttcgaaacagtattctctctattcgtcgaaaattgggactaagaacatcattattggtagtatcttaggttagtcttagcttagttcttaggatttttttataattgattttgaaaattttgaaatgaaagctaagaacatttcattttatctcttatgtaaaagactcttttaacaaatatatgattaaaaagccaaaattttctaataattaacctaagcaactaccaataaatgtgttctaacgttttgatttaatctggtatttagggtattttgtcattttggtttatctcttatggatttttgtttccatgtttgttgtgtggcattgcttaccaatacatagaatagaaacaataaatgaaactatgatgcttttcttacttaaagagtctgaggtcatcaaaattcaatatgtagagtgagtgagatgcaatttctatataaccgaaatccaactgcattattgtttgcatctggaagctcctctctttctgatgtattttatctacaaactaaaaattcatttgtctatcttgatgatggttcttttcttctttatcctcattttaacaaatattcgagaatcactttcgctatgaacgtgtgctaacatggatatatttctttttaatattcaatattgtgattcaaaccaaccatcgaattatatcagccttctttttaccacagtttggctcaaccaagtttcttccttttatttcaaatgagattgtttgagagattttgaatatgactgtatgtaacgtattgtatgcgcttaaactaaacttagtgctctccatatctgtttttactcgcattttgtcaactattgagttttatattgcccccttagctagtggatcttgtcgtggtgtatgcttattttgagataattaaaatcgaaagcatgatatcatcttgaagtttacagactgtccgagtgcaaagtctacgaaagatttaaagattagaaacttgaagaaatcaatgtgaaaattaatggtcatttacacatatatatatgtgttggggaaacaacggacaactgtacagcaataaagttccaccctacatatttatgtgagtttgtgaaaaaaaataaaaaatattttgctagcaaaaaagtaaaaaataaatgagacaccaaattatacgtaaaaatcatcttaatgtgaagagtaaaaactatgggaccgtagtacactcaaaatttcagacacgaccagcaaatgtccaaacgttctacacaaaaaaacctaacagatctatttttctcctcctctagatcttaaacctctcttttcttttgtttcttatacacaaacaattaggttaagagtgtttatatactccctcataacccttacccaaattccaatctcatggattaataatataaatggttgaactccaagtttggttctccaaatcaaaacccaatttggttcccaccactaggaggaaaaccaacagactcccctccgataaagtactggaggaaacaacaatcctgactatgataacatcgtatttttgcatgttttagatatagattttttatgttttaaaaaagtttttgtttgattttcaaatttttttagtactaatgtagtttatacgagattaatattgtagtctttaatggactgtatcaaccaaacctgactttgttggggcaatttgtggtaattgtatatatgaaaaaatggtaatgggcttgaatatcccacgaagccttttaccaagaagtttcacgcatcccacatcggaagggtaagagagtttgatagtggaaacttttatataaatagacttcactctccctcagattcaaatttcgcagctatgtggtgagcacaaagcgaactattctttcgccttttactaaagaataccgtgtgctctccacgccaagtggcttacgcctatttttggagggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagtaatgaaaaaaatattgagagtgagtgattggaggaaaataacacaacgcaacaatctaacaaagagagaccttatcatcatcagcatcaccttaacccatataacattcctcttcgaaaatgccaacaacaaatttcatagagaagcagaa

SEQ ID NO: 4986 - DNA, 3000 bp, Unknown; identical to SEQ ID NO: 4981
  misc_feature (1)..( 3000): cDNA_ID_3075060_gDNA_ID_1620751_Annot_ID_166798 3000 nt of promoter + ATG

SEQ ID NO: 4987 - DNA, 3000 bp, Unknown; identical to SEQ ID NO: 4980
  misc_feature (1)..( 3000): cDNA_ID_1826813_gDNA_ID_1620751_Annot_ID_166795 3000 nt of promoter + ATG

SEQ ID NO: 4988 - DNA, 3000 bp, Unknown
  misc_feature (1)..( 3000): cDNA_ID_3075067_gDNA_ID_1620751_Annot_ID_166791 3000 nt of promoter + ATG
catataaaaagatgagttttttggtaacgaatttacctcatcggcgatcattgcgatgagggcagagttgcgagcagggatcgtagctctcccagccatatttgattcaactacacacgataaacaattccagaacaaaaatcaatccagcgaagaagacaattatcgaaattgggtaaaaaccctgatcaattcctgatcttagattcgaagataaagcaaaagctcatagattttactcattacctctttttctctgttcttctctccttcttcgatttgatttgatagatagatttgtgtaaatcacaaccaaagaccacgcgcaaaaaaaaaacttgttcagaacacgattcaattgacaatattacccctgactatacctttaataacgatactaccctcctttaataattgctcattaacagtaaaagtggcaaaagtgtaaatatatactaaaaataatgatgagtgcaagtcccatcaaagccagcttgcctcttcgagggtacgtttgtcttttcgacatctcttttcttgtctctacttcagaaaaacctcctgtgatgattattatatgtgaagcagaacaaaagcaaaaagagagagtcagaggaagaagaagaagaagaagagtcagtgagctgcaatggcggattctcactcagtcaacaatcagctctcgagacacacttccatttttggtttacgtttatgggttgttctcggcgtttgcgttggagccgcgatcgttcttttactcgttctcatctctctctggttcatttaccgacgaagcaacaagaacaaatctcttgagtcttcttctaaatctaaccatacgattgttcccgttgtttccaaggagattcaagagattcgacctccaattcaacccgacccaacaccggagccacaccaaaaccaacaaagagaagacgataacaaaattcacatcgaaattggtaaagatcatcggattgcgtacccggaacgaggaggttggactggttccgggtctgggtccgggtcgggtgatcagggtttacttatgttgtcgggtcctgaggtttctcatttaggttggggacattggtatacgttgagagagcttgaggtttctactaatggatttgctgacgagaatgtgattggacaaggaggttatgggattgtgtatagaggtgttcttgaggataaatcaatggtggctataaagaatctgctcaacaacagaggacaagctgagaaagaatttaaagtcgaagtcgaagctattggacgcgtaagacacaagaatctggtgagattgcttggttattgcgttgaaggagctcataggatgttagtttacgagtatgttgataatgggaatttagaacaatggattcatggtggtggtttggggtttaagagtcctcttacttgggagattaggatgaacattgttcttggaacagccaaagggttaatgtatttacacgaaggtcttgagcctaaagttgttcaccgagatattaaatcgagtaatatcttgcttgacaagcaatggaactcgaaagtttctgactttgggttagctaagctcttgggttcggagatgagctatgtgactactcgtgtgatgggtacgtttgggtatgtggctcctgaatacgcgagtaccggaatgttgaatgagaggagcgatgtttatagcttcggtgttcttgttatggagattatttcagggagaagtcctgtggattatagccgggctccgggagaagtgaatcttgtggaatggttgaagagattggtgacgaatcgagatgcggaaggagttttggatccgaggatggttgataaaccgtcgttaaggtcattgaagcgtacccttttggtagctttaagatgtgttgatcctaatgctcaaaagaggccaaaaatgggtcatatcattcatatgcttgaagctgaggacttggtctctaaagatgatcggagaaactctggaggaggaggaggaggaatagaacagggaaggtcaccgcggaggaagacaaatgtgaatgaatcagaggatgagagtggtaattctgttctgatcaacaatgaccaattagctttggagaataagcagaactagtaaaaaagaaagaagctttggcattataattttgtattactatttttagaagttttttcttgtgtgtgtatatttatgtgtgtagattcttagccctttcacaaaaaaaaaaaaaatgtgtgtagattcttgtaattttgcaataattaaaactggggattgcttgaaaaatatatatatggtttgtttttttgtattcttttggttcgttctctattgtaatatagcctacatagtggtgatttgtggtattggtgacactatgttaaggtcaaaaagaaatagagagtaaattccatatatatgaaaattgaaaatgactgtttaaatttacatatggcgcgaaaaaatgatctagttcgttaattatttttagaagctttttgtggtaaatttagatttttaaaaaactccatatattttttttttataatttaggcttgtctattgtaaatttgtaatatagcttagtgatttatttgtttagcttctggtgacattttataaatttttaatgaccagtataatatagtatttttttataaattaaaatataatctaatgttttatgtcaacttcgttgttcattgaataaatcaaactttgaagaataattaaataacaatgtttgcaaaaactgttacgttttttcatgtaaacattagtggacgttatacaatagatatttaaattataaaaactattcaaagaatattgtaaagaaataaaacagaaatgtgtaagaaaaaatgtttattttattgtacgtaataaaaaaagagaatatacttgtgtgggtggacctaaatgcaaataggcaaagtaccgacaaaaaaagaagaatcagaaagtgaaaaagagagcgagcgatg

SEQ ID NO: 4989 - DNA, 3000 bp, Unknown
  misc_feature (1)..( 3000): cDNA_ID_3075075_gDNA_ID_1620751_Annot_ID_166788 3000 nt of promoter + ATG
gttcatcatctccgaaaaataattggcttaaccgaaacttgattattcgttattcttttgtgggttttgatagtgttgatggatagtcggaaagagagagaggctatcacagagttatcccgagctatcgcctttaaagcagatcttcatcttcttcacttacgagcggctttccacgagcatatcggtgatgtcacgagtgcgttgcgggactgtcgtgcagcgctctcggtcgaccccaaccatcaggagatgctcgaactccatagccgtgttaatagccatgaaccttgaaccgcaaccacacacaaaagagcttcgatatgaaagtaaagtgtgaaaaattgtaatactaaaagaatcattgttggaaacttgtaatctcttgtaactcttttattctttgttgctgttttccatatatcgatttcgtattttgtccttccatcgtaaacttcaaatttctctgggcctaaaacgtaaacttgatttaaaacaataagtagatcgtttgagttcttggtgacaaacctaaagcattttcctttattattcttgcacctaataaagccccaatgagctatcttattttcaagctttaggtttgaaaatgtgaaaaagctttgggtttgtcaccaaagactcaaatgatttcgattacgttttatagaaggttgaatgtttgtactcttgttacattaacccatgacatacattacatatacatataatatataagagcttttactacaagacctattaacatgggcttagatgggcttctagagttgtagtgttaataacttgggcttaatgggtactataatactgatgactagttttctttgtcctcaaatgatctagtttcttccctgttttactttaaaatataaaattttccctttgtttgttacaagaattcgaatattcatgtgtttatttccttcgtatagcatatatattttcagaatatttcacaattcaaaaaagcctttatgaaaattttaaaagaagaatattcggtgttgcatgggttttagttacgctcgtgtctcataatggtcacacgttttgttttgttttggcctaaagggattccatcataaactgaattttactacagtagacacgcctatcccaatgaatcaaatggtacaagacacgtctaaggacaaaatcgacttaacaaaatgttcttcattggaatatttttctatagaaaaatttcaacagataaaaagttaaagaacggatgaaagagtgcgaaaaattcttgttggtggggtaagtattttctttttggacatgaacaattttcaaagggatatattaagaatattaatcaaaaacttataaaggttggaaaaaaaggaagaggaagatagcacaaagccacaaagtcatccacaagagtaaatcatatgaagacgaaacaaaattcaacaaagtgatatattccattttgatattcaaagccaaaatgcttttagggcattggttgctttgagtgtatgtatttttctcccctacaaatacaactctcttttatctttgtgagtgattcaaacttaagttaggaggcatgtaaggatgttgtataatcagaatttaaatttaaattagagaaatagacaataaagttgtttaattcgtctttagggcgaaatagctttaaacctaaatttgttttttttttgttagaatctttgtatgatgttccctttttacaatgagtttctatttccttacgttgttttaatttattttatagcttatgataagtttcattcaaatcagtgtgcctttttaagaattttgggtatattatgggaatgagagaaactataaggaaaaaaaaagataaagctttagcagccttggtagagaaagtaacatcactcaaattcataataacacacaagtaaaatataataatatttaaagacaaattcagaagaaagttatagctttttctacatgaaataaaatcgaactagaatccctagctaaagtaataaggaaatacaaatagaaaatagcacaattgaacaagtatacttatactcttggcaataagtcaaacaatttcatcttggatacttaattttccagtagatagtttcctattagatattcctcaatggttgtattactaaatttagttcttctattataagaacaacgtttattttggctaagtaattgtgtgtttagattctctttacaaacttaaacaaaacaaaaaaagtttccattattcaaaccccaataaattgaaaagaggcacacttttcttgatataaaagtgattattacttccatttaaggaaattaggcctgataagtctcatctcacaatattttccattaattgcacaaattgatagcttgctttttttctttctgggtctactcttcttttttagtagacaatttcaagtaaatgcttatagtctgaacctgtaatcatcactcttctctgtaatgcagaacacttaaaaaattacataaaataaagaataaaactgaggaataaaaaataaaaaacagttaaagatatatgaaaacaaagtcaaagtctcactttcaagcacaatctctttcctctgtggtatttatctgcacatagaaaaactaataaaaatgggaatcaaacagtctttgcatttattgtaagcacacacatatatgtgtacatgatagtgacattggagaataatccatcatggtcgtcttcttgcttttgagactatacatatacatgtgcattatatacactactcaagtaactaaattatttaattttgcatatatagccaaagaatgatgtctttctgtgtacacttacttcttactctctaggtacttgcagttccttattttaagagatcagaagaaaccaaagtttggatctttttatagttttcttccaagttttgtttttgttttttcttttgttggagtttccttcttcatatagctataaccatatagctagcc

SEQ ID NO: 4990 - DNA, 3000 bp, Unknown; identical to SEQ ID NO: 4975
  misc_feature (1)..( 3000): cDNA_ID_1826835_gDNA_ID_1620751_Annot_ID_166787 3000 nt of promoter + ATG

SEQ ID NO: 4991 - DNA, 3000 bp, Unknown; identical to SEQ ID NO: 4974
  misc_feature (1)..( 3000): cDNA_ID_1826842_gDNA_ID_1620751_Annot_ID_166785 3000 nt of promoter + ATG

SEQ ID NO: 4992 - DNA, 3000 bp, Unknown
  misc_feature (1)..( 3000): cDNA_ID_1809497_gDNA_ID_1620751_Annot_ID_166809 3000 nt of promoter + ATG
agagacccataaggaacccgaagcagtaaacaacagccaaatcagcttgagagcaaggaccttattccaagaagataatctttttaaacccaatccaccactctccttagaagaacacactatatcccaagagatttttgcttcacgagctgagtttggagctccggaccataagaacgcgttgcacatctgctctaacttatgaaggcattggttggggaggataaatatcgaagcccaaaagttgattgtggagtaaataacagatttcaagagctgcaatctaccagcaaaggagaggtgccttgcagtccaagacgtgaaccttgaatttatcctatccacaagaggctggtaatcgtgctttttcattttttgggacataagaggcactcctaaataacggacaggcagagaaccttgtgaaacaccaagactagctgccataatccgattcctttcaaagttaccaccatctaaaagtaaggccgtcttctgcagattaattccaaggcccgaacctttcttaaacacgtctagaatatccaggatggcaacaagagaagacagagacccatcacagaaaaccaaaatatcatctgcaaaactcaaatgagtgatcataggagccaaacacttgggatgcagaacaaaccggccctccactgctcccaaatccaaagatctggccagaatatccattactaacacaaacagatgggaggacataggatctccttggcggatgcctttctttcctacgaagaagccaatcaattcaccattataagcgatgctataagagggagtagaaatgcaaacccatatccaatttataaaaatgggaggaagattcaaggctttgaggatattgatgagaaactcccaattgacgttatcataagccttggttagatcaacctgaagacagcctctagaagtatcaccttcagcttggaagttgtccactagctcagacgccaagagaacattttcacagagaagccgccccttaataaatccaacctggttggattgaaccgcttgatcaatgaacaggttgagtctcttagagataaggcgagtaatcaccttgtagattgtggtacaacaagccaccggacgaaagagattgagctgatcagccccgggaaccttaggaataagagtaatggcagtggcattaaaccctttcaacaaatgacctgtcaggaaaaattccttaatagctgcaataaaactttcctttacaataggccaagcttccaagaagaattccactggaaacccgtctggaccaggcgccttgttcctaggcatagagaataaggccatagtgatctcttcatcactaggaatagctgttaactgagtagccaaggaggagtcacacctaaaaggatgaagagactgaattcgttcaacggagaagggggtcacatcatcattagggggcctaacagatgagtataataggagataagcatacccttaagagactggtttgatgtttttcatgatataaactttttcgtaatgtaattagtggttaatgatttttgattgttttataattttcatgatgtaatgataaatagtgatttctgatattttatgagatatttttttcattatgtaatctacatatacatttttggagccattttaccaaataaatcctagatttgaagttatttacaataatgccattagcattaaatctttttttcaaactaattaattttactttacattcttaatttaaattgtcaatcacattatcaatcaaatttaatccaaacaaacttcacatcaatcccttaaaattagcataaacatatttgttaacaatattttaaaacaaagttttttatttaaataaatattattcttactaaacgtttttgtttaaataaataaatcatgtatttgaacttatttacaatgtcatgcttaattatttaggaatgaaaatatttaattaaagatctaaatcttctaaatccttgcttttagatttattatgtcattacctaaaaggtaaaaaatattaactttttaaatataattatttctatatttaaacttaataaaacgttatcaatatttaaacttttaaaaagtttaatatatcacaattttttaacatcattatataatatatagagtttaaaaaaaaatcaaaattttttccgtgattcgaaattttaaaaatgaaaatatattaaccaattgacgaaaaatatgtggttcaatgtcccgcatcgactaaaatatttaaacaaatgattcataaacatatcataaataagatcaacattaataaaataaatgatatttttatatatactaactttaaaaataaattgtttccgcggtacaccgtaagttaaaatctagtacttatgtaatactaataatggtatcttttcatgatgagggaaaaaaaacattttttataaaccatatcacaatataatgaattccaaaagtcatttgggtaacttcctaacctctaattagtaatttaagtatttaactatatcaaacaagttaaaatattatgctatttatgctcctttttcttttcaactagttttctatatataaataaacaaacgagtttgtacaaaaaaaacaacgagttgacttttcaacgctgttagatttttagttttttatagatagatctataactgcatcaacggtcaagataattgatcgcaaatgatacgctctagaacttcgccacgtgtcaacaacgctactaactcatcactaccaccgacaattaagtgaaatcagacaatcttaactgtcgtgtccaaaaacacaaaaactctcctcgcttctcttctcttgttgtagtaagtaactttggtaattaacagtgttattatcaaattcgaatctcttacattaatggaaactcagatcttctcttaaaaacacataaagcacagatcttttacagagaatcttgtaagaagaaagaagatg

SEQ ID NO: 4993 - DNA, 3000 bp, Unknown
  misc_feature (1)..( 3000): cDNA_ID_1012102_gDNA_ID_1620751_Annot_ID_166778 3000 nt of promoter + ATG
tgcctacttccactcatcacataaccaagatcctcaaacttctgaatctcttcagcgttaagacccacttctcctctacgtgggatacgtttaccttgctgaacatactgtgcaatggcgtctccttcaccgggtcttaaagcaccaccataactgatgtgaccttcagctttaggtaatggcattggaccaacatcaccttcttcttcctcttcatcaacagctgaagatttcttctttaattcaatcatctctttgaacttcttcaactcttcttcatcaagttctagctcagtgttcttcaccgtttcgtctacttgcatcttcgaatcttcctcagtaccatcgctgtcactccctgacttcgtcttctctcccttgcttcgttttgaactagaatccgaagatttcttccgcctcttgctctttgacttggtatcttcttcctccccagacgaagaagcactaatctcagctttactatcttcatcgctgctctcatcagagtcactgtatttcgtctttctcctatgacttcgctttttcctaaaactacggctgcttctactcttcttcctcttagaagaactcttcctccttcgtctcctatcttcctcttccgaatcactctcactcccttcggattcactatcgctgtcataagatctctttctcctgcgcttagacctcgagctcttactcttcctcttcctagatctcaaaccatcagattcagattccgagtcagatttacctttcctttctttccctttcgaattatcatctctttcgccgccgttcttgtcctgaatctcgtcggcgttctcatcggaatcctcgttctgatctctaggtggactcggtgtgttctcccaaaagcagaacttggctgatttcctcatcttaagccgtttctgcctcctatactcttcgtgactcaatcccttcaattcttcatcggaatctgaaccagatcgtcttccgtttcgataatctcgatccaaatagccatgattcttcccaaatctcctcggaagcgagttcatcgtcattctcgaatccctaattcactccgacgacgacaatgaagaaaacaaaatctaagcagctgtctgataaattagggctttgattcatatacagtatctgcgcctttttacttattgggcccttaacgaataggcccaatatttatcattattcaccactgaaaatcatgttttgattttacacaaagcaccccacattttaattagagtcaatcgagtcctctatccttatcgtcgtcttcagatggcaagtctctccatgtccgccgtgtctctgtcgccgtttcggcctcaaacagagaatcttctttcaaaactcagtttccgaacgaacttacactcgttcaatctcaaaccaataaggattagtacgaaagttagaagttttggtgggaatcggagagagccgaaggattcaagatttgtcgatgaaaaaggcgtagttgatgacatggaaggtttcttagacaatctctctctcgaatacgactctgtttgggacactaaaccctcttggtaaatctcatttaagttcccaacaattttatttcaagtagtttggatttggtcctaagacttatgaggaatcgtatttgttggttgtgaatatgggattatagcttagatagagtcttaagttcacttttaagtggaccaatccttaatctttattagcattttcagtgatttatgcctgcccaagaacttttttgaatcatatatgaagctatatatttattgatgctacttaaaacaagacttaccccattacagtttcatgattgtgtgttgtggtttagaagatagaaagaaaaagtttgaatcttttggttaggaagatagtgaagaaccaaaatacagattatgtaatggtaattgggttaagaagggtttaacatttcgacctcagcatctacagctttgaatatctattgatctggtgtgtatttgcaatcaagaactttacggttcttcttagacgttttcagggcctagtgttcttccgtatggttttgaataagcaactggctatgtttctcaggtgtcagccatggacgataatgttaacgggtctatcaatagtggcatgtagctgggtaatactacactcggtcatagtttcatcgcttgcggttggtgtaattggtgcttggtggtacatattcctttatagctacccaaaggtatgattttcccttccatcatctaacaacctctccttttcattcccttactaaagaaatgttcgtagctctaatttactaagtctaagttaaagtaaaaatcctgtttaaacatcttcagacaatgctagtttctataatcttagtgaacaagactttactttggtcttgtctttgagattctggtggttttttcgtgtactttggttcagtcgtattcagaaatgattgctgaaagaaggaaacgagtagctgatggttttgaagatatttacggcaaaaacaagccttcataggatcttctcaatgttcaaaattacattcgtttcttgcataaatcttcccttctgttgtgtgtataatataaccatcatctatggatttatctcaatttcattcacagatgtttggatacataaatcttgatttcagagtcctctaatgtagtgggcattaaaatcgaattgaaccgattatacaaaccgaaattaacccaaatataccgaaacctcattactgaaaccaaccgaataaagtgccttcgaactaaataaaccaaacgaaccggaccaattttagttcaacaaaatcgacaaattcaaatcgaaccgaaccgagccgaagaaccaccaatacgagaaatgaggaatgaagggtaaaaatgtaattcccaagaggtcatggtcaacggaatgtatatatatgtaacggtgagagattcattgagatcatctccactctgctaaatccgacgagagacgacgatg

SEQ ID NO: 4994 - DNA, 3000 bp, Unknown
  misc_feature (1)..( 3000): cDNA_ID_1826789_gDNA_ID_1620751_Annot_ID_49824 3000 nt of promoter + ATG
ttaaaaaagaactgagtcctcctcgagacactttgtagcttgcggataacgagacaatttcaaatttccagcctgtgccagcggaaagtcaacaatcgatctaactgtaaactaagatcaaatatatgtattattgagggtttaggttggcatgtgcaactttcacatattttctggagaaatcaaatataataataatcattatcattgattgaatgatcatttttgacttttgatggcgctcctcctatcttccaattagtagtaacttttaagggttaagttgtatactagtcactttttaaaatttaattgaaaaaatagtcactttactatttataatttgcaaaatagtcacttttcactgtttgattcgtacacttagtttgtacaccacttttagtgatcagatgtatataaaaaatacacagcgtacactttacatttgtacaataaaagtgatgtacaatccaagtgtacgaatcaaacagtgaaaagtgactactttgcaaattatgaatagtaaagtgactactttcctaattaagtttgaaaaagtgactattttgccaaaacaccccttgaacgagatttatttaataaatactgtattaattaacgaaagaaattttaaaactttaatgacaaattgggtcaagtaagaggaacctgagattctttcgaaacagtattctctctattcgtcgaaaattgggactaagaacatcattattggtagtatcttaggttagtcttagcttagttcttaggatttttttataattgattttgaaaattttgaaatgaaagctaagaacatttcattttatctcttatgtaaaagactcttttaacaaatatatgattaaaaagccaaaattttctaataattaacctaagcaactaccaataaatgtgttctaacgttttgatttaatctggtatttagggtattttgtcattttggtttatctcttatggatttttgtttccatgtttgttgtgtggcattgcttaccaatacatagaatagaaacaataaatgaaactatgatgcttttcttacttaaagagtctgaggtcatcaaaattcaatatgtagagtgagtgagatgcaatttctatataaccgaaatccaactgcattattgtttgcatctggaagctcctctctttctgatgtattttatctacaaactaaaaattcatttgtctatcttgatgatggttcttttcttctttatcctcattttaacaaatattcgagaatcactttcgctatgaacgtgtgctaacatggatatatttctttttaatattcaatattgtgattcaaaccaaccatcgaattatatcagccttctttttaccacagtttggctcaaccaagtttcttccttttatttcaaatgagattgtttgagagattttgaatatgactgtatgtaacgtattgtatgcgcttaaactaaacttagtgctctccatatctgtttttactcgcattttgtcaactattgagttttatattgcccccttagctagtggatcttgtcgtggtgtatgcttattttgagataattaaaatcgaaagcatgatatcatcttgaagtttacagactgtccgagtgcaaagtctacgaaagatttaaagattagaaacttgaagaaatcaatgtgaaaattaatggtcatttacacatatatatatgtgttggggaaacaacggacaactgtacagcaataaagttccaccctacatatttatgtgagtttgtgaaaaaaaataaaaaatattttgctagcaaaaaagtaaaaaataaatgagacaccaaattatacgtaaaaatcatcttaatgtgaagagtaaaaactatgggaccgtagtacactcaaaatttcagacacgaccagcaaatgtccaaacgttctacacaaaaaaacctaacagatctatttttctcctcctctagatcttaaacctctcttttcttttgtttcttatacacaaacaattaggttaagagtgtttatatactccctcataacccttacccaaattccaatctcatggattaataatataaatggttgaactccaagtttggttctccaaatcaaaacccaatttggttcccaccactaggaggaaaaccaacagactcccctccgataaagtactggaggaaacaacaatcctgactatgataacatcgtatttttgcatgttttagatatagattttttatgttttaaaaaagtttttgtttgattttcaaatttttttagtactaatgtagtttatacgagattaatattgtagtctttaatggactgtatcaaccaaacctgactttgttggggcaatttgtggtaattgtatatatgaaaaaatggtaatgggcttgaatatcccacgaagccttttaccaagaagtttcacgcatcccacatcggaagggtaagagagtttgatagtggaaacttttatataaatagacttcactctccctcagattcaaatttcgcagctatgtggtgagcacaaagcgaactattctttcgccttttactaaagaataccgtgtgctctccacgccaagtggcttacgcctatttttggagggcccttacttaatcgtgaggcccaacatttaacctagtctgaatgtttcatttgctaaaaactttgtttgttgctactgggcccaaaggtttgaaaggccagttcaattgaaatatcgcataatcaaattgaatttaatctgcaagaccaattcgttaatcaataagagcatactaggatttcaaaccaaatgattcagttcaacgatgttttaaattatcatctagaaattataaaatgtgtaataaagcattttttttttttttaaacttgacaaaatctctaaatgtaaagtctaatataaaccttaaaatctaaaaactaattatgcttgtttttgagaaatttttaaaaaattgtgaaaaagaaaagta

SEQ ID NO: 4995 - DNA, 3000 bp, Unknown; identical to SEQ ID NO: 4984
  misc_feature (1)..( 3000): cDNA_ID_1808696_gDNA_ID_1620751_Annot_ID_49825 3000 nt of promoter + ATG

SEQ ID NO: 4996 - DNA, 3000 bp, Unknown
  misc_feature (1)..( 3000): cDNA_ID_1826956_gDNA_ID_1620753_Annot_ID_49838 3000 nt of promoter + ATG
ttttatatctgtctggattcagtattcgattcaacttggtgatcatctgatgacattttcctttgttcaggtgataacttttttaaaaatgtgagctacacaatccaagtcctgtgtgctgccgcttttacgcaagaaaaagaagacctcaggtctgtagaagctcagatactcactaaaagagcagagctggcaaagtttgagacagagtacagggaagtacttgtgcagttcaccgatatgaccagtcgatacgctcaagaaatgcaatcggttagtcttttattcatgaaagtttataaatttcaaaccaccattcacagaaaacgaagagaagatgtgtcatgactgagtaaattagaccagattctatgtgtaagtttctgaaatggttagcttagtctgattatcttatggtctttttgcagatcgatgagctcttaaagcagagaaatgaaattcactcagcatacacgacgattccattgatgaagcggagctcgagcaagaacaggatgagaaagagctcattcaagaaggcggcggctaaggcgcctgctccaactgaacaggaagaagaggaagaggaagaggaagaagaagaggaagaaagcagcagacagaagaacaagaaaccaagtacttgtgataagtccgagacactaaagaagaagagcaaatggttcaatttacatttgaaattggacaagaaaaaaccttgttagtttcttcatcacttttatcaaagaaaaagattcttatccattatttttctcccttaccttagggatcggtgtatctgtaaatcttttgctatttttctccttcaacttatcattagtattagtcaacaattttattttgataattgttatctgtcaaagttctcttaaacatattgtgccctattgaacccgagatcacatatgacaaatggatcgcaagtatggaaattttgtgatatccaattttgtaacagattattcaatttgacacatgcaaaaatttagataacacatattgatggcacaaaaaatttcacgagagattttttttttccacccgaaggcatgaatcatgattgctacattttcaatttcaatatattagcaactcaatatcacaagaccaaattcactagtcactaccaaataaattttgaatgtgtgttaaaaggggtaatcctaatttatcccttgtagtcattgtattgatcacaccgccttcttacttctccaagcttccccgtcttcacattcttctcactaactttctccatagccttcgcaaacgcgtcaaagaacgccgtttcgtcctccgcgtaaagatccaccagcgagcgcgtcctgttgtcaaacgcaatcgcgtgatcggactggagcaacccgtaaccgtgcttcaaattcttgtaatacatattatcaaatttccctggagtaaaaacgtcattaaacgcagacatctgttcatcattggtgtaattcgcacacaacttcctcagctccgccgcgtatttcggattcatctccaccggaccattttgatcagacttgttaaagatccgactcgcgaactctttgcaatgagagaaaccaatggtgtgagcaccaacaagagcaaccatttcttgaacggtcagaccactagactcgaaaatagaaatgatatgatccatagtcatgttaggtcgagctagttttccttcaacacgattcatatcagagacaagactatctttccgaccgaacttaacgttaactctcggacctccgaccattgagattaaactacgtgttgcaccaacgaggatatcggagcaagaaacaatgtttggacattttagctcgacggcggttttgatacgtgtgattacgtcgaatgcgtctccaggaagagaacggttgatatcggcgtcacgttcggaggttttacgtggagtagaagcaacgaggattgaggcgtcgcagccatcaaccatgcaatcgtggaaaaagagacggagtgttccgacagctgttgttggagctgcaatttgtttatcggtgacgatttgtacgagtgtttcctcgaattcaggacatgttttggtgtaataatcagacgagagattggcttgaaggagacatggagaagatacgagaataaacagacataaaccaaaagatttcattgaaaaaaagagggaaaaatctaattaatattattttctcctgatttcaaatgatattggttgattttcgatctctattttttctcttctattgttgtgggcgtgtgtgttatcttttagctgtttgtgtcgttgttaattctaaaacgaaggtgtttttgtttagaaaaatctaaattgagagtttttaggagaaacagaaaacgatattttaccaaattgtaaaacccttttttggtctccacaattattagaaacactaggagataaaaataatcaaaatgttgctcctaacaaaaatgtcatatgtataaattttgtttaatcgatttgccacacacactcactgtatttactaacgtcaaagaggtgtgactttccaatctttcatatactacaaatcacaattatttcgacataatctctaaacaaaaacctaaaaactagttatttatttttacatcactttcctataaattggttatagttatttcacaataattcaaaattttcataatttcgtgctgatatactacattccattgttctttactaatttttatatcattattatgttctgttatttcattgtttttttagtattttagttacacttttttcaattgagaaaacttctaaaaagagaataatactatccaacaacattgaggttggtgccaccaacgcaaaacgtgaacaacgcgacataatagatctgactatataataaaccaaaatcaaataacaaatgtcttcaacactttatcatcttcaattgaaaaaaaaaaaaaaatcaacccaaagctctgcttcgttgagctaaaacaatg

SEQ ID NO: 4997 - DNA, 3000 bp, Unknown
  misc_feature (1)..( 3000): cDNA_ID_1808807_gDNA_ID_1620753_Annot_ID_49840 3000 nt of promoter + ATG
cgatgaacgaccgcttcaagactctctttagtagcaaaagctacgtggaagtccgacggcacaagaagtgcacgtgggttcaccatgtggacgccgtgtcatcactagccttgtcgcaagatggctctctgctttactctgcttcgtgggaccggagtttcaagatatggagaacatctgatttcaaatgcttggactctatcgaaaaggctcacgatgatgctattaacgccatcgtagtgtccaaagacggttttgtgtacacgggttcggcagataagaagatcaaagtgtggaacaagaaggacaagaaacactctctggtcgctacactgactaaacatctctcggcagtgaacgcgttggctattagtgaagacgggaaggttctttactccggtgcgtgtgatagatcgattcttgtgtgggagagattgattaatggagatgatgaggagttacatatgtctgtagtgggagctttaaggggacacaggaaggcgattatgtgtttagcagttgcgtctgatttggtgttgagtgggtcagcggataagagcttgagggtttggaggagaggattaatggagaaagagggttattcttgtttggcggttctggaaggacataccaagcctgttaagtctttggctgtttcagtttctgattccgattctaattctgattattcttgtatggtttatagtgggagtcttgatctttctcttaaagtttggaacttaagggtttcatctatctaactgcttattttacaatctataacgtgattatgactaatctctctttattagtctatatacttatgaatgtgatatatcataatggagctacctaggttttagtcaaaaacctacaacactcggttatcggagtacactttaatattacgatttataaatttgttctccaaatatatgagatttctcagttttgatcatcattggctatgttattaacaatgaccttcacgacttcacacgaacttatgtgtacacattgttttaatgtttagttttatttttctttgtgaaatatagagttaaagtaaatttaaaatgacgatagagaattataaaacttattctacaacgtggaagttgatcatccatgtggtgtggtggttttatgatttgtgtttggttgaagttattaatctggaatatgtgtgtgaggtcagatgaccccccaaaaaacattgataaaagaattgtggaactttttaaaataacgaatcacgtagttttgtcttccactatgactgaatttatatgttataatagtgataaatggatatcgcataatacacgtgaagtatggggaaagaaaaactttcacactatagtactactatacaatctttgtgtgcagataactgaattctaaattgaaatataaaaatactctatgcaattaccaaaatatatgtcccttcttattgcttgataaaatgcgaatggaggtttaacattttaggcgattcagttattgggtttctaattgtaaggcccaaactttagagacccatgaataatatatagattttagtacgatgatacaaacccatcaaacaagtcaacagtcctaagcatatgacgttttgttgtgacttatgaccgtaaaggggaccagttccaatcattttcgtagtaggaatctgctgataataattttaattataatgtaatacgtcccgatctcgtgaagtgaaagtaatattttgaaactgcaaatatctcattctccaatgtatttttctatctaaaataatcaaaaacggtaaagtatttcttagacattcttataaacaaatatttgttacaaactaatctttacattagtttaaaatgatcctcgataaagcccaagaaaagatttggcaagaacacaaatttattagaaaaatgaacccaacatgataatgagcctctgattgtgttgaagtgtcctcgtcgttgtgttttcattttcattaatactcaattaataatctcatgtggaccattttttataaaatattcctgaaaagttgtacactgatgcaagccagcatcacaacctttttgtgaggataggacagaaaataaaataaaaacttaacaatttgacgttaatcgctaattaaattcgattatactcaaactcagcagcatcaaatcaaatattaaactgttattatactcataaataattattattatattgttatagtcaacaaaactgttactattcaaccctacctatatagtaaaatcctttttctatttttgtttttaccataattatattttttaaaattcccatatatgtcacatagaaaaatcttagctgtttacaaaaacgtataacaaagtaaatataaaaatttgttaattgttaaacttgaaccactaatataagttgggtactagatattgttgaaaaccatattgtaagttataacttataactaaaccaatccaaatagaaacaaacattagagaaatgattaaaaaaaggtcataaataacacatatgagttggattattaatgttaattgattgatttaatctggaaacctactgtcttgcttcgcgtgaacactacgcgcctcccaaaaacaaagatgccaaaacaagaaacaacctgcggacctcaaatctcataacccacgcgccgatatcacgcgccgaaccagcgcactgtagtgtgaaatatccacagttttaaatttcgtcttctctctctctcaaactatttctctcaccttcctccgacgatttctcctttgacagttcagtcttatctctcgcaaggatcggagatatagagagatacatagaaccgtctcgtagctctcttccgccgtcaatttgaggtttccggggagagaattgtagaaatgaaggaataattggagaagattattatcacctcgctggagattctattttgttgaagtgtgattgattattaggggttttggttgtgaagagaaaatg

SEQ ID NO: 4998 - DNA, 3000 bp, Unknown
  misc_feature (1)..( 3000): cDNA_ID_1826945_gDNA_ID_1620753_Annot_ID_49843 3000 nt of promoter + ATG
tgacatccagtgaaattcaagaatgagttccaggggttcccggtggcgtttcggagaagctgcggcggaatggctgaggagtttgtatagaaaccagcggagactggagaaggagcgaagaacaacaagaaaaccatgaaaacacaaatcctcaccatccaaaagagaaatattaaaaagattaagtgaagaggtattattgagatttacaagagaattagagagatgacatagataaaactaaacaagtttgacgttggagaaagcagaggtcatttctgcgttgcgtttggagaattttctatgttgaaaatgctgcattattcaaaggaaacttcctccgtcctcgtttcaaagggtctcacgaagaaaaagactaatgaagcttctgccaatagatagtgtcgttttatggataattaaagttgattggtggcttggtgcaatagattaggcccgatttagtcttggatgactagaaattgtgattgaccggtggtaaaggaccggttaaatgcaaagttggaaaaagaaccatgcaacaaaaatggttgaaggcggcagaatcaactaaattggttgaaagtgtttttgttttttttgggtcgttgaatgtttgaattggtcttttttctttttgtgataatttttccggaggttgttgttattggttgaaaaaatcaacgtaaaatctccaccttacacgagtaacgccatgacttgtttgttaggctatctaattttttcctgtaatgggtataacatgcaagtctccatcggtaaaattaattgatatatcatacatgcatataaagttttgggccaaaagtttgaagccctttctaaacagaattaggatacatataaacagaaaaatgtagattttcatgttagatccatttaggctaaaaattgttttcagaattagttcaaccacgtttgcaccaacattattaaaacttagaagcctgtaaacgcatagctttattaaccaaaatctaaactaagggacgtttgatagtgtttagtgtacatttatttcgtagttatgatatttttgactgactaattcattttagttacagattttaattacattttttttttggtgtgctttgggttaataatacttaattatattctaccaccaagtgataggttttctttgcatacggttagtgtatgactaatggagtcataagagcaccttcactagaggactctttagagcatcctcaatggacaatttaattgggtgtctttctctattataaaatattaagaaaatttcgtttgcccccaaaaaaaaaaaatattaagaaaatcaaaatataattattaaaatatgatagtgtctttaaatgagagacattcagttaaaatgtctatgaaaagacattatgggaaggagaatttttatttaaagacattttcatattttaataattatattttagttcttttaatagtttattgtggaggaagacatccaatataaatgtgcaatgtggatggtgtaagatgatcttaagaagataaagtctttttatatcacatgaaaagtctattttgttaataaaaaaaagtatatggaaaaacagaaaatacatatatttatgaaaagacagtgttgccctacagagccaatagaacccatttgactgagtaaaatgctgtaaacgaatgccccacatactattaaatagtgagattctaactcaaaaacaattgacaatgaatagaaaactttatatattatatatctatatatatatttttgtagttattttaacaaataaatcttagagttggacttatttacaacccaatgccattagcattaaatatttttttcaaaataattaattttactttaaattcttaatttaaattgtcaatcacattatcaatcaaatttaatccaaacaaacttcacatcaatcccttaaaattagcataaacgtatttgttaacaatattttaaaacaaagttttttgtttaaataaatattattcttactaaacgttttttgtttaaataaataaattctgtatttgaacttatttacaatgtcatgctactggcattaattatttagaaatgaaaatatttaattaacgatttaaatcttctaaatctttgcttttagagttattatgtcattacctaaaagggaaaaaatatatttttttaaatattattatttatatatttaaactttataaaacattattaatatttaaacttataaaaagtttaatatataaaaaaatttaacatcattatataatatatagtttaaaaaaatctcaaaaacatttccgtcatattttgtgattcaaaattttaaaaatgaacatatattgaccaaattggcgaaaaatgtgtgggttcaacatcccgcatcgactaaaatatttagacaataattcataaataagatcaatattaataaaataaatggtttttttgcaggacgggttttgcgggacgggtttggcaggacgttacttaataacagttgtaaactataaaataaaaatattttatagatagatacaatttacaaatttttatatatactaactttaaaaaatcatttgtctccgcggtgtaccgcgggttaaaatctagtaccacttaatttcatacttaattttcaatgtgatatattgttatccttaatacataccaacatgtcgtcttccctctcatttcctctcctcaattttgtttatatagatgcgtaatctaaaatagtgtcgaagtgaactttaattattaagatctcttcattcatttgcctttttcttctcatgtttttgctttttatagatgaacaagcccttgcaacccaagcagaacaccgcaaactcaatgagtcacttacttacatatactttcgttattttatttatgttattgttttgttgattttcatggtttaatacatcatgtcatatgtatattatgctggtgttgtagaagagacgataacc

SEQ ID NO: 4999 - DNA, 3000 bp, Unknown
  misc_feature (1)..( 3000): cDNA_ID_1826941_gDNA_ID_1620753_Annot_ID_49844 3000 nt of promoter + ATG
tcgtcgtacgtactatagaaactgattgaaaatgatatcgaggaaacataatttgtcgatcggtgttggaaccttccatgcatgactccaattagagttctggaacttttggtttctcattagtcatgactctgattggacaagttctagtttttaacgactcatgactcttcacatgctccgaaagttcatcaaaacatttatcaaagttttacatgtttttgtgaacaataattatcttataaaaacatcaaaacatttatcaaagttctataagataattattgttcacaaaaacatgtaaaacatcatatcattttgtgggtttatattcaggtttaaagagtgtatatactatatatatatatatatatatatgtcataaaaactatgaaaaaagatccggcgacaaagacgaggaacgcttgtctttaggaaaataacaaaagtgatttgttttgatgatatattttcgtaaattcaaaacagaaagaatacgttatgtaagggagctaaatgagctcttaagatgcttaagaaaatggaattgtgatcgattgcgtacaaaacgtaaattcctatctaccatttctagtggtcggtttagccatagaatggccaatgtgattaagacaattgttgaaaactggtcacatgtatgttacaatttccggtactatgttcaaacagagaaaccagaatggattggttacctacgtatacatacttttaattttaaaagtttagagagcgttagatctaaacagttaatataacttaaacgtaatttggaatgtaacatcaggagtcacaaatgaaatgagtaaatagatagtataattaaataagaagcaagatttatttagtagacttaatagccagatcgattacaataggacataataactcataaatccatataggaatgaagaggtaaacattattaacctcctaaatatcctaaagcagtagccatagcaatggcagcctgagccatcattgaaaaacatgatacgatcaccaagaaacatccccatttcaacattttcacgatatttataaactcagcttaaatatgaaattattacaaaatatctttctggtttttaggtggggctgaaatgcttctagcatgatagatcaatttatagttgaaccatgcataaatgattaaatgatactatcagactcttcaaaattctttctcttctcgtaagttggaaattaataaaggacagtcaaagataaagaataaatgatttggaaattggaacattttgtcatgaaagtgcgtcgaaccaatttaggcttaagctcaaattgtatatgagcttattatagaggcccattcattttgtcaaaaagaaatttttttaaatatattttttacttcctcctctgcaaacatgtaaacgtgggacgagtagtcttacttgccgtgtaaacttaaatattggccatgtttggtccgtatcaatacaagaagtcaagaagaagacgtgttaagaaagaaattgaggaaacaaagcggtcgatgtggaaccttccgtgactccaattagggttctgaaacttttggtctctcatgcatgactccagttatcattagttcaataccaattctagttcttgacgactcaagtcaagatcattcagacggccttttaaaatctctttaacgttcgagacaaagataaaatccttttattttttcatagagaaaattgtaaaagaggataacaaaatagagagaatttgcttttaggaatttccgattgaatatgtagttggtaaagcctagttttatataattatatgtggacggaaaaagattcattatctcgcttatataaaaacataccaattaattatagtctatagtcacaattcatcatatattctagactttaaaagttgattttagaatttctgagaatcgagaggcaacaaaaaaagtctacaaatttgactaagaagaagcaggcacatccgccttgacgaagaaaacggtttggttgggaatgatggagttgaccggtagacaagtttcgtcgaagaaaacaaaaaaaaatagaaacacaaaatcgggtttaattttgcaatttcgcttcagtagaagacttgttgaattcaataacaatttagtttcgttcgacgagtgtaataacgcgttgagcattaataactatcgaggggccattaagcattaaattaccatttaattacgaattttaggggttgtttccttcatcgtagcttatcaaattacacacactcatacgttcacaccttcccatttttccaagaaaaaacttggttcatatttcttctaattcatacgttttgtgatagtattttcaacttttgttttaaagtttttcaacatgtattaccaattcaatttggtaatccaccatcatatatttatatattgctcgaaagatccggtagcagttgagtctgtctgacaaattaaaacactattcacgatttttttctacagttttactttaatcttaaaaaccaatattattacaaataaccaagtcaaagataaggtcaaccccaccagacaaaacttagttcacggcacaacaagactaagcactgaagtctttgagaggaagattttgaaaatctcgtgcaaagactaaaacatccttctttactatatatatctttcgctccactacgaaggttattttcgtaattcgacacaattccttacagagaataagcgaacagatcaacaactactctgctcttacaggcgacgacgtcaacaacaacccaaaataccaaaaaccctcaaaagtctcaaacaaaactcaaaacccaacaattaaagaaacaacatttcaatatacagatttacttccttttacagattttcctaaaaaaccgaaattgaaacaaacaaaaccaaaagacgttaccttttttccattgattcctcaattctctaaacaaatgagttaatcttccatggctgccatgttg

SEQ ID NO: 5000 - DNA, 3000 bp, Unknown
  misc_feature (1)..( 3000): cDNA_ID_1826937_gDNA_ID_1620753_Annot_ID_49845 3000 nt of promoter + ATG
tttcataaccaatctttcttcttcttcttcttcttcttcttcctctttccttatctctccatctctgtggagagacacaaaacttccaaaaaggaacattctttcagttctttacttaatctttcacaatgctaaatcattagccgttgataaagtcttaatctttgattcattcaaacgcgtttttgtttagtaatgtcgtcgcgtttttctttgacggtggtgtgtttgattgctctgttaccgtttgttgttggtatacggttgattccggcgaggatcacgagtgtcggtgatggcggcggcggaggaggtaataatgggtttagtaaacttggtccgtttatggaagctccggagtatagaaacggcaaggagtgtgtatcttcatcagtgaacagagagaacttcgtgtcgtcttcttctagttctaatgatccttcgcttgttcacatcgctatgactttggactcagagtatctccgtggatcaatcgcagccgttcattctgttcttcgccacgcgtcttgtccagagaacgtcttcttccatttcatcgctgctgagtttgactctgcgagtcctcgtgttctgagtcaactcgtgaggtcgacttttccttcgttgaactttaaagtctacatttttagggaagatacggtgatcaatctcatatcttcttcgattagactagctttggagaatccgttgaactatgctcggaactatctcggagatattcttgatcgaagtgttgaacgagtcatttatcttgactcggatgttataactgtggatgatatcacaaagctttggaacacggttttgaccgggtcacgagtcatcggagctccggagtattgtcacgcgaacttcactcagtatttcacttccgggttctggtcagacccggctttaccgggtctaatctcgggtcaaaagccttgctatttcaacacaggagtgatggtgatggatcttgttagatggagagaagggaattacagagagaagttagagcaatggatgcaattgcagaagaagatgagaatctacgatcttggatcattaccaccgtttcttttggtgtttgcgggtaatgttgaagctattgatcatagatggaaccaacatggtttaggaggagacaatatacgaggaagttgtcggtcattgcatcctggtcctgtgagcttgttgcattggagtggtaaaggtaagccatgggttagacttgatgagaagaggccttgtccgttggatcatctttgggagccatatgatttgtataagcataagattgagagagctaaagatcagtctctgcttgggtttgcttctctgtcggagttgactgatgattcaagcttcttgtgagagttttaaagttacattctttttcaatatcttctgttgtattacagatgaaatatcattgttcaggtgagtgattctttgattttctgttgtacaaatctattttagagagggaagatatatattaggctgtggaaaagccattgatgatcctttttgttgagaattcttttgtcattctggcgctcttgtgtttcaatcttttcttcttaataaaactcatcttgaagtgccaatttgatagtgtttaatctagtacatactctgttttctcattttgaattaatccgtagaaatattcacaacgaactctatcaatctctatcagagcctaagtcatgttcttttgagatacttttcattcagaccattcaagtagtctagaatgtgtacatgtcttaaaaatggctaaaaagattatgatcaatgtgacaaggtttgtgatgacattgatggcttttgactcattgggaatctaagctttggtattggagaagcaattatagttgttcatttatctcttccaagttccaagtcttctcgcaatgttattaaacctggtcaagaaagatcataaatgttttggttacaaaacagttacatgacaaaacaccgtcatttgaaaactactaatgggctgtattaaagcccatttacgtttttgttatggctaatcaaaaatcgggtcagattcaaagaccattggttcataactatttttcgtgtgtagttgagtttcaccgctgagaagaagaatctatggggaccctgacatccacacaggtgtcctgagaagaggaggcataacatttattacaccaattttatatttactaaaattagtgttttctaatcaaatattttactcataaagaagctcgtgaagtagtacttaacagtgttatttgtctcttgatctctctctttgattgcttcgaagttatcacttgcatattactactagactactaaatggtcccaccgactcttgtcttcatttccgatctgagtcggatctaatctcttcttcttcctcttgcttttgtgttcatctctctctctctcacccttgttaaatctgcatttaagagtctttcttcagctgagtgaaccaaaactatttaataattgttattcttttgacaagtcttctcttttttgttcaaagtcttcaacttttttttactatagagaactttttctctgtgtgtccactagaagcagcaactacaagagcttgaaaaaggtggatcatcattgggaatttaacaacaattttggtttgtgggttatcttcacttttctggtaaggtttggatcattatttcacttttctcttagattctctctctccttctaagtgaagtttggtacttttcaatcattgatggaagatttggtctttctttttgtttcttcaattatttgaaagcttcttcattttttaagtacacactactgtctacaagaatctgagtttgctcactaagagggtttagagaattacaaaaaggagaaagtgaaagtagctactagatctttcttcaagatattaatggctatggtttgattcaaatttacttgattttgtgtgaattaaggttcttgtgctgagcattaatg

SEQ ID NO: 5001 - DNA, 3000 bp, Unknown
  misc_feature (1)..( 3000): cDNA_ID_1808026_gDNA_ID_1620753_Annot_ID_49847 3000 nt of promoter + ATG
agttacgtctgatgaaaagcctgaaagcaagcaagctgtttctattgagcgtgcacacgattcaactgctctcgctgtggatggattattagatcaaagtaatggaggaagcagtatagtacacatgaccggtaacacctcaaaatcttgcttagaagttagttctcttggaatttttcattttctttgtacagttaatgaatagtttcctctttacttggtcaggacattgcaataataatctgaagcctgtgacctgtggaacagagttggagttgaaaatgaatgatggtaatgggccaaaattagaggtatagtttcagtgaagcacgttttagtcccatcatcttatattttgatctgatactttctatatagatgactcatttcaaatgaaggaccgaattttgttgatatggaacaatatctcccattgtttgcacttggtgcttaggtccttcatatggaacttagatagttttaaaatttgaagttacacacccttagttctgtgttaaccaagaggtggtactgataaactttgtctcacaggttggtaacaagaagttattgacaaatgggatcgcggtagaaataacaagtgaccaagagatggcaggaacatccaaagttgaaagagaagaaggtgaactttctccaaatggagactttgaggaagataattttgcagtttatgcaaaaactgattttgagaccttcagcaaagcgaatgatagtactggaaataacattagcggagatagaagtagagaaggggaaccatcttgtctggagacaagggctgagaatgacgctgaaggtgacgaaaacgccgcaagatcatcagaggacagcagaaatgaatatgagaacggtgatgtttctggaacggaatctggtggtggtgaagatccggaggatgatttggataacaataacaaaggagaaagcgaaggtgaggctgaatgtatggctgatgcacatgatgctgaagaaaatgggtctgccttacccgtttcagcacgattcttgctgcatgtaaagcccttagtaaagtatgttccttcagctatagctttgcatgacaaggacaaagactctctgaagaactcccaagttttctatggaaatgattcgttttacgtgcttttcaggctgcaccgggtaagagctaaagatcatatacagtttgaaaaaattataaacagtataatctaaagtacaaagagttttcactagctaactttacgctattactcttgacagatattgtatgagagaatactatcagcaaaagttaactcatcatccccggaaggaaagtggaggacctcaaataccaaaaatcctactgattcctatgctaggtgaaatttgctttttattgcagagattgtgtgtgtttctgggattcatatgtgctccatacttataactttaattaatgtggaacagattcatgactgcactctacaacttacttgatggtacatctgataatgccaagtttgaagatgactgccgagcgataatcgggactcagtcttatattctcttcacattggacaaactgatccataaattcatcaagcatgtgagtatttttgctctttgatgttttctctatgtattcacctctctatctttacttgctttttactaacatacgtgtggtcattcttcagctacaagtagtagtagctgatgagatggacaacaagcttcttcagctttatttttatgagaaatccagaaggcctgaaacgatttttgatgctgtgtattacgataatacccgtgtcctcctccctgatgagaatatttaccgtattgaatgtgtaagtttttgctgcatcttacattagctacttatattctgtcgatgcactgctgatcatgcttttggactccaaaacctcatgtgtatgcagagattatcaaccccagcgaaactctctattcagcttatgtgcaacggtcttgataagcccgatgtgacatctgtatccattgacccgacctttgcagcttatctccacaatgacttcctctccatacaaccaaatgcaagggaggatcgcagaatctatttaaataggtaaatgtaaaacatgaacaaatgactgtcccttgatctctgaaacctagtgggtcactcatcaaagccaatgccatttttcgttttctccaggaacaagcgcaaagtttgtcgtgaagatgaacagttatacagcacagatgaagttaagatcaaaaatggtttggagtgtaagatagcttgcggttcttcaaaggtaacacttttatcttcttccctatatcacgcttaccgcttatgagtatatccatgagagaccagcacttgaaagcacgttcttgaaaatctcttgcaggtctcctatgtactagaaacagaagatttgttggtgcgagttaaaaagagaagaaaaactttgtgccacaatcaggattcttgggtaaggcaaatgaggttacaatattacaaaaataacttcttgtgaccagcctgtaacaatctggaagaaggataccaaatcaactcaacttgttcattcactctccaacttaacagagacaaaacaaaaacaaaagtggcaattctccattgttgacttcaccggatagagccaaactgcattctctatcttcataagaagaagaagcaacaaaggatttggctttttgttgtctgtgactgaaaaagaaaacaatcactcacaaaaatgatgttacatatgtaaagtttgtctttattcactctcttgttgtaaagttttgtatgttgttgtaacatttatcaaaaatttcattttgttatggtatgttatatagaaatgagtcaaatgaccataaaaggtttgaccttttccataaacgacgcttcgccctctcctaactctttccctcactttaaaaagattcgatttttgactgcaaaaaagagaatttctaaaagcaaatcggagagcttcggcgatg

SEQ ID NO: 5002 - DNA, 3000 bp, Unknown
  misc_feature (1)..( 3000): cDNA_ID_1826929_gDNA_ID_1620753_Annot_ID_49848 3000 nt of promoter + ATG
atcttcgttacgtccactacaagttttattttctttgttcattgcctttgtagttgctagatctgttgcttgttgtaatttgtattcgtgggatgatatcgagttccttgaatatatttttcgtaatatgtgataagatatcaaatccgactgatgaagtttaatcaacttgaagtctcaaaactagatatgagttttgttttgtccccaataaaaagtgttaatctaatcccgtcagacttaatactatggcaatctctgaattggggtatctttggttaagaatgagagtaggacatatctaaatccaatacttgactggtttgccctgtgtttgaattgactacttcacatgtgtaggttacgtgtgataactaataatggatcaccttgaggaatgaattgttttgttgttaagactttggggttgttcaaggatccaatattttttgaagaaaccttgcaccatcttttgattctaataatgtttcacctttttttttggctgcctctctttgaacaataaagctttcctaaacttcaaaccatggttggagaaggaggcgcacacaagcctactacaaatgacgcgcttaaataccttagagccgtgaaggctaaatttcaaggtcaacgtgaaaaatatgacgagtttcttcagatcatgatagattataaaactcagaggttaaagttctttctacttttatgtttgcatttggtcttggtttaggtaaaactccatggtttctgagaactgattaccgactattgtgttgtatagaattgatatatctggtgttataataaggatgaaagaactcttgaaagaacaacaaggattacttttgggtttcaatgccttcttaccaaatggttatatgatcacacatcatgaacaaccttcacagaagaaacctgtcgagttaggggaagcaattagttttattaacaagattaaggtatatatgtttatgtgttataaactgtccaaggaaattactgcttttccctttcctactctcttagttattcattcatttgcagacaaggtttcagggcgatgatcgtgtatacaaatcagttttagacattttaaacatgtacagaaaggataggaagcccatcaccgcggtctaccgggaggtaggctcattgattcatactaagtttttttttttttattgctaatattttacttagtttcacacgtttatcttatcaggttgccatcctatttctagatcataacaatttgcttgtggagtttactcactttctgcctgctactccagctactccagcaacagccttgttgcattcacagttttgcatagatcatcctgatttgcttgaagagttggattgctttctgccaactatttctcagagttttttgtgacgaaaggattgctatgttacttcaatcgcttcacatataagtagttttttttttttaaagttacaagtcagagataatagtagaggttttttctttttaatatgcatgattaatagctttcttttccctataaattatagccactatcaaaattcaaaattaccatcatctatagttattcaatgcttttttttttacctagttatttcaatgcttacctatgagtttactatgtgtaacatgaggataagggttatcggaattattctacgaacaaggtgacaaagttttcggtctaccggaaagatagtaatgccgataaaaaaaaaatgaatttaaaaggcgaataatatgttccgtttttatggttttaatcaagttagagttaaattattcttctattaatgttagccaaatattattttttagatttaagcaaaatctaaccgtgtaatgtaatatagattccatttacatcaatgattttagaacattttttccccattaataattttgataggttttgcattaagtaattaacttagaaattttaagaaaaaacatctatgttgaccaaaataaagagaaaaaaaacatctattaataatatgattaatcatctaaaactttttaattacaaaattatttccaaaaaaaatgaataatttattttatatcaaaaattttcaaaattaagtatgtctctctcacataccaaaggagataaaaacttccaaaagaaaaaaaatgttaaaaataataaaagaagaagataaattataagtctcctaaaatgatacaaccaacaaaaggaagtaataaaaacaagaaaatacaactttgatttttattttattttttgtcaacagaaaaatgaaataagtaagtaaacgaaaaatttagcgaacgagaaagtgtattaaatatgtagattttaatttacttaagaagacgtaaaactcctttgagagaaatctcaatcctttcttcataaaaacataaaactctcgtttgctcagtgagtcttttctttctgtctgaaaattgttgaatagtttttgtcttctcagctgtttcgtcggaggaagcttcttcttctagacttcttcttcttcttcttcttcgtcttctctgaatttcttcggtaaactctctaacacataaacgatgatgatcttctttcgttttttatcctttctgtttgatttttgggtattacaattttaatcgtgaactgaatgtgaaataatctgaggattaagttaagatcgattttttctggtccgtctccttttgttttttcttcataaattgtttctgtagctgctagatctacaggtgttgcttattgggatgaaattcaagttcggttctttgaattttccttgtttatgtgattgattttgagttttactaggttttgatttgtagatgaacatgaagaaagttgttttcagcttttgttcttttgctgaatcccaaattttacttgaattctctaaagaaacgttctttggtcttatgagatgttgaatagctttctaaatgatctgttttttttaatggtaatgaagctctgttcaacttcaaacaccatg

SEQ ID NO: 5003 - DNA, 3000 bp, Unknown
  misc_feature (1)..( 3000): cDNA_ID_1826925_gDNA_ID_1620753_Annot_ID_49849 3000 nt of promoter + ATG
atctctttagtctaaacattaatctctattttcgattagatcatccctatactaaaattagcatttcacattttttactttttttacttttctcaattaaaaagttttaattaattaattaaaaaaaagaagaagatttgcctttttccttttttaaaccgtacttttgatgtaatccttaattatataatccaacgttaagtgtcggaaactaaaccctagagaaatctcttcttctagttctagtctcctgcttcttcgagatcgtgtgtcgtaactcgtaagctagggaagccctttttgtcttcgaatttcggtaactatacgatgatcttcttctcttattgtcattgaatgattttgtagtttctgggatgatttcgaattgggttcttcgaatttaatttcgtacctgtgtgatcaattttacctgaatttcatcaaatccgatttaaaccctcaaattagcgaattaacttcttattgtttttgttaagactgagattttaagacttctaagtgtttggttggtttgctctgtgttgatattggccactttacacaagttctcacgttggttctgatgggaatgaattagttgttgttgattttggttttgacaattatttggattttgagaaatttagcttattgcagctttatgtcttgttcaatttcagtgttgaggcaaatcatagatttaagtaatgttattaagatttctgcactctaggttctgtttcttcaagtggtaataatagcttctaggttaaattcaatgatgtgatctgttttactgaacaaaaatcttctctttcttttgataacaaaaggctagattcaaaccatggttggaagacgagtatcacctgctctaactaaggatgatgcgcattcatacatcattgctgtgaaggaaacatttcatgatgaacctacgaaatatcaagagtttatcaagctcttgaatggtgtttgtgatcataggtatgtattcttttcttccctgttatatttggtttggtctttactttcaactgtgaattgattctgatgttactagtctctttttgcagagtcgataaatatagtgtcattgcaagggtggaggaactgatgaaagatcatcaggatcttcttcttggtttcagtgtcttccttccacctgtttctgtagaggattttataaacaagctcaaggtaaacacatgctaaaatgacaaataatccttggagagaaacaccaaaatccttttttgattcctcttttactaactagagcaaatttgtccatctgcagacacggtttcagagccttgatactcatgtagtgggggcaattcgcgggttaatgaagatgtttaaagagggaaagatgtcggtaaaggaggtgcaagaggaggtaatgtttgttcttggtgggctattttgtgtacttgtgttttttttttttttttttggttctctttgtttgatttggttagaaataatattatcttgcaggtcattgatgttctcttctatcatgaagatttgattgaagactttctcagatttttcacaaagaaccctgtatcaacagcatcactactactacaattataacgagtgatgtattttttatgaatgagaatggagtgtatagtttcttttgtagaggttttaaatctttgcttttcaccatgaagaggatgagatttgaatttgatatactcagatgattgaaactcaaagtgtcacaaaactcaaaaatacttctcataaccttattttgtttatgttgaattttactgatgaaaaacctatgaaagatcaaacatttttttaaaactcatttcttagttttgttatgtacttaattaatggttgttaaaaaaagggttttgtgtaaaaaaacacttcgaactcatccatttttacaattttatccttcacctccaacatattgagattaatcctatgaagtctaaaataatacgcattgtaacccttctttgtttttttctttactattaattttgtaaaatattgacatgtaatatattaaatctaaaccctcacgatgaagagttcaactctgccttcaaaattttaaaattctaatgtatatcatcgtaaaaacgtttacaatatacgtataaatgtcatattgcgtattattttaaactttataagattaatctgcatatattggaggtggagggtaaagttacaaaaatggatgatttaacccttttaaaaaaagtacataattaattaaaatacaccaaataataaaaaaaaatcattaaaataaatagaaaatcttacataaccttggaatcataatacataaacaaaaccctaccgagactagaaactcgtctcccctgcttcgtgctcgtgatcgtgaagccttcttcattcgtctttggtacctatacacatgtgttcttcttcttttttgtgtgatcttcgttacgtccactacaagttttattttctttgttcattgcctttgtagttgctagatctgttgcttgttgtaatttgtattcgtgggatgatatcgagttccttgaatatatttttcgtaatatgtgataagatatcaaatccgactgatgaagtttaatcaacttgaagtctcaaaactagatatgagttttgttttgtccccaataaaaagtgttaatctaatcccgtcagacttaatactatggcaatctctgaattggggtatctttggttaagaatgagagtaggacatatctaaatccaatacttgactggtttgccctgtgtttgaattgactacttcacatgtgtaggttacgtgtgataactaataatggatcaccttgaggaatgaattgttttgttgttaagactttggggttgttcaaggatccaatattttttgaagaaaccttgcaccatcttttgattctaataatgtttcacctttttttttggctgcctctctttgaacaataaagctttcctaaacttcaaaccatg

SEQ ID NO: 5004 - DNA, 3000 bp, Unknown
  misc_feature (1)..( 3000): cDNA_ID_1826910_gDNA_ID_1620753_Annot_ID_49854 3000 nt of promoter + ATG
gtagcccaaagggaaactagttgtggtaagagcttgtttgactcaaaaaatggctaactaggatgatgctgaattaccatctgttcatgtttttgactagagagatgggtagtgaaattttcaaagcctttgcaaaacgcctgtgggacctgtttcagaaaaagacttaaaagacttgagactcaaggaaaataatatccattatataaagatgacaacaaatattaacggaagtaggagtgattgagaacgattctagtagaagagacggctcgcaggacgtcgtttataataggccaatggcagagatagtgagaggaccggagtagcctaaattctttaaatgtcgtttgatacacggaccaactagacgagcatcatactcagagggaaccggacacgtcttgatatcccagaagaccgatgttacggccttagcttgctgccgcgttgccttcatcatcatcttctccttttaatctataacggaaatcaaacatcagataaagcattcgaaaagatagattgacacaggttaaatcatccacttcagagaaaaagagagggacatggccgtaaacaatgagataaggatcggcctaatgtttataatgggcttgcgtttaatgggcctacagtttcttgaatcagccttatgcatgagtcctagtattttatcaacttttttttttcatctttctttagttacaatagatttaaagtgttttttgttaatgccattgcaaaatttggtaactgtttataacattgttcctcacttcaaaatttaaagcaccattaataaaagctatacatataattataacttgggttttgtgcaaaaaaaacaaacaaattaacctttcattttaaataaatgcaattcaataccgcaatatcaaaagtaacccgtataacctttattcgtgtatagattttagaaacagtataagtcaaattatcaaaactatgttgttttaagcattttaaaaataagaataataataatgttgaagggtggatttgaacccatgaactatagaacaaaccaaagcatgcataaccacatgcgccgaacaaaccaaaaactcatggctttgttaaacatataaaaatattcgaataaaaaatgtggggaacttgttaccagttttggttctttttggagccatttttttcaacacagatattgttaaggagtttcaggtaaaactgtatattatgcagggaaccacagtaggctataatgaaagtcacactgtgaagttagcagacaagtttttacttaaagatgtgagttgtgatctttttgatgtaagtcttgatgtatatgttgacaaattatataagtttgtattgcatattctatgacttacgaagtttctatgcaagaaaagccgggagaaaatttccgtcaagtaactaagagatcgtaattcttgtctgaagaacaacccttttttattatttgagtttaggttgccaacagtgaacaaagggacgagataccatatgacaaatatcctctaacgccatttcaacagttaatcaacagtgtcggctatatgcatgtgctaacaatgcacaagaacattgtcaccatcccgtgaatatgaatattaatgattatgaacgagtttgtagagttccaagaggaaggtactaccttctcatactcattgatcatatattttgtttcttgtttgttttagtaactagggttattcggattgtttttcaaaataatagtaatatgtcaactatatttataaaaaaaaaaactaaataacttttgtacaattgatcattttttaaatatatcataaagattcatcaatatatgaacatatatttttaacaattacactaattggctatatagtgtatagttccttttgtggagaggtttaagttcagttcagagattattgtacttggtaaaatatttgtccttgttaattagttcatcttctagaatacagatttgggccatgtagtttcccagaaaacaccggaaaaaaaattcacacttcacaccagaaacaataaacgaggaacagagcccaaactcatccctataattgggcccaaaaaaagcagagcaaaccaaaccaaaatcaagtaaatccatttacaaatatgctttataattattatttttctcaaccacaaatatgctttataatttatgtaaatgttatatgaattatttacgatttattttaattactttatcttggaattatcttacgaagttaatgaaaatattttaaatatctaatttatatatgtctggactaaaataaatagaaatatctgtattccaatcatcacaaaaaaaaaattctcatcatctttgatatatagaaagtttttaaaatttcagtttcacagattttaccaattatagttttataagcttatgctaattatgtgatcaatgcaaacaaaagttgacaataataaaatgaagtcaaatatgatagattcctactataaatatagactcgtgaataatactcgaatcagtctctgaggttttgctggaaaagaaaaaccgaagagctcaaaacagagtgcgtttgtttctgggaatcttcaagcctctcacttgcgaagacgaagcttactcgtaaggtgattatcttcttcttcttcttcttttcaattcctttttcgttcatctgaaatgtgaaatcatgtgacgtgacgattaggttaacgatcgaatttcttaatttcgtatatgattatcttctagtttcttgatcagcacatcttgttgttttctttcaatcgagactgattctagatgttcttaaggatcttgttcgatgaactttgcatgaatcatccatatcgacgaactggtctgatcttcttgttgttatggattaagtttcttgagatacaagaaaggcttcaatgatcaatctgatctgttttgatgaacacaaatctttatctttgaaccatggataaggtcaatttcacaccatg

SEQ ID NO: 5005 - DNA, 3000 bp, Unknown
  misc_feature (1)..( 3000): cDNA_ID_1826890_gDNA_ID_1620753_Annot_ID_49860 3000 nt of promoter + ATG
tagcataaacgtatttgttaacaatatttttaaacaaagttttttgtttaaataaatattattcttactaaatgttttttgtttaaataaataaatcttgtatttgaacttatttacaatgtcatgctactggcattaattatttaggaatgaaaatatttaattaaagatttaaattttctaaatccttacttttagagttattatgtcattacctaaaaaccaaaaaatattaattttttaaatattattatttatatatttaaacttataaattttttaatatatcacaatttttaacatcattatataatatatagagttttaaaaaatctcaaaaaaaattccgtcatattttgtgattcgacttttaaaaaatgaacatatattaaccaattggcgaaaaataacgtcccgcatcgactaaaatacatagacaataattcataaacatatcataaataagatcaatattaataaaataaatggtttttttttacgggacagacttagcggggcgagtttggcaggacgttacttaataacaattgtaaactataaaataaaaatattttatagataaatacaatttgcaaatttttatatataataactttaaaaaataaattgtctccgcggtgtaccgcaggttaaaatctaattgatcttatttttggttgataataatcattcaaaacaacaaaaactaaatttgttatctatcttaccttaaaacatcaactactataatgttctaaactctaagttaggaaataagtagaaattatcccacacattctatactatacaaaaaataaaataaaataagagagaataacataacaaatatctatttcaactctaatctttaatagaatcgaattgttccacacataacattcaaattaaaatactaaatctttgagaggatcgatttgttcaactcaaatataccacttcatcatgttaaaccccagattcttaagtcatttttaaatgtagaaaattattaaccaaactatacgtacattaatatattattaattttttaccgtagaatatgtgaaaatatatattttaatatattttaaacttagttaattcccaaggtaatatcatctatatatacaaataaataaaatctaaatattattttaaattacttcctaatcctagtatgaattatcctagactttgattgtcatggagtctcgatttgcgggattaatgtgatgtgaaaatagatgtacaatggcccatgaactcgtttggcttcggaagcgatattgtaggacataatgttgcataagttgggatattggagctctgcatagagaagtatatatgttgcatacatcaaagccaacgatgttgttcaaaagaaggtgaggggtgtggaacggatgaggagtgcttgatactacaatgaccttgtttctacgcgttagatctccattgtgttagatgtagatttacgtgtaacgctttcatcaatacgcacgagttctttaatctcactcattctttggaattagtgaagaatattcaaaaatgaaggatgagagtgtgtcgaggatactcgatatattataaatatattaaaaccaaaactatatattatttatcaatatatattatcaataatttattatttggttttcaatatttattgagctaagaattttagaagatttgatgaaagttagatttggagagatttgagggactttttaatatatatttggattgatttgttagattttataatttttgaaaaaatattgattagtgatttggtggatttacatggtaaccataattgaggaaaagaagcgtgactagataaggacatgcgttatacaatggttaatcgataattgtttattttatagaaatgttagtaagtttttttttgccattgtacaaatatcatattaaattttaaatgatcaactataaattttataatatattcgggttttaatccccaaaattttactttacagattgtataaaatttaaaataatagaattaagaaaacataattttgaagtaatatatgatttaacatatgagttgtttatacataaacaaaatgttcgttatccaacttttttctaacttaatcaacgattagtcgaaatagacttttaattagatctaaatatcatctcaatttatccactctatcactatctttaaaataaaaaaaatgataggcattttctaaaacatgtattatagtctaataaattaattgaaaataacgcggttttatgaattacagttttgtaatatgccaatctctgttaagaatattcaacttatataataaaattaataaattttattttttcgggtaaaaatattattacctttttaatgtattaacaaaaataatacgaataaatttaacgttaatagtttaatatattgatattgttatatccttaattttaaccttttttaaagatagaatttttttttttttttacttatgtctatatatttgtttccccgataaagttaagagattttttaatttatttttaaatatattaaaaagattttaaatacctacaatctgtatgaatatatcctaacaaaatatataacatgagatataaatgatactataattgtttatatttttaattcatcatatttaatcttgaagatacatatcagaggtttcaacaataaaacttaaaatacaaaacaataaaataacagtgataatttttttttttttggcgaagtcctccttagcctttcctttgtcgcccattcactcactaattcatctctctctctcgatctcaacgcgaaagcttttcttctccaaaggcaaaaatcgaaaacctgcaaaaagtttctccgccaaatctctccaaaaccctttctcctatctactttttgcttcttcttctactgcggtcgctcgttcgtctccttcttcatacgtaatctcgaagtcccgttgtttcaatcctgccatg

SEQ ID NO: 5006 - DNA, 3000 bp, Unknown
  misc_feature (1)..( 3000): cDNA_ID_1808987_gDNA_ID_1620753_Annot_ID_49861 3000 nt of promoter + ATG
aaatgcctatcattttttttattttaaagatagtgatagagtggataaattgagatgatatttagatctaattaaaagtctatttcgactaatcgttgattaagttagaaaaaagttggataacgaacattttgtttatgtataaacaactcatatgttaaatcatatattacttcaaaattatgttttcttaattctattattttaaattttatacaatctgtaaagtaaaattttggggattaaaacccgaatatattataaaatttatagttgatcatttaaaatttaatatgatatttgtacaatggcaaaaaaaaacttactaacatttctataaaataaacaattatcgattaaccattgtataacgcatgtccttatctagtcacgcttcttttcctcaattatggttaccatgtaaatccaccaaatcactaatcaatattttttcaaaaattataaaatctaacaaatcaatccaaatatatattaaaaagtccctcaaatctctccaaatctaactttcatcaaatcttctaaaattcttagctcaataaatattgaaaaccaaataataaattattgataatatatattgataaataatatatagttttggttttaatatatttataatatatcgagtatcctcgacacactctcatccttcatttttgaatattcttcactaattccaaagaatgagtgagattaaagaactcgtgcgtattgatgaaagcgttacacgtaaatctacatctaacacaatggagatctaacgcgtagaaacaaggtcattgtagtatcaagcactcctcatccgttccacacccctcaccttcttttgaacaacatcgttggctttgatgtatgcaacatatatacttctctatgcagagctccaatatcccaacttatgcaacattatgtcctacaatatcgcttccgaagccaaacgagttcatgggccattgtacatctattttcacatcacattaatcccgcaaatcgagactccatgacaatcaaagtctaggataattcatactaggattaggaagtaatttaaaataatatttagattttatttatttgtatatatagatgatattaccttgggaattaactaagtttaaaatatattaaaatatatattttcacatattctacggtaaaaaattaataatatattaatgtacgtatagtttggttaataattttctacatttaaaaatgacttaagaatctggggtttaacatgatgaagtggtatatttgagttgaacaaatcgatcctctcaaagatttagtattttaatttgaatgttatgtgtggaacaattcgattctattaaagattagagttgaaatagatatttgttatgttattctctcttattttattttattttttgtatagtatagaatgtgtgggataatttctacttatttcctaacttagagtttagaacattatagtagttgatgttttaaggtaagatagataacaaatttagtttttgttgttttgaatgattattatcaaccaaaaataagatcaattagattttaacctgcggtacaccgcggagacaatttattttttaaagttattatatataaaaatttgcaaattgtatttatctataaaatatttttattttatagtttacaattgttattaagtaacgtcctgccaaactcgccccgctaagtctgtcccgtaaaaaaaaaccatttattttattaatattgatcttatttatgatatgtttatgaattattgtctatgtattttagtcgatgcgggacgttatttttcgccaattggttaatatatgttcattttttaaaagtcgaatcacaaaatatgacggaattttttttgagattttttaaaactctatatattatataatgatgttaaaaattgtgatatattaaaaaatttataagtttaaatatataaataataatatttaaaaaattaatattttttggtttttaggtaatgacataataactctaaaagtaaggatttagaaaatttaaatctttaattaaatattttcattcctaaataattaatgccagtagcatgacattgtaaataagttcaaatacaagatttatttatttaaacaaaaaacatttagtaagaataatatttatttaaacaaaaaactttgtttaaaaatattgttaacaaatacgtttatgctaattttaagggattgatgtgaagtttgtttagattaaatttaattaataatgtgattgacaatttaaatcacgaatttaaagtaaaattaattatttgggaatttttttttaatgctaatgacattgggttgtaaatcagttcaagtataggatttatttgctaaaatagctgcaaaaatgtatatgtagatatataataagtgtgtattagttgaagatttaattcttattatttcgtaatagtaaatggtgaattaagtgcagaatcgtccgaatttagtccgatatacaacatacctcacaccattcaaagcctaagtaagtaatttattctagtttttccatcatacatggactaggggacatagtctaaaatttcaaaaactaaaataagtttgttacttgattttctcaatatattcggcaaaatcaaaagatatgataattgaattgcgactatatttcatggaattcatatttcgtaaataaataaaacttataaaacgaaaaaaagttaaattaaattcaccaagatacatcaacataataatttgtgttactcttttgatttaatcttaataaagttagttgatgaaagtatttgaccaataagcgaaagatgaacaaaaccctaaacaatagatgactcacggaaaccaacgccgagaattccgtcgaacacttgagctgcgttttaaagttctccaaatggcgccttttgcctactaaaaaacctttaccttcttcacagagatctaacctctccttttccca

SEQ ID NO: 5007 - DNA, 3000 bp, Unknown
  misc_feature (1)..( 3000): cDNA_ID_1826886_gDNA_ID_1620753_Annot_ID_49862 3000 nt of promoter + ATG
aggaatttgattggtaacaaagacaggaaggatgtgataataactaacctgttattgttgactgctaagttaaatagagccatagctccggtttcctgtgcggctgcattgttatcatgaacagctgattctagaaactgcaaaaacgcttccacgaacccattggctcccatgaggatcctggcctcttcattatcctttagcaatatcctgacattttctactactttgcactttttagctaagtcctcctctttgtccacgattgccaatatatcctgatacccctctagaacattgatttcagaatccacctcatcaggagcattgtttttttctttttgttgtcgttcagattcaatagtactactctcctccaaaggaacgactctgatatccttcggtgtgcacaatcctacactatcaactgactttgaattgggggattcagagtcagacatggctaatctccagtaattgaggtcaagagattctggtggtccagtagggactgtgattccattctgttcacaccagctcgcaatcaaacctttaacacagtaattgggagtcagggaaagatgtgggagttgctgctgagtcttgggacaagagttatgtccatcactaaaccatttctcaatacagacccgttcataagtctgtccagaagcaatgatgacaggatcatacataagctgcaaagatatgggacacctaagttcttctggtggaataggcatctgtcctgatttcctactgttcataggcttatagttaatagaaccaaacttggatagttgtcgcccaaacgcattaacacgatcttcgttaggaccttgaccagtaggggaacacggtgttgaacaaggagagtcattctcatccatcatctcacttctaaatagcttggagtattttctcatgagatgcaacagataagccacaattgactccttccgcttgtcttcttccacacgtgccctgtcaatgactttctttaaagcacgccgctccgccagagctgatctagaagaagttatactgagtctagtagctgcctggtgaaaaatttcaagttcggtactgtcactgccgttgtcaaatttcttcccttgttgtaatagtgcaattatcctatcaccaacttccttctctgatggatcaagtaggaacttggtgtgctctagttcaccaacaatgtccaaaatctgaagaagtcaaataacattagcataaaccattttatcaactagaattctaaaatcaataaacaaaaaaagccaatatctagcacataagccctggacacttattaacttgcaaaaggaaagattttgtgtgcactgatatatacattacctgagacccaattgaactaggaacaatgtcctccacacgtctaagactatcgataagtgcagattttgctttctcaaattttaacagtacagcatccccagtaatggcctgctcaacatataaaagtggaggaattcaagagagagaccaaacacacaaaagagaataatgtatccaaagaaagaaagagcaactaaccaaataaagtttgctacactcagaacagtgttgaagaatgttctttgccttctcaagtgcaatatgtaacgaacacaaggtttgaatccctgatttactccgaggtcttgcttcttccaacgaagggaagatggacaataccttgcaataaactgcagatagttccttgcacatatctccatgtaactgcattttacccagcacacaacttttagcaaagaatagagaacaccatcaaattgaaagagttacatcatagaacaagaatggaaataatactaatgccgctaagattcccatatactctctcaacacaagatttgctaacaattaacagggaaagggatcaaaggggcaagtctgaattcaggagaatcaaaactctataacatcaaaaaatagaagcaatccaaaaccaaaacacaaaaaaggagataacaataacatactaagcatatcccttgttcattagattccaacaactaccgacaagaatcttagagatagagatggttaaaacatatccatttatgagaatataaccttggcatcgctagcagcgaacaaattctcctcgagctcgctaacatccatgatcttaactcaatctggagactctaattagctagccacagctttatacaaacctgaagacatgaaacagagatgaatcagtgacgacagaagaaccacgaattaatgatatatccgacgcaaagtcttctcctttctcatttccaaattaacgaatcattgtcgtggtgaaaacaagaaaaccaaatttgatcattggaaacaaaaaccaaagagaaatcgattaccttgttccaagaaagagtttttattattatcccagaaaaataaaaataaaaagagaagagaaaatacgaaaaacggaagaaatggagcataacggaaggaagagagacgaataaaatggggatgatgatgagaaagagaagaactgtgtcagctccacaaaactcgcaaaaatctacgattagtaattgaaacacgaaccagacacgagttctcgatacgacaagaaaaaacaaaaacaaaaagagctggaataagaaaattaacgcacgtgtggaaaagtggcaacaacaataccaaaaaaaatggattaccgaaaataattttggtgaaagaacgtaccgggaccagccacaaagagaaaggcttcatgataagatacgagagagatgtcgaaaattgtgtagtagacaaatactataaaatggttatagctaatttctgtattataaaaagacttggcaacaacaataagtatttaaaaaggacaatcagttgctatcacgatctacatttggtcaaatagctcaaaagtccacctactatagctttagcttgttatttctcagcttcaacgatcattttacagagcacaacatttctcaaatctatactcagatg

SEQ ID NO: 5008 - DNA, 3000 bp, Unknown
  misc_feature (1)..( 3000): cDNA_ID_1826878_gDNA_ID_1620753_Annot_ID_49864 3000 nt of promoter + ATG
tgctgggtaaaatgcagttacatggagatatgtgcaaggaactatctgcagtttattgcaaggtattgtccatcttcccttcgttggaagaagcaagacctcggagtaaatcagggattcaaaccttgtgttcgttacatattgcacttgagaaggcaaagaacattcttcaacactgttctgagtgtagcaaactttatttggttagttgctctttctttctttggatacattattctcttttgtgtgtttggtctctctcttgaattcctccacttttatatgttgagcaggccattactggggatgctgtactgttaaaatttgagaaagcaaaatctgcacttatcgatagtcttagacgtgtggaggacattgttcctagttcaattgggtctcaggtaatgtatatatcagtgcacacaaaatctttccttttgcaagttaataagtgtccagggcttatgtgctagatattggctttttttgtttattgattttagaattctagttgataaaatggtttatgctaatgttatttgacttcttcagattttggacattgttggtgaactagagcacaccaagttcctacttgatccatcagagaaggaagttggtgataggataattgcactattacaacaagggaagaaatttgacaacggcagtgacagtaccgaacttgaaatttttcaccaggcagctactagactcagtataacttcttctagatcagctctggcggagcggcgtgctttaaagaaagtcattgacagggcacgtgtggaagaagacaagcggaaggagtcaattgtggcttatctgttgcatctcatgagaaaatactccaagctatttagaagtgagatgatggatgagaatgactctccttgttcaacaccgtgttcccctactggtcaaggtcctaacgaagatcgtgttaatgcgtttgggcgacaactatccaagtttggttctattaactataagcctatgaacagtaggaaatcaggacagatgcctattccaccagaagaacttaggtgtcccatatctttgcagcttatgtatgatcctgtcatcattgcttctggacagacttatgaacgggtctgtattgagaaatggtttagtgatggacataactcttgtcccaagactcagcagcaactcccacatctttccctgactcccaattactgtgttaaaggtttgattgcgagctggtgtgaacagaatggaatcacagtccctactggaccaccagaatctcttgacctcaattactggagattagccatgtctgactctgaatcccccaattcaaagtcagttgatagtgtaggattgtgcacaccgaaggatatcagagtcgttcctttggaggagagtagtactattgaatctgaacgacaacaaaaagaaaaaaacaatgctcctgatgaggtggattctgaaatcaatgttctagaggggtatcaggatatattggcaatcgtggacaaagaggaggacttagctaaaaagtgcaaagtagtagaaaatgtcaggatattgctaaaggataatgaagaggccaggatcctcatgggagccaatgggttcgtggaagcgtttttgcagtttctagaatcagctgttcatgataacaatgcagccgcacaggaaaccggagctatggctctatttaacttagcagtcaacaataacaggttagttattatcacatccttcctgtctttgttaccaatcaaattccttagcaatgtcactttctaacatcccattcatggtgctcttcatttgcaaaccttgtcataatctcttctgtttcgttcttttggatgcactgcaggaacaaagagctgatgctgacttcaggggtcatcccactgctagagaaaatgatttcttgttcccaatcccaagggccagcaactgcgttatatctaaacctctcttgcctcgagaaagccaagcccgtgattggctcaagtcaagcagtttcctttttcgtgaatcttcttcttcaggatacgaaaacccaatgcaagctggacgcccttcacgccctctacaacctctccacctactctcccaatattcccactctcctttcatcaaacataatcaaaagcctccaagtccttgcatcaacaggtaaccacttgtggatagagaagtcattagccgtattactaaatctagcctctagccgggaaggaaaagaagagatgataacaacacaaggaatgatcagtacacttgcaacggtgttagacaccggtgacacagtcgaacaagagcaagcagtttcttgcctagtgatcctatgtacgggaagcgagtcgtgtatccagatggtgctacaagaaggagtgattccgtctctggtgtcgatctcagtgaacggaagtccccgaggaagagacaagtctcagaagcttctgatgctgttcagggaacaaaggcatagagatcagccatcaccaaacaaagaagaagctcccaggaaaaccgtatcggcaccaatggctatacctgcgccagtttcagctccagagtcagaagtaaaacctttgactaaatcaatctccagaagaaagacaatgacaagaccattcagtttcctctggaagaaaagccactcgatccatcattgacactcctatgtaaagttgcgttttcttctgtcgtccttaacttcttacaagtcatccgcatagagaaaaaaaatatttgtacaggtcacattgtgatcacaccattttttgctaacgaatcctctctcgcgagaggtatccatgtagatagtctactgatgtatcaggttatatatatgaaacctcacttttcagtacaaaaacagagtcgacaattcttgaaaactctgtttgacatctgtttattttgacggtcgattcacaggtggaccaattctagtggataaaactagtgccacgtagtatgaataaatactatataataatacttaaa

SEQ ID NO: 5009 - DNA, 3000 bp, Unknown; identical to SEQ ID NO: 5004
  misc_feature (1)..( 3000): cDNA_ID_1826910_gDNA_ID_1620753_Annot_ID_166847 3000 nt of promoter + ATG

SEQ ID NO: 5010 - DNA, 3000 bp, Unknown; identical to SEQ ID NO: 5003
  misc_feature (1)..( 3000): cDNA_ID_2052322_gDNA_ID_1620753_Annot_ID_166838 3000 nt of promoter + ATG

SEQ ID NO: 5011 - DNA, 3000 bp, Unknown; identical to SEQ ID NO: 5002
  misc_feature (1)..( 3000): cDNA_ID_3075104_gDNA_ID_1620753_Annot_ID_166837 3000 nt of promoter + ATG

SEQ ID NO: 5012 - DNA, 3000 bp, Unknown; identical to SEQ ID NO: 5001
  misc_feature (1)..( 3000): cDNA_ID_1808026_gDNA_ID_1620753_Annot_ID_166836 3000 nt of promoter + ATG

SEQ ID NO: 5013 - DNA, 3000 bp, Unknown; identical to SEQ ID NO: 5000
  misc_feature (1)..( 3000): cDNA_ID_1826937_gDNA_ID_1620753_Annot_ID_166834 3000 nt of promoter + ATG

SEQ ID NO: 5014 - DNA, 3000 bp, Unknown
  misc_feature (1)..( 3000): cDNA_ID_3075108_gDNA_ID_1620753_Annot_ID_166833 3000 nt of promoter + ATG
gagtactcttatatgtcgtcgtacgtactatagaaactgattgaaaatgatatcgaggaaacataatttgtcgatcggtgttggaaccttccatgcatgactccaattagagttctggaacttttggtttctcattagtcatgactctgattggacaagttctagtttttaacgactcatgactcttcacatgctccgaaagttcatcaaaacatttatcaaagttttacatgtttttgtgaacaataattatcttataaaaacatcaaaacatttatcaaagttctataagataattattgttcacaaaaacatgtaaaacatcatatcattttgtgggtttatattcaggtttaaagagtgtatatactatatatatatatatatatatatgtcataaaaactatgaaaaaagatccggcgacaaagacgaggaacgcttgtctttaggaaaataacaaaagtgatttgttttgatgatatattttcgtaaattcaaaacagaaagaatacgttatgtaagggagctaaatgagctcttaagatgcttaagaaaatggaattgtgatcgattgcgtacaaaacgtaaattcctatctaccatttctagtggtcggtttagccatagaatggccaatgtgattaagacaattgttgaaaactggtcacatgtatgttacaatttccggtactatgttcaaacagagaaaccagaatggattggttacctacgtatacatacttttaattttaaaagtttagagagcgttagatctaaacagttaatataacttaaacgtaatttggaatgtaacatcaggagtcacaaatgaaatgagtaaatagatagtataattaaataagaagcaagatttatttagtagacttaatagccagatcgattacaataggacataataactcataaatccatataggaatgaagaggtaaacattattaacctcctaaatatcctaaagcagtagccatagcaatggcagcctgagccatcattgaaaaacatgatacgatcaccaagaaacatccccatttcaacattttcacgatatttataaactcagcttaaatatgaaattattacaaaatatctttctggtttttaggtggggctgaaatgcttctagcatgatagatcaatttatagttgaaccatgcataaatgattaaatgatactatcagactcttcaaaattctttctcttctcgtaagttggaaattaataaaggacagtcaaagataaagaataaatgatttggaaattggaacattttgtcatgaaagtgcgtcgaaccaatttaggcttaagctcaaattgtatatgagcttattatagaggcccattcattttgtcaaaaagaaatttttttaaatatattttttacttcctcctctgcaaacatgtaaacgtgggacgagtagtcttacttgccgtgtaaacttaaatattggccatgtttggtccgtatcaatacaagaagtcaagaagaagacgtgttaagaaagaaattgaggaaacaaagcggtcgatgtggaaccttccgtgactccaattagggttctgaaacttttggtctctcatgcatgactccagttatcattagttcaataccaattctagttcttgacgactcaagtcaagatcattcagacggccttttaaaatctctttaacgttcgagacaaagataaaatccttttattttttcatagagaaaattgtaaaagaggataacaaaatagagagaatttgcttttaggaatttccgattgaatatgtagttggtaaagcctagttttatataattatatgtggacggaaaaagattcattatctcgcttatataaaaacataccaattaattatagtctatagtcacaattcatcatatattctagactttaaaagttgattttagaatttctgagaatcgagaggcaacaaaaaaagtctacaaatttgactaagaagaagcaggcacatccgccttgacgaagaaaacggtttggttgggaatgatggagttgaccggtagacaagtttcgtcgaagaaaacaaaaaaaaatagaaacacaaaatcgggtttaattttgcaatttcgcttcagtagaagacttgttgaattcaataacaatttagtttcgttcgacgagtgtaataacgcgttgagcattaataactatcgaggggccattaagcattaaattaccatttaattacgaattttaggggttgtttccttcatcgtagcttatcaaattacacacactcatacgttcacaccttcccatttttccaagaaaaaacttggttcatatttcttctaattcatacgttttgtgatagtattttcaacttttgttttaaagtttttcaacatgtattaccaattcaatttggtaatccaccatcatatatttatatattgctcgaaagatccggtagcagttgagtctgtctgacaaattaaaacactattcacgatttttttctacagttttactttaatcttaaaaaccaatattattacaaataaccaagtcaaagataaggtcaaccccaccagacaaaacttagttcacggcacaacaagactaagcactgaagtctttgagaggaagattttgaaaatctcgtgcaaagactaaaacatccttctttactatatatatctttcgctccactacgaaggttattttcgtaattcgacacaattccttacagagaataagcgaacagatcaacaactactctgctcttacaggcgacgacgtcaacaacaacccaaaataccaaaaaccctcaaaagtctcaaacaaaactcaaaacccaacaattaaagaaacaacatttcaatatacagatttacttccttttacagattttcctaaaaaaccgaaattgaaacaaacaaaaccaaaagacgttaccttttttccattgattcctcaattctctaaacaaatgagttaatcttcc

SEQ ID NO: 5015 - DNA, 3000 bp, Unknown
  misc_feature (1)..( 3000): cDNA_ID_3075116_gDNA_ID_1620753_Annot_ID_166831 3000 nt of promoter + ATG
caacatcccgcatcgactaaaatatttagacaataattcataaataagatcaatattaataaaataaatggtttttttgcaggacgggttttgcgggacgggtttggcaggacgttacttaataacagttgtaaactataaaataaaaatattttatagatagatacaatttacaaatttttatatatactaactttaaaaaatcatttgtctccgcggtgtaccgcgggttaaaatctagtaccacttaatttcatacttaattttcaatgtgatatattgttatccttaatacataccaacatgtcgtcttccctctcatttcctctcctcaattttgtttatatagatgcgtaatctaaaatagtgtcgaagtgaactttaattattaagatctcttcattcatttgcctttttcttctcatgtttttgctttttatagatgaacaagcccttgcaacccaagcagaacaccgcaaactcaatgagtcacttacttacatatactttcgttattttatttatgttattgttttgttgattttcatggtttaatacatcatgtcatatgtatattatgctggtgttgtagaagagacgataaccatgagaaggaacttggaaggcataggcgaaaaagctcccaaattggggttattccgagcacttcacgtcatgccgagacaaaaacctctaaatagcaacgagaaagagtgtccttttatagaaagactaagtcttgtcagtgccggtccggtaaaatgtggggctaaaaattcaaaactgctaaattttgtttttgttgctaactatagggcatccataatttttatttcttaaattttcttaattttgggggtactgtttgctaattttggaatatttttgctaatttcatgattttttttgttaattatgggacttaataataatttaaaaaaacatagaaaacgtaaaaatttgagacccaatataaatgtttcaacattatgcgtaaaaggacaggccttcctaaaattagaacattttatatgatatcctcttaagtcttaagtactatcgaagccggagatttctaagttttacttttactaattaagctattgacacttgataaatgccatatttttgcattccctaaaacctcaaaactctctaaacacgtttttgtggacatattaaaatagtgtattttgtagtctcttccaggtttcttccttcttgtcaacgtcgcacaagtccgtttacggatatgggtgaataattgaatattatccatgtttccttattagcagtcgctattgtgggtttctttttggtagtctaatttattatttacttctttaaaatggggaaacagatacaaagttgcattacatatataacgcaatacaattagatcccatttgaccgagtaaacgctaagatccacacaaactcaatcgtcaactcctctctcttctctattctatatagttgcgtgaaatgtaatgaaagtgatcatcattcacttctaagatggcggtatctatagtttcttccatcattttctttcttctgtttatcatactttcacaatatgtagatggaaacggttttgctgcccaaatggaacatcgcaaactcggtgagtcttctacctgtataaatatatatatatatatatatatataaatagattacttttgagtcatgtagtcatgtactgttatattttattagttagctagttcaatatagcttatagacaaattgtttttgaaggtactaagcctaattaaaggcttgacgcgctatatgttatgtgtaacgtgcaggtggaccgaaaaaaacaatgaccatgaggagaaacttggaagaaaatgggcgccaaggctccaaaattgcaactcctgggagcacgtcacggcacagtggacaaaaaaacattgaaaaagagccgtcaaaaacaatttatggtcatcaattacgtcctgatcaaatcaaaaggggaagcccttgcaaaatctacacccgatgtaaacattcatcctcacttccacaacctcctccgcttccaagctcttctatagacacacaaggacttggtcactgatcgcactgtagcttcaaatgccaattctggatcgataaaacggtgtatattttctagtcttcttttctcgatacgactatttgtatattgatacatggaggtttatataactttggcgtgacatatgttgcctttggaatgtttaactatatattcttaagacaaagagaagctcgatgcatctgtttggctaaagctataatgaatctattccacgtacaaaaaacaacgaatgaatccctttcgaggggtttgaggaagacagatgataaacagtgttaagtccccacgtggctgagtaaactaaaacattgacatgcttgagcatgaagccaaaaatattgggatttcctatgtaatatcgcacgttcatatggttcactccttttgatagatggctgtgcgttcaggtcttggtcttttgtctctctcttacaattattaacgtatcttatcatttttgaacgtctgactattcttttcacattgtttcttcgtgtcactttcttaaaccttgtagaaatccctctccttaaagactgatcctttactgaaataaaaagaaacaccactatagtaattgtgatttttttttttttttttttgtacaatagttctcaagtcaagtgtcaattcctttattttgttatttaaaaataaaactattccgtggaaaaaaggattggacatgtaaatatggaatgaaatccacttgatcatacggatacatggtgtgcggagaccataactcaaaaccccacaacaaactaagtcctcatctcgaccaccttctctattctatataaatgcgtaaacgtgagtcggattcagacacatcacacatacaaagtaaattaggtcaattttgtgataagtgatcattaagtaacagagtgattattaag

SEQ ID NO: 5016 - DNA, 3000 bp, Unknown
  misc_feature (1)..( 3000): cDNA_ID_3075123_gDNA_ID_1620753_Annot_ID_166829 3000 nt of promoter + ATG
ttgtgccgtcggacttccacgtagcttttgctactaaagagagtcttgaagcggtcgttcatcgtcggaagagtagctacgcacttgtacttctgacctctgcgattgctctcgtcgatgatcttccatacacgaatcttgtgatcttgatgagcacttattagcttgtcgccaagaatcaccaacgatttaacccctccgtttccgttggcaactacgttacggtcatcgccggtggaatattccggtgagaacggaggttcacgaggccatacacgtatctcactgttggaagagccagtgtagagtaatttatctgagacagcgagagaagatacgtacgaggatttatctttgagcgtggctaagcaatggtgatcgacgctggagctctgatgctgaaaagacagcgaaggaaccaatggaagacttggctgagacaaaagcgatgatgacgttgaggattctgattggtgatgcgtcgatttcgtttcacattctgatcttgtttcattgcaaggcagaggacaagaacacggaagcaaacccattgttcttgaccaagctagagagagttttatgttttgtttgttttgttgttgtcgggaataatcgtggatatgctttgctttataagatgagttttcgtatcccgaggtagggaagatctggggagtttaatggagaattatatagaaaggtaaaagataattaaaagaaaattaaagtttagggtagtgtagggtgggggaactgattgacccatgtgtcgttactgtgatagtgtgatgatgtgtttgtaattaattaacatatctttgtgttcctaacttacctttttgtaattattatatttcccttataatcagttttggcttattataaagttatgtgtgttttgagttgagagatcaaacccgatgcttccaaagttatgttaaattccctttaccagggtcaaattgtaatcattatttctagttataatggtccccatcaatagtgatttccatttaaaattgttattgaatttgagtttaaataaaataatttgaactttactcctaaaaagttagtttgaactttatactttgaactcataaatttcatctcaaaattaattagtaacaaaaaaaaaagtatactattatgttcaaaaagagaaactatgcatgaatgaagaaccaatctaggaaaaataatccaaaccgtgtcttaataatctgtaaattaatgaactaatccaatcatctacactaaatacaaaaataatccaaatataatccaaaaataatactgaagtagattagtcaaaaccgatctagaaccgtcgcttctaccaggagcaccagaatcgccagtgtctcgttgttgagtggacggtggtggagatctagaaccattgaagttaggattcgcaccgtacaaatattggactccttccacgtcatcggtcgttaaatcaactttacgcctacccgtcctgatggttggatacatgatcgaaccttctaccgaggaatggcctaaccctagaagatgtccaatctcgtgaacagccaccgattctagatcaacagcctcagacacggagataaaaccgtcgcctccttcgccggagacgatccagttctcttctccgtctagatggaagtgtcccgtcgggggcgagaacgcatgtgctagcgttctcattgggccgtcgaacggttctccgtctccgtgctctccggagtagaatccgatgctgatgtcagaggtcgagaacctctccacgcgtgtgaacgttagtggagtcacctcctcccaacgagtgaaagcgcgtgagaacacgctcttgacctcttcggtcaacgcgtttcgcgggtcgaaagcgtaggttagatcacgacgatttctcggccaccgtggctctccggggaagaaagagtagtgtttaacggcgtggaagcgttgtccccgcccggcgaaggaaacctcgaaggttttcctaccgctatgcatagttgaggtgccgttgactacgtcggggttgccgcaacgtgggatcacaacgtgtttgagagtgagctcgtcgagtactccggtgacgtttagctggaagtttctctggtacatttcgacggcgttcttgagaatatcgtcgaagtcgtcagtgaagtttccggagagattagtttcggtgatgtagccaaaatgttgaaaatattgtttgagcatatagagaccatcgtacttcttgccggcgtgacatccagtgaaattcaagaatgagttccaggggttcccggtggcgtttcggagaagctgcggcggaatggctgaggagtttgtatagaaaccagcggagactggagaaggagcgaagaacaacaagaaaaccatgaaaacacaaatcctcaccatccaaaagagaaatattaaaaagattaagtgaagaggtattattgagatttacaagagaattagagagatgacatagataaaactaaacaagtttgacgttggagaaagcagaggtcatttctgcgttgcgtttggagaattttctatgttgaaaatgctgcattattcaaaggaaacttcctccgtcctcgtttcaaagggtctcacgaagaaaaagactaatgaagcttctgccaatagatagtgtcgttttatggataattaaagttgattggtggcttggtgcaatagattaggcccgatttagtcttggatgactagaaattgtgattgaccggtggtaaaggaccggttaaatgcaaagttggaaaaagaaccatgcaacaaaaatggttgaaggcggcagaatcaactaaattggttgaaagtgtttttgttttttttgggtcgttgaatgtttgaattggtcttttttctttttgtgataatttttccggaggttgttgttattggttgaaaaaatcaacgtaaaatctccaccttacacgagtaacgccatgacttgtttgttaggctatctaattttttcctgta

SEQ ID NO: 5017 - DNA, 3000 bp, Unknown
  misc_feature (1)..( 3000): cDNA_ID_2052277_gDNA_ID_1620753_Annot_ID_166853 3000 nt of promoter + ATG
actccttgcatagccaaaaatggtaaaatgctgcgaccaaaaacagcttaccacatcaatcaatataacaatcaatcatcagaaagagagaaagatagaagaagttatttatacctcaggaagacagccttcatagtaaagtgcgaaaagagctgggaatattttcttcttggcaagatcaccagaagctcccaccaccgtgatactaactgttgaaagttgttcaccgccatcagactctgctacaaccttgtcagcttcaagtgaaggaatcgttaacacccctacatctttcgcctcctcggacgagcttgactcggtggctactgatcctaaacacacaattgtaagcgcattagagaacattcattacatgcaatgttttgtctaaagtcggatactttctataagaaaatctatctaaaaccaagctgaactacaggattcaatcctatatatacaagctttcaagttaccggcaaagcaaggcataaagaagaaaacccaattgagaatccaattaaagttaccatcttgcacgacaacagaactctgaacggacctcctctgcgatctaacaacacagagctcagctagattaagcccctgaggagaagcgtagtggaaggagagtgagcggcgtgggtcaacaacattgatcagcgaagaatgatgatgattcgacaagaaaggagacgaagacgaagtgcgggagcggtaggtagggcaggagagagacgacatttttcgaatttgagacgagtgtgagttatgaattggatttggatgcaaacaaatctcacaattgcactaatgagcgaatttgtaaggacaattgtcaaattttgagccttttcacgtctcccaaaggttatgtctttgccaaatctgtgtggttttgttggtatggtttagtgaaaggttatttgcaaatattattattattcaattcacaagtggccctttgatttctcttgaaacaaggatttgcaactactatattgttgcattttcatgagctcttaaaattgataagcaatactagtagtggccctaagcaaaaaaaaaaaaatatatattggaagaattagattcgaaatttggctataatgtccaagaccaaacatagataaccctatcggcttaggcatgcatttctaataacacacattccgatcaatgactatgtatgtgtttaaaacattgctttcatcatatcacatctaacattcattgatacattgcacaaaagccttgatcttaaacttaataagtttataataattatttatacttgtctcatgtaagtttataatctatttgctaaatatttttccattacaataaaactatatcattgaaagaagcattttaaaaatcatgcattttcgctggagctattgtgatttagctcatttgtgaattgattgaatttgttaaaaaaaaaaaaaaaatcatgcatgtatatgatgagcgagagacataataatgattaatgagggtgaaatacataaacatgaaaaaaggctctatactctgtttcctcttatctgcgaaagccattaaggaaagaaacaataatcgcagcaaagaaaactctctcctctgcttctctctctctctctatctagaaaagaaagattcctcaaaatcagccatgaaagtaatgaagaaaggtaaagtgcacccatctcctcctcttccatcttcttcttcttcgaatggagatgactctctttctgtctttaagcttctccagagtgcgattctagttctagtctcggttctctccgccgaagatctggaagttcttgcttacttaatcaccaggtcactcaacaccactaacgtcgtatcttgcaagaagaagagaagccataaagctcctctgcttgactgtcaatgttttgattgctacacaagttactggtctaaatgggattcttcgtctaaccgtgagctcatcaaccagatcatagaagcctttgaagatcatctcaccagggacgagatctctgcttcccacacttccaagaaaaacaagaagagagctaagaagatagagatatcggaagaacaacctcaaaataagagtatatggttattggttagctagttgaaaaactgtgctattttgcatcaggttttgcatattctttcttcttttgggttggtggtaacaacctcaaaagaagagtgtatgtttgaatatgtcttagtttcggaaggtgggccaaaagagatgtgtctttgtttgattaggcacttcgaaaaagtccaaagagagtctcgtttagatattttggggaaggaaacacttttcctatcatgtattcatgttactctatttcggacttgtattgctttttttccggtgaagatttggtccttttggtggtataaaaatgaagaagatctatcgaaactcgagcatcttatgaggtagataggcacaggacgtcgacggttaataatacatttgcgacctatcatatgtatgtggaatagatgaaacaaactattaattactaggacaacttcttgaagcttataactctagcaaaaacgcctttgtaatgtcatgtgtggtctgctctcagcctctcaagttgttttgttatctcgaattggtcaaagtctcaaatctcaataaccttatgcctcatgggcatcttcttagagcatattctaaggcctttttctaggcccaataagaaaattaataaaataaaagtattgtatgtcaagtcacttgaggaacacaacactgtcccttcgacaaaacaattttgagtctctctattctctattctctctcctctccgcctctctttctctctctctctatctccgtcgtcgcaagagtgcatcatctttaacgccggcaccttcccgctgctctcttctaccaattctctcttagatcttctcatgcgtcttcttcttatatcttaatccttcgtcgtacaagctcgccggattgagttttcgtcttccatg

SEQ ID NO: 5018 - DNA, 3000 bp, Unknown
  misc_feature (1)..( 3000): cDNA_ID_2052346_gDNA_ID_1620753_Annot_ID_166828 3000 nt of promoter + ATG
agacttagtctttctataaaaggacactctttctcgttgctatttagaggtttttgtctcggcatgacgtgaagtgctcggaataaccccaatttgggagctttttcgcctatgccttccaagttccttctcatggttatcgtctcttctacaacaccagcataatatacatatgacatgatgtattaaaccatgaaaatcaacaaaacaataacataaataaaataacgaaagtatatgtaagtaagtgactcattgagtttgcggtgttctgcttgggttgcaagggcttgttcatctataaaaagcaaaaacatgagaagaaaaaggcaaatgaatgaagagatcttaataattaaagttcacttcgacactattttagattacgcatctatataaacaaaattgaggagaggaaatgagagggaagacgacatgttggtatgtattaaggataacaatatatcacattgaaaattaagtatgaaattaagtggtactagattttaacccgcggtacaccgcggagacaaatgattttttaaagttagtatatataaaaatttgtaaattgtatctatctataaaatatttttattttatagtttacaactgttattaagtaacgtcctgccaaacccgtcccgcaaaacccgtcctgcaaaaaaaccatttattttattaatattgatcttatttatgaattattgtctaaatattttagtcgatgcgggatgttgaacccacacatttttcgccaatttggtcaatatatgttcatttttaaaattttgaatcacaaaatatgacggaaatgtttttgagatttttttaaactatatattatataatgatgttaaatttttttatatattaaactttttataagtttaaatattaataatgttttataaagtttaaatatataaataataatatttaaaaaaatatattttttcccttttaggtaatgacataataactctaaaagcaaagatttagaagatttaaatcgttaattaaatattttcatttctaaataattaatgccagtagcatgacattgtaaataagttcaaatacagaatttatttatttaaacaaaaaacgtttagtaagaataatatttatttaaacaaaaaactttgttttaaaatattgttaacaaatacgtttatgctaattttaagggattgatgtgaagtttgtttggattaaatttgattgataatgtgattgacaatttaaattaagaatttaaagtaaaattaattattttgaaaaaaatatttaatgctaatggcattgggttgtaaataagtccaactctaagatttatttgttaaaataactacaaaaatatatatatagatatataatatataaagttttctattcattgtcaattgtttttgagttagaatctcactatttaatagtatgtggggcattcgtttacagcattttactcagtcaaatgggttctattggctctgtagggcaacactgtcttttcataaatatatgtattttctgtttttccatatacttttttttattaacaaaatagacttttcatgtgatataaaaagactttatcttcttaagatcatcttacaccatccacattgcacatttatattggatgtcttcctccacaataaactattaaaagaactaaaatataattattaaaatatgaaaatgtctttaaataaaaattctccttcccataatgtcttttcatagacattttaactgaatgtctctcatttaaagacactatcatattttaataattatattttgattttcttaatattttttttttttgggggcaaacgaaattttcttaatattttataatagagaaagacacccaattaaattgtccattgaggatgctctaaagagtcctctagtgaaggtgctcttatgactccattagtcatacactaaccgtatgcaaagaaaacctatcacttggtggtagaatataattaagtattattaacccaaagcacaccaaaaaaaaaatgtaattaaaatctgtaactaaaatgaattagtcagtcaaaaatatcataactacgaaataaatgtacactaaacactatcaaacgtcccttagtttagattttggttaataaagctatgcgtttacaggcttctaagttttaataatgttggtgcaaacgtggttgaactaattctgaaaacaatttttagcctaaatggatctaacatgaaaatctacatttttctgtttatatgtatcctaattctgtttagaaagggcttcaaacttttggcccaaaactttatatgcatgtatgatatatcaattaattttaccgatggagacttgcatgttatacccattacaggaaaaaattagatagcctaacaaacaagtcatggcgttactcgtgtaaggtggagattttacgttgattttttcaaccaataacaacaacctccggaaaaattatcacaaaaagaaaaaagaccaattcaaacattcaacgacccaaaaaaaacaaaaacactttcaaccaatttagttgattctgccgccttcaaccatttttgttgcatggttctttttccaactttgcatttaaccggtcctttaccaccggtcaatcacaatttctagtcatccaagactaaatcgggcctaatctattgcaccaagccaccaatcaactttaattatccataaaacgacactatctattggcagaagcttcattagtctttttcttcgtgagaccctttgaaacgaggacggaggaagtttcctttgaataatgcagcattttcaacatagaaaattctccaaacgcaacgcagaaatgacctctgctttctccaacgtcaaacttgtttagttttatctatgtcatctctctaattctcttgtaaatctcaataatacctcttcacttaatctttttaatatttctcttttggatggtgaggatttgtgttttcatg

SEQ ID NO: 5019 - DNA, 3000 bp, Unknown
  misc_feature (1)..( 3000): cDNA_ID_1826992_gDNA_ID_1620755_Annot_ID_49868 3000 nt of promoter + ATG
atccatgagagagtctggatatatgctcggaagcgtttagtattgttgctcgagggacatgagggtcccaacgactcgtgaggagcggggtatgctcctgaggtaccggtaactcgaggggtatggtggcttcgggtgacgatccgagagcacgctttagggtgacgacccgagagcgagttttgtggtattattttctccaagtgtcgtaactcgatgactttgtggctgagagtgagtcgacacaactctgggtttgactttgagtggggaagataatatgtgtgatacccgagatatcgtaggccgaagcctgagagtgacggtttatgctcgaagattgcggtctgagagtggagagtgagttgtgagcaacaatgactagtaaatcgtgagtatatcgactggatagagagacctagagggggtctggttggagggagtgcggactgtagtgatggttgcacggagttcctcggagtggaagggtgaagctagattcgaggacgaatctatgttagtgggagagaattgtaacgcccgtgaaccggaaaatcgattaggatttgtttttaaatcatccggtttaattggttgggttaataacaaaccctagagtgtgcctataaaagaaggaacctcgaaattaggctttagttagccacttttcgtttataaaggagaaaaagagagaaaaggagaaggagcagaatcattagggtttgggagaaatcagtttcgtcatatcaaatcgtggtaaaaggtaacgaaatttggtatagttattctcaagtcctttatcgttattctccaatttacagaattggatttggattaaaattggttgagttattcgcagttttgtgagacacgttttctcagacgcgaattaggaccagcggagattgaaactgagatcgtggtctcgtctgttttccgatcggcacgagattttgtgggcagctttgtgacgtctgcagctaggatatcactggagcgattgaatagttaacggttagcttgtattttagggtttcgtctttgagactgcttgtttctggtttttcctgtccagtttgcttcaaggttgcttttggttgtggacttgttgtaggacgtttatggactgtttcagacgcaaggagagtctctcctgtgtttaattgctcttagaatcaatttgttaaggtgagtgcgtgaccatgagcttatctgagcgattgggttgtgtgatttattttgtgtgatgatatgtaggtgtggtgaatgtgttttgggtgaattgttcaatgactgatttgtttgtattgtattcgtgattatacccttttatttgcttgtgtgtatagctcgtagatgggaggatcgcctcactaagtatttatgataatatttacgcatctcgttgtgttgttgatgcaggtaaagataaagtgtgatcgtggaatcatggctaggaagagaggatgatctaggaactcgtttgttttatttttggtatttttggttattggaatccggttaggattgtcagttattcttggttttgttggtcgaattatttatttatttataaaatagtatttttgatttacggtttaattattatgttattggttgatttaattaaatatttatgagaatatttaattatattttttttttttaaaaaaagggttgggttgtttcaatatcattcttgatccaaaaatttgaaccggtaacattttgtttggacactgtagaacgtttctggaagctgcatgtttatagcgttactaggtactaatccgtataacaccgggtaatattttttttttttttttgtcatatatatattttataaagtccaaacgagcatatagtcaatacaaagaaaggcctaataaggtccactaattgcaaaacagtacaagataaggaaaacaattttgaaacatgtgttatgcaacgtgggttatgaagcttcgtcaacttcgccgttcaccgactcatcactaaccagagttctttgtcggaaactttcgtaatcggccgacgtataatttgtttaggttcttcatgaagctttcactcctatagccttctattgtacctattgccttttgcgattgatcaccggaagaaatggttggatttaaactcgctcaccggaaatttgacctcagttgaccagatccaaaatattcttgagagaatcatcaaaacacgatgagaactccaaatcttcatatttcgtttccatcaaccgcaaccacttgattgaatcaaccaaaagtagaaccgacgcttttaacgatctattaggacaagcggggatttaccttctcttggtagactaatcaaccatccaacaatgcaagaatccatctaaactcctggaattttacagcttcaaaaaaactgggtttcaaagctgcaaaaggctacaaaagatccgaacaaagtcgaaaaattatcttaaacaagtcggaagaacaaaccggacttagccggtaaacaaagaaaaagaaacaaaccaatacaaaatcggaagataacaatgatacaagatccgattttgatttatgaaaacaaaagaagattgtagctttcctctctctaaaagatactttagaagaaagagaaaactttttttttttttctttttaaagtagcggaagttagttaatattgtagaaaaaaaaatactatagtgattttgtgatctctatagattgtttgctgacgaaattctacagataataacacttaaattttatgatgtagttttttttcattttgtcaaccatattttttttaactatttccaaatcaaccacaaaagttatgttaaattaggccaaaatggtaaaatcgggccgaagcctataaccaataagtgaagtagacgagcgacgcaaaagtcaaggttcgacataacagtgccagtgacagtgaggttatagggtttcgttgatcgtcttcaagctttgatagttaggttgtcttacttcaatg

SEQ ID NO: 5020 - DNA, 3000 bp, Unknown
  misc_feature (1)..( 3000): cDNA_ID_1826982_gDNA_ID_1620755_Annot_ID_49871 3000 nt of promoter + ATG
aatactagatagtggaactttattctacaaagaacaaatttcttgccaagagcaaacgagaggtcatatatctatcagctgcacataacaacatttctagggtcgatttctagccaagagcctatgagatcaggtaaagtaattattttcctctcttctcttgtgtattttctcatacatttgtccctacaggttctttgcatttgatgagataccttggcttgtttgggttattcaaactaatgttttgcatttgatcgttttggctctgtcttcgaatttaaagaagccatcttattcgtataatctggactaatgggtttggttattagtctatcactgtgtttatgtgtttctatggtgattgatttggaaaaaatggtcaattgttatattcatacaagaagattatatggcatcacatacattgtttatctcgatattccgtgtttcaataattgcatgtttatgttacgaactcttatcagtcttgtggtcatatgattcagcaatcaagtggcaattcatatctcaatttggagacgagaacattgatgtaagttttagaacactctttaaattatatgtgttgtttctaagatgatgcagtctccttaatgtgttcttaaagtgtgattgtttttctaactttgatagttatgtttttcagttgtactctttgttaacacattttccgtcaagattaaaagtagaaaatattagcaaccagtaagattttggatctgtaagactcttaccatgttttttttttctttcttggcaatgattttgtcgtttcattttattgtcctatttgtatgatgtactttcaggtgaaattttggttcagtagtcaagagaaaatgaggggttgtgtgtcctgcttcatggagatatctttgaggtccaaagaacaaaaaatttcgaaggtaaagcatgtgggaggtcaggtatctctctctttattctcatgtcaattgtgtcatgcatagctatcttggctttgttttggttactcacaatatctgaaaacacacactttcacaaacacggaaaaatctcaaactcaaaacacacccaaagacaacaaaaatcaaactctacaaaaaaaaatcacatcacacgcaacaaaactatagacatactcacacgaaacaaagctcaaactcaacataacacaagaaataaaatacagcacaacaaaaaactagacacatgagagaacaaaaaaacaatcaatatatttccttacagtaaaacattttgtgattctgttgctaagtcaatttcaggggaaatttctttctcgttcttttttagttttttacaactattaatcattgtttggtcacattgaatctaagtacttgttatgctactctaaaagtgaaatccaagccacacaagctcaaacggtgtcatacaaaaataaatatatttacttagatttgtttaatcatgtgatttcatgtgaagggatactcagtgatacttcaaaatccaaagtaaaacacaagtttcaaggtgaagtttctttatttcttctcttttactttttcgtcatacaaattttcttattaatacttatttcacaaagaatatttatcatacgtaataaacatgttttgtggacattgtttccttgtctagattaacagaaacaataagagcaaagcagtcgaatcctagcttggatcagacttaataaattccagtaagtttcttgattagcattatttatgtggtttatttatagtcttatatgcttagtaattgctattagaatggttttgtatcaagatggagaactcttaagctgaaaataactaaacttaggaaagtgattcaattgtctcggaaaaaggaaggatcaggtagataaactatcttcatccctttttctagagtttttgtaaacaaattatggtcttgtgtatatactgctaacataatggttttgtagaaagatatacaattcttaagcggaaaagaaccaaatttaagaaagccatatagtctcctcaaaagaagaaaggccaggtatataatttacacacactgatacaatgttttttggaaatgtctgacgtatttgagtggttttcaacttggaagaactaataaggcatatcacatttctctactagatctttattcccatggtacaatactaaggaaaacagggatcggattcttcttgttagaaagtctcgtgcatatgagacaacaaatatattcttcagtgctaaggtgattaaatttttttatcacctcttacaatagttgtcattctcttgatattttctaacttaaagggttatgttttatattcgggattttcgttatacaacatgtttcgtgaagattatagaacaagagatgaaaaatcagtcagcctctgtaagattcttaccatattttttcttggcattgattttgtagtgttttatatattatttgtatgttgtgtaaggatcctgttttgctctgcacataatgtttgctaacaaaattctttgaattctagagagtggatccttattctgaaaagaacaaaggtccttgccaagaacaaatgagagacgattttgcagcaacagcatatgagaagtcaggtaaagtaaagtttcctctattctcatgtgtatatgctcaattctcatgtattcttcctaaagtttcctctattctcatttgatgagcctaggtggcttggcttgttttggttcctcaaactatctagaaacacacaacttcacgaattacaaatacatgcaatcacctaaattcaaaacacaccgaaagacaacaaaattcaaacataaacacgtgaaactgaaacacgatacaaaaaaaaaaaacacgtcacatagataaactcaaaacaccctcgaacacaacacaacattttggtttagcatgcaaaggggaaagactcctacgtgatccctttagtcctaaatgcaccaatctacctccatatgaaataagccaaccatg

SEQ ID NO: 5021 - DNA, 3000 bp, Unknown
  misc_feature (1)..( 3000): cDNA_ID_3075288_gDNA_ID_1620755_Annot_ID_166917 3000 nt of promoter + ATG
cttggatgatgttgtctcatgacttaggttctgctagtttttattttcgtttgagtctaggtttcaaaattagggtcctaacataggaagctagagagacttttgttgaaactggaagctcctatattttttaaagaactaattgttttgttgaagacttgctaggattttgttagttgccttgttcctgactatgtaaacagattattgccggcaaaagcttaaactaataggtgtatctatcagtattcagtatttatcttagcttattaagctaattaaaagcttaactttgatgaatccgttaaacttttaccaactagagagtaactcttaattaaacagcaccaagtggtcacagttagtcatttggtgctcttcttaattacaaagtagaaagattatgtataacctaattacagtcaagctataaactcttaaggttaatgtatactctactctccatttatttattagtcatttacaaaagaaatataacgaggataaactagtaggtacaaccacgtaagagataaatatttaggatcaaataaggaaacaaagtgtttaagatagaaagtaaaatatcaatatatagatttttgcattatgaaataaatcttcaagttggaacttatttacaaagaatgtcattagcaatatttttatcaattaattaatatttctaattactaggattttcttatttaatatatctccatcaattctaattagtataaaaaaagataaatcttaggacattattaatattactagggcaaaacctgcgccaagccgcggacttcttttgtttaatgaaactttgttaagttgtatgtaggtattgaatgttatttgtcataattcatgatatatgtagaacaaaaatattcattagaaagtgattgaaaacataatgcattttgattttttttagtaagatctatatagcctttataagttttggaagctaattttttgttttgcgaacatatatttaaaagagccattaaaaaacaaaagtgaaaagagttaaaaatcaccaagtgctaattctggtgaggttaaagtcattttagattcttaagaatatgttatatggagtgatcatattggattttaatgttcccaatgcatacttgattcatatgttgaagatgcataaaaagctaaaatctatgtttgtttgtttttcagaatttgaaaattgaaacttttttttcttcataagagtataggacgtactcaaatgattattagttagtgattaagatccacaatgacgcttagtaaatctgataagatccttgaatattttgaggaagaaactcaaaaatctttgatatctcttctctaagattcttcttccattgaccttcttcctcgttgtttcatcttgttaagacttcattctgtacggaaataagctcttgaactaaaaaatggatagtaaattattgactttatggacttttaagccaacctataatttattgacttttatttggtaattatatacatgtgttagattatcgttttaagttgttatattgtacctttaaaatttacatttactttacttagcaaccgaattatggtttattttcttcaatatctgattatgtgcatcgaaataactttgaacgtctttattaaatttcacaagtctatatagtaaataattagtaattaaattcaatgatggaagaaatagtaaataatttgaatattgattgtataaagtatttagagttcttttgattaatatcaatatatcaatattcatatatgttaatctcacaaattaatcaagattttgtcaatctcacaacttcaaatctattgaatattctacaattttacactcatactataatcgatatgtactctctttgttcctaattatttgatgttttgaattttttacttgttctatcaagattgatgtttagaaaactatcattattattttagtttgtgacgaatagtgaaaggagagaagtaaaactaatattagtattaaactaataaataattattaaaataataagtcatttttttcttaattcctatgcgaaatccaaaacatcaaataactaggaatagaggaagtatacaagttcaaatttgaaatctttaagtcaaagaaatattacatatcattttcagaatttaaattaaactcataaacactcacgcaaggattttcagatggtttttagaagtgttgcaagtttttaagattgttacatgtttttattgttttgagtgttacagattactatttgctagttttggtttcttttgttcctattttgacattgttacagatttatgttggtttctactttgacattgtaacggatttatgttggttctcattgtcatttgttaagatttaaacaggaatcaacgacattacattatctcacttactacatgccacaatttaaattgggaatcgacaacaatacattaattcacgacatctcgtctctcatgtgtttcagctcacaattacaacgacaacatctactctaatcaaagttgacttagccatttcacgacccaattcttccatattcttcatcttcttgaccatctcttcttccatatatgatgtaactgaaattacaagaaaaaacatgttgtcactgaaattacaagaaaaaaacaaaacatatgttgtcactaaaattacagaacatatgttgttacatgaaaaaacaaaacctggaactctttggtagatgatattgaatgcaacttcaatggtagatctcacgggacgatagctaacaagtcactttctttgcaaaagcaatgctttgcatctgttccaaaatcaacctgaagaatcaagagagatgtctcattttcacaagtatgattaaaagtcatcgtaacaaaataatgtttttctcaattaatcataaaatacaaactttaaaggcgctcatataacacaatttgtaagagatacaagagcatgcatgaatg

SEQ ID NO: 5022 - DNA, 3000 bp, Unknown
  misc_feature (1)..( 3000): cDNA_ID_3075236_gDNA_ID_1620755_Annot_ID_166939 3000 nt of promoter + ATG
gtttttgggaaagaagctaaacatatattagaaattgatttaggatttttttttaaaaacaataacgacatgaaattgaacttgtctagaggacttgtggtatattgttacttaataacaattggaaattacaaaatataaatattttataaatagatacaatttgcaaacttttatatatactaactttaaagaataaatagtttcacgattatcgctgattaaaatctaattaagaataataatgtttcacattggacattaagtaggattttaagtagtgtatatataagatatgaacctttctactcattattaattagttttaagttgaaaattcaccgtctaatgaaaacatgaaatcatttttctttcaaaactttatatcataggccagccttgagctcacaagtaaaacatacgagtataataaaacaaaaatgagaattaaatataatgaaagtattcatcccaggccagccttgggcacgagtaaacctttgggccgcttataaccagcccatattagtgcatagatattattgcgcaatttatggtaaaacacaacaaataaaagagagattcatgcgcaaatgatggtaaagaaaataatggaccatgcgaccaacaaacaaacaaagcattcttgcgatcataactacttctttctttcttctttttattttaatctcaatgtcttaaacttaattgattggtttatgaaaaacagaacaaacaaaaagaagacttgattgaaattacaatctcatcacacctaattacttctgtcatatctgatcacaatcttctacttcaagcctttttttttcttttaacaacacttctacatcaagctagggttctcttttatttttgttttcaccttccatttttcttatttactgttttcaacttttaaccacataatatctgttactattaaagactaacaccaattaatactgtttgaaaaagatattataacttctttttttgggttaaattatttataactatttctttaaattttagatagaattttcataaatacaacatttcttaaagatagcatatgaaaatatttatgagtaacactgaaaatcctgttgtgtttttgtggtaatttgttagtgttaataaattaactggttcgctgaattgggttaggaaatgtgggaaaagaaagaatagaaaaaagcaatctcgaaagctttcattgtgccgcccgtaatcatttgaattccataggatccaacgtctactattcatatatgatttcttcttttatttttgtggaaataacatctcccaccactttcaaaaataaaataagaacaatttataaaagtcactaatacaatctagagagaaggagaaattgagagaggagtttattacgattacgaattctgttttcatgaaagaagcaaaactatacaatatgttctttatatacaagtatctaacttaaccggtcaactgaacccgaaaattaatctaaagtttaaactaaaactatatgtataactcaatagtcgttgttacataatggcaatgataacggctaaatatatatgaacaaaacccacaaatgtatttccctataacaatgcagtattatatccaaaataagttcattatatttaatttccataatattattgaatcgctttaccaagttcaatttcggtgtttccaaaagacagtgtttttatttcttagtccttagaaatattctctttcctaacacttcaaacatatataatctactccaaagtcacttatatatataaattgattccaaagtcacacatataaaaaattgaaaatacgatacgaaagcaaaatatacaaaattaagtatatgaaaaagagggaggaattgttttagggcatataatgctgcttagtgaggtatcaggtgggccgacttacgagttacgactagagtacgttttcgttagctgacttcgatggatgctcgccacgtgtcaatcttgaatatttaaaaggtcaaccatcatatgagctgcaagaagaggagtgggttttacgttttaacacaagtactaattacaattcacaactataaaaagtagtctacactaactataccattcatgtgtccgacaaaaaaagaataaaacataagatttacttttcgattcggatttccaaatccatcaaaaaaacgattgaagtttgtaactattttgccaaactatcttgtgaaagatactaataaattcataataacaatacatcctgataaacagttgaaataagctttgacgttttaagaagaaaaaaaaaacggaataaataagcaaaagacagtgaaccaacacttgattttctctacacacgtctctctttctccatcttctacccgttataaaaaacacacaataaagtgcaaaaggcaacgaatcaactcttaattttcctcttcacaaatctctattctctctatcccatcttagaagttacgacatccaagagctcatcatcccaagttctttgttctggttcgaatggtgtgatcgatgaacaacatcatccgtggattgtcttgtcccttcaagttcaacacttgtaattaaggttcgtgcatgtaagttctctctagtcccacttctaaatctagtcaaaaatcctccatttattgatagacctcttatgtgaaattagttgaccaaattatagagatatagagggatctatcacttcttcaatggatttgatttacagatataagattattgtttttaattacaatgtggtcttctcacacaatagtctattaacgtcagcaaacgggttgcttctaaaagctaagatttctgtgtaaaatgcaaaatgagtgtttaaaaatcatttttgttgaatttgagagttgtgtattgatgaaaccgtgttttcagaaaatactatcttgtggaagagaagtaataaatcaactcaacagaaaaataataaaagaagaaaggtgaaaaaatg

SEQ ID NO: 5023 - DNA, 3000 bp, Unknown
  misc_feature (1)..( 3000): cDNA_ID_3075228_gDNA_ID_1620755_Annot_ID_166944 3000 nt of promoter + ATG
atgtacaagggttttttaaactcttgtaaagttttttaaaacctttaaaaatctcttgtaaatcttgtaaaacccttttaaaatcacttgtaaatctatttctcgccaaaaaaaatttacaaggatttttatagctgtgaaaaattttggcgggaaaaaaaaatttggtaggaaaattttagtttccaattacatgttcctattagatgaggataatttggtaattctgttcaaggaaatgagtatttttaaaaatggacaacacgaaagagtatgttacaaaagagtagtaaaaaaaaggtagttttgcaaatctccttcttcttttttggttaaaaaccataaaattgcattttcccgacacaacaataaccatatagtttctttttttgtcatcgacaacaaccctattgctttaccaaaacacacaaatctgttttctcgcaaaaaaaaaaaattatggaattttttaatagtttattcgattataaagtcatcaaaaaaaccaaaatagttaagattttaataaaaatacatatagcttaaaccatatataaattataatcaacaaaaaaagtgtactcaagaaaaagatacatgtaatctaaataaaaattaaatagttaaattcggtggtgcaaaatattagcattgattgaaataattgatgcattttgcatcggttaaaagaattatttgaattaatgttaatatgtatcagctgcaaaatatgaggttaattttacatcagttaatataaatgatgttagtatttacattaatttattaaaataatcttaatatttaatttcgttaatattaaatcatttttataataaccaatattatttaatttcattaattaatatggaagcaaaccattaaattcattttggaataatagttgctaataaactttcttatatggaggggggacataacagatattctctgttagcctgtaagactaaaaatagcttggttgctctccacctcttcatcgaaattgtttcgatttcccttatttgtgtcaatggttgtattagaatgtttatgtatcttgtaaattttttatgatatattatatttggttggctggaaaaaaaaataaaaaaactttgttacaccataaaaaaaccaaagtcgcttatataacattcttaaatgtctctttttttaagtgaaagtgatgtgggcgtagataaattagcatcatttgtttttacgacaaatgcttagtcattaataaattatcgattgttattgattaaaattttctattattttctatatgacgtaaattcatatatttatattaatattctgaaagtaatgcaacatcatcgatgattattgtatctgattttaaactataacgtacgtgcgggaatttcatattttatttttaaaaaaatctaaactaatcaaaatatttttaaccatttgattatgggtgttaaataggatatgaattcagttttagtttcggttatatcatgttatattagttattttggaacggaaagctaacccgtcttgtatttgtcataaattcttcatcccataacccgtctcgtatacatgaaacaaaaacattaacttgttatatccatcgtaaatagaatatgtgtaacaaagtatatatgtgcaaggttatgtgtgcaaacaaatttattttatatagttttcataacccgtactcataccagctagatatgaattttggaaactaataattacttaaaagtattttctgtttttatttaaatttatgaattttgtaattactattacatccttaatgaattaatttaaaaatacttaaaaccaatggtattttttgtaatatcttaccttttataaggttatattatatccaatgcttcctaattaatagtataatttttgtatcgattataaataagtaatttaaatttttaattttcttaatgcaactgcctttttctctatagtgcatttcacatatccctagtatctatttaatttttgtttatacgaacggcatattttattttatttttgtgacacaaccaaaatcaaattattcaaaaaaacatagatagcagattcaaatcatatatatgaaaattggtcaactctctatatataattgacacatcattactttaccatttttcatgtatctattaattaattaatataatctcttcaatttctaatttataagttaataatatatttattatttaattgtagtattactaaatttattttaatattacatgatttttcaataaaaccattttaatagttttctcatactcgaagattttttttttgtaatccaaactcaaagtatgagtatataataattgtggattacttaatgatttgaataagttattctcttaaattgatatttatattctcttaaattgatatttatacaataaatcactgaggatgaaaaatacgtaaggaactccatcatcagattcttaaatttctagaatccaatattaccttctgctaaataaatttaatacaaacgttgtttatgaattatgtgtatgatgcattgttgagaatatttttagaaaaaatatttttaatagtaaaagtaattgcttattgcatgagtgaatgattagataaataaaaattatatataaattaaataatacgaaaaaatcctctgcgtaacgcgggtgatcacctagtaataataaattgattccatttataaaaaggacgatcgaaaactaaaaccttatctttttaatgatttaaggttgactttctcgcgttgaattcacattttgcatttgttaaactaaatagaaattacaaatcagttaagacatattcaaatccaagtttgttagtaaaccgattcaaattgactagcaaactaactttctatagaaatgtactaaacaacttataaatagaacgtgacgcagataaaagctcctgtaagataaacgcaaaaactaatgttttgaaaagaaaaagaaa

SEQ ID NO: 5024 - DNA, 3000 bp, Unknown
  misc_feature (1)..( 3000): cDNA_ID_3075264_gDNA_ID_1620755_Annot_ID_166925 3000 nt of promoter + ATG
ttttgttttgataaagtaactttttttaacttaatattgtgattcaaatttttaaaatggacatgtattacctgattgaaaaaaaaatgtgtgtgttcaaagtttcacatcgataaggttgtgtacggctttttttttgttgttgtttgcgttgattagtaattctcgattagattgtgtatggattttattgatcgagtcgtaagttttacggtatttattttttggggcgacatgcatggtatcaaacacacttatgcctatcgctccatcaacacactccagtattttatctgactcatacattggatattttatatttaaaaatatttatatttagaagatttgattaaggtttaaaattatgtttctcctagctataacctttgtttgattttttaaaactgttttgaataatcatataacacataaagttatttttgttttgaaaaagtaactttttttaacttaatattgtgattcaaatttttaaaatggacatgtattacctgattgacaaaaaaatgtgtgtgttcaaagtttcacatcgataagattgtgtacggcttttttttgttgttgttatttgcgttgattagtaattctcaattatattgtgtacggattttatcatctaggatttaatctaggatttaacccatggtgatgatattttattttttattcacaatttattttattataatatataatttaaactttgtattacagtttcaaatttagatgtgtcaaaaaaattaatacttattttgatacattataatgctgatttttagaaaacctacaaaaaattgttattattgtttgttttgtttagtgtttaaaattgtatagttgtaatattatagttttatttatactttaaaatgtaattttcatggaggactcggttggagtttttttcatcatattagttttactgccaaatttattagtgatatatatttttatgtggacttgtgttgtgtcatgtgtggacttgccggaatatccattaggagatctatgttcttaaatctcgaagttatgtgaacttgtcaataaactcacacgtccatcattagtcatcaaaacagtatgaagtgacaaaaacatgtttaatggtgttgattacgaaacaaatctgcatggcgaactacatcagatttaacttttaactcccaaaataatgtataatttaaatcaacttcaaaaatgtaataaagacacattacaatgtctttatcaaaaaataaaaagacacattacatatatagtgtttttgttttggtcaagatgttatttaatttttgataaattctttataaataactttaatgttattttttattttggacatagttttgttagaattaagggggtgtattggttgtataagactataagttgaagtcaactccattagagataaaacaacttctgtctattttacattttgtattacattttgtatttcatttttttacagtatatatatgtattcgttttcttgaggtctttttctattctttagatttaaatgttgaatgtattttatgtacaacaaaaataggagaaaacataaactctatatatactattaagcatgaatcattacgtgcaaattcgttagtatcattttcaatcatttatttttttgataaagaatttccaatcattttcaagaaaaggttttgtttttttttttttgtcaaaccaagaaaaggtttctatgaacgaaatagaaagtagcgttgtgattcatgttgatgaatcatgagttaatacaaatgattctacagctgatttatactgataggatcaggatcacatgaaacgcaaagtaggaatgaaattattataatgaataaaattttcttcaacagtttgtgataacccaagtcagcaacccaaattgttttgtgggtttaggcctatccaatagaaccaacctcaggtttcagttcacttaaaatattaaataagttacaagactaagaagctaaatctgattgtttattagttctgtaatctaattatcattatacgttttctctgaaaatgttaactttttaatgactagtgagataaaaagagaaaactcaatgttacaaccctgtcatcaaaatgatatatagttacgatttcctctaatggaacaacaaaataatggaatcttaatgttaacaaaccaaaaaaacaatctattcttgtgtgcaattagtgctccaccttgaattctattaaaacacagtcaaaaacacaattttagttttccccaataaaaacaaaaacaaaagaaaagttgaaacgcgttcttgttgacgtcgattataaactaaaggaagtaatcaggcaggttaaagtaagaaaattaggaacaataatgccatgtaatttaccttaaaaggctcgttttactgtaacatattaatgtcacgaatacataatgtatagcgtatacataatatttgtaagaatcgattacacgctattatatggtcaagggtagtattgtcattttagtaatgttcagctatagtaattaagtactcttaatctttcttcgttcttctttccaccaaaaaaaatctttcttcgttcttctttttctctttttgatctcgtcttcttgatacgccattgacagagaaattgaacaaacacatttcttctttcatctccttccattcgtaaaggttaaaaaaaacatatttctgctcttaaatataatgtttcttgtttcttgcactccacgctttttgcttctcaatgtcttcaatgtttagtgttgatcgtttcaatctctgtttacaaaggttcaatcgatgagatccttttatctttcttcgtcttcgtccatattatgtaaccttgagatgtatgtgagagaaatcttctttgcgtgtatgatggcgtttgattgagagtgaatgtggtcttgatttcaacattcttaagttttcttgtgcatgaggtcttgttattttctaaacatca

SEQ ID NO: 5025 - DNA, 3000 bp, Unknown
  misc_feature (1)..( 3000): cDNA_ID_1826968_gDNA_ID_1620755_Annot_ID_49875 3000 nt of promoter + ATG
tttatttttgtggaaataacatctcccaccactttcaaaaataaaataagaacaatttataaaagtcactaatacaatctagagagaaggagaaattgagagaggagtttattacgattacgaattctgttttcatgaaagaagcaaaactatacaatatgttctttatatacaagtatctaacttaaccggtcaactgaacccgaaaattaatctaaagtttaaactaaaactatatgtataactcaatagtcgttgttacataatggcaatgataacggctaaatatatatgaacaaaacccacaaatgtatttccctataacaatgcagtattatatccaaaataagttcattatatttaatttccataatattattgaatcgctttaccaagttcaatttcggtgtttccaaaagacagtgtttttatttcttagtccttagaaatattctctttcctaacacttcaaacatatataatctactccaaagtcacttatatatataaattgattccaaagtcacacatataaaaaattgaaaatacgatacgaaagcaaaatatacaaaattaagtatatgaaaaagagggaggaattgttttagggcatataatgctgcttagtgaggtatcaggtgggccgacttacgagttacgactagagtacgttttcgttagctgacttcgatggatgctcgccacgtgtcaatcttgaatatttaaaaggtcaaccatcatatgagctgcaagaagaggagtgggttttacgttttaacacaagtactaattacaattcacaactataaaaagtagtctacactaactataccattcatgtgtccgacaaaaaaagaataaaacataagatttacttttcgattcggatttccaaatccatcaaaaaaacgattgaagtttgtaactattttgccaaactatcttgtgaaagatactaataaattcataataacaatacatcctgataaacagttgaaataagctttgacgttttaagaagaaaaaaaaaacggaataaataagcaaaagacagtgaaccaacacttgattttctctacacacgtctctctttctccatcttctacccgttataaaaaacacacaataaagtgcaaaaggcaacgaatcaactcttaattttcctcttcacaaatctctattctctctatcccatcttagaagttacgacatccaagagctcatcatcccaagttctttgttctggttcgaatggtgtgatcgatgaacaacatcatccgtggattgtcttgtcccttcaagttcaacacttgtaattaaggttcgtgcatgtaagttctctctagtcccacttctaaatctagtcaaaaatcctccatttattgatagacctcttatgtgaaattagttgaccaaattatagagatatagagggatctatcacttcttcaatggatttgatttacagatataagattattgtttttaattacaatgtggtcttctcacacaatagtctattaacgtcagcaaacgggttgcttctaaaagctaagatttctgtgtaaaatgcaaaatgagtgtttaaaaatcatttttgttgaatttgagagttgtgtattgatgaaaccgtgttttcagaaaatactatcttgtggaagagaagtaataaatcaactcaacagaaaaataataaaagaagaaaggtgaaaaaatgccacaagaattaatgagaggattaaagggtttggtggtgtcgtccacaagcaatggagattatgagcttgctcaacgaaaagctgaagaaacaggtttgtctcatcatcatcactgtttgttttttaaaattgtttttcataatgaaaatgaagatataaatcagataaagtaaagaaaaaagaagtcgaagatggaccatatatatgttaataatagctttgtgattcaaaaacaattacgttgggtttgatttgaatttagagaaagtcgtttagaaatttgctttatggaatatggctttcattatagggttacccaccacaaccgcaaaactattattacttttatgtttggtatggtggatatacaattcaaattttctataatctcccaaatcttttttctataacacaactattacttttaaattgaaaaaacatatttttgtaaagcttgtttaagtagattttatgtcataattaaagaaataaccttgatgacaagatggtaaataggaaagagggtgattttgtgaggattgacaaaaaagcgcatttgccactatagcgaaatgtcattaactcttgctaattcgaggactcaaagagtaattatccaaaaatagtgtttacatagagaaaatttaaaagcaaaattctactaattcagatggtcaaacggtaaccagctaaaaagtaaaattttttaaaccaacaaaactattattattattttttgtcaatagtttttatttagagatcaaaagagtcaatcttaataaatattctttacataagtgatataaagcagttcggtacgaatttttagtgccaaattgtccgttttaacatttgcattacgaattttttttgaatttttccttattgttttgaaaattctctaaatacactgaaaacaaaatttgtttatttaataaaataatcataagtaatttacttaaaaaatgtaagattatctaagtatatattccctaaagcaattagtgtattttagccaaaaatattcccttaagcaacataagttgccataagattatatataagaacagtaacaacaatatttttttaaaacccattaggaaagatattgggctttgaatcaatatctgagcccaatttatttccgcgttaagttttccgttattaataatacgtttctcgagaaacatgtattttgaatttttgattttgggtttatgtgaattgtcaaatttcgttagctctgagaagataccaagcggtggcatggctgagacagatg

SEQ ID NO: 5026 - DNA, 1177 bp, Unknown
  misc_feature (1)..( 1177): cDNA_ID_1826962_gDNA_ID_1620755_Annot_ID_49877 3000 nt of promoter + ATG
tcaagctttgaaatcgacatatttacttaacaaaaattttatgctaacaaaacaaaactgtgagatattttgctaaatgaaacattagtacgttacaattatttttaccgtacttttatgtcataatgaatgaaagaaaaagaaatattgaaaagtttatatgatatattgtataacttagcatattaaaaataaatctaacacattactaattgtatacctctttaacattttttttatcgcgatatcatatgttttaacatgatatatttctttacttacatgtatatatattattatcacgttaacttaatagataatcatcaatttataatatgttattcctcaagtatttgatgataagaatatcgataactattttattacattgctaaataatttgatatatgtgatgagggcattttcgtccaacttacataaatatagagagagaactaataatacaaaaaacaatgatatattcttaatttttgatttatctgggcatatagattaatatagcccttacttctataaacaacaattcacattagcctttgacgcaccaaattaatggactaacactcggtagtcacaactcgatgatattagacatagaaactactttgagtgttaataagagaggcaatatagccacgaaaatgttgaagaagttgagaagaacctaattatctcttaaagatccctaccattggacatgataattttaaaagcttcaatgaagatcattaactttagaattttcaaaatttaaaattagaaaattggtaagagcccctcatgacctcttaccattgcggattgtgatacgttcatgagaagttggcacgtgtgagaactaaagtgagagattggagtcacgtgtgaagaagcttataaatagtaagagagagtagagagaaaaggatcctgcgtgatcattgatgtgtaaagaggattagagctttatgtgctctgttcttgggagataagattgaagaactgtaactccaagcttatcgatttagggtttgtttcattgtaattgggattttaaggataagaaagagagattcatagtttcattcttatcaaatggtgcgttagtgtgctcggatcgaatcgaacgcaagaagattagggtttcaaaagttggggatttttgtcaatcgcaatg

SEQ ID NO: 5027 - DNA, 3000 bp, Unknown
  misc_feature (1)..( 3000): cDNA_ID_2687416_gDNA_ID_1620757_Annot_ID_49911 3000 nt of promoter + ATG
tcgatgtaagattaatctcgaaacgttttggattgtggttagacatgtttgaattcaagctgaatcatcttgcgtcatttgctttgaggagcaatgcatctcaactctttcaaaccttactaaagaacacgcctccaatctctcaaaccttaccgaagaacaagcctcaacgctctctaactttattgaagaacacgcctaggtactttcaacctcacactttctcaagcctttttgaatcattgatttgtggctgcgatttgattgaacgacaccaatctagtctcccaatgttcctttggttatggccttgtgattatctttggcgatttcgacaaatcttatccggcatttggaatatctttccaccggcagtctcctcgatggagcattctaccaaaagctcatttgcgtcaatcgcgcaagccgtctatcaccaccagttggtcgggattttctcgaagcttgtcttcgaatttgaatctcctatggcatcaaaagatttttcaaacattgcaagcttctccaagttgagcatctttttaaaaacacattgagcctttagctttcttttccatgcattatcttaatttcagtttgtatgaattttcctctttttgaggttttaagtgaatgaaagttcttttgtccaaaaaaaacccgacatattatgtttctttcctataattgtttcaaataaatttaaaatatatattttctaaaggttatgaatcaagataaacacaacaactaatcaatctccacaataactagtatatagtttgacaaaaaaataaataaagataaaagtactttttacggggctttatagatttgggtacatttaagttaaaaaagtcagaataaatcactttttgtttggtttatagagataagcattttctgttagacaaaattaccattttgccctcaatctccttcttctttctttattctttctttattctttctttctttcttcatcgcttatttctcttcttaatatttccagaaaatctcaattttttttttggtttttttttgtttttgatcacaaaaatccaataataatgaaatctataccctaagggatagtaaaaagtgaacccaaacaaaataattaaaccgatttgataagaatataagaacgctaaaacaatttccaaatttgataaaagtttaagattttgagattttggttttgcaattttgttggttcgttgtctaggtttagagatttatttgggttttgtctaatctatttatttttgaaatttatttcaatttaatttgtttgtatgttgttgatgaattttgttggaaatttccggattttcttctatatagaaaattcttcaacatgaattagctagagaatccaaaatcataacaaaaatatcaattttcagttccttaatccaaaacaaaagaactgctattaaaaatcagcttgaattttgatctggttcgggaagggaaagagatagtgatataatttgtaggtggaaaagatttgggggagactaagattaaaacggtaaaacagaaagtagaaaagtacatgaagctgtaaggcacaaaaaaaatgccgatacttacaaagggacaaggttttaagtgtttttctcataattgatcctactttatacaactataaacaaggagaatcacaagtatctttaatttgaaagatgatatatgaaatattttagatctacaactatgtatctatatatttatttagttattgatgttaagaaaatactttatttagttttattttaggtttaaaatttaatattttattggatatcatctaagttacaatttacactttgaatatatcatttaatattaatataatctaatttaataaaattaattaatatatttatctatatatatatattacgcttatatatatatatatttttaataattatatattttatttttaaagcctgcaaataacccgtaaacacacgggtttgaccctcaccaacctcacggtagagcagtcagggtgggattagaaagctttagttctgacaaacctaacaattaccactaaaattggaaaaaatgtcaaaacaaatcacaaattttaaaatttgggacgaaaaaaccatgaagttttgacatgtcatttaaatctcaaagtttaatttgactttacaataaaatggttaagttgtgttgattgagtcattttaggcatgccgtttttttgttatttaaaagataacaaagttaattttctataacatctaacaaaaagtaacgacaatgcctaaaatgaccgaatcaacaaaacgtaaccattttattgtaaaatcaacctaaattttgagatttcaataacatttcgaaaattaatatttttttcgtctcaaatttcaaagttcatgaatttttttcgttacttttaccactaaaaattgtaaacattggtaataaaataacaaaagttgaatactccatattttgtcacctacccattagatcagatctcaatgacaaacagtatcatttatttataaaatagtccaacagattttcgtcatttctctagctttacatagtcaccattttttttgtttgtttgacctcaaaaactcctacgtttctaagctcttctctttgcttcgattcccaaaacgactatttccaaaaggttagtttttaatcttcaaatccttcttcaatgtccatcttcgtgatttaatagtcatctcctttggctttttttttttttttgagtccgtactttttggattgtagacaaagatcctcccgaccaaacattttgcttccgtgaaaaacgattgtggtctctgtaagattaagatcgacattacacaaccactgatttgtcttagctttaatgattagattcttaattaattagtcattactcttgtctctgtaatagttgacttgggtttttgaaactaatgttaaatttaccaaactaaaatttttgtagggtttaaagaagtt

SEQ ID NO: 5028 - DNA, 3000 bp, Unknown
  misc_feature (1)..( 3000): cDNA_ID_1827135_gDNA_ID_1620757_Annot_ID_49912 3000 nt of promoter + ATG
ttcgtaattatatattttctttacataaatacatgaggttatataaatttaaacactctcattataaaatgtcatatattaaactatatctttatacaagcaaaatagttatataaacttatatttctgattttatattaagatgactataattttttattttttatttttaattatccatatctgtaatataaaattaaacaataaataaatgacaaaatgtaatttttgagtgtcattactttgaaaagtttactaatttatttagataaaaatagttagagataaatgtatacaatttcattctaaagtgtaaatgtctaaattttttatctctttgcaagcaaaatattatatcataacaaaatttgagttctattattagatcacttaaaagaaagagcaaataatagaacaatcttaattttccaatagtttaggaagttgaatatatttttacggtgacataacaagaatcatttaacttagagaattcttactatacttatgcataaaagaattcaacatacaatgatagaaaacatgacttagctcatctgtgcaatcgaatcatacttacaaaacaatttacaagttctacatgggccaactatagataatatgtttagtgattttagagttttctctttaccattatttagtttaaattactttggcaaaatatggatttacaagcagccaattaaatatagcccaaacacatatacaaaaaatgcatcaatatttaaatagtttaacatggtaacacaaattcttatttcacacataccattaaaattttcaaattcaaaattaacttgtgtttcaccatccataacacaaaattctattgcaattctctaaccataattttttatataacaatactttacatcattataacctaagataattttccatctaagatgttttttaatctacttttcagtttaaaactacagaatttgacttatagttcacaatattacctattatgtcataaacaaacataaataacaatcgacaattttctttacatatattataatataataaaacaaaaaatctatattaaatataaatttcatacaacacatttcttaaaatatgaaatgtcgcacgttcgtgcgggtcagaatctagtagcctataaaatgttcagaacgtactatttgaaattaggaaaaatgggagagaaagaagaatatgtgtctgtgggaaaagatgtgagataactttagaaaatcttaaaaatttagatgaaaatcttaaaaatttaacagattttgatgagcaaattgttcataaattttttttattacaaaaataactttagaaaatataagtgtagaggatcgagctaaacaatacgccttataattacataaacgagaaataaaagaaaacatctatactattaattgggaaacattgtgtgaactacaacattgtaagggtagtataagattatccaaatgaatttttacatggatagttttgtaaattaacaattactacaactaaataaatatcttggattttgttttaaaaaaaaatcgaattaaatcaaaaaattaataactacccaataattttggaaatcatttcaaaaggtttccataacatttcaggcaaatttaattcgaaattgtatatatgtaaacttatttattttagtaatatgttattagataattcggaaacttcaatctaatttaataccaaattatcatttagtttagattttaaacaatttccttaacaaaactatgttaattgtttctcattagtacacataaaaaaagattttaaatgatgatttaacatattcaaaacataatttttggattttagatttataaatatctagaaaatattttcagtatagattaaaatatttaacatttttattataatttaaatgatataaacttttaaagtattttttaaaacaggtaattttcattattttaaaaatatatcactaaactaaatttgaattataaaaaagaatatatttttaaacgtattataatagttacaagcttttggaatattcataattataagaactacatcttattgaaaggtatataataaaaatcggttttataaactacaatatcataaattaataaatcacaaattatttttaaatatattaatccaagatgtaccacaggtcaagccctcgatttttttatatattacaagaaaaatatttgaaaataacaaaataatatttaattttatggaatgaagttatatggtggaacgagtttgagttgatattaatacggaaagataatcaacgagtgatatcttaaaagggctgcctataggagcccccctcaagtatattgtttcaactgggttccacccaaactcttagcctctttctatttccccctaatcaacttaaattcttctcaattccacctaatatatataatcccacgtaattaaccaacattaatcaagctgctaaaatacgatttaaaatcataaaatcacgttttaaaattaattagcctcgattaaaccgataatcctaccataatctattaacccaaattgaagccactgtatgagaaagaggcttcaaattttcttcttaaaacccaaaacaaaatcaatttagggattagacacacaaaaaaaaaaacaatttggggaaaaactttattagggtcgcactcgcatattcttcttcttccttgcgacttttttttttttctttggtgtgaaccctgcaactctattactcgaacatcaaattcgattttctttgattcttcttcttattcttcgtcttgtggtggtgcttcgtcgtgtggtggtgcttggaatcttggtttgatcgaatctgaaacgtaatttggttggagtctcataatttccacaaagatgtcgtaatttggttgattttgtattaattttatcttgttcggaattgtatgtatttgtttggattagttgatatttgagagtgataagtag

SEQ ID NO: 5029 - DNA, 3000 bp, Unknown
  misc_feature (1)..( 3000): cDNA_ID_1827131_gDNA_ID_1620757_Annot_ID_49913 3000 nt of promoter + ATG
taatttccaaaaataataaccaatcaaaatcaacatataagatttgatatctaaattttaattaatttaatttaattagaaaaacaaaatacattattaatttccaaaaaagtaaccaattaaaatcaacaaattatattttatatctaaattatcatattatttttttattaattattatagttcacttctcatctttatatgattctatttttgcggaaaataatatcatcattataaaagaaataattagagttatttcgcatatgccacaatttgaattcttaaaaacgaatataaactgttcaatacatgaaaaaatattataacgagtgaaaaatagatttaagaaaactttctactgagtaacgggtcataatttgaaatatttatattcaatttcatacatattatattgaaaatttataatcttatatactacaataattaataacatattagatgtgattcaatttttaatacaagctggaaaatcctagaattgacgggtttagatcgatattaatacaagatggaatactatatgcgaaactcttaaattaacaatcaaagtacaagtgtataatcttaaacactaaacaatatagataatatcaacaaaacatatacaactcacaattaactatacatttaaaatcaaataaaataatatcatatatttttaaatcatctttacaataaaagtttttagtttaactaaaatacaagcctacctgcggtatactgcaggttaatatctagattatagggcttattggatctaaagacgggtcatcaaagatttcctaaactgaagcaaaatatactgaatattcaaatatctatctgttaccaaattataaacaaataagtcaatttaatattttatatacaaaatcaattaaatcttaatcacatataaaattagcacaaaaaaaattattcaacaattaaaacattatcaaatctctgtgttatataagttttgatactatattcgaataatgtaatataccttttcaatttgtattctttaactaatttaagctaactaatatatttgttaatcttatacctatcaaaaccgactatcgttttttatctttatagtatttttgcaagacttttttggtggatttggataaaagtgcattcggatcatatggtacattcccctattaaataaatatggtgcacacctatgttattagcaaaaatgtttagaatataattcaaagtcatatcattaataaaattaatattaataaaataaattggtttttggcaagacgaatttggagggacgggtttttgaatcaacattaataaaaaataaaatataattaatccaccgtttcaatacgggttaaatctttaatttattattttttaagaccactaatattaaacatatcaaatcatcctaatttagaaaagattatataaaaccaaaaatgttatgtggtatgtataatgttactatatataaaattaaacaataaaatataaatgtattagagaatgatacaatttgcaaaacttttatatataaaaaataattcttaaaatttaaaaattactactttaaacaaaaaaatcacgggacgggtaaacaaattacagaacgggttttattttggaattgggttatatggtggatgtatttgaatcaatatttataaaattttaaaatattattaatatgctgttttaatagggattaaaacttcagttttttaacaattatctcatggattcgtggtatagctttacttaataacaattataaactgtaaaataaaaatattttataaaaataaaatttgcaagttttaatatatattacttttaaaaaataaatcgtaccgcggtataccgcaggttaaaatctagtcgtttagtagatttgagaaagcggatcatttttcaggaaactgtataatcgagactaactttgaatcatttgtttcaaacgcataacaatcaacttttttttattctttataacacaaagtaatgcttcttactccgagtgaaggggtgaggggcacctggaaaaacactttgcaccaagcagtaaagtataatcattttcttgaaaacactaccaacataggcccataattggatccatgaattttcatgaaccatcaatccaacatcttatattttgatttgaactatccaatttttctctaataaactaatagctctagattcaataggatccaattgagttttttcccacattgctacttcccacaattggactatccaaagctattaatagattttctatatttttttttattttttttgtcttttgaactatgagtgattagtttttcgaaaatgttttgaagaacgttaacaatctatttttatacctcttagattctctcggttccttaagtcatatttcaatatacccattaattatcagaagagaatctctgacaattaacattacacaatctatttattttattttgatttaaacaaaatgtttgtcaagtaaaacccattgttttcttaaacaaaaaggcaccctactagctccaacgatttatcatcattttccgttatttcaaaattaaaatgaatatgagaagtcaaatgtatttatttttagtaatgtttcacgtattttactaaatctgattatccaaacagaaatcatcatgataacagataatgaattaattctataaaaaaaaaaacagatagtcaaatgatcacaaaacattaaaatcgatgacaacaaactaataacctattcaacaataatctctaatctccaagattaaaggaacaagaataggacttcaaaatcaaagaaaaaacaaacaacgcaattcttatcttttctttttcctaacttcacttccatatataaaccccattcttctatcatcatctcaatcaagaaaacataaagctaattaacaataagaaaccaataaactctaacgctcttcaaagcaaaaaaaaacatcaata

SEQ ID NO: 5030 - DNA, 3000 bp, Unknown
  misc_feature (1)..( 3000): cDNA_ID_3075380_gDNA_ID_1620757_Annot_ID_167042 3000 nt of promoter + ATG
gcccaaacccacctctttaggtccacgtttttttacataggctctaatatcaattgttggactctccaagcccaaatatttttctctaatatgatattgtccgctttaaaccaagaggccaagcccacacgaatttgtttttgaactcgtaaacataaacatgaaaagaacactattttatatttaaattaatttaataaatgctcttttctataaatggctacacatattttttctcagaaactataaatcagtatttcctcttactgatatgaaatagaatataatttatttcaaaaatatctaaacattacttaatatatacaattatagctagttttctatattattataataatatgaaatataaataaatcaattacaactacaaaagaatttaaacatttctcaatatataataaacaacaattaaaacttattttacaatattattttgaaccattcccgtgtgactgtctctagtatgatatatctaaggttttttaaatcatatgcaacgatttcaattatttttttctaggctatatgtatgacttaatatattcgcttagaacttctcttttggtttttgtcgtcaaccattaaaaacataattttatgaactgaacaaagtgaaccttgaatattttttacggggtttatatgcttaagcttcatattgattatatagcaaacgttgcaaaggctgtttctataaacgaaaccctacatcaagatgatgaagtcatctctataactataccaatgtgtacgacttagagtttcgtttatagaagaagcatgttcatgtatcggatcatacatttcaaaaacacggtttgatacggcaacgacgacgacctttgaggttgatgaagaagaacgtgtcccaatcgattcaggtgactttgagtttgtctcctacatggactgagcttaattttgatagttgcacatattcttcttataagaacgtttatgatgtcctgtaaatccctgtttcatgtgtcttttgtgtttatcaatatgttttgtgtggattagtgactagttctttttcttcacaacgttttatatagtaagagtcatgtttttcacaatatggaagttagagttggagctttatatgtggcaggaacatccagagttctcctatgtgatcttttgtgcttcaccatcacaaagctctaatactaaggtaaacatgttacatatctctgttttgtaatgtttttttactttagaaaatctagctaaagtcaagtgttttgtaatgtttttgacatgttacatatctctgttttgcaatgttcaagtcaagagtttaagtttcagttcaactcttgacaaatgcgacaagatttgacatgatattgttggtgtctcacaggaaaagtcaccaagcagtctgtaacttgaaaaacgaatttaaaatcaagaagcaagactctgagatctatgctgctaaggtaaacatgtcacatatatatgttttgtactgttttagaatttctgttttaagtacttttgacttaaatgttttaagtacttcaagctaatacataacgtttcacaatattccttgaagctaacacttcatagaaacaaggtacaacttcgtcaatcaaccaaacataagttcttctgcctctaaagaccgtgggccggtctgtctaactgttgggctttgcggggcgggttaggactcacttttcaagaccgcggtcgtctgcggtccggttcgtcgcggatcaatggaaaagcgagcatgttgcggtcggtccgttcggtcgcgggcacgcccgtctaccatctctaaagttatgtaaaccaaaattcaattcttttgtttcacaattactactcaaactacatttttcatagtttttttttaataaaactcggtgttattagttatactatttgtaaatatcttgtaatcttaaggttatggaactaataaaacctcatataaattaataatcgataaattaatacccgataaattaatacattttttctgtcctaaattttgtttttggatcaattgataaattaagaaaataccatagtctcatctatattaaattattaatttatggaaattttactgtgtatagttttaggaaaaatataaaaataataacaattttcttaatttcacaaaaaattactaaaattcacgtttagttggaaatttacgaaccgaagtattgggccttaatggtcttgggccaacatcaatctctcgccgtcaaggttacatttatcgccgccgctgagaccgccacctaagggccgtctcctccgcaatctctaaccgaaactctctcatctcctggtaagctcgattttcttatcaattcgatctcatatgatgtcgatctgtttctactgaagctaaatcttgcgaaatcgatctttgttttgttctgagatttagggtttcacgaatttgtattctagggcttttctcgattaatcatttctattgttatttgttcttattggttcttatgcttttgggtacagaaagatatcgactttttgttgactctgtatgcaaatttgtcaaaagacaaaactttgtaacagtttactctctttcgtgcttgtgtttatgtatgaacaatagcttcgctattgggattgttgatttcaccacacttgattaagtatgtacatactattgaaaatgttatagttcgttaaaatgtgcaatcttcgaatttctctagcgtccattgttcatgttggtgtgtttatgttgatatactcacccacacacacatcaatgatatgcattgtacataatgcattttgttgttgtctctttaagattttagctattgaggatcgattaggggaagtagctcttttcctttccttttctggtgaatactaatgatgcaaagcttgaatctaatccctgtattattttgtgctgcagagacagatagctaatttgattgagtttggttacttgcaagtgcaaatatg

SEQ ID NO: 5031 - DNA, 3000 bp, Unknown
  misc_feature (1)..( 3000): cDNA_ID_2052620_gDNA_ID_1620757_Annot_ID_167023 3000 nt of promoter + ATG
actccgattagcgatggaaaaatcctggaagcttgtaggccgttcacgaggatgattccacagatgatgagtgaaattcttcctcccgaagtttgtatcccgcaatacgaccaattttcattccggcggaggcacatgacaaaggtccagcaaaatattatcaccggggactgcggcgtttacacgttaaagattcttgactgtttattgcttggtgtttgttttgatggcattactaattcaaatatccagggtctacgggttaagatggcagcagagatcttcgatgaactacctgtaagaatgccccttcagttttttgagcagtgatttgctttttcgaacatgtctgtatcttttgggaattttagcatgtgattgtactaaatatttacactttaggattgataaccagaattatgtctgtatgaatctattattatgttaattataacaaaaaccaatgtaatggctgacttatcatcgctcgatacgttttacggctgagctatgctaacgtaagggctgacttgttatcgctcaaatcgtgctacgactgagttatgataccgtcacagctgagttatcgttgtttaattcgatgtttagctgagttattctaatgcggtggctgacttgtcatcacacaaatcgtgtgatggctgagttattctaacgtggtggttgacttgtcaaacccaaacttccatcccatcaaagaaaccaaacgtcactgtaggactatacatacaccggtttacgacaactgaatagtcaagaacccaaacgtcgttagaggaccaaacgtttgattcatagggatacaaaataaaagaaataaaataaagaaccataactcaacaaaagatgtttacatctgatatttcatacggacaactgaaaaaaagttttccggttgtaacaggatcacgagaagtggcaacgacaaccttagcattgcaatcacactcgatcggaacgcccttatcgcgcctcctgttttcgtcgtacctcgttcgcatccttatttccatacgatcgagctcctacattaacacaaacacgatatactccacgttagatgggtaacgatttgtactattcagatgtgaagataaatacctcatcgacactagagtcaccgtggaaaagagacccttgagccatcatcttggctgcaattagtatggtactaaagcactgattctatatagtcgtgtctgctacaaaaagcactaatcaaacgacggcttcttgtattggctgaataaatttagaagtggttgagttataaaagcattgcggctgggttttcactgagttgtggctgagttatgtcgggatacaatatgttattacttagcgtgttgctttaggttgggtttatcaaaattctttattatatcattatcgacataacaaacagcatctttatggggaaccgccagtaatgattgggtccacatgcacaggaacacaagccagcagttaatattcaaaataattcgaacgtgttcgaaattattcgaataactaaaccctcaaataatcaaattttctgttttgcggtagaatattataacgttacggctgagctatgccaaaaaatttcgtggtttgaccgagttatgagaaaccatatgttattatgacattttaaaccagccatcaaattgttggttatattagtagcgtgaagatgtgtaatttgaaaacagaaaataacttttattttcagtaagtgtcgattgacaaactatgttggcaaaacttctaagaatgatgttgttggatagagtatgatgttggataaagtaggatgttggataaagtttataggatatgagctagtttcacgattccactatttggaatgtggttatgatatgtaaattacttgattctaccaactgttggctcaagaaaagcactttcagggtttggccgagttataacagttatatggctgagttattcctgagttgtggctgagttatgtcagaagatttcgatgttcgaactacttatgagaaaaccaaatgttattatgagatttgtatacaagcattattgttggttctattgatgtcccttactcaggtagaatagaatattgctgagttttgctttttgctgagtttatcaagaaacaattattatgttattgtcgagattaaaaaagtgtttttatggggaccgccaataatgattggtttcatattcacacgaacacgtcaaaagataataattcaaacgagtttgaattgattcgaataactaaaccctcaaatataaatgttctgtttggcggtagaataccaatacgttacaactgagttattgcagaagatttcgtgatatggccgatttatgagaaaccaagtgttattatcagatttcaaactagccatcaaattgtaacaattttgtgtcaaaatttaaaatctattatatccaaacagaaaataaagacacaatgcactaagtgtcgattgataaactatgttgaccaaacttctacgactgatgttgttgcgacttcccttttgttggatagagtatgttgttggataaagtaggatgttggatgaagtatataaaaaatgagctagtttcatgattccactagttggaatgtgattatgatatgttagttacttgattgtcccaactgatggtttaagaaaagcaatttcagggtttggccgagttataacaaagtgatggctgagttatgcctgtgatgtagctgagttaggtcagaatacagagaaaaatagtctctgttattgaccagatacgacgtcggtttgttccagagtctctgttatttaccagatatgacgtcgttgtgacaaaaaccaaatgaacacgaacacacttataaatccccaaaatcaaaccctaagttttaaaattccaatttctgatttcagatctggagctgcattccttcttgcttttcgtctccgaatttcccaactaaaaattaaagaaatg

SEQ ID NO: 5032 - DNA, 3000 bp, Unknown; identical to SEQ ID NO: 5029
  misc_feature (1)..( 3000): cDNA_ID_2052629_gDNA_ID_1620757_Annot_ID_167019 3000 nt of promoter + ATG

SEQ ID NO: 5033 - DNA, 3000 bp, Unknown; identical to SEQ ID NO: 5028
  misc_feature (1)..( 3000): cDNA_ID_1827135_gDNA_ID_1620757_Annot_ID_167018 3000 nt of promoter + ATG

SEQ ID NO: 5034 - DNA, 3000 bp, Unknown
  misc_feature (1)..( 3000): cDNA_ID_1827127_gDNA_ID_1620757_Annot_ID_49914 3000 nt of promoter + ATG
cttcaaaatcaaagaaaaaacaaacaacgcaattcttatcttttctttttcctaacttcacttccatatataaaccccattcttctatcatcatctcaatcaagaaaacataaagctaattaacaataagaaaccaataaactctaacgctcttcaaagcaaaaaaaaacatcaataatgaagcaatctcttcttctatccttcgtgttactactactctcatcatcatcactcgtgacaccaatccatgcacgtaacaaatcaaatccggcaaagtctcctgttggtgctccagcaccaggaccatcaagttccgattgttctacagtaatatatagcatgatggattgtctcgggtaccttggtgtcggatcaaacgaaactaagccagagaaatcgtgttgtactggaatagaaactgttttacaatataacccacaatgtatttgtgctggtttggttagtgctggcgaaatgggaattgaactgaatagcacaagagctcttgcaacacctaaggcttgcaaactctccattgctcctcctcattgtggtgattttttatatttatttctattgtgtctcaatattaagtttttttttttttttgctttcttttgccttatatttttagggtttgaaagtaatattttctttccttgcaggtataataacttcaggcgctacgacaccaggtgcatctcctggtacgtgttgacttattttcatgttatggtcgtaattaagattgaaggcttttgtgttttgttccccttgaggattgtctctaggaaaatgattgaacaaatataagttgaaaacaaaatgagttaatagtttttgaatgttgaatcattttttcagttttttttttttaatttcaaatgagaaaaaaatttggtcagttagattttcaacccagttctgttcctccaaatgtgggtctttcatttactttttacaattgactaggtctgggcacgaagcggatatccggaaaaattgtgatatttgttattcgattcgttttaaccgaatacttgattttgtgatttgctttacttcgaaatttccagatatccaaaatttcgaatatccggaattatttgtgatatttgcgaatatccgctttgatacatttaaatattaaaaaaatctgtaaactatataaccatatcagatattcaaagtttttatttaacatgctttcaaaataagttctaaataccaaacataactattgttgatttgtggtacttctattaagtttcattttgttatcaattcatatcaattagaattttgaaatactataacacattgcatttgtgtcactcctttctgttttttgttaaataaatagtgttttcgtatgttacaagatataacgtatgaatgataaatatggatgcagtttccccatcggctggagcacctacgacttcaccatctgcagccaagtcaccggaaacttcggcaacttcgccatcttcggatgagacaccgtcaatgactgcaccttctccttcatcttctggcacaaacatcctctcagttcctgcactcaccattgttttcgttattgtttcttctgtcgcttacatttcggccttttctaattaaccacagcttttacttttattttctttgtttttgatctatgaattgaattctacattgttatggttgtgatttggaagacatgttatgtttttttgttgcttttaatcatgcaaccgtaatacaatgtgaaatatgcgctgggctgcttaatttgataagaatataagaaatgggacttattactttaaaaaatatctacaagatataaaattaaatattacaataactgtctttatattaaaagtatgaatgtaaagcttaattaaaatattggttaaacaacattaaacaaaaatggtttcgtgtatagaagaattgctctttatctatatataaaaaaacattcaagaattgtagtcctcggaaccgtttttcccaaaaatgaattccatcaaataaagaagatttactttgatgggtaacaaattaggtgttattaataaaacaagacaaaacttttttttaattattatgatatttttgtctttttttttaatacccagcgtgtctctactaaacgttactggaaaaaacataattatatagaatgccactgccacgtcaaaatttgctgacgtggattaaatgaactcagccgtaacgcgatacagcggcagttacgcctgagttacggtatattgcggctgacttacgacaaaaatctatgagtcataacaaaacggcgaagtatgagtagaactcagccagacgttacggctgagttgtaatataacccaggcaacggtatggttgagttaaagaatgttggtcgagttataaaaagttatacgataacccagacaacgttatggctgagttatgataaaacggctgacttatttccgcgacacggccgagttatatttttggacggcttagttatggaatgatgtgacggctaagttatggtcgagtgttataaatcagccgctaatagctggattacggtaaaactcagccttgttatggctgacttatttgcaaaagattaattactataatagcatgcagttacagccgagttgttaaacgttacggctgagttagtttagttacgacataccacgactgacttaactttgtttttctcctgttttaattactgtaatagtattcatgttgcgactgacttatagatttgcttgatggttgtgttatgaactgttcgtttggtggcttacttgccacctcatcacttcaaaacgacgtaggctgtaattttccatgtcatcattccatgtcagcatcctcaacggaaatacgaaacgtcccttgcttctttaactcgtcttcccagactgtgtttaacgcctgaacgttacaacttcttcattcatcttctcatacatcttcaatttctttcatctttctctcgat

SEQ ID NO: 5035 - DNA, 3000 bp, Unknown
  misc_feature (1)..( 3000): cDNA_ID_1827123_gDNA_ID_1620757_Annot_ID_49915 3000 nt of promoter + ATG
aaaacaaaccctgaactaaaacctgttaataaacttaaccccacagtaattaaatattaatgggatattaatttccaaaaatcgaccaaagaacaatgacagaatccgtgatccaactgaagatcgtccacctcaaaaagttccttatacacgtgaaaaagttcaaatggtaaaatagagaacaatgaattatgtttcacaagatcttccttttcaaattatttaatttaatctttgcatatttagacttgcagcaactgtcaacaagtcggacacaacaaacgttcatgcaagcgtaaagcagtgccaaaaccacccaagaaacctcaaagacgaccaaggaaaaaacagaaaacaatggatgaagagaaccctatcactcagccaatacaatcttctcttcaaagttaatgcttgacaagtctttactttagaatattttgtccctctgaaacgattgtttttttttgtgacaaatattgttgtgttgcaacagcttcgatagttatgttggttggatttatttaagcatgactctttggattattttaagttgttgtgtctttctttcagcttctaaaatccaaactaattaagcaattcaaaatcatttagaacatttttttgtaataaattcaaaacagttttaaagaacatcatgtggtttttgcgctaaatacaaatgtctcattgtttttttttttggaaattaatatcccattaatatttaattcttaagtttattaacaggttttagttcaggatttgttttactaaaaacatagtttagggtttaaaaatggatctggccaaaattgagggtttttttcattaaattcccattaagagtgggattgatgtatggtttaatgcaatgtgagaattttaatttttcatcactaacttttattaatttttaaataatttaaatttagaataatatgtggctctctctactgtaataatgtgtcattaatatggagagagttggccaactttcatgtatatgattcgactccaataaatcgtgttatcatgcattatagggattgatgataggttggaatttgtcaatccaattgttgtataaaaacaaaaagaaaaactaagaaaccaagagaaggtcaacacaagagtctcatatcaatctatataacatatcagatattatctgcatcaacctaaatagttaatcatatttttaatttactaattggcatttttaaaaatagattaagatttgagtgactagctgacagctagatactgttcataaagccgcttaggagggtatatacatccatcattgttctctggcataagattgacattaataagattgattaaccaaacgttaaccatagctatgaccaactaaacaataatattatactacaactaactaataattaggcctactaatagaaagtcacaaaattttctgattaacgtttctatctacgtgatgaaaacataagtgaacattagaaattaaagtactcaatgactcaagtacacgaacaagttgggccggggcaccaacatgttttcctactattcctcagaatcattttttaaattggtaacacaaacgattatgtacacaatctagctagcatgaacgaaataggtttcagtctaaggcaccgattattttagttacgagttttaaaacagtgaaccatctcatttgaaacgcgttaactcacgttaaaaattttgaaattctctaaactaatgtcaaatttggcttgctcaaaatttaatggttactcgaactagagcctagacgatgatttacggacggtggtcttcgaatttttcatttgcctttccaatactcagggttggtccagacctaaagctcagcaagcaaatgttttaggcagcaaattttatatcaattttaaagagaacaatatttacagaaacgtcttataggtagacggtggatggttcgatccttggcaaccgaaaacattaactattttctatgtttattgattgtaaatggacatcaaattttattgggctttagacatgattagtctttgggccggtccagccagcacagcagtactgattataaaataagtcacaatctttttttcaaaaaggtgaacttcattcatgtatcaaagattataaagtaataaagatgtattatacatgcataactccaaaaatagtggagaaatgggtacctgtaaatttccatcaaattgttagtgtatgtgtttcagtatttggtcgtttcatgctacgcacgatatgctatcaaagttagaaaacgatttcaggatgcataatttattttagaaataattcctaagatagaacacaattatatgtttatttctagaatagaacacaattggaggttttttacagcctcaaccaaccttaatcctcctgcccagttaatggactgtcttatctggcttttatctccctcaagggataaaaatatttgtctcattatcaggcttgcctttcaggcttgtgtttatgcaatttggagagaaagaaaccaacgtctccactccggcgtctctcgctctactgagtctatcttgaaggacatccagctcaccattcgcgctcgtctggatcctttgtctcgcagcacggcgcatctccctaacgctctgtccttgctaggaacttggttttctcttttctagttcagggatgtttgttttggttttccagtgttgcaggtttcgtcttcccttttgtttcttgcaggagcaggtttgttctcctgtcttgggcctgtggtttttatttgggcttttgtcattatatgtttttagttgaatggaaaattatgaattaaaaaaaaaaaaaaaaaaagaaacagaatacattttttttttattactcacatgttttcagtagttgtgtaattacaattaacattcctgattagttataattaattattattatttaattcgttttaactaaaattaaatgaaaaaacagtgattatacatg

SEQ ID NO: 5036 - DNA, 3000 bp, Unknown
  misc_feature (1)..( 3000): cDNA_ID_1827119_gDNA_ID_1620757_Annot_ID_49916 3000 nt of promoter + ATG
ggcgtgataaagttaatgctgatgtatatactcaaaaacgttaactacacactcttctttcatggttaatgctgataaaacttttacaaacttcaaaacaccaataaacaattttctagtactatgatattttggaatataaaacctgttcttgaatgacagatttctgaaaagctagcaaaatatcattgtagtaaaacatgtactagttcaggattcatattagaggggacattatagagactaagttcaaatagagaaagtatcaatgtgagacagaatagctacgaactaaaattaccaaaggagtgcgaggtctcattgatcgtccacctgcaagtccaatgcttggcatgccactagtatacgactcatcataatcaacatcactttctccattggatggtggctgagctactgcatgtggatgcctcagtggagggtttttagtctgtaatacacaaagtgaaatatcaagtttaacgaataataactagcaagaacagtaaggatatcaaaaatttcactactagcaacatgactctcaacattcttatagctgatatacaagtacaagattcaaaatgagtgtgtttaacaaactaattaccagaggagaacgtgaccgtgcagcccttccaccaggaagtcctacacttggaatgctgcttgtataaacatatggagtctcatcatcttcgttatcctcatctgctcgctgatgagctgccatcaccggacgcccttgtggttgggttttgttctgtgctttccaaaatattgaaattttgagaaatagttaaaatatgaaaataataataaaaacctagaaacaacaagtttcaagagtcgatcaataccatagaagattgtggccgcatagccctcccacttccaagcccaatacttggtctaccaattgtataatctatagaaacaacatcatcatcatcattaccgtcattcttatttccttcgtttgttggttgtgtacgtctcggaggtgcaatcttagtctgcaccaaaagagtaacaacatatgaaagctgaaaccaagatacacttggcaggcaaaagaacttaaaactagactgaccatcacaggagactgaggtctcattgctcttccaccaggaagtccaatacttggtctactgctcgttacatccactgaaaaatcatcatcctcattgtcctcatcaactaactgtggagttgccatctgttgacgccttgccataggattcctaatctgtcagtccagaaaacactatcacataaaatccctacattgcaaaaccctcattacagtgaaaaagtgagtctgttaattttaattaccacaggagagcgagaaggatgagatcttccagctgcgagtccaatgctccctgttccgatagcattatagtcaaaggaaaggtcttcatcactatcttcctcgtcccctgtttgatttgacatcacagccgcaagtctctgagcagctgcttttgtctgagctttcttagcattcgaagctggcccagcatttgatcctgaacgtgtatgacgatgcattagaggagacgtcatcataggcgaagatggtgttcctggttccgtactcttattcctaacatgaataggtctcgtgtttctcatcgtcaactacaaaaattaagcacattgattttcatcatcacattcacatcaatggcagtttgattggaactaaaaattccacacattgaattaaaaaaatagttaccaaatttgtcaaaattttggaaatcacagaaaagtgaaatccagaaaaatggaaaaagaattaaatgcgtgaattaaacagaaccttacaaaattagattcaacagaaatctcaaagaatgtttcaaaagaaaaagcaatgaataaatttgccatttatggcagcacatatttctctctctgactgatcttcggtcatttagccagaaattgcgagtggctttcaacggtcggattgagaacagtttcttctttaattatttatactttcatccccaataatttattattgttatcgatagtacctaaatttatttattttatagttttcatcccacgattgtgtaataattatccaaagtacccttttccaattataatagcattatcatctttttgtttatggtttaggtacagtttttaaagttttctcacggtttgtaaaatagaaaaaggaaaatcaagtaactaagagatatattatttgatttgatagttagctcgtaattgtttcgtctaccacaacggcatatagaaatttatatttctagttatgacttatgatcagtgattatagcatatgttgtatgataaaaaatatttttcatatagtttttatttcttattaaattattaattacttattaggcaatacatattttttcatttattacttgatatctctaacttttgctctctttgtaatacgtaagtgtaacttatctctgtgttgtttttatgcttggcaacatcaatccttaataagatagatgagctttttatcatatccgaaatagcctctaagcagcagaaagatgaaagagatgatttagccattccttttgctagatcaattctcaaccataaagattctttgaaagagatgagactgataacatttcgggatatacaaaatccttggaaaaggtgaatgatgcgtccttattactatttattatttctagagttaaaacataaatatcatatttgtttttttgttcggtaggctcttgagatacttcaagaacaagttaagatatctgagagactatggttgtgcaagagacttttctttcccgaatgaggatgataactagcaagcagtttaaccaaaaaagtttaaattctttagtacttgaggtattttattcatgtaagattttttttattatttctcatttcttcagtgttattgcaatagaatggttcatctgtttacaggtatgctcttaagtcctaacgaatgcaatg

SEQ ID NO: 5037 - DNA, 3000 bp, Unknown
  misc_feature (1)..( 3000): cDNA_ID_1827111_gDNA_ID_1620757_Annot_ID_49918 3000 nt of promoter + ATG
atatgtatagtgttttttattacagacaactgtatatcgctgttaaattatctagttatgccagttgatatattaaaaagttagatgaaagtctactcgcagaatcgtatgttatgatatatgaaattttgattctgtataacttggcctaagaaagaggctaagaggcatattaaacatcaaaagaatgagtatactaataccactattgaagaaaccatgaaggagacaaagccttaaggattgaacttgaacctagacattattagggctaaatgcattttatccgacgtggcggcatctattcagattctgggacccacgtttcacaacctattggtcaagaatctgttgcttacagcgcaaatactataatcaaattgttaagtcaacctctattttatgttgccaatgcacataagttgttttcaagtatagtaatacaaagaacatgtatagttgctagatattatataattttagtttatctctaaatgttgtcccagaaatataaaggaacttggacaaaacaaaaacatgggaggacaaaacaattgcacatcaatcatttctaatagattgcataaaataatatatgttactaaaataatctattggcagaagatgaatagttttgctacatatttctattcttttgattattttataaaagctgtcccaccaatagacctttttaatggaggaactttggaagaaaaagaattaagaagaaagacgagaagatttatatgtgacatgaaaattgcttacaatttcacatcataagcaatttcttcaaatatctaagaaagaattaaaataaataagatttatccacaaaaaaaaccaagaaaatgaagggcaattctcacaaatagctgtttctttagggtttagtatagttgaatttgttttatgttcctataaatgacacaatgaacctggacggagtgagagagaaacaattctatgagcacacttgtatttgtacaatttaatgggatgacagcagtagaagacaaaacagttgtaattgtactacacctttgactttccattttcatgtccaaagtttccccaaataactcagatattttttatatttgtttttgttaaaatatatcttttatataaagaaccaaaataaatcatatcaattaagaaaaaagaatttattttgactgcttttataatctttaccattttgtcaaaaaaactttcgaaatttccattttaaaaacggccaaatggtaaatttgaaaaaatgtagaaaaatggcaaattttattaaaaggttgagcaaaaaatggctttttggacaataattcaaaataaaatggtacctccaaatggttttaaagttttaatacgtaattcatgggtcaatttgaaaacttataattttctttaactaacaaagtaattttaggtgtaaatttacaatggtacctccataatactaatatttttaatatattttaaaggcaaataatatgttcttatgataatgatgtagtatgatgctattttatctaatctacaatgtgttgtatttataatcactcatagttgagatattttattttaaaacatgttatttaataaaataataacaaatatgtgcatgaacttttggtggaaccatgcaaaaagttgacttccatgcaacaattttgtttttccaaacttgaaagatgattgccatttcttataattttctttaacttatatagtaaatttaggttgtgaataaatcgaatcggattgcaattcggtttactatactagatttttggtttggtattgaggatacaagactggaaacaagatctaaaatatgtgtagttgtggttctgtatgaaacttcgtgagacatatgttatttacccaaaaatgtataaaaaaaagttcagagtaaagattttaataacagatgtacattgcttttgtaattagtgatcgtgaatggtacaataataccatattcaaaatagtctttacttgcctcatgtgtttggatacgagattactgaacgttgtggtgtattttatagtcatgggtttgttaattgttatcatgcttgcctacttaactagcgtaattatgtttttttgtactacctcggaagtagctattttgtcgcttattgacaacgagatactttaagatgttccacatccacgtcgtaatcggttgatcgaatggtgcctaatagatcaaagttatcctcaacaaatatcgatgtgtagtatatacgtgaatatatagtagtctcttgcatgcatatcatatacaacttaaatactctttttgtttcaaaataaataatgttttaggaaaaagattattgtgtcaaattaagtgttggtctattcatccaaacaagaaagaaaaaaaatacgaatttgttttatatatcattgacgaacaatgtttagctaataataaataattatttatttataaaaattaaaagttagatagtttcttaatttaggtgcatataagttctttaacaaaaaaaacatttaggtgcataagtcttaaatatcaaatattttggaacagtaattttatgtataacttttttcgtacctatcttcacaccgcataaattgccaaagtcaaccttttgatatttcattcctcacaaaaccatattaatttatacacctcaatattgtttaatagtattatcatgttggctttcgctgaatttatcaaagtgcaacatgttttatcttacaaaaaaataaaaagaaattcacgttgtgtgatcttgagagttgacttttaaatatatcacaacttatataaatacgcagcaacattccaatctctcaagaaaatctacagttcctccaaataataataccctccctctaaggtttaaaactatacctcattaacacattaagaagctagtcattacttcatttctatattttaaataatgtttattgataacaattgcaggcaactaattttcagcaatcatg

SEQ ID NO: 5038 - DNA, 3000 bp, Unknown
  misc_feature (1)..( 3000): cDNA_ID_1827107_gDNA_ID_1620757_Annot_ID_49919 3000 nt of promoter + ATG
gattaattccataatcagctaagaacttgattaagtggattccttttgtcaatgatttaagggatcttatccatgaaggaacatgtgccaactaatatgacttccgatacacttattctaacttatagaatataaactatgattgtttttttttttttttgtaaaagatataaactatgattgttgtactaacgaactaaatatatatatttttcatcgtaaaggaatatgttcgttcatatatggtttcgtctcctaagctgcaacgtgttggcatgacgcctttcttttttttaatccccaccaagatataggaattggaatttaataaaagtaaatgatacaaaaataaattcttttctaaataggtattttgaaatgtatacaaagtttaattaacctaaggaaagcaagcttgtcggtaagatatttcgggctgcgtcttgctctagtgagctatcaaaagaaaattgagtggtctaaagcttatatatcagctgttctcgtggatttaaaagcatctaactatcatagtttttggagctttgcatgttttctctcgaaaatgtcttcaaataaatattataagtaaaaggttgggttggcgatctatttcccggcaagaagtattatatatcatcgaatgcagatccaactgagccctagtgtgctatatttacccgaaaacaaagttcaaaatctatatctctctcaaataaaagtttaaaacctagataacacacataatcatactttggaacctctagccaaaaaaaatggatttagtcggtttactgtttgccaaacaattgttaaccaaatatgatactaaacggattttaaacccaattacaatttacaacaaataatcgtgaaaatataactccatattggatcttgatgaaacatttcagccaaaacattgcctaagaaaacatcaagttattcttgtttcataatttgtgtgatcgttttaaaaaaataaactgatttaaacgattacacaattttcttttaaatcacagttatttcctttgaaattgtgacaaagcaattatttgccaaaatgtaatttggcatttttaatcaatatcatatacaacgcaattccacaatttttaacaaaagaacacaatcaatcaacatatataaaaacatagttccactttttgccaatcgcggttttttaatattgaaaaccgattccacaatttgcaaacaattgtgtttctctagcttaattttaatttaacgtgtttgttacataatcgatgaaaatgttgtttgagcaaagtcaccttatcaaaactgcaattggaaaacaaagcaaacatgttacgttgcattaaaaaaaaaaatgttctattgaaataaattaagtgctgcacaaaaaaaaaagtttcatttgcaactcagcccagcccaggcccaataagaaagccaactacaggcccacctatcatcaaacagttttaccttgtcattcaaacaaccacagacctcaacgaagacaatgacaacttcttctttttttgacagcgacgacttcttcctcttcttcgtcatttttttcgattaaaaattgaaggattatatgtgcaaaaatgcttttgatttatcttctgattatgactctcgcaggaccggcttaatagaaccggagtcccggtacaaaattttaaaattggccttgtttagtactaatttttttgtatacacaaccatatacctacatataaataaaagataaaaatatatataaaaatttgggccatcttaacaacataattacaaaaataagaagagtatttgggattttttaacaacataattacgaaaaaagcatttgaacctttaaatttgctcaaaaagattagacgtggaacatttgttccataagctcctcctcaacgtcggcactggattctgaagcagaaatcaaacttttttaaaggttttccttagaaagctatcattaaatatagctctagttataaaaatcttgcgttttcatataagtaatccacatttttatacctgaacatatcaaattgggttctagttgcagttatccatcctaaaaactcatacataccacataccacataccacataccacatatatacgaatatttgaacaaaaagaaataaaagaaaggaattactcaagcttttaaaccatctcttaagctcagttgatatcttagataccaaggtgcttctcgaagttggctttatatatctctaaaacaacacttgcactatcagaagcaccagttatgatctcggctatcttcgaatcgagtcccattctattctgccactatttttgaaaaacaattctgacgtaccactccttgatgtgcaattacatctctctccttaatgaataactgaggagaatttccaaaataaagagtaaatgatttagtaaaaaaaaaaaagaatcacggttacttacgttcatcccccaaaatcgcgaacctactctccgacgtgatttttttttacttcgccgtcggcgacttgagctccgatttcgccggcgatttgagctccaatttcaccggcgagttagcttccgagatcgccgtagcttccaagccgataatctgctcccaaagtgagcttcctcctcaacggcaaaagtaaatccgatctccttttgatttgtagattaatgtgaatttcttattggagttagttgttaataacataaaattgttgtattgttcattatgggctgttgtattgttttgaaacaaagagtttagtgagtgttcaatcgaaattaacgatttgtgaaacccagaattgacgaactaggacaaatggtaaaactgagatataatagtataagcggtacaaatgttttattgagatacaataggacaggtggtacaaatggtattagtgagttataatataggtgcaattatgtctaaatctgaatgattacgtaattgtgtttttataatttatttgtaattacatgagacg

SEQ ID NO: 5039 - DNA, 3000 bp, Unknown; identical to SEQ ID NO: 5030
  misc_feature (1)..( 3000): cDNA_ID_3075380_gDNA_ID_1620757_Annot_ID_49922 3000 nt of promoter + ATG

SEQ ID NO: 5040 - DNA, 3000 bp, Unknown
  misc_feature (1)..( 3000): cDNA_ID_1827226_gDNA_ID_1620758_Annot_ID_49925 3000 nt of promoter + ATG
cttgctgcagactccggaaagttatacagaacaagctgcaaaaaatgtgagggacatcactgcttctgagcagcctagcaatgctgcaaggaagcggatatgtggtgattcctttatccaggaaagcagtccgaatcctaagactcaggatccgactttgctgcggttgatggagagcctccggtcagatgatcccactgattatgttaaagcacagaaccatcaggtgcattctcgtcttacttcataagttgactattttagtttatcagttatgagtattcttaatcacacatttacatgttaatagatggtgtacttcagtttttgggtaatctatagttttgttctgtgcttgagatcaaacaacttaagatgtgtagtgatcttttgtgtccagcagttacccaaaagtcatacagaacaagattcaaaaaggaagcgtgacatcaccgcttctgatgcaatggaaaatcatctgaaggtccccaagagggagaataatctgatgcaaaaatctgctgatattgactgcaatggtaaatgctctgcaaactctgatgatcagctaagtgagaaaatctcaaaggcattagaacaaacatcatccaacataaccatttgtggtttctgccaatccgctagggtatctgaggtaaaacctttaaaagtctttgccatatcctctgctctagaaactgagcttctctgtttgtgaagtattttactcaactggctggatcaatatttgttaggccactggagaaatgctgcattactctaggggaagaccggtggatggagatgacatcttccgctccaatgttatccatgtccatagcgcatgtatcgaatggtatagaaaatgaaacccaaaaaacttctacatttgctcatctttgtttctgcaagtccatgtggatatagtttggctagtgttataacgcttttggcttttgcatgataaaaatactaaaagtagttgaataaatgttcagggcaccgcaagtttactatgaaggtgacacagtgaagaacctgaaagcagaactggcaagggggatgaaaatcaagtgcactaaatgtagtctgaaaggtgctgccttaggctgctttgtcaagtcttgccgtcgaagctatcatgttccatgtgcaagagagatttctagatgccgttgggattatgtatgttttgccacattctctacattctcattcacataagagttacttaccaatgttctagttataatgtgagattgttttcttggtctttacaggaagattttcttctactttgtccggctcattcttctgtcaaattcccgaacgagaagtctggacatcgcgtttccagagccgagcccttaccaaaaatgtataattctgtttcagcatataatttaatacttacagtatgacattattattcttatgatagcaactaataaatctcattaccttgctccctcagaaatcctgctgagctatgttctttggaacaaacaccagcttttacaaaagagcttgttctctgtggatcagcactctctaaaagtgataaggtcagtactaagttaatcttctttccacaaggttcaaacaagaaacaagtgtttgtggatttaccactcttggttcaaagttggtagagctttttcatataaaaagactaattttctcattgcattgctattccctagaaactgatggaaagtttagccgttcgatttaacgcgaccatatcaaggtactggaacccaagtgttacacatgtgattgcttctacagatgaaaaaggagcttgcacaagaactttgaaggttcttatgggtattctcaatggaaaatggattatcaatgcagcttgtaagttagattgctcactcaagagtttgtcataatctttacttttcaccattaaggaatcttcatctttacatgaatcaaccttgaattgtttctagggatgaaagcaagcctaaaagcttctcaacctgttgatgaagaaccattcgagattcaaattgatactcaaggatgtcaagatggaccaaaaaccgcaagactcagagcagaaactaatgtaagtataaaaacacaccaaaaacaagtttgaaagtgctttgcttcttttagatatctcactctctattttttcttttggcaaacagaaaccaaagctctttgagggcttgaagttctatttctttggagatttctataaaggatacaaggaagaccttcagaatctagtcaaagtcgctggtggtacaatcttgaacacagaggatgagcttggtgcagaaagcagcaacaatgtcaatgaccaaagatcatcatcgattgtggtttacaacattgatcctccacatggatgtgccttaggtgaagaagtcacaatcatttggcaacgagctaatgacgcagaagctttagcaagccaaactgggtctcgtctcgttggtcacacatgggtcttggagtccattgctggttacaagttacatcctgtgattggctaatttaagaggaagagacaaaagacatttcaatttccctacacatatgtaacatagtttaattttactatttttgatttcgtaagataacaaaacagattcgtgtttgaacgcatataaaattccaacttttactttcgaaaaacaaagctttgtaacttaaagtttggaaatcttaccgattaatgacagaattaatgtttttaatgaaaaataaattgtaacgaaaaatggtgtgccaacgcaccaataccaaaaggctttgacagggcattggtgggtcaaaattgtaacggtcacttactttatcctccttaataaagctacacaattaataaattaaagaggcaaaaaataatgctaaacaaaccctaaattcccaatttccgaagtgatcactttttccccgctctcttcgtagtgatcgtccccaccacaccagaccccgctcctcaatttcgatgtcgacctattaatg

SEQ ID NO: 5041 - DNA, 3000 bp, Unknown
  misc_feature (1)..( 3000): cDNA_ID_1827214_gDNA_ID_1620758_Annot_ID_49929 3000 nt of promoter + ATG
gatacaaactcgccatagacattgtcagagtttgactatggagcaaacttgcgccgaaagaatcagggacgggttcgaaaacaatgtaaaagaagagctctctctctctctctctctctctctctctctatgaactacctaaaaaatggagcaatgcttcacatatgaagaagagtaacgttcgcagagaagtctttcatttacttcaaaatgcggattcaataaaacgtcgaagagggactgagttgtgtgagagagacagaagagaagattggtaaagtcaaatcttaaaccgcggagactgatggttatttagccggtttggatcggtttggaaaataattattgatttgaaaactaattgaccttgactaagactcacctactgttttttctttattgcaactggggaaattgtttattttattttattctgaagccatgaaggcacgttggttttaaactaatcaaataaaataggtaacaaatcctcacaagaaccagcactgtagctagcttaattgaatttccctagtaacctatgttatttattttgatgcaaatttttatcgtcttaagttagatatcctgcatcagacgttgatgaagaatcacttatagattctacttgagatccacgtactcgtcgtgacgatcttctagatccaccatctacacagtcctttgatttttttctacgagatttcttattaaaaccaccatcttgaggaatagcagaagattcttttgatgatctccgtgaaactttagggtttccattatattgtgaagatccacgtcgtcgtgatcgttcttttgttggtgaaccacctaaagtgctcgaacgctctctcgacgattttggaagtctcggtatatcacgtgaccgagtcgaatctgcatgtgcattttttatttataattatttcttcttttacaaaaaaaaatatctatagtactattccatattagatagctcaccttcaaaaatgcatgaagcatcctccttgatatttccgataagcgccggtgaatatccacccaatactttgaaatctttcatctacattgaatttcattattttgactttatgataatgatttattagttaatgttatactatagaccaaaaaattattgaaaattaaattaaatacccagctgggtggattatgattgacagagcctccatcccaaccaatgtgagcaacatgttttacatctgttggagttccaatttgcatctctgcctctttctcgttttctgcgttatgcaaattgatcataaaatgtaatattaaaacgagaaatttacaaaattattaggctacattcagagaagatagtatatagtatatatatataaaactcaccaaatatttgagaaaaatacctaagacccttcacgaggctcttcattttgtaggttgacataatgaaatagccaaacaaatcaatatagtttctaagagaaaaaaaaataatctattctgtgtttactaattttgtttttctcctggaagctataagaatgaaatgaattcagaactgaaaagaaatcacgtaagtttcatttcggctcgatcgattaagagccattgtcagtgatttctttgaaagcattttgatttaacattctacgacctaaaattttctttctccaggaaaaagaaaaaaggttgaatcaaaatactcagttatgaacaaaaagaaataggaaaaggagattgtgcatggagagctaatatatcaagttttctgtttccagttccagatatggaactaattaacaatgtgatggagggaaaacaaaaaactaattaagtgaacgacaattagtttaaagtagatttttttaaaaaaatcgatgaggctaattttattgtttgttctctattgcaatcttaatgtggtaaaactgtaaagaaaatcagcagttgttagtaaaaacaaatcaattattggccactaatttttttgtcaaagggttttcatgtttattgactttttaggaggataagatggaaacaacatattgggccagacccatacagaatgataagataaaacaaaacaaagaaggccaaaacccataaaggggaaacatgcccaaacagagggagaagcccaagattcgccagcaagagagcccaagaggcccaagaaccatgaaccgtaggcaataaccattagagcatctccatcgggagatagatactcttgctggcatctcaaaaaaaaaaaaaacctgtgacgctagtaaaactgtgttacacacataagtagtatattcacaaacgtactataactattaataaaattttgaggatgatgtatatagctggaaaaaacgattgaaatatgtaattgaagactatgtatattatctgatttcacagaaatgttgttatttctacatggctgctacacataccagaaaaaaaacaattattgacacctgaaaaagaaaaggctgtcataattatattatatacagctaaaaacaaatgatttatatatatagagagagagactttatatgttggtggtggaatatctgagagctttattttatcggtgatgtcgaaaatatacacatgtaacatattgtaatacaacagtacgatgctgcgtttgtcacgtgtactcctgatgtatcccacacctgactcaagacacatatacgtattcgtatacatcacacgtgatacgtaatctgtggtctctttttccagacgcaaacaaacaaacataatcatctcaaaactcaaaaaagaaacaatctctttcaagtttgttttagtccttctttctgattacccaacacttaaggaaccgccttacactttcccacaacaagttttgcagagaaaatcgaaaagaaaaatgctcaaaccctagaagctcttcgcatgtctatatatatgtttgtgtaaaaaagaactaagcgtaaagaggaattaagaaagagagaaaggacctaaaagctgagagagatg

SEQ ID NO: 5042 - DNA, 3000 bp, Unknown
  misc_feature (1)..( 3000): cDNA_ID_3075497_gDNA_ID_1620758_Annot_ID_167047 3000 nt of promoter + ATG
caaaaaacaccagaaaattgtcatcaaattaaagaaagttaacttactctggacttcttttcctcttccttcttcttcttttcctcttccttcttatttttttcagtggactaccatatgacatatcaaagaaagagaactgactaagtgagaatatgtaaacaatcaaataaagaaaataaaaagtgattaagcagaaaaaacagacctgggcatcagcctcgtcgaagattgcatcaagaaggaccttataagcatcctcttcaatgaaatcccagttattctcataggtcttgagaagtttcctgagaaaggcccttgttttcgtctctgatattcctaaaagcttcatcgcgtcacaggctttcttaatcctaagattcggtgccattttcaacaagtttctgcaataacaaagctgaatcactcaccaacctcaaaaaacttcagaaataaacatagcaaagtaacaaaagtggaaactttcatcttcctgccccaccaataagagcgaaaccagagaagagagtaaaagagttagatgtgtaacgaaactaatgtgactaagaccctgaattttgagatgaaagcaaacaaaaaaacaaatgtaggaagagccattaccaaatacttattacccaccaaaaaaattggaactttttctgtttttttttttttttttttggaaaaccgaagggacaacaaagtaccaaaaccctaaaacgtttcaattttccagaataaaaaaaacgagtagaggtctcgaaacggaaaagattgaagctttagcagaaaaaatgagaagaacttacaagcaaaagaaccaactctgaaactgatttagggttttaagagggtgagactctgtagtgagagaaccggattttcgactttcctcagagaagagaatgtagtgaaaaactgatggtagatttgcttatgcaaagcgtatttttgatcaatgtatctctctgtccaaagaaagacgacaatttgaaactttaaaagacgaagtgaggaaagaaaagtgtatactctccacgaaggagagtcttcaaagatttgagaaacgcagcgtttgggagtcgtcattgactttttctgtatgaggcgaataagacaaactaaaagtgaacctttctttctctctatgcagtgtcagtatgattgactgattttactccttcgagttgactggtttaactcctttaaatcatatgggcttcatcaagtatgggacggcccacaacatatgttttttcttttaagcgattgggtccaggacagacaacgttttgttctactacaattgaataacccagggaattcaagtatgatttcagtttttggtttaaagtagaattttgtatagttcttttggttcaagtgtgaaggcgataggggaagaataaaatcaagagattcagtaatcagcaagtcagctaaaccaaaacccttcatgcaaacagagtcaaaatacacattgaaaactgaaaaagtgggagtcaaaggttttgtcacgaaaagagcagtgatgctaacaagatatttgctgaacaaaagaagcatcatcaaggtttaggcagtctatttacaggccttgccatgtaaaggagtgatgatcaaatcaaaatttgaactaaatggcataaatgttgacgagaaattaagacaagtgtaaacagctaagtttaccaaagatccttacctatattcttaaccagattgccaaataaaatttcgaagattgatgctccactcaaagtgagtcacagctatgagattaaaagaataatcacttgtacggagaaaatctcagcccacatcataaattgccaaataaattagaagaagattgctcaaacacaatcttcaaaatagccaattgaaattcatcaaatcccttatgagtaaacctaatcttacacaaggaaggaaactaacagcttctaatcgagtagcagaaacaagcatgataatatcaaatttatgatatgatcgacggattagggtttctaaagttactttagagcatcgcaccgaccggtggggttccgagaagactcgcctgctcaaaatctatctcgcctaatcgatgatcttgctccaactctaagatcaaaggcacggcaaggatgagaaacgtcgtaccggcgatccacgccgccttcccggtgctctttaacagcttcttcgacacgtagacggcatcgcaagcggcgcgtcttccctgagaaacgatatcgtagtttgaaatcttcgccaagatgctcgaatcgcctttgccggctccgattttcttaggcgccattgattgaatgaaatcgagagagattgaaaaagttcagactagagacgacgacgagggtttcactttgaaaaataaaattgaaaggggatcctcggctttaataatgtacgggtcagtaggcccattaagaaatctaatgacccatttacttaacgggccagattgagttccagtgtgcgccgaccaacacgatacgcgtcgcctttcgttttggttcgtcgtctctaaccctatacccccctctcttcgtgtgtaaacgaaacacaccaaaatcaaaagctgagagctctcttacattgaagctactttcgaagatagcattcactgattggtaaagagttctagaagcgacgagcatcttctttagttcccgaggtacatatccttttctcgtctctacgaattgggaacaaaactagggttttacattagctcatttttgtcgggtttctgcttttgtttcggttgtggtttagatttttgtcctattgtagaaacttcgtatcatgctttcctggttgtgattcataggaagatagagtgaattttgctttacgctaatcttatttgcttgcatttaatgaaatccttcgatgagtttagtatcagtcttctgtgtctttaaactgattctgttcttatgtgaatgtagttttctgcgtttgagaagtctgttctagaaagtaatg

SEQ ID NO: 5043 - DNA, 3000 bp, Unknown
  misc_feature (1)..( 3000): cDNA_ID_1827190_gDNA_ID_1620758_Annot_ID_49936 3000 nt of promoter + ATG
ttgagatcttttgatgttgtttggtgcagagacataaagccggataacttgttgcttgatagatatggacatttaaggttatctgattttggactatgtaagccattggattgtagtgttattgacggagaagatttcacggtaggaaatgcgggtagcggaggaggttcagagagcgtatcaaccactcctaaacgctcgcagcaagaacagttggaacattggcagaagaatcgaagaatgcttgtatgtacttcttatctatcaaaagatctctaatttgaaatatttctttgattatgtgtctaacttgtagttggtgttggtgtatcacttaacaggcttactcaaccgttggtacaccagactacattgcacctgaagtcttgttaaagaaaggatacggcatggaatgtgactggtacgtgtacacacttgtctattttcaacttgttaacaaagaacaaaaaagtaagtccttagaatgtttttaaaaaatcctccaggtggtcactaggagctataatgtacgaaatgctggttgggtatccacccttttacgccgacgacccaatgtctacttgtagaaaggtttcaatacttaattttgtaaaaaattaatcatttgacttttgttttttttctaatgaactttatgtatttataagctagaatttatgaatgcaaaaaaacagatagtgaattggaaaacacatttgaagttccctgaagaatcaaggctatcacgaggggcaagagatcttattggtaagctcttgtgtagcgttaaccaacgactaggctctactggtgcctcccaaattaaggtatctttctccttttttcttctatagtaaaagttacaatatatagttaaaagttgaaaagatttaagcccacaaatgtcataagtcgagttgatccaaaccacaaaatgtcacatgcaggcacatccttggttcgaaggtgtacaatgggaaaagatttaccaaatggaagctgcgttcattcctgaggtcaacgacgatttggatactcaaaactttgagaagttcgatgaggtttgtattttatcttcttcttcttttttttcacattaattgtgttaagctaataattgctaattactgtatcaaattccttggttttcttaatgcatgtttaggaagataatcaaactcaagcaccttctagaacagggccatggagaaaagtaagttgagttaattaccttttactaaaaataaaataaaaattcttaaaacacaacaaatgttttgtaaattgatgatctcacactcttaaaacactcgttccctttctgtaaattcttaaaacacactctttcccttttgtttggtttggtagatgttatcttcaaaagacataaattttgtcggctacacatacaaaaactttgaaatcgtcaacgattatcaagtccccggtataggtacgtatcttagtccttgaacataatcggataccaggatcagaacctctaacattccggtttatatttactacagccgaactaaaaaagaaagagtcaaaatcaaagagaccatcggttaagtcactattcggtacgtgaaaatgtctcagaactaaaaaaaaacgttacttattctctcgtataattgtcttcattcataatcataatcgtgtttacgtttgtaacagagagcgaatcagactcgtcatcttctggttcggagcaacagaccattaaccggagctattctaatccgacgcctcgtggaatggaacccaacctgagacgtctagattctgagtagatatatatctgttatgcctatgtatatgtaaaccaaattaaaccggaaaataatgagcttaaatgtactaaaaacgtaagtaaactgaagataactaactacactcttctttctttaatacaaagaaaaatagattgcaagtctttttttaatcccactttgagaagccaaattaattatccatattcattcattagttttatagtaataatctaaggaacaaatgatttatgatatagtatcgtccacgtctggtagattcggatgagactcgtattttcctgattgggaaaaagaatatgaaatccatatgcaacgacaacacgtatgggcagttgttgttcccaaatttgatgtatacaaatgactactagctacagaaattcatatactactaataagaacattcacatgtcactatgtcaggtcataattaacctctattttccactatataaaatttatttgcaccaacaacaaaaaaaggtaccaaatgaaatactctgccaaattcatcttctgttaaaaatggcgtgtttcgcatggtcataattggagtgaggaaaaaaaaaaaaaaaaacagaatgtcacaaaaaaaaatcatctcttttccagttttcctttgttattcctaacttgtctgtaataactaccgaatcttcttcttcttcttattaatgttcaacaaaattcgacatttttgggtctaatccagctcaaaagtttacgtttttatttgtgtgtgtcggtctgtaagagttagttcgatttcttatccaagtaaaggggtttcattggctaaaattgacaatcggggcgggccctagaagaaaatatgaactgtcaattgtagcagacggttcgtgattcatcgttttcatggccgattcgatttccgatttccccatgagggtttgtcgttgatattaacgcctcccctggatttccataatttgccttgtttagttcgtgttatgatggatctttgaaagctattcccttttttttgggtgtcgaaatcgagaatctgagagttgttgtcacttgaagaatctggattctggaaggctgttgttggtgtgttaaatgttggattggaagatgaatccagggccgtagctaggagacgaagggtttgttgtatatttgcgtttgaaaaatctcggtttttgttgctttagagattgttggagaaaatatg

SEQ ID NO: 5044 - DNA, 3000 bp, Unknown
  misc_feature (1)..( 3000): cDNA_ID_1827186_gDNA_ID_1620758_Annot_ID_49938 3000 nt of promoter + ATG
tccttgtatctgaccgcttgagagcttttggagactggcaaaaatggcggagaaagatgcgacggcgagtggcgatgacgccattagagttagcggtatgcaattcgcatacgaagttgaggatccaatattcttcgacttcaacctcgatcttccagctggttctcgctgtcttctggttggtgccaatggatctggtacgatgatcgatttctagagagagattttccttgtagttagttttcattttttttctgtcttggggtcacaggttttggatcagcgattcgacttgttatgttttcggcgagaatggaaagttaaagacatcttttgtttgatttgatttaaagtttggaactttgaaaattggccctatgcctctgcaatttcagaatttatttgccagtctgaaattggaatcatccgtttctgtcgttctggggttgggtttttttgacgtcgttgtagtagaatccggtttgccatgtgatcttaatactgcgattagcttgaggtatttaccatgttcaaaactactccaggctattgaatttgttttgttttttctggaagactaatgcttgtgttcctttggtaaatttgttaaggcaagacaaccttattgaagattctggctggaaagcatatggtgggaggaaagaacgttgtacaagttcttagccgctcggctttccatgatactcaacttgtttgcagtggtgacttgtcttaccttggaggatcatggagtaaaaccgttggttcagctgtgagtagtcccttatcttctttccatttctcatgcttttgtgagatcttttaggaatttgattgcctagagagtaactaatcgactaccgctcgactgcattatcaatctgatgttatttactttcttgattctgctacattttagggagaggttcctctccagggagatttctcagcagaacatatgatatttggaggtaattttcagtaagttgatttgttttatctttagtccccttttttcaggcttataaactgaaggagattttctttcgttgtccttctagttgaaggaactgatcccgtgagaagagaaaaactgattgatcttcttgatatcaatcttcaatggcgtatgcataaggtttctgatgggcagaaacggcgcgtgcagatatgtatgggactcttacatccattcaaggtgaaaacaatactgtttcagagaggctgattattctgcatcctctaaaatctcacatgattcattgtcagttatgttctcctctggctttaagcaaaaaagaacctcgtttctgattgtgttatcatcattgctgacgctaattttaatctgattttacaaacttcttataaatctctcatgctctgatcacaggtgttattactcgatgaggtcactgttgacctagacgtcgttgcaaggatggatttgctggaattcttcaaagaagaatgtgatcaggtaatattctaccagcctctttaatatcatctatgatctcctaagtatatacaagccgtttgtgtacatgtttctgtcggttagtaactggaatattaatgcttaaccattcaaggacaagcttttcatatcggttcttgttgctgctaagtgatgttgcctataattactatagggtccttgcatgtctatgatctgtggtagtaccataaaaggataatttagtagtagcatgcatgtatcatgcagtttcaagtgcaaatttgtaccggtttttatagtttcacttcttgagttctgagcacgtattcgtattggaagattacaactcacacacttattcttactgatgacttattgcatgatctttgacttgtttataccattgattaactcagagaggagctacaatcgtgtatgcaactcacatattcgacgggctagagacatgggcgacacatttggcctacattcaggacggtgagctgaatcgtttatcgaaaatgacagatattgaggagctgaaaacttcacccaacctcctctccgtggtagaatcttggctccgttctgaaatcaaactcgtgaagaagaagaagaagcctgtggcgccatggaaaccatctccattcgataactctccttttagatcatcgagacacatggcttattaccgatgattggtgattaccagtgagatcattgatcctatatatgaatttgataatcggtaagaataaagacacccgagagtagttcagatttcgtgtgtgtagctgctatttaccacttggctcattgaagaatagacaacaaattgtacttacaattgtgctgatatatataccacagtgattttcacaaaatgggaagtgaatttattttaccgattgcttcaaacccttaattctatatacttgatctctaaacattgtgtaaattgtgtaaatttcaaccaaaatctctgaaatgtgtttttaacgtttttgatcatataagtggacaatatgaaccggccgattttgctcttaaccagtcgttattttccatagacggtcggtttttcttgaaccgggaatttccacatgattttattgacagaacgacgtcgtattaaaatagaaggaaagaagaaccgacgtccgaatgacgaaaatctccctgaaacttaataaatcttaaccctcctttgctcgatccattatcggggaggagaaaatcctaccgccttcaccaccgtcgcgcagacgccgcaatcaccaacactcatcgtcactgactccagatcttcctctccaactaggtttgcaattctcttctccttccgctgtttattggtttcaatttctgcttagattctcttactgctggtgaaacttgaatttggagcttctcttttcgctcatttaaccacttcgtgtgttcttagggtttagatgttggtcttttagggactctctttgaatacttgtttattgcactttaagaatgattcaatttatcttcgacagagagatatg

SEQ ID NO: 5045 - DNA, 3000 bp, Unknown
  misc_feature (1)..( 3000): cDNA_ID_1808130_gDNA_ID_1620758_Annot_ID_49939 3000 nt of promoter + ATG
agttataatattaattaatataaagctcattttctttggaatatcgttataagaatattttaacttggatataactgggcttacgccatttgcatctcgaggattttttgtttttgtttttgtttttttaatacattctcgcacttacacactaaaaatcataatgatcttcttaattctttagcggaaccaccaattaatctttttattaagaactttattacttatttcacttatttgtgcatacgtgcattattttggcagtaacaaatatcgcgttatatatactgaaatccggacgcattaataatagggatatgattatatgaaccactatctagctttggtagaaacccaattataatcaaataatttaccattattgaataaattaggctatataagttcattaatagatgctataggtttttcttacaaggcacacatttgattgttattttctttcatatacactgaatgtacatgtgtacacttggcatacatggcaagattatgtgttacaatatagactgtgccattgccatgcaatgtgactcctgtggccatttctatcacaatgtgtcaatcttggagtatccgttgtttatcctctaatttactgattaatttatgaacatgtataattatttatatcatatgatctcgtaagatatcttagcattttccaccatatgttattagtaaatcatctagatggattgatgtaaataggaaagttaaattaacacaccaaaaaagtaactgattaaaagcatacaacttaatattcagattatggtaactaaatcagtctcatgcaaactccaaaaaattatacgagtcacaactcttgatttttttccggttaaacaaaatacatattttcatttgtatgcaaccagaataaaacactaactatctcctttaaataccattttccctacgagtctacgacgctctctaaacttcttatacaaaacaaaacacacccaaatatgcataagcttttgttttctcttctctccgtcgtctcactctcatttctcctcttcttccatggcgccgaggcacgccagcgagaggcgccgtttccaaacgcctgccatttcagccaaatcaacagcctcgcgcccgctcaggcgacgaagttcgaagccggtcagatggaagtatgggaccacatgagccctgagctccgatgcgccggtgtaacggtggctcgcatcacccttcagcccaattccattttcttgcccgctttctttagcccacctgcccttgcttacgttgtccaaggtaagaaaataaataaatacgctttttgatcaagacctaattaaaaactcgcaacctatagaaaatctaaaaaaagtggtcttttattttaattgttttcaggagaaggagttatggggacgattgcttctggttgtcctgagacttttgcagaagttgaaggatcatcaggaagaggaggaggaggagacccgggtcgacgttttgaggacatgcaccagaagttggagaatttccggcgaggggatgtgtttgcttcgcttgccggagtttcacagtggtggtacaaccgcggtgattccgatgccgtcattgtcattgttcttgatgtcaccaacagagaaaaccagcttgaccaagtccctagggtaatcatcaaattcaagaaagtccaaatttgtactgcatgcaaactatatgactaccactcagtgattaaaatagtgattcatatatataacacataatgtcatttttttgtgaacccttcatatgtagatgttccaactagccgggagcagaacgcaagaagaagaacaaccattaacgtggccatcaggcaacaacgctttcagcggtttcgacccaaacataatcgcggaagcattcaaaatcaacatcgagacagctaagcaactacaaaaccagaaggacaacagaggaaacataatccgagcaaatggtcctctccatttcgtcatcccaccgcctcgtgaatggcagcaagatggcattgctaatggcatcgaagagacttattgcacggctaagattcatgagaatatcgatgatccagaacggtctgaccattttagcacacgagccggaagaatcagcactcttaacagccttaatctccctgttctacgtctagtcagacttaacgcccttagaggttatctctacagcgtaagtatcccacttttaaattagatttacaaattctttatgtgctatataatgaattctcgtggagatagggaggaatggtgttgccacaatggacggcaaacgcgcacacggtgctatacgtcacaggaggtcaagccaagatacaagtggtggacgacaatggtcagtcggtgttcaatgagcaagtgggacaaggccaaatcattgtgattccacaaggctttgcagtttcaaaaacggctggtgaaacgggtttcgagtggatatcattcaagacaaacgataacgcttacattaacacactgagcggccaaacatcgtacttgagagcagttccagtggatgtgatcaaagcgtcatatggagtgaacgaggaagaagccaagaggatcaagtttagtcagcaagagaccatgttgtctatgacaccaagctcttcttcttaagctctttaattgcttcctttaatgtttttttagattttccagtcactgaaataaataaagatgagactaataaccaacttttcacaaagcttcaataacaaaatttcagattaaaaattcctactaacatacacatcttagcttttatgattacgttgattttattttgttaaatttgattacgttgattagtgtatatattaaattaaaatcattgaaaggataatgataacactaataaaaaaaagaagaagaaggttacggtctcgtaaagctttcaaaagtccgcaacgatcacacacgtctttctccgaaactcgtctgagagaggctctgagattcgatg

SEQ ID NO: 5046 - DNA, 3000 bp, Unknown
  misc_feature (1)..( 3000): cDNA_ID_1827178_gDNA_ID_1620758_Annot_ID_49941 3000 nt of promoter + ATG
gcgaaagcttgtgctctccgaacatctcaccgggcaacaaaaccatgtcgacaacataaactgcgagaggacgttgttgcctcaacgaattgctaatacgtgtctccacataaccagtagagacattgatttggtttgtttggccggtgaagttaagcccgtaaacaccgttgtctcggccagaagcttgagtcctaaccgggttactcacggagaggagatcatccatactgtaatatttggggctaacgtggtagagaatgagtttaacttgatcgtcagggcttaactggtttagggttccgggtttaaggttttgaaaagcattgtctgttggtgcgaacaccgtcataccttcggatgaactattgacttgaatgttcacttgactaccgacttgagtgatgtttagaagatggatgaaagtagtgaattgaccacctttttcgaggatcgcagtgaggttgatgggaccagcaggctctggagcgggggctgccggctgagccgttgccttggttgcgagtagtacggctgcgatgaggaggagaggagctagagttagacgagtggtagccattattggtttgcttagttaaagtgtgaagagtgatttggaaagtgagatcggaagggaatggtttatatggaagttgaatgtttggagtgatgagttgtatcttgttggaatgagatggccaagtcaatacaaaacgtttgtagacaaataatgtctagactagagatatatcattaacataaatgttgtgtagatgaattcatatacgaatatatcagccgttaagattcgtttagtatttaaaattagcatatgagaaaaatattagattagaatatgaggttggtggaaccgtaggtagagcccacatcacatgtaatgggatcgagagagtcaataatttacataaaatatgtgtggaagataatgttcgacaacacaacttacggtgtaaggtggacgtaaatcgggataggaatttagggaatgaaatggagaaaattgaaaaatccttggacataaaaccttctacatttggtattgctacaagcctacacctagataggtcctattaaatcagaactttttttttatagatagtatcatcactatatcatcattagaagttaactgagaatagaatacaaaactttacagcataaatgacttacaaataatgtaattaacgtaatccgcaatatacatacaattgatgcattcatacatatagatgcgtagacatgtagcatgtaatgtatgttagaagaatatatgatgtgtgtgtttttgtaaaaaagaacaaaatgagtggacaggctgactaagtgacagctgggaacacacaagttggcatgtgggagagtggaagacccttaagtttatattgccttatcactaacaattgcatatttaagacaataaactaattaattggttcattaccaacaccatgaaatcccgtacatgaattcaacatagaaaatgtgtatacatttgttctagaatgcatgcatgacgtctctccctttcgttgatgtgaaaacggcacgcagttggagaacaaaagtaatgaaattccaacctgagttgcatgggctatatcgggcttagacactgcttttgtagatggcttataatgggcttaattctaaatcgggcccacacatattgagaatcttgaggtttttttttttgtttagttgggtctgaaaggaaatcttgagaattaaaaggccttatctcaaaattaagtttaatgaaagacgcataaaaaaacccataataacacaaaactctaaaataatgaattgggaaaataaatattatgtattttttgtccttgctaatatttgtttacaaaacagaggaagacagaccaaatttagaaacaaggatccaagtggaagcatccgagcagcatgcagccatacactcgtcacgtcggttcgtcgcgtccgccacatcatcacgtggttctcacgtgtttactctctagactctcatcagtgttcttttctaatacagtaataactcaaactttaaccttagtttttaaacgtctaaatctgattcttacattttttacaagctttacttttatttatgcttacattattacaagccttaattttttcttacacaaaaacaatcgattactatactataacattaaaaccgggttctcccaaaaaaaatcgattaaatttttatttagatacaataataacttttaaactcttttgtcgtttttgttccccgttgtctgtttttcgatgcccatattagatgctgatgtgtaagaacatgcactttaaggaggcatgcaagctgaaatgtgtctactactcgtctactccctccatttacaagttcaagtacttctcattttccgttcgtcattactattttaaattactagtagaacagcaaacaaaacgagaatacacattacttagagggtcactgataatatgatgtcttccaaaaaatgtttaatgccaaaagtagaaaaacgtaatacatgtggagtgtcaccccgatcaagagagctatttcccttaaaccaattggtgtcaaattagttaattatctaaaccatgggtcgacaattataattcgatttcattgtttattgaataaatcataaccaagactaaactgtagcgaatatgaaacaaattggtctacactatcattttgttacaaaatgttgaataatttattttaaaaaataaataataaaatcttgaccaaaactaaaataatatcagacctaattatcgaatgtaagtatgttactgattattggattattggattatgcgtctatttgttttcgattattggatttgtctatttttattggtgttatggtgttatttttatttttaaaagaactctttacaacaagtctcctataaatacataaactccataacccacaaagtaagaaagtaaatcaataaagaggaagaaaaatg

SEQ ID NO: 5047 - DNA, 3000 bp, Unknown
  misc_feature (1)..( 3000): cDNA_ID_1827167_gDNA_ID_1620758_Annot_ID_49946 3000 nt of promoter + ATG
agagaccagaatctacagcttcaccgtcgaggacacaacctcccatggaagctaaagcagaggacgagcaaagaagtaaggaaacgagtgtatgtatgtccagaaaagagttgcgtccaccaccatccgacgagggcacttggtgatcttaccggcattaagaaacatttttgtcggaaacatggcgagaaaaagtggaagtgtgagaaatgcgccaagagatatgcagtccaatctgactggaaggctcattccaagacttgtgggactagagaatatagatgcgactgtggtacaattttctccaggtacttagtgtatatctacacacgtacgtactaatagatgatctttacatttcctcatcacggtatcatatatttttagtggcgtaacaaatattttgatcacctagctgtaagcgcatatcatgtttaattgcattatatatagattcaaatatgattttaacttcttaaccagtaaagttaatcatgtttgaatatattagaatataggaagaatatatatatacttatatacatatcttaaaactcatactaaacctagctagagcttatattttaccgggtgaatactatgatgaaaaacaaaaaaaaaacgaatctgttacctcaactaacactactgtaccactggaccacacaaacaaatttcgttttaccacgttgtttgtaagtaaataagatttttttttttttttttgtgaaacaatttgtaagtaaataagatacatgttttttgttggaagtagtagctcatgtagggtctaaaacaaaataatttggagttacttttgtatagatattgccatattggtcattctctgagcatacgtgctgcttgatttcttgaataagacagtttcttggattgacatattttggttaaagtaagatatacaactttatttatctttttttccttaattgctatctatattactatatacatacatattaaacacaagcataaattagcgagtgtgtatagacgatattgatcttattggtgtgtataatttggtcaacaggagagacagcttcattacacatagagcgttctgtgacgctttagcagaagaaaccgctaggctaaacgcagcctcgcatctcaaaagctttgccgcaaccgctggtagtaatctaaactatcattatctcatggggacacttatcccatcaccatcactaccacaaccaccgtcgtttccgttcggaccaccgcaaccgcaacatcatcaccaccaccaattcccaatcacaaccaacaacttcgatcatcaagacgtcatgaaaccagcgtctacgctctctttatggtcgggaggaaatattaatcatcatcagcaagtgaccatcgaggaccgtatggcgccgcagccgcattcaccgcaagaggattacaattgggttttcggaaacgcgaataatcacggcgagttaataacgacgagcgattcactcattactcatgacaataatattaatatcgtccagagtaaggaaaacgctaacggggcaacttctctttccgtgccttctctttttagcagcgttgaccaaattacccaagacgcaaacgctgcttctgtggctgttgcaaatatgtcggcgactgcgttactccaaaaagctgctcagatgggagcgacttcttctacgtcaccaacgacgacgattactaccgaccaatcagcgtatcttcagagttttgcatcgaagagtaatcagattgtagaagatggtggcagcgacaggttctttgcttcgtttggatcgaacagtgtcgagttaatgagtaataataataacggtcttcacgagatcgggaaccctagaaacggcgttacggtcgtttcggggatgggtgaattacagaattacccttggaagcgtagaagagttgatattgggaatgcgggaggaggagggcaaactcgggattttcttggggttggtgtacaaacaatatgccattcttcctctatcaatggatggatttgaaacactctttaatggatttttctaccttatttatgagtgaacttaattatcaaagctgatttctttaattaattttaaaaatgatttatttcaccagaccaaaatcataaattaattttacgatcgattgtggttattagatttatcgtatcttctcaaattcaaaatgatcacctacgtctcaaaatttactcttccatcagatttttgctaaatttaggtcaactagtctatacttgtagtactcttcttattttattttttcaatttatagactacactagacacaagtataatgtagtgtgattcacatattggtattattatatgagcattttcgttgaagaatttttttttttttttcgttgaagaaaagttaagattcattcatattcactatgtgtagaaaggtgtttgatatgcttttttaaaaataaataagtacttaatcaattgtatgtattttgtatatatgccatagaaaaagtgtggatcgagaagtggtgggcacacaagaaaaacatgaaggcttttgagctcaataattctaaacttaacttgcagggcaattcatagtggaggaaaacattaagaaatgaaaaatgaagagagatagaaaaataaaagagaaaagattttctttaaagaatagctaataataattctcaccaaaataaaataaaattaggtaataatattgctagtggttctggaaaatcttaatgggcttaaacttatgggcctttgattagtacggaccaaatcttcagtcggtctttgggagatctttctctgtctatctctccaaagtttaaatctttcctcagaatcttactgtactttgttcaagtttagtactttattctgtacattaggttgttgaaagatcggagaaaacccattgtgaaattaaaccgaagctattcagtgactcatcactaggaagaaaaggagacgcctttggagggttttc

SEQ ID NO: 5048 - DNA, 3000 bp, Unknown
  misc_feature (1)..( 3000): cDNA_ID_1827151_gDNA_ID_1620758_Annot_ID_49952 3000 nt of promoter + ATG
tccgccacgtgattgaccttctggtaataaaagaacatagatgttggttagagaattgttttcaggaagatgattcaatgttgaatatattaatttgacacttttctgatgtctgaaatgctttagatcataacgctaacctttggaaagatattgtgccattggtcggatacgctgcaataacaggcaatatctgagaaggagctgtaaaacgctaatgaaatcagagaacatcaaagtgaaggggttttcttacattcagcggatcatctagatctttgtgtggatgtgtctctggtaacacttgaataattttggcttcgacccttggctggattataagtaaataaactttaggaaaacccattaaccataaacatgaacccagatgttaaatttccttggaaaatacctctgagaccctcggtgaagagctatgaccggaagctttgttaggaacagatatggtagtttcttgtttcccgtattcaaccctaccacggtctgtctcacctctacttcctttcaccaaatcatgctggatctgttccacactttctactgaagaatcaggatcttcacctctactatccccatcttcaccctccagttcttcctctatttcaagttcattcaacctggccatgattcttgcaaagtcatcgtcttcaagttcaccttcttcagtctctccttcagaaagattacaaggctctttttcacttgaatgtatcacaacaggtgcagaagaatcttcttctacatactcttctcttatctcaacaagtccatcctataaaaaatgataacaccggttaagatacatatgcagaatcaagaaaaaggaacacacgatccactctttcagcaaaacctaccgctacttcagaagcagttgtagtgaagaatgaagcctccgtttgaagatcttcaatctcagctttaagagaatgaatttgagactgtaaagtcttgtctcttctcttcaggaaatcaacagtttgtttcgatgatctatcagtatagtaattctctcccaacaacacctatatgaaatcacaaaacataatcctttaaatttgaaatttacactaacctcaatagcttactcttaaacctcatagcaaaacgatactagaatcaaattacatgtatcctgccattgaaatcgagaagagagaacatataatcatcatgaaacttaccaaacactcgttggtgtgaatcaatcgacctgggaaaaaagccattttaccgaatggaacctgtttacacaaaagcaccaactacattaaacgggagcaaaattgaatcataaggagaggaagtcaaaggattaaaaattcaccataacgttgtgatgaagctgatcgggaagcttcttgacgagattgatgagattatcgttttcgtcgacgtactgttgaagacgattcatctctactcgcttctctccgattttctcctccatgtaacttgctgcttttcgaacatcctcctctgaaaatcctaacggcgtcaccgttcctttcgccggcggctccattccggtaagggtttaagcacaacgacgacgaccgattgcagaaagaaaaaaagaaccaaaaaaaaaatggaaattgagagggaagcaataaaggcttctaagttctaagttatagtgaacttaatgggccgatttaatatggcccaatgtattttattatgttttcgaaaataaaaattgccttgtctgtaacaaatttattaacgtttgtaaattgtgttatcgttgatatttttagtaacaaatgttaaaagtttaaattattgtaatattttttaccaatcttgatttatttaaagaattatgatgcctgatagttgatatattatttacacttcacacatgtgtcacatgtaatgcaaagtgtggagataatggaattgggttggcaagtaggctaacacacgagaagaaggccgacaatgttgtgttacttcaattcaatatcatttgtattcaattccaatatttcgtagttttgagctagctattgacaatacatattaaatgatatattatttatatatccaatatatgtttaacaataagtcaataacacatcatttactacaaacactatgagaaacaaaaaaaaaatttgaactaagatctatcatcaaagttactttaactaatacaatctaccataatgaaaaaagttatcactaaatttcaataacttatcacccaaatagtgtttttaataggtttctaacttacaaaaaaaagaaaaaatatagtaacaataaaataagaagaaattatattagtttagaaatacatatgaaatattttgtggtcaaattctcctaaataagttttgatattttgccttttacgaaaaaaaaaatctaaactaagtatgtgatatccaagcagaagtagagacgggtcaattatacgcgtggtacacttttggaagtgaattacatcctctaattttgattttgtttggtaatcggataatatacgtctcttcaaaaacgtatattgtatcttttatctcgtaaaattagaaaaattatggtgaaagtccaaactttttagacgcgtcagtatgaaccaaaaaaacaaaaatatgattaaggatttgtgagaaaataagaggtttagcttaagaattcacaacatgtataataagattttagtataagggatcttagtataatttttacttttttttcccaaggatcttaatataattaacaaaaaaaaaatattataaaataatataagtatgctaaaaggtaaagaagtttctctctttcttcttcgtcctcctttgttctcctttctctctttccatcggcaccgaaccgaaacaacaaagaacgaggaaatacaaataagcccacaagagagagacgtagatggagagataaaggtcaaagctttattctttttcctctctcttcctagaagcagagatcactgttatcaaacaatcaacaatg

SEQ ID NO: 5049 - DNA, 954 bp, Unknown
  misc_feature (1)..( 954): cDNA_ID_1827143_gDNA_ID_1620758_Annot_ID_49954 3000 nt of promoter + ATG
ttcattattccttctaaaattgattgttgttccgttgtaattataaggtttaattgtaatatttggttgcctcagaatcacaatctctctttgcagcttaagaacatccgtagattcaaattgaattatccacttaataaaccgagaattaaggtaacctatcttcaaaaccataaaattcaattacaaacagaacggaaaaacttgtttttgaaacgaaaaaagaaatttaactgaagatcagaatatgatgtcattctcatacacagaatctgtgtcagaaggtgtcctaagatttatctgatttctcatcatttctccagcattactatttttccaataccaaaagatacaaatccaatttaaacaaaaacgtcgagagaattctccaaaaccgtcaaacaaaaatataaaaaatccaacttttgtaagaatcagaaagaacgtagcgagttgaaatttttgtcgatcatatgaatcaaaagaccatcaccgatatacaactttcatcatattctacacaaaacctcttgaaaatcaaataattcaccaaaacattaaagaaaaaccaaaaaccaagattgggttgaatcgacaaatggtgacttttctcggcgttatcaagaaggagattgctatatataagagatgcacgagaaaccctaaacctaaaagcatgtttggaaacaaataatatttgggcttctcttggatgctattcgaactcggcccattattactgccacaagtacagtttgggcttcgtttctatccgtatttggcccattaaaactgcacatgtataatgtatttccctttctagcctcttattttcttcaaattagaataacagcaagtaagttttcaaattgctaaatattacgactttatttcagtttctcgaaaaaagcaagtctttttcctttgctctcgcaacgcgatcgattagcgatg

SEQ ID NO: 5050 - DNA, 3000 bp, Unknown
  misc_feature (1)..( 3000): cDNA_ID_2991033_gDNA_ID_1620758_Annot_ID_167073 3000 nt of promoter + ATG
ctctgtttggttgtcgatagtcacacagtgcctgatcgtcggtcaatttgctaatccttgtgtgatttagagttggaatgatcatttggtgaaatctcgtggatcttttcttgttgaaagcttgttgacttgctcgtcatatatattcgacgatctatgggtactgtatctagttgataatgttcaaaggcttgatcgattttagccttgggatctgctaccgatgctttcaatttctgacgcttttctatgcgatcttttcgaattcgtttttctctccagtttttgccatgtcaattgattctcttagtaacactacttctttgtttgctctcttggattttttgtttcttctgaaatggaggcttgtgcattgattgttctatgtgtgtgatttcttatgcggtgttaagtcctttggatcttcgtataatgatgtttttaatctgctgacaaacgaatttatccctgcggcgttttagtttgctacatataaagttcttagctgtgaactgtttctcctgggtatctcattgcggtttgaattctgttttgctatcaggaaatgagtttcaacaaagttcccaacattcctggagctcctgctctctctgcccttcttaaggtcagcgttattggtgggctcggtgtctatgcccttactaatagtctctacaatgtcgatggaggacaccgtgctgtcatgttcaaccgattaactggtatcaaggaaaaggtttgtatttctcaaactaacaagatgtacttttatatctgaggctttgaattctaagaaagcgttacttttacttggatttgtgttttcaggtgtacccagaaggcacacattttatggtgccatggtttgaaaggccaatcatctatgacgttcgtgcacgaccttaccttgtagagagcaccactggtagtcatgatcttcagatggtgcgttttggtttcttcttcttttggcttcttttctgtgtgtgtttgtacaatatttagcccagggatttaattttaaatgatgttactgaatgtggtgctatatagatcatactagatattccttcttttgacgttatgttaagacccttcaatgcagcattaagagcatgttttagaaaattttgggtgtggtttgaggttatggagctgtagattaaatatcacttactcttttaggatattacacgatcaatgttgatccttatatgaactgtgtgagtgtatggataagtggaaaaacaagagacaagttacacttgctttcagtagacttaggtagagcaagaaagaacttagtctccattttctttcttaaaggagttgctgtgtttctgatatttttcttgggtgttgcacaggtgaaaattggattaagggttctcacacgtcccatgggtgaccgtttgcctcagatttaccgaacccttggcgagaactacagcgaaagggttcttccttccatcatccatgaaaccctaaaagcagtggtagctcagtacaatgcaagccagctcattacccagagagaagtacgtatctcaacattctttttctacaacttttctgctcttttgtttctaatggtggactctgtttactctctcctctaggctgtgagcagagagatacgcaagattctgacagagcgggcttctaactttgacattgctcttgatgatgtctccatcacgactctgacattcggcaaagagttcaccgcagctatcgaggcaaaacaagttgctgctcaggaagctgaacgggctaagttcattgtggagaaagccgaacaagacaggagaagtgcggttatccgtgcgcaggtatagcattggtgatcttgattgcaaatctaatgacatgagattagtggttttggcctgaagcattagctctttttgaatctttgtgcagggagaagctaaaagtgctcagcttatcggacaagcaattgcgaacaatcaggcattcatcactctgagaaagattgaagctgcgagagagattgcacagaccattgcacaatctgctaacaaggtttacctgagctccaacgatctgttgcttaaccttcaagaaatgaacttggagcctaagaagtaaaagagaaggaacgagtaagtttcttcatttcatattcatttcatttaaaagatctctccgccttggaagtaaaggatgggttggtgtttgaccaaatgaccctttctcgtgactgattctgaaaatagtctttaagaggacatattgagagagacgcagattggctttggtcagtattattcatcattttcaatgaaactttttgttgatattttcctgtgtttccccggacaattgatgaagttgaatttaaaactcaataatattcatatgatctgatctatgccaatagttctttttagtatatgttacatacgacatgcttatataaatatccgaatataagatccgtaccaatcctttcataaaacttaaatataaatatttcttgttagcttgctattcaaattttcttttttccactagttgccaaccttatctacctataaggatttgtattggagagcagagaaaataaaatattgcatacgtataataagattttgtatgagcagagcaacatggaccctttgtatttaatgacgtcttgccggcgccaccatgatagagacgtctttttctttctttcaccggtgaggagttttatgggggtgacgaaactccggcgaattttccggtgacgtcaaattttaaaattttgaccaagtaaactcttatttcaatatttgtatataaccgacggctgctttttatgatgtcatgtataattaaaattagctggaaacgagtgatgaccgttaaccaagataataaaatgttttgagcaataaataattccaaaaaaataaaagcgttgtggattaacaaaagacggaacgacttgctgtttcgtaaagttaaagggagacgtcatgtcgttttgtcacc

SEQ ID NO: 5051 - DNA, 3000 bp, Unknown; identical to SEQ ID NO: 5046
  misc_feature (1)..( 3000): cDNA_ID_1827178_gDNA_ID_1620758_Annot_ID_167070 3000 nt of promoter + ATG

SEQ ID NO: 5052 - DNA, 3000 bp, Unknown; identical to SEQ ID NO: 5045
  misc_feature (1)..( 3000): cDNA_ID_2990358_gDNA_ID_1620758_Annot_ID_167068 3000 nt of promoter + ATG

SEQ ID NO: 5053 - DNA, 3000 bp, Unknown; identical to SEQ ID NO: 5044
  misc_feature (1)..( 3000): cDNA_ID_1827186_gDNA_ID_1620758_Annot_ID_167066 3000 nt of promoter + ATG

SEQ ID NO: 5054 - DNA, 3000 bp, Unknown
  misc_feature (1)..( 3000): cDNA_ID_1378198_gDNA_ID_1620758_Annot_ID_167063 3000 nt of promoter + ATG
tggatgatcatggtgtgttagattttgaaaactgaggatttgtttttcgcatcttcactgactatattgatgttcaacaggcttgcttgaaggaaatacacgctgagatgctgagacgtcatctacatcgcctcgagcaactttcagagggtgaagatgatgtagaagttaatcctggcttaacacgtgtggtggaagaaaatgaggaggagataaatgatacgaatctttcagatgctgaagaagcattttctccagagcctgttgcggaggaagaagaagctgatgaggcagcagaagcggctggttcgttttcgccagagctcatgcacggtgatgatcgtgaagaagcaatcgatcccgaggaagacaagaagctactggtatatttaacagttcctacaattgaattttacacatgaattattgttgttggtgcttctactgacccaaaatatgactgcggctataacagcaaatgaaacggatgattgtgctggagaaacagaagaaacggcttaaagaagctatggactcaaaaccagcacctgtagaagataacttggagcttaaagcaatgaaagcaatgggagcaatggaagaaggtgatgccatatttggctctaatgctgaagtgaacctcgattccgaggtacccttatcactatttttctcttctctgcaacttttcagttttgtagaacaaaaataccataattttcatcttctaggtatactggtggcatgacaagtaccggccaagaaaaccgaagtatttcaatcgggttcacacaggttacgaatggaataagtataaccaaactcactatgaccacgataatccgcctccaaaaatcgttcaaggatacaagtttaacatcttctacccggatttagtagacaaaattaaggctcccatttacactatcgaaaaagatgggacaagtgctgaaacgtgtatgatccggttccatgctggtccaccttatgaagacattgtaagtactcgtaaccattatgtgggtttcatcatcacctctcgtgttatcattgtgctcaaatttatttttgtttgcttttcaggcgttccggattgtgaataaagaatgggagtattctcacaagaaaggtttcaaatgcacgtttgagcgtgggattctgcatttgtacttcaactttaaacgacataggtacaggcgataaccttatcggagtttggctggagaagacgaaagtggcacttgtaagactttggctgatgtttttaaaagccttgtttgtaagagaagggcgatatacatagtctaaatttggatttctctcaagttaatttctgaggtaagagctgtatttggatattttgttgaagctgatcatcaaacagaaccgaatagaaaatgattttcccacatgacaaactaacaatcgaaaatgtaatgatgataactaacaaaatgtgacgtaaataatttgaacaaatctggagttggtgtttctgcaagaactttttggtgaatgagtgttatatggaaaagttggtgtagagacatgaatgtgtgttttggttggggacgagagagacgaagagagagagagttaaggtgttgaagttgcttattaggttgagatctcaacatcaaaatgcttataaaaagattctgttggtaacttaagtagtggagtagaagatattatttattctgacttttcctttctttttcatcttccttttgatgtctctttttctccaaactctcctccactccaagacaaaaaaaaaacccttcttttgtattcgtattacttaaaatttgcatttcttttaataatctcgattctgaatattatatttatgtctaattttcgttactaacaaactaacataaccaaattttccgtatatatccaccatttaagtttaatgaagctttttgaaaatgaaaaactagtgcgtagagagtggagataaccactaaattaattgttcgtcgtcaacatcacaagtattgttaaatttgtaaacaattccctataaaactgagtgtgcgttatatttcattaatatattctgaaaataaaaatattaacaattccacgctctatatatatatatgataaaatcgctttcaaacttctacggtaacccgacattttctgtttttcctcaataaaagatttcttttttttccttttccgataaaattaattaggcaaccgtatcttaatctccgatctttccgcttctatcagattttcagatttgatgaactcaggttcgttcaatctttttctccaaacaatcttctttgctaccaaatttctggaatctagggttcgattatatctcttttagattatccattatttttgtaattcgttttagtttcgtttttatttccttttttagattaagaagagttcatattttagaataattaaaaaaaatggattctgcaagaagttggtttcacaagtttcaaccacgagataagcctcggaaaaaggatatgttctccggaagcacttacggcggtggcgtgacagaaaccaccgtccccgacggaggaaatgatacagaaacggcaacgaaacttccaccactaggcggtgacggagaagcactctcaaattcaacaaaacagaaagttgctgcagccaaacagtacattgagaatcattataaggaacagatgaagaacctcaacgagaggaaagagaggtacaaatattttagatatattcttgatgggtttatttatttagttatttaaatttggcagacgaacaacgttagagaagaagctagcggatgcagatgtatgtgaagaagaccaaaccaatcttatgaagtttcttgagaagaaagaaacagagtacatgagactccaaaggcataaaatgggtgctgatgacttcgaactcttaactatgatcggtaaaggtgcttttggagaggttcgagttgttagagagatcaacacaggtcatgtttttgctatg

SEQ ID NO: 5055 - DNA, 3000 bp, Unknown; identical to SEQ ID NO: 5043
  misc_feature (1)..( 3000): cDNA_ID_1827190_gDNA_ID_1620758_Annot_ID_167062 3000 nt of promoter + ATG

SEQ ID NO: 5056 - DNA, 3000 bp, Unknown
  misc_feature (1)..( 3000): cDNA_ID_2781994_gDNA_ID_1620758_Annot_ID_167058 3000 nt of promoter + ATG
caaccaccattttttttggttttcaaaacatttgttgggcctttatgtttgcttgccgatatatcaatcgaacccataattgttgggttttcagaattttattaactttgaaaaccaaaaaaccatttctttcaagtacaccggatttaaaattgggctttggtagtttattaggcccattaaatattgtttattatatatatatccacaaatcttcccagaaagcaaactgtagaagacacattgaatgtataatattttttgtctgaaacatcttcaagctcatggtacttcttctttctatctaagcgccgccaaccgcttctccagttcatcgattccagaactgcacagaaacatagaggtttggtttcgatacagatatgttctagttgtgtttagtggataccatacctgccaacatcctctgctttcttcccaccaattttcccttttggagcagatgataactgcagatggataaatacagagacaagcgaatatgaatcacggagaatacgtgattatacggaaacaatgacaagaatcgatggttataaacaaacctgcgaggcgatatcaatgccgatttcatcaagaacctaatcagtaaaacaaaaagcatttgttaaccctttgaaacagtctatttttagaaattgaattgatggatagagcccggaaatgtacctggtttgtcaaatcctctgtttcgtcttcagcttcgtcattgtctaaagcatcatctatggaatctgacatcatctcagtctggattccacatgcattagtcagattaatgactatttgagtgttcatggatttaaagaaacgatggatttgaaagaacttacagtcatgtccatttgtgcagactgcttttgaaattctctcataaccttagcctgttttgctggatccatattctggaaaacccacagaaacaacaagatcttaacaaaagagcccctcaaaattcctactggatttaagttatttctactaatttaacttgatgaatccaatcaaataattaaacatggacaaatcagatttgtgttacatagggaatctgaccttgctcatagctgccattgccttagtggcaccttgcattccagcagcaactgaagtgtgtgcatgcatagcctaaacaccaaagagaaagcttccaatactcaatcttcttggtttataaacagaaatactttagaatgaaaggatagaagttgtttaaattaagaaacctgtgtatgagtagcaatgcctcgcatttgagctcggctaccttgtaagttagctatttgctgccttagacggatcaattgccgagcaagaatcttagtcgctccctgcataaaaacaaaagatgtagtgtacataaactagatgctattactgataaggaatgcttgaaatacctcattgcctgatttagcagttcttttgatctcgagaacgagctttttttcctatcaaacatgaaagaaaacgttttttagatatgtcccttttaaaaagatggatgaaaacgttactaactgagccacactcatacttctgattgcagagatccgatttccttttcgattcctgaagccaaaacacgaaaaggtggaaaatttcatcagtttgagaggaatttaggtatatggcgataaatacttgagtaatatctagttaaagccatggaacatagtagcttatcaatcaagcaatcaaaaacaatgaattaacctttttctagattcaataatccaagcatatgaacaaagaatacctctggtagcttgtgtcatctctctcttactctcccgaagcacttctgcaattgccaaaaaaaaaaacgaaacattcagattctgacagtccgatttcaatagacattaagattctcgaattcagacgaaaccaagccagattccaaaagaaacatgatcacgaacgcgccacaaaattacagaagaagtcaaccggaagaaacccagatgatcaaaattccatttaggttgatcaatcggagaaaaaaaaaacctaattgagaaaacaaaatccataatgatacaaaagaaaaatccggtggaattaaacctctgggattaggtttcttagtgaagatgttcatgtttcttctccttgcttgttttgtttttctctgtgaaattgaagatggtctcaaagcttttagaacacggagactctgtaccacagaggtagttagagagagagagatttagcttcaaacgtgatcgcagcaaatttttgaaggttttaattttctcatcgattacgtaaatattcttatttatatttgattattagtttttttactgtgattattaaattccacaaatacgagaatttatagctaaaacgttatacataatgtaattaaatcgttttttttacacgactactactaacctaagtattttctatttagaataaataaataaatatatgatacaatattatatttttgttttgattaaattaatctaaaaacaaaattaattttaatccttggcaaaaggagataggggggtcaaacagaaagaagtgaaaaaaaaaagaaaaagaaacggccggtgagtaataaatatctctcgaggtcctcctcctcctttcctttgataactttccggcaaaatctcagaacctccccatttttctttgccgattattgatcggaattgctttgttcgctcatctgccaacttccttcctactcggtgtaggaatcttacgtgtccaatcatctgtctatttttggaaacaaatcctcagtgattttgtactttacttatatcaaattcgataactagggtttatcgaatcggattgttgtttctccaattataataattcaagttggttcacacagtagcgtcgacttttcatagccgctgttgtcgaattttgaatttctcgattttcccggcgcttttgttacgattcaaggagtttgaacaagtagggcttctcgttgcggagatcatg

SEQ ID NO: 5057 - DNA, 3000 bp, Unknown
  misc_feature (1)..( 3000): cDNA_ID_2150841_gDNA_ID_1620758_Annot_ID_167052 3000 nt of promoter + ATG
tcttgtttgaaccttgtggaaagaagattaacttagtactgaccttatcacttttagagagtgctgatccacagagaacaagctcttttgtaaaagctggtgtttgttccaaagaacatagctcagcaggatttctgagggagcaaggtaatgagatttattagttgctatcataagaataataatgtcatactgtaagtattaaattatatgctgaaacagaattatacatttttggtaagggctcggctctggaaacgcgatgtccagacttctcgttcgggaatttgacagaagaatgagccggacaaagtagaagaaaatcttcctgtaaagaccaagaaaacaatctcacattataactagaacattggtaagtaactcttatgtgaatgagaatgtagagaatgtggcaaaacatacataatcccaacggcatctagaaatctctcttgcacatggaacatgatagcttcgacggcaagacttgacaaagcagcctaaggcagcacctttcagactacatttagtgcacttgattttcatcccccttgccagttctgctttcaggttcttcactgtgtcaccttcatagtaaacttgcggtgccctgaacatttattcaactacttttagtatttttatcatgcaaaagccaaaagcgttataacactagccaaactatatccacatggacttgcagaaacaaagatgagcaaatgtagaagttttttgggtttcattttctataccattcgatacatgcgctatggacatggataacattggagcggaagatgtcatctccatccaccggtcttcccctagagtaatgcagcatttctccagtggcctaacaaatattgatccagccagttgagtaaaatacttcacaaacagagaagctcagtttctagagcagaggatatggcaaagacttttaaaggttttacctcagataccctagcggattggcagaaaccacaaatggttatgttggatgatgtttgttctaatgcctttgagattttctcacttagctgatcatcagagtttgcagagcatttaccattgcagtcaatatcagcagatttttgcatcagattattctccctcttggggaccttcagatgattttccattgcatcagaagcggtgatgtcacgcttcctttttgaatcttgttctgtatgacttttgggtaactgctggacacaaaagatcactacacatcttaagttgtttgatctcaagcacagaacaaaactatagattacccaaaaactgaagtacaccatctattaacatgtaaatgtgtgattaagaatactcataactgataaactaaaatagtcaacttatgaagtaagacgagaatgcacctgatggttctgtgctttaacataatcagtgggatcatctgaccggaggctctccatcaaccgcagcaaagtcggatcctgagtcttaggattcggactgctttcctggataaaggaatcaccacatatccgcttccttgcagcattgctaggctgctcagaagcagtgatgtccctcacattttttgcagcttgttctgtataactttccggagtctgcagcaagaagaaaaaaaagaggaatttataaacatctttcaatattgcgcactgataaatcaaaatgatcagtaatatgctcttacgtgattggcagcatcatactctgattcaaactcatataataggagatgatcactcaactgcttttcagtccaatcctgatgcttaggtcttggatcactttcttctgaggtcggaagaggagaaccatcacgactagaagaatcagtaccaccactgcgcttgctcacatccttgtcagtcatctcagaatcttcagattcgccatgtttagggctgttggaattgttcaatgcatcgttcttgtagttgcaatcatttggaatctgtaattgtgggagatgaacactaacagctgcattcaagctcttgtatatgcttataacactctccatgaatcgaagatctctcctagctgcacatgagagtaattcacaatttcacatactgtcttgaacactaatcttcaaatgatatcactggacttaccctttttgggatgtttagatttgcagacaggacatcccgattcaacttgcgacgatttgtgtacacatgaactgtacaaataatttccagaaagataagaatctatatgaattcaaatttgtaatgaattgttaaagaataacagagtagttagataatctcactcgcagaagacgtggtcgcaaggaagcaacaccggtcgattaagcaattttaagctgcaaattacgtaaatctcttgttacgattccaagaacactaaacaaaaactcgattactctacaatataatcaaggaaagggaagctgtgggtgaaacaaaccatagagggcacttgagctcgagctcgagcttctggagatgaagaacccatggattcattagcatgttagtaaattccgccattggtgatgtacaaaacccagatctaaatgacgaaagctcttgaaaccgagaagagaaggagaagatgcacttccttgcttcgtctccgtgcgattggtatttactttgagaatttagagacacgtgtacgatagatatcaaatggcgggaagataggcggggattttatgatttgattaagcgggagaaaatgtgaataaacgcccgcttgtttgttacgaaaattttgaaattattcaactttcaatttcaaaggcccaattaaaagcccatttgtttgttacgacgtgatagagagtagtaaccttctcgatgacttcgaaggttcttgtaagggtatatttggaaagttaggacgcttccaaaaacttttcaactctcaccttcaaggtccccaacaacgcacacactctctctctctcctctctcttacttttcctcctaaactctggcgatgaaaagtagttagagacaccgagcg

SEQ ID NO: 5058 - DNA, 3000 bp, Unknown
  misc_feature (1)..( 3000): cDNA_ID_2150883_gDNA_ID_1620758_Annot_ID_167084 3000 nt of promoter + ATG
agatgcttgaatctacaaaacaagaacaatgatgcacagatcacttagtcaccgtagaagcattctgatctacttaagtgagttagtcttatatgcgtcgggtttctgacctgcttattacgagcttcatcatcttgacgaaaattcaattcctgaacaaaaatgaaaggcatttatcatcagtaatctctgttaagtaacccttctctaaaactgtcgaagaggaaaaagaaaagttgatgcttcacctcctcctcaaatttatcaatatttttgaataaagctgctattaaggcatcaaagtttgggtcgtctcttaaagaacgtcggcttgcacaatgttttctgcaagtaggacactcattgttcctgaaaatgcatttgccagttaatataatacagaacaagctttacattagactccctaaagaatgctgaacatgcaaatggaatgcataccccaatctcattgacttatcaatgcactctcggcaaaaccggtggagacattccatcacagtccttgttttccttataatccctaggaaatgaaaaccagtgctggcatcagtcgaatttagtaaagatagagtgaatgactatgtaaaaacagggtaatgagaaaagttggcaagcctgaacagtctacaatgactaccagctttatgttggttgatgaaagtagctgaagcctgatttttcttattaggtagttaaacattcacaataatggtgactgagaggcaactgaagctgattgactttgtaatataaatgtggagaagagtacctaaacatatcgagcattgcacgtccttacagatatccgctagatcaacaaccatatatctgcaagggaagtcaagactttatcaaataacaaagatcaccaactactgtgttgcctactataagaagtctgtctcagtcaaaaacttatgttaagctaaaaagagactaatcaacacagatcaatcctcggcatttaaacacaacagtatcaataacatgcaagcaagaaccaaacaatgcatcggatcaatgaaaacaaaacactgaggacatcagagaccacatgttccgcttaaaacctatcaaacacaacagtgaaaccaatcatcagaaaatgtcgaaagggaaaagaattgttactctgattctgataactctcctgctgaagaagattgacttctttccttagaatctgaaactgttaataccaattaaagactttcatgttgtacatactaacgcattgattgattcatgtatctcacatcacatacgtatataaatatatccacgactataaacaagagcaaaaaacgaaactttcaccttcttcttctcctaacgcttcctcatcctctgcttctacttggtcacgtttcacgtcgtcttcctcatctccactttcgtccttctcatccattttgtctggatcttcttctttctccacagcttcaggattgaatctttcagcttctgagttccgacccagttggtcatcttcttcctcggcggcggagaagctcttcaaggaaggcattgttgattgtttgataacagtgatctctgcttctaggaagagagaggaaaaagaataaagctttgacctttatctctccatctacgtctctctcttgtgggcttatttgtatttcctcgttctttgttgtttcggttcggtgccgatggaaagagagaaaggagaacaaaggaggacgaagaagaaagagagaaacttctttaccttttagcatacttatattattttataatattttttttttgttaattatattaagatccttgggaaaaaaaagtaaaaattatactaagatcccttatactaaaatcttattatacatgttgtgaattcttaagctaaacctcttattttctcacaaatccttaatcatatttttgtttttttggttcatactgacgcgtctaaaaagtttggactttcaccataatttttctaattttacgagataaaagatacaatatacgtttttgaagagacgtatattatccgattaccaaacaaaatcaaaattagaggatgtaattcacttccaaaagtgtaccacgcgtataattgacccgtctctacttctgcttggatatcacatacttagtttagattttttttttcgtaaaaggcaaaatatcaaaacttatttaggagaatttgaccacaaaatatttcatatgtatttctaaactaatataatttcttcttattttattgttactatattttttcttttttttgtaagttagaaacctattaaaaacactatttgggtgataagttattgaaatttagtgataacttttttcattatggtagattgtattagttaaagtaactttgatgatagatcttagttcaaattttttttttgtttctcatagtgtttgtagtaaatgatgtgttattgacttattgttaaacatatattggatatataaataatatatcatttaatatgtattgtcaatagctagctcaaaactacgaaatattggaattgaatacaaatgatattgaattgaagtaacacaacattgtcggccttcttctcgtgtgttagcctacttgccaacccaattccattatctccacactttgcattacatgtgacacatgtgtgaagtgtaaataatatatcaactatcaggcatcataattctttaaataaatcaagattggtaaaaaatattacaataatttaaacttttaacatttgttactaaaaatatcaacgataacacaatttacaaacgttaataaatttgttacagacaaggcaatttttattttcgaaaacataataaaatacattgggccatattaaatcggcccattaagttcactataacttagaacttagaagcctttattgcttccctctcaatttccattttttttttggttctttttttctttctgcaatcggtcgtcgtcgttgtgcttaaacccttaccgga

SEQ ID NO: 5059 - DNA, 3000 bp, Unknown
  misc_feature (1)..( 3000): cDNA_ID_1827286_gDNA_ID_1620759_Annot_ID_49955 3000 nt of promoter + ATG
ctgcggctataagctacactgatgaacgtgtatactggtaagtaagaactaagttaggatatttttaatttctcgaggatcttactgaaaatattcatatgtgttgcagtgatcattgtgcaacttcaattgttgacttgcatcgaagctgtccaaagtgctcttatgaactttgtttgaagtgctgtcaagagattcgtgaaggatcgctttctgaacgccctgaaatgaagttccattatgttgatagaggacatcgatatatgcatggtttagatgctgcggaaccgagcttgtcttccacttttgaagacgaagaagctaacccatctgacgctaagtggagccttggtgaaaatggaagcatcacttgtgcaccagaaaagctaggtggttgtggtgaacggatgctagagcttaggcggatcctaccactcacgtggatgtcagatttagagcacaaagcagagactttcttatcatcatacaatataagccctagaatgttgaactgtaggtgttcttctttggagacagagctgacaaggaaatcagcttcgaggacaacatcaagtgacaactaccttttctgtcctgaatctctcggtgtcttgaaggaagaagagcttcttcattttcaagagcattgggcaaaaggcgaaccagtaatcgttaggaacgctcttgacaacacacctggtttaagctgggagccgatggttatgtggcgggctttatgcgaaaatgtgaattcaacatcaagctctgagatgtcccaagtcaaagcaattgattgcttagctaattgtgaggtggagatcaatactcgtcagttctttgaaggttatagcaaaggaagaacatatgaaaatttctggcctgagatgttgaagcttaaggactggcctccttctgataagtttgaagatcttctacctcgtcactgtgatgagttcatatccgcgttacctttccaggaatatagtgatcctagaactggaattcttaacattgcaacaaagcttcctgaaggatttatcaaaccagatttaggtccaaaaacttacatcgcctatgggattccagatgagcttggtagaggcgattccgtgactaagcttcactgcgatatgtcagacgcggtaaagctttcatttattttgtttttaacactcttggtttggttttaaatagtccatagactgactttgcgattcatgtaggtgaatattctaacgcatacggccgaagtgaccctaagtcaagaacaaatatcctcagtcaaagcactgaaacagaaacacaagttacagaataaggtcgataaacagagtactgaagactgtaacgaaaaggaagaagaagaagaagaagaattgaacatgccagagatttcgagcaatgaaaatgaagaaacgggcagtgctctttgggacatatttaggagagaagacgttcccaagttagaagagtatctaagaaagcattgcaaagaatttagacacacttattgtagtccagttacaaaggtaacaacacccacctgcatcaattttatgacgaatttatttccggtactgacggtttcttcttttcaggtttatcatccgatacatgaccaatcatgctatttaaccttagagcacaaaagaaaactcaaggcggaatatggtatgtaaccgtttacttggggataatgtttctagtcaatcttttgagtcaatattgacaagttaactgtagggatcgagccatggacatttgtgcaaaagctaggtgaagcggtgtttattcccgcgggttgtcctcatcaagttcggaatctaaaggtaaactgaatggtttctattcttcttctactcatacaatttgctttgtattggaaaatctaaaacttctctgtgattgggggacagtcgtgcacaaaagtcgcagttgactttgtgtcaccagagaacatccatgagtgtctgcgtttgaccgaagagtttcgccaacttcccaaaaaccacaaggccagagaggacaaactcgaggcaagtcttttatctctttgacatttctttctttcttttttttttgttcgttgtctgagcatactgtgcattgcttgctgcgggtgtttttttttttttgggatatctgaattcaattagaagagatgggcgattgaactaaatcaaaactaagaccaaaccgatttactcaattatttttgttgtttttaaaatcgtgttgagaaaactccatatcaatgacgagatagaaatcaaactaaaaatgacaaaaatatatgtttttcctccccaattctaatttacatttagactttaaatagttagcagcacatgatttgattacatatttttattatttggattttcttttctattgaaccaaaatatttcgatccaaatattggataaaattttggtttcaattaggttaatattttgttttcatttataaaattataaatcataaatcaaaaacttaaatgcccatctctacctaattacaataacaaggggaaatatctaatggccggttatccgacctattgataagctatttttatttaagctttcaatgcttgttatttgtttgcacaaatgcgtttgtctccgttcgatgggtatatttcacaaaactagtttatctaacaagttacaatggtttctttttaaatgtgattttttttattttacaatgttttcccatgtaaacttaaacacatagattgaaaactagtgaggtcttatgcaaaatattactcgccgtgcgctttattgtaatcggcctcaaaaataaaacatctttaagtactcaggtggtgctagtgtactcactttgtcaccacccatattcgaactcgcatgttgcgtgttgttgacaaaaaaaagaatctaggttgcattgtggtactttagggtaaatatgacttgtgtagaagtgttgaatcatcgatttacccaatccggtcaagattgaagacccatg

SEQ ID NO: 5060 - DNA, 3000 bp, Unknown
  misc_feature (1)..( 3000): cDNA_ID_1827282_gDNA_ID_1620759_Annot_ID_49956 3000 nt of promoter + ATG
ctatgcagatcataaatgtgtacaatcagaagtatgagagtgcgggtgcattctggccagacgttcatggacgtataatatcggcattgatcatctcacaaatccttttgttgggattaatgagcacgaaaggaaaagttcagtccacacctttcctcctcgttctagcgattctcaccttcggttttcatcggttttgcaaaggccggtacgaatcggcattcgtcattaacccgttgcaggttagctcaaaccaagatcgagcattttcggttaatggatggtagttttagctacatttgttttggttcagtttgtgttatttaatcttgtgagtaccggtttacaggaagctatgattaaggatacattggaacgagcaagagaaccaaacttgaatcttaaagggtttcttcagaatgcatatgttcatcctgtttttaaagacgaagaagattcagatgaagagggactaatcgaggattcagatgacgaagattgtgtagttgtacaaaccaaacgtcaaagatcacggagaaccaccgttgcgagcagcaatgcgagccgtggctcgtcacaatcaacgccttttaatcaacttgatttgggtaaggggaaaccggagacttgatggtccatgagtaattgacttaaccggattggtttgtctacgtagagatcttttttttttatcttttcttttgttacgtgtggtgaaaggttttgtatatttgtatgattatcattgttttgtttgagtttgatgtaaaaaaaaagagaggtgattaatgcaatttcatattgcttcgttttttgctaaatcggttttgtaattgttgtttatgcttatgcaatgaattgtatcattctttcgttataaatttgagctggaagaaatattaaactagacgttttattttaaaaatgagacttacattgaaacggtatattttttcctattggcaagtgtattttttttgtttggttgtcaacaaaagtattttttccttggctcaacaacaacaaccatcattttttaaaaagaatgtaaatatcattcaaaattaaacttaggttttaaataagcataaacttaaaacatagttctataccaaagaaagattaaaaaaaaaacatgaaaacatgaaaacatttgaggttcatttcatcaactaaaccttaaacgatgaagatcttggtaaaaagatgtagtgaactcgacaaactcctttaggcgaaaccgagagagaaatcaaaaacaagataagcattagatcaacattcaacaatatagcgacctttcgacgatggcccaaaacaagcaaaaacagagctacacgaactagtagcagaagacaatgctttcttactctaccaaaatcctcctaatatcaatagtctaacaacatcacatcctctaaaagctttatcagcacttccaatcgcaaaaattagcaactatcttacttgtatgtaccttatctttactgttgtaaaagttttatgataattttttccttaaaagcttttatttattaacataaaacaattaaaaaaaaaatccgacatgtatgtatcgtactagacgtaagcatcgcatcgataggtttggtcaagactcaagactaactattgtgcgtgtttcaaagcttactcagatccatgacaagaagatatcgtactcattctttattaaaaaaaaatgttggaactttttattttttttcgtgagatccaatgaaatggaactgcataaggcttatatccaattaaaacaatatttttttttaacatctcaactaaaacaatttttctattaaaaaaacctaattttttttatacacttcttactttttattattattattatataaactatctaattagtcaatctattataattatgtttaaaagatcttataaaacacagatagtatctacagatattaattcatgattgtaggaatgaaactcctggttagttatgagaatctaatgaattcattgagttataaaaataaaataaaagatatcagaagatattttcagtttcttattcggataaatatcatacgattttttttttataataacctttacaaattgttgattactaaaacgataaacatgccaataaatatcagtaagaacaacaataaatccaaaaatcaaaagatatctctttaaatgcaaagaaaaatccacaactacttaaaaaccattgactaaaagtagaatcaaatcaggaattttattaagactgcttttagcttgttgaaataaaataaaataactaacgctttatcagaagtgagtaaacgttctttatttgttttccacgtggtgagtatcggtgaaggtaataatcacctgcgatgcatttctttaatcacttgcgctccacggatcttataggtcccaaaaaagtgctttaacggtcagattaggctcgattctttttctttttttccgtgctcaagaaattttccttttcctaattctgggatatttctccgaataaactatttctcttttttcctttattcagttatgaaataaaaaggaaagctaagtttgagagaatccaaagtttgttcaatctctttcatctaacttagctggaatctagggtttatagatttgtttttcacaggagattcatcgttgcagagttcttcgagcttgtttttttctgtgtttgtgttcatcataaggtaaaattgagttttcgatcttcttctgatttccaattctagactcaattgtctcttttgattgatttggttttaataatgttgtttggttttgattggaatcgattgatcatatactgttttattgcgattaattttgattatgatcgaagaactcgaatttgttgtctctgttttagatattcaaatctgcatgttcgttttgtttcaattttggtgtaagaatctgtttcatagatctgaattaccatcactggcgatttttgtttgcaggagctaaagaatg

SEQ ID NO: 5061 - DNA, 3000 bp, Unknown
  misc_feature (1)..( 3000): cDNA_ID_1827278_gDNA_ID_1620759_Annot_ID_49957 3000 nt of promoter + ATG
ttggttttcccatctttttcttctctttatgctaccaaatcataagtcactcaacatcaaatgaaacttccataaccattaatccaaatgcaaaaatcatgtaatatataacattacactacataaacttaccatttactacaataatttcatacttcacctagcaaaatctcaaacatgtaaactttgtctcctaaccacagcattttcacattctaactaacaaatctcaaacagaggattttatttttctctaaccaaatctgtatttgaagtaattgtatattagacaaaaagtttaaatttttacacaatttaaccatttggggatttgaaattgatttgacaagaaacagactgttaaaaagttaaagttcacagtaaactgactgaccaatcacattattaaatttttaactaatttacctgtacattcgccgacactttaacggatacccgtttcacactcgagttcggatccgggttcagtttcggtttaagattcgtttttttcgagaatcctctccgtagccaagctcgaccttcatggagctgagagagcataaaccaattaacgaaaatgaagaaaccaacaagtacgattacaaacgcggcggttttcgccgttctgattcgtttcctttttgctctcttaaccggatttttcaaattccggtttggatctccgttgatccaagacaaaaccgacccgatacaattcgacccggtgttaagaatcttgtctccagctacttctgaaaagcgggttggaccgagacgtgtcggtgattgaaccggtgaagctcctcctcctccatggatcagatcttggactcgaagaacatcgcgagtctctggtttctcttcgtctggtctctcagaagacatggctaagctcacactctctctcagttctgttcgatcgtgagagatagatttgctgaatttaacgaagctagcgaagaaagagcgaagtgagtgttttttgctcgaatttcagtgaggatttttcttctttgtctgaacgtaattattaaagttttttttaaaccttgagattgacgctggtattaatttaaggtccctgtcctttaaaatcattttaatctttacctattattttatctaatacgaaatataaccctacgtatgtccgttgtggtttcaaagttataagaaattgatcaagtagactgttcttagtagttgttatcatttcttagaattaataacattttggtaagacagaattaataattttgttgagtatttaagatgaataataatttttcatttagcgatgtgtaaagttggattagctcctaccaactacgtaaataataaaattgaaaactagtttattactactatctacagcttgttgaagctatatctatgaaatttgaataatttttcattgtgtttcataacataaacaagtagctaaactagctgtcaaaaacaaaaatagttgcaagcatgtgtttggtatattgggctttttgtgtggagggtttcaaatacgctttctgcatatcagagtaatatgattttaattggggcctagacatctgtttttggtgttatattaattagacaagagttagagaacttattaatttccttttgtcaggccttttttttttgttaaaggaaatatagcacatgcagacacttattaacttactttttcaagataattaagttaagaatttaaaattgtatttacaaccattttaatatatgtatatagcaattgatacaaatgtttactttttcgacatggtactagtactacacgtctacaaggactaatataatgagagtattaaaaaacaattgcagttttgatgtaatcccagatagtcttaacgcacgtccttagataaatttctgtgacactgatgaaaggtggttattaaaaaaagaaaatgaagaaaaatgtagctagattattcacattgatttggacgtaagaaaagtaattcgtattgggaataaaatagacaaaaaggtgatttatactgaagaatatgattattaaaaaaaaacaaaaaaaattatagacttcaacgtgatggcacggtatttgcctattttcattattttcttacttgagtagtattagtaacaatttaattaagctaatttcatgattttttactttagtcaactatgaagtcattatcttattttagcaacaaagttattattttagttattttaatctaactttatctccaaaataagcatgggtatatctaaaacaaataagatagatgtgtaataataataaaaagttagagctggtttaagtttaatttaggaataaacccaattgggacatttttttgaaatgaaactttttcaaggaataataatagtctcttgagttagacggccgaccaacaacaactagattcaaagattttaaaaagatccaactttttcatcatcttcttcttcttctatttctccgtgtattttcagcgttttgtatcaacaaaaacggcacgaagtttcttttcttctcttccccatttttgtgctgttaacagaaccaatctctctgttttttccatactctgttttttcttccctctctctgtttctgttttcagaggaaggagaagagaaaactaaagaaacttgtgcaatacttttccttgaagaaaatttaaagattatattcgaagaagcttttatacaaaccacacaaatctccacttcaccaatatgatttcttgattcatctcatattattttcttcttcaatctgatcgcaagaacattgtgaaaaaaaagagtcaacgaaagggccaaatttttttgagtaatgagtttctaaaggtgagattagtataagcgtctttgactattatacaaatctaaaacttgatctttgtgtctaaactcttatgacaatttttagggctcttatatatttgcaggtgaagaaagaatttgtgagggtttattataaattagtttgaggagatg

SEQ ID NO: 5062 - DNA, 3000 bp, Unknown
  misc_feature (1)..( 3000): cDNA_ID_1827274_gDNA_ID_1620759_Annot_ID_49958 3000 nt of promoter + ATG
aacctgtcaaatgcatacaatatcctaaaaattggaaactatctcttcagaccaaatagcaaagagagattctatattaatgaaaacaataatctttacagtgaattgatcagcacgtcgcttctctgattggagaaaagataaccgcattgcagcaattttctcatattccttcattagtacatagcaagtccaaaatgtgaatgcataagccatcacaagatgtgcccaaaacctttttaccaaattaagaaaaattctaatcattataaagtttttaacaaaaatcagaagtagcaactacataattttctttcactaacaaacctgtctgatccacgttcgacattcgaaatcgaaagcttatcgatattactcgatgttacattacgaagttttgctagctgcaatccatcacttgtccaatttacaggtactaaaattgaccatgaaagtaatgcaatcggaccaaagatcttaagcctataaaatagtaaacaaaaaaaaaaaccattagaaaaaaaaaacaaagctataattagtaactgtatgcaagaacaaaacattttttgattacccaatcaagtaaatcctcaagtaaacagcagaatccaaaccagcatgatcaataagttcaggctctggcatcttaagagcatcaggcatccagtttaaaaaccgaacgtatgatcgaaagtccaaattcataatcttgctaacgaaagcacccgaattcacagggctgcttctaacaccttttaagtaccatttagggaaataaaccctatcattgaatggttgaatcctcaagattgcaaatagcaatagaaatatcaatgcacttagaatattaatcgctgctgctagtccaatatctgctaatgtcgccatctcctcaaactaatttataataaaccctcacaaattctttcttcacctgcaaatatataagagccctaaaaattgtcataagagtttagacacaaagatcaagttttagatttgtataatagtcaaagacgcttatactaatctcacctttagaaactcattactcaaaaaaatttggccctttcgttgactcttttttttcacaatgttcttgcgatcagattgaagaagaaaataatatgagatgaatcaagaaatcatattggtgaagtggagatttgtgtggtttgtataaaagcttcttcgaatataatctttaaattttcttcaaggaaaagtattgcacaagtttctttagttttctcttctccttcctctgaaaacagaaacagagagagggaagaaaaaacagagtatggaaaaaacagagagattggttctgttaacagcacaaaaatggggaagagaagaaaagaaacttcgtgccgtttttgttgatacaaaacgctgaaaatacacggagaaatagaagaagaagaagatgatgaaaaagttggatctttttaaaatctttgaatctagttgttgttggtcggccgtctaactcaagagactattattattccttgaaaaagtttcatttcaaaaaaatgtcccaattgggtttattcctaaattaaacttaaaccagctctaactttttattattattacacatctatcttatttgttttagatatacccatgcttattttggagataaagttagattaaaataactaaaataataactttgttgctaaaataagataatgacttcatagttgactaaagtaaaaaatcatgaaattagcttaattaaattgttactaatactactcaagtaagaaaataatgaaaataggcaaataccgtgccatcacgttgaagtctataattttttttgtttttttttaataatcatattcttcagtataaatcacctttttgtctattttattcccaatacgaattacttttcttacgtccaaatcaatgtgaataatctagctacatttttcttcattttctttttttaataaccacctttcatcagtgtcacagaaatttatctaaggacgtgcgttaagactatctgggattacatcaaaactgcaattgttttttaatactctcattatattagtccttgtagacgtgtagtactagtaccatgtcgaaaaagtaaacatttgtatcaattgctatatacatatattaaaatggttgtaaatacaattttaaattcttaacttaattatcttgaaaaagtaagttaataagtgtctgcatgtgctatatttcctttaacaaaaaaaaaaggcctgacaaaaggaaattaataagttctctaactcttgtctaattaatataacaccaaaaacagatgtctaggccccaattaaaatcatattactctgatatgcagaaagcgtatttgaaaccctccacacaaaaagcccaatataccaaacacatgcttgcaactatttttgtttttgacagctagtttagctacttgtttatgttatgaaacacaatgaaaaattattcaaatttcatagatatagcttcaacaagctgtagatagtagtaataaactagttttcaattttattatttacgtagttggtaggagctaatccaactttacacatcgctaaatgaaaaattattattcatcttaaatactcaacaaaattattaattctgtcttaccaaaatgttattaattctaagaaatgataacaactactaagaacagtctacttgatcaatttcttataactttgaaaccacaacggacatacgtagggttatatttcgtattagataaaataataggtaaagattaaaatgattttaaaggacagggaccttaaattaataccagcgtcaatctcaaggtttaaaaaaaactttaataattacgttcagacaaagaagaaaaatcctcactgaaattcgagcaaaaaacactcacttcgctctttcttcgctagcttcgttaaattcagcaaatctatctctcacgatcgaacagaactgagagagagtgtgagcttagcc

SEQ ID NO: 5063 - DNA, 3000 bp, Unknown
  misc_feature (1)..( 3000): cDNA_ID_1827264_gDNA_ID_1620759_Annot_ID_49961 3000 nt of promoter + ATG
cgaggtcgaatatcccgagtaccgtgggcttatccaccggtggttcgtctggtccaaccgatagcgtcaacacatctacgccgtccataattgcctatgacaaaattaaataagtaaacaaataaaattggttaaagatcactaagagaaatataggccctaattagtattgtttacttggtcgatggctgcaattacgtcaacaagagttccgattgatggataaatcgccttgtagacggctattctgccacacaaaccaataaaataactcgtcattttttttccaaaactataaagtatcatttagtctttgaactttcaatatatgagctaatgaatatgcgtgaggtgacaaaccgtgaacgtggggccataccgctagcacggccgtagaagaatccgtcgacgatcaccggaactccagcgttcccggctgcgatggatgccacgtggctgaaccaacccgaccaaatagtaaacacttatgcaacacatacaatgcacaacaaacttacaaagcaaatgtatagaccattttacaaacacaaacaatataaagacatataatctacccccataatatggccgtaaagagactttagcaaaacttattgtcattaccgccaataatttaaaaccattatatagagtcaagtctacaacctcatttccatattctcaaaaaataatatgaacatatcattacagtttaccaaaaaaagatagatttatagttttttttctaagatatatagttgactacaaaataaagacatgtatttataatacaatggctaagtgatttatcaaattcaaaaatggtatttcacaaaatctcttcaaaaaagagagagacatttataccttccgtggccggacgcatcgaacggagagagtatatccaaggaggagttaagagcgcctgaagctcgagctccggcggaaaagaaccttgcggagataatttttccgttacaagatccgggtggaaaaaagggaccgatctcacagtcaccggagaaatgcaaacgtgagagatttgatgagtaagggtttgtgagatcaagtgcggcgaagctaggatgagtagggttaattccggtgtccacgaaaccgatcacgatgtcttctccagcacgtctgtctccttcgtttgagatcttttgccagacttgttgaggaagttccaagaaatcgggagtgtatgttgtcattagtttcactcctttgtcttcttctactgccttcactccttttgttttcccgagtttcttggcctgcaagtatcagacaaccaaaattaaccagtgattgaactaaacctaattaaaaatggaaattatcaagagattcaaaactcggcgatcctggttggtttagtttcaattgtttttgatattttcttaatatatcggattcatagtagttgatatcaagtaaaaaaattgggaattcatttagttatgcacttgcgatataaagtgggttcaatttcttaaaaatatgactttttatccaaaaaaaaatgaagtccttaaacttgactaacgaaatgaaccaaaacagaaaagtgaaccgagttatattcattttgggtaagcggagaacctgagaagcagtggtacggactgcaatagcattgatgacatgtttgaagctataaagctttgtataacttcccttttcaagtgtgcttccaagtatttcgtcatgaatctcttctatcttctttgcttctaacgccatagctttgctaattaattgtcgaacatcaaaaaagtattcctcaataaataaatgaattatataatgattaatttagatattggccaagtcaaagacatattgttaatgaacatggaagatgagaaaataagaacttatagatgaatttaaaccaagtatatgaaaaaataataatgtgataaattctttaaatttcgaagaaaaatgtattgatgtggacctgttgatattagtagaagctcgaaaggccaatggttcaccttcaaccaaaatagagtaaatctttggtatatgatcatcgttttcgccttttccttctttttcttctgctctggacaatattgcacaaacaaccaatacaaatatacatactattaaacatatgtaggaatatgatcttagttttcttggattggtttccattagatctttattaggattctccatttgcgttaatgaagataatttatatcatgtagagggcaatgagagtcatgttcttggacaatgcacattaccaacgtgaccattttattctatcagaggtttatatatatgcgttacaatttgtaatatttggtattatggtgtgagccttgcttataaggaagttattttcttagttcaaaccataaagaaaaagtaaaaaggaagcttatttagaaaaagttatatcttaaacaatctgtcattcctttttttcccatttaatgttatttttcaacttatataaaataggtacacaatttatcgtatgccacatggcatgttttgattcgttttctaggtttttgctgacccagattgataagattgtgaactacatttttcaagagtaatttcagttataatgagaaatatggaaaattaattaaaatatagcaatgtaaagataacaagattgtttgaatattccttaagacaagtttaaaccattttacccttcatttaaactgttacagaaaagaaaattagattttttcattagacattttatttctgaaacatgtgaatatttgcattctcaatctcatattctcatatagccacaatattcgaaatataattcatgtaacaatattatcgtccaaatcccttatggaattgtacacaaaccacttcatttctcgactcatttattattgggccaagatgggccggactattgtcttaagaaaatataatctcaaaacccaaatctgctaacatatatcgaacaaaaaacctcaggaactcttgaaaacttgttaa

SEQ ID NO: 5064 - DNA, 3000 bp, Unknown
  misc_feature (1)..( 3000): cDNA_ID_2781280_gDNA_ID_1620759_Annot_ID_49964 3000 nt of promoter + ATG
attaattaaaaaaaaatatgcttctcgtttaaccaaaataccattcacatataccctttaaaatttttaaatgattaatttcatgtagaaatcatatagactgtaaatgggttcacgaaaaaaaaactggaaaacgatgaatattgatagaatgaataaaaatggtattgatagaatgaataaaaatgagaatgtaacaaaaaagatacgtgaaatttgctaatcccatgacaccgtgcttgcactctttttaagatctaaaaacttatatatttcttctaactagtagtaaaaaactaacccttttcttaatacaacttttttgcaataatatatatcttaactggtttaaatcttatggtataacaatttgtcccaaaaaaaaaaaaacttatggtatacaattaaaaaacagctactaatagtctaatacttcttgtttttttcatcagaagctactaatacaaaccattaaagttttttatttatttctatcaattatttctcgtggttttttgaatggtcaaagatcaaattgtatttaataacgtcacaaaataatctgagaaaaaacgagagaaatggtttgcgaaagtttctatcagactagagcaaactgaaaagacagaaaaacgaaaataggttagcaagcaaattgccacttaaaatatttcattaaattaacaactcaacaagaccttgttccggcaaacacatacagtgcgtcggattataaaaacatagtcggcattggtaaaatacaagttaaatgcgtattaaacataaacacataagctttacttttagttttattgtagtgaagcaatagttttgttaaaacatttttccaggaaaataaatcaagaatgatgcggcaatgcaaatcatctatctagcatcaacacctttttgacttttggattcatttctaaattaactagtataatttataatttaggatgatttgttttatattgaattaaaatggatacagaatctatgatcgagtagattacaaaaaatgattaaaaaaagaagaagaattaagttgaacaaaaaaaattgaaccaaactcgcatgaaatagtgaatatacagggtatgatgggaaccaaatatatatttaaattttaaacttacatctatcttaatttttgcttcccatgttatcttttggtactcatatcatagttcatagattatgtgcgtacacactacacatatgattatgatttatgaatactgcattaaactgtttcaaatgcacactttaatttctctttttctccaaccaaactttaatctagatctaaacattatatattcataatcatgtgtacccattagacaattattggaaaataaaaaattatatcacgcgcatgaatggagtctaagatcgcccaagagaaaagtaggtagcagccacgaccgaagtctttgttctcactttggttaacgtttttaagacgatagggagagtgagaaagagacattgtgttattcaacagtttattatgtaatataagcttaattgcaactagtaactaactaataacattttacattgtgtatacgtaacgacggcttatggttgtgatattgttttggatgaattattgagttagaaaacaggttttttaataaagtgaaaagaaagaagtaatattttatggttttataccataatgcactctttaagttgagtaggaatattcgataaatttaattccaatatataattatttgacttgtattctttaattatgaaacatcagatcaacgtagaaagtgtgaaggaattttaagatgaattgatatattaaaaggtggcgaatattatcaaacaagccaccctgtaaatttggtagtttatatcccatatgctttctatttttctgaaacactgatacataatatctcctaaaaacaaatatattagagaatttttttgataaaggtttcttagttcttacatcaattcgaaagatgatatacatgctatcaatatcaccatgaattatccttgatactagaaaattgatggcacacttgatataagaacttgtattttcaatatacatttattctatacaaaaaaaaaaaaaaaatcctagaacaagtgggtagagaatctctaacaagtaagtttcaataaatatacaagacaaaataaattatgtgataaatgataaaaagagacaaattaagcgagttttatggatcaacagatgatttgtctgataaaaataaaatctttatactggaaataattcggacggtgtgcaaagccaaatctaaaatacaaaagaagtaaagtgttacacatttgaaaagaatcctagaatgttacattattgcaattttaaaaattccttataaaaaggatatcaagtaattttcgaaatcagtatcctgaaaatggaaaatgtaagtgatagaactagtctcctttttaggaagggtctcttctcaaatttggttatatgattcaaacgatgggctcaactagtaaactttgtcattcagagttgtttcgaaatacttgaaatctctcattattgttctcttttttcgtaaatttttcaaactatttcgaataaaataaccccaaaagggaagagaaaagaaaccaattgaagtgtataaatagagacccaaaaggaaaatgccaaatgaatcaatctcttaaagaaaggagatggtaggggtccatctatgatgtgctcacatacatgctccacgaactcttgtttcttttactttaacttcttcttttttaacaatttgaatgaaacatatttatacatcttatctatgactatgactcgcacatattttctcagaattttatttattttattgaaagccaatctctctcatttgcgcctataaatagcaaccctctctcattctacaagtctcacatcaaagcaattaacaaatacacaacttgtaacttcaaatagattactttcaaagaagagagagagaaagaaag

SEQ ID NO: 5065 - DNA, 3000 bp, Unknown
  misc_feature (1)..( 3000): cDNA_ID_1827254_gDNA_ID_1620759_Annot_ID_49967 3000 nt of promoter + ATG
aaaactagaaaccctagctcaaaggggaatcatcaacttgttgtctctccactattttaccaagtcgtgagataaattttgggccgaagatggaagataatgggcctagagattttcagcccaatggctgaaaacattttatgcatgaatggatttgtaactagtatcggaaaccatccaaacatgtgatgttgtagactagatcatctataaaattgtatggtctaaactatacaagctatgtaaatggtgtctgtttctaatactatgtaaactagttaacaagatttcgttaaaataaactataataaccaatgaatcaaatcggtaattggaactaattgagtgtccaacgctcacaaagccaacccctaaatctcataaacctacaaaaggacaaaatgtattagaagattgtgaatcgcaattttgacaaaaaaaaaagagtgagaaaagaagaagtatagttatctttctaagtctagttaaatgatctacttgttggaacttcaattctaaaccaatgacttctggtgaagttcattaccaaaatgatcggatcttgaagtcattagattctctgcaatgaacattataaactaatgtaactacatgtaaaaattgaagtcatattacataagaaattgaggtcttagtttgaaagcttataatagcaatgaacaaatataaacatttatttcacattggaaaatgaaatattttcctctatatatattatacacttactacaagtttcactagctttgtgaagaggacattatggtataagtgatgaatagacatgcaaaacaaacatcgggttttggtgaatgtgcccacaaaagatttatgaaacatttgttttttgaatttaatgctaaattatattcaaaataaaaaaaaacgttttttacacaaaactggaaactgattgaaactttttatgaaaaaaaaacttctcttctctaagctctcgatgcaaaccaaactctcatttcatccttatacttcaaaacaccacaaccactcatcgtacttaaacgatttctgacgtttttgtctatcatttttataagtctctccggcagggatgggctcttcccgtgtcttctttggttcctttcattccaaattgagtgtatgaaacattcgtcacatatttttggtccaagatcaaactgttttctcttcggatttttattcaacatttgtcacatatttttggtccaagatcaaacagttttctctaacggaacaagattctacagcttctcagcttccacgtggtcccgatcatggattgccacgtgtacgattccacttggtaaacatgatttttttttggaaagacaagttgtatctgtaagattaaataattcagtacgaaaaggcatcgaatcctcactcacggattgttcacaaatgttgtctccaagtagtgtaaaatatttcgctttttacacattgccaaagatcatctccatccattaacgttacgtttatctccgaatatactttatgaaacagtttgttaattaattaagttctagatatcaggtagaaagagagtttatgacactttctgtcatttttagtcatattttaagggaaggtttttgcagagactagaaaactgcaaatcatatagtgtttctaactttgatatattgaagatttttttttgttgatatattgaaattttgatgtaatattaacatgtcttatttatgtttctttatctcattcggatgtatatattttttatgccacaaggttttctgtgacctaatatcttatatgatcaaatcaatagtttctatatccaaatataacatgatctaatggtacaccaataaaaatgctccaacgatgatcgtgaaaaccaataagaatgtgatctgaatttggtttattattacggtgtaattttgttattttactagccagtgttgtatatggatgaatcaaagtgtaattttttgtgtaactaattattcgtcgatcgcgacaattcccttttaagataggatagtttattgatatataaaataatcctaatactaaaatagaaaaagacggtcagataacaaatattttcgcagtcgcgtctaatggtttttacgaagttgaatacagtgtgatctttggattatttttgaagtcaatcttcatctataatttttttttaaataatattaggataataataggttgaagagaaataattatatccataattttctgtaaataaatacagctttactttatatttattatcatcatcgaaccaatgatatgaagcaattttagtcggtaacttggcgagtcgttaattcagttcgaattataaaaagacttctaaacacgaaccgaacacgatttgatttgttctcaagagaaaatatataaatagatttataactctttacttctcaaaaggctaacttttgaaccaagcaatcacgagaaacctttgaaaatctcttactttggatccgttcccttattcacttggtttcttctttaacttccaaaactcaacttgtaaccaaaactttctggtgcttttctttcttctcgtgtcctttatttccccggaaaatttaagctcctcttcgttagtttccccggaaagtttcatcattgttatacactaggaaaaaagaagaagatgaaacccatttgtttccttctctgtttctgcttccttcctgtgaaagtctcttccttttgacacaagtctcttctgtttcaaattttctctgttggcttatttcttcttttccctgattctgttttgttttccctagaaaattaatgaaacgacggttagattctcgggagatcctatcgaacccatgtttttgaatcagttcatgcacttcctgaaatctattcatactttcagaaggaaaaacctagtttaacatatctttaaccctaatttctctgctttcaaaccctaccttgtgaaccaagcaaaactctcctttgatcaat

SEQ ID NO: 5066 - DNA, 3000 bp, Unknown
  misc_feature (1)..( 3000): cDNA_ID_1827250_gDNA_ID_1620759_Annot_ID_49968 3000 nt of promoter + ATG
aaattttctctgttggcttatttcttcttttccctgattctgttttgttttccctagaaaattaatgaaacgacggttagattctcgggagatcctatcgaacccatgtttttgaatcagttcatgcacttcctgaaatctattcatactttcagaaggaaaaacctagtttaacatatctttaaccctaatttctctgctttcaaaccctaccttgtgaaccaagcaaaactctcctttgatcaatatgtctggtttatgtttcaatccgtttcgtctacgttggtctctaagatccaaattacctttagagccgtccctcccgaatttaccctgtaacccatcttcctccaaaaccaaccggtatgcagaagcagagacgatggagaagaagagatttgacagtatggaatcttggtcgatgatcctcgagtccgagaacgtggagacatgggaagcttctaaaggcgaaagagaggaatggaccgcagatctttcgcagctatttatcggaaacaaatttgcttccggagcacactctagaatatacagagggatctacaaacaaagagccgttgccgtgaagatggtgaggatcccaacacacaaggaagagacaagggctaagcttgaacaacagtttaagtccgaggttgctctgctttctcgtctctttcaccctaacatcgttcaggtctgtattgtttatcttcttatcaaaacatgtagctttcattatcaagaagtaatatcattgagggagaaaaaaaacagagcaaagatcattggctttagaaaatatgtgtctctacaaggtttaaaattcttgctaatttcatcttttattttgatatatagttcattgcggcgtgcaagaaaccgccggtgtactgcattataacagagtacatgtcacaaggaaacctccgaatgtacctaaacaagaaagagccttactcgctttcgatcgagaccgtactaaggctggctctagacatctcaagaggaatggagtatcttcactcgcaaggtgttatccacagagacctaaagtccaacaatttgcttttgaacgacgagatgagagttaaagttgcagactttgggacatcttgtcttgagacgcaatgcagagaggccaagggtaacatgggaacttatagatggatggctccagagatgatcaaggagaagccttataccagaaaagtcgatgtttatagctttggcatcgttctatgggaactcaccaccgcgttgcttccgttccaaggcatgactcctgtgcaagccgcattcgcagtcgctgaaaaggtcagtctccattcatcttatttaccagattgttgtttttcttgggatacaagttattgatttttttggtttctttgatgagcagaacgaaagaccaccattgccggcgagctgtcaaccagcgctagctcatctaatcaagaggtgttggtcagagaatccgtcgaagcggccagacttctcaaacatagtggcggtgctagagaagtacgacgagtgtgtcaaagaaggactgcctttgacgtcacacgcaagcctaacgaagacaaagaaagctattcttgatcaccttaaaggctgtgtcacatccattagctcaccattttcttcctcctctgttcctgtaaatgcctagtagtagataaaagttatttgaagtacctgtaacctggtctcattccaaagtttacaattcttctttttctttcactagttatttgattgtatatttgcatctacgtgatgttatgatttgatatacacgaacttaggctaactaatttgtatgatatataatgatacttattgatcactggtctctcgtttaaaagggaatgagctcaaaaagaatacgtaagtgtctaattatctaaatgtgtcgaaagtggataacttgaactcacaagaagtgacttcttagttatattgactcattgtttttaactttttttttctcaaggaattaaaatcataggctattacaatgtaaaggcagactttttcagtttataatgatattaacattcataactagaaaaaaaaatgatttacattggaaaacggagaccatctacatttataataatatcattatttcttttccaaatgtaattccattttaactaatcttaaataaaaattaaacaataaatttcggtcgccgacgtttcagttttctaggctcgattttttctgaacattgacgcatggggaaatattccccattatcaattttggacacgtttccaccatgctgtggccattcctttcttatatattgtagattcttctaagtctttgcacccaaaacgtgtcataattcataactacagatgacagaaaaatccattgaagaggctaggttggcttgtattcgatctacagtattgttgcaagattggataacattcaaagcattggctttggaaggaataagctggtaatttaattcctctatccgctattttgtacagaatatatatagatatatacacttctgatctctcatattggcatcattatgttatttaacttccaaacatcaaatctttagatttatctttgtgttttatacttttcttgggcagtataacgaaccagatagccgaagagaaatatggtcgtctcatgacccaacttatcagctcttgcaatacatctgatatcttaaaaggtgcatgctcttaccatatagtaatatatatagattaacttttatataattatctgccagaattagttctatatatcatatttgttaaaattacattcgtttatactacatatattaaagctctacgtaaattattttctgtcggggttttagctatggggaaaaaagtctgagctaattaaccatgtattaagtttttttttcttggtttttagttattttttttatatgaataacactctgatttgaactgaaaaaaacccaacgaacttaagaaggtttggttatggctt

SEQ ID NO: 5067 - DNA, 3000 bp, Unknown
  misc_feature (1)..( 3000): cDNA_ID_2130298_gDNA_ID_1620759_Annot_ID_167124 3000 nt of promoter + ATG
caaaagaattgtaggctgaattcttctaagagtttgtattcattttgacagaattgtttatgtttatgaccgttattctacctacattcaaattaatagtgcccaaaaaacggtctacttacaagaaaagtgaagagtaaattccataaatacacaaacggtctcttatttctgctcatttaatcaaaagctaaatcatttttctagtcttgaaaatcgaatgtaagattaaatagatattgatgatcaaatattcaaacgagcattgatttagactttgggagaatgtatatacggtggatcattgccaactcttgcggatgtcgaaggtgtagttgatctccaagtagcatttgttatcgtcatcgatgaactgaaatatgtacaataagatgacatcaaactcaccaagttcagtgaaaataactgtattatttaataacaatctgatcagtttctgcaaaacctttcatcatgtatactaaatgatataccttagttcttgcggaataggatcctctagcaaacataccagacggtgtcatttcttcaggcattacatgttggtaagactcagcttgaggactaaacgtcccaagcattgcttttgtactatccactgctcagtagggaaaaaaaaaaactgaacatcaaaagagaacattcgacaatatttttaaaatgaaggagaaacacacgaaaatacaaagtaacctttaacaccggttttccacacggtattgttatagcgaaggcccgaaacgatattgtttgtgacacggaagttgaagacaagtgtgtatttagaaccttcctttatcgtaaaccaagggcctttcgggtttggcaacccatcttcgggtattgtcaataccatttcctctctgtctggtgatctaattgtgagatctagtatctttactactggatccggtgtttctgcatttcagtttaattaattttatgttagataacatgattcaatagttttgaattttgtatccgttttttttttccttttaaccgagcctaaggcaagccaaaatgtcatttaactaacatgcatatgattcgttcctttcgtacgtaatacttcatttgaatcagaactagtgagaccggtataatcttttcaccattagagctaaatacatttgattcttaatcaatattctaaaccatacttacgaaccatggaatctaaatcaagtaatgaatttggtttacctccgacatcctccaaatccacgacgccaagaagctgttccttccatctcctcaggctttcatcatcctatcaaattttcgtcgaaaataagaaatatcgaagaaaaaaatttaaattatataaagccatttttaaacaagaaaaaccagatagttattcttgacgttatcatctattattaattttaatttcaccaagttcatactttaatatgccaagaatatagtaaactactaacattttttccccattcataatatggtatagtttacatatttcgtataaataaacaaagtaaaagaccttgtctctctcgagttgttctttgagagcgatcatgggaccgagttcgagcttcttgtcttcatcttcttcatcatcctctgtcggagacaaagagctcccactgttctttctgcttaaccccattttctctgatgtctctcctgacgcttcacctttcttcatctcatcttccaaaaccatcttaattttgtttcctcttaccaaaaaaataagttcttgttgatctaataagaacttacacaatttcaaccgttggcttggagtagaatgcaacgatggctatagagaagacagagagagaaagagttttttggtgtatttttgttgagcaatgtttatatttggagcatgaagaaatggtcatgtggtgatcctacaatcttgtaagtctcactttcaaatcaaaattgtctaaatatatacgtattctacaatgcacatacatttgtaggctcaacacctaaatacatggcaactaatttgacttataggagactaaaaagaggattttaacaaaaactataaaaggagatatacctagtactcggaggaatcaactcgtgtagttgggctattattatcagtttccttagcccaatgtggcctcgtgaggtttgcagtttcccaatagtgtgattgaaaatattcatttctagagatgaccttaaatatctcttggtttactctaattacgttagaaggtttactttttgtttgatggtcggttggttatttttgaaggcttagaaaatttcttgagtgctcatatcaaacacgctggacactaaagctttttaagaaagatctacaaaaatcaaatttcaaagtaatttattttgagaatcaaccatcaacaacaacctcacgagtcacgagctaataagttgatgattgacggctcaaaatctagtggatttgagagaaaacagtaagtactgtaacgggacaatgtgaggtggtaaccttatttcttgaccagggggagagaatatatccaacaattaactaagcgttattcatataagaggataaattgagcttgcgaaaatggtgtagaagacaacctaataaatagaacgggctttgacaaaaacaaagatatggtagcccaaactcaacaaagcccactacagaagcccagtcaacatatgcaaaagaagataaagaccaaaagctctttacctgcaaaacagaagactgtcactaatacggagaagaagacaataacacttgaaaacaaattcaagccgttgcagtcgctgccgttgcagtaattcacaataaatagctattgattaaagataacattgtcaaggattctagattgttctaaagaagtctataaaagaaagatgtaaaactccattgaaagataagcaaaataaaaacatttttgtcaagaaataatcacagttttctttttctcttcatggtatcagagctattataccttaacaggtgattca

SEQ ID NO: 5068 - DNA, 3000 bp, Unknown
  misc_feature (1)..( 3000): cDNA_ID_3075516_gDNA_ID_1620759_Annot_ID_167118 3000 nt of promoter + ATG
gccaccacatggcacatcaaaatgcttacatcatttcatcatctttttcttcaccatgcttctgaaatgttttgtatgcgtaatgtttcagctggcaaatattttgggtcgtttcccttggttgacatgcccacgacaggttagtcattgagcacaaagaataacactaatcttgcagacgatcttttagggagtttatagtaaatctttgaatcatgatgcaggatttgtccactggctggctacagtgtgacgctgatccattgttcaaacctgaaccttttgctttacctgcatggattccagaatgggtaagctttggtatcatgttgcatcgtgtagaagaaaattatctatgttgtatattttggcgtttgtacttggtatatttctagtcatgaataagtgaatgtaggcgaactccctcagagtataacttatttcatagtgtattcttagataggttcagatcctggcctttttattagtttctgaaataggtttggattctagccattttatggaggttactcagttagctcttgttagctaacagatagtagtgttagactgtgcggttagcctttctgtttgaataatattgcatgaggtttctcaactttctagttcatttgtgcagtttccttggaaggaaatgacgatcctccctgttcagtggcatgctttatgcctcggtttgttcgcttcaatcatagcaccttttggaggatttttcgctagcggtttcaaaagagcattcaaaattaaggtcagtaatcaatacctccaaatatgagccaagcttcactttccatacgcatctaacctctaacaaaaccttgcttgacaaaaaccgtaatcgcaggactttggtgatagtattccaggacatggtggaatcacagatagaatggactgccaggtaactctaatgaaactagtatctcttcgtaagattatgattaggtctttagagttttcattcacaagattcgcattgcatattcttcttctctaactctcatctttaagcatatacataaaccagacctaatgttatctattgttacagatggttatggcagtatttgcctacatatatcttcaatcatttattgtctcccaaagcgtttcggttgacaaaatcctagaccaggtaaatgaacttctcgactttgtatcaaaactgaaaaatattcacttttgcactgaatcattgaatcaaacatgtgatggtttcattgtagatattgacgaaccttacctttgaggaacaacaagcgctcttcgtgaagttaggacaaatgctgaaggacaagctctcataggctccattgccaaaagtttcttttattcagattctgattctccaagaacaggttcctctggaatatccttttatctttgtccttactagagacaataaatttaaaattggattaagatttgttgtttcctgccattgtaaatcctctcgaaatttgtcgaaaaaaatagaagtttttttttttaagtcttctcattggatacaaaaggtttgaaggaagttgtatctactactatctacttatttagtagctttggtggtttttagctgtattttgtatattggttaaaatgaaacaacatttggtttgtttgtctcatgattcgatttgttctatgttttcttttttaactggagaaattgaatgcataacgatgacatagtaggcccatattctttttgactcttctgggctttgaagataggcccacatgttttgttggaaataggctgagaatacgtatctagttttccaatgtttgtgaacatccttcggcctttttactaacagtgttttgcatgaactaatcatagattatatttcatatcgcagcagaattacagaaattgaaacagaattacagaattatcgcaccaaagaccagtctgcggccttgtattcacgggtttagtcctaccatgtcttatgaccggcgagtttatctctagctgacggacttaaaacccaaattttgacacctcaaaatgaaacaatgatcaactaaactatgacaaaaatgattagccaaaacataactaaactaaggtgatactacgatactagtatgaaaaagatgattttatcacgtctttcacgtttgtaccaaaaaggtgatgcgattaattttttcaacaacttcaaagtgataaatagagaggcattgaacaaacgaaaacgctattcattaaatacattgaagctagacgttcttaggttataagcctgcttcttatttccgcgtctgaagataataccaaaaatctggaaaaaaaaccaagataaccacatattatcacgtgacaatcacatgttaaccttgagtcacttgttatctggcacgtgttctcacgcgccggcacattagactaaacacgcaaggtctttagtacacgtcagcaactgataaccgataattactatgacgtggacgttggttaaagaaaataagaacaacaaacacaacacacaaatcaaagtaaacttttttttgtcgtttctttttttctttggtcaattttttttttacatgttttgtcgtatatcaataaactcttaagtgataaaatacatagaaataaatctgaataatttaattcagcactaattatttttaagcatgaaattataataaagagtataaccattgaagattttattttgatacaaagtgaatctagacgctatatgtgcgataaaactgagaatttaaccatcaacatttcacaattatattcagtaagttataaaaaacattacatcaacgacgttcaatctttttaattattgtcacataatttcaccactctgtcgtcatcttttaacattttgtcgtttactccgtttagtctctctctattaaatcgtataggtattataaatatacgttataaattcttcgaatcatttgtgtatcgtcaaaaagattttatcaaaaggacaaaagaaagagatg

SEQ ID NO: 5069 - DNA, 3000 bp, Unknown; identical to SEQ ID NO: 5064
  misc_feature (1)..( 3000): cDNA_ID_2781280_gDNA_ID_1620759_Annot_ID_167112 3000 nt of promoter + ATG

SEQ ID NO: 5070 - DNA, 3000 bp, Unknown; identical to SEQ ID NO: 5063
  misc_feature (1)..( 3000): cDNA_ID_2130272_gDNA_ID_1620759_Annot_ID_167105 3000 nt of promoter + ATG

SEQ ID NO: 5071 - DNA, 3000 bp, Unknown; identical to SEQ ID NO: 5062
  misc_feature (1)..( 3000): cDNA_ID_3075538_gDNA_ID_1620759_Annot_ID_167102 3000 nt of promoter + ATG

SEQ ID NO: 5072 - DNA, 3000 bp, Unknown; identical to SEQ ID NO: 5060
  misc_feature (1)..( 3000): cDNA_ID_2130256_gDNA_ID_1620759_Annot_ID_167099 3000 nt of promoter + ATG

SEQ ID NO: 5073 - DNA, 3000 bp, Unknown; identical to SEQ ID NO: 5059
  misc_feature (1)..( 3000): cDNA_ID_1827286_gDNA_ID_1620759_Annot_ID_167098 3000 nt of promoter + ATG

SEQ ID NO: 5074 - DNA, 3000 bp, Unknown; identical to SEQ ID NO: 5068
  misc_feature (1)..( 3000): cDNA_ID_1827242_gDNA_ID_1620759_Annot_ID_49970 3000 nt of promoter + ATG

SEQ ID NO: 5075 - DNA, 3000 bp, Unknown
  misc_feature (1)..( 3000): cDNA_ID_1827383_gDNA_ID_1620761_Annot_ID_49994 3000 nt of promoter + ATG
cagatagatacctgaaatagaagcaagctcgagtgctcgggatttgaaatggaggaactgcatgagctgaatgttgagagcaaaaggaacatatctgggaagagtggaagatccaacaattgcgaaattggcaccgttttggaactttgatccaaccaatgagtctaagtatgggttcaatagacttgtattcaaactctggcctgccaatatgtcagaaaagaatggaatattagattcatatttacttttgaagttagatatagaagttgcatttcaactttaccaaccaccaaaatttaacttgaatctgcatatcgttagtaacaaaatattttcatgcattatagtatataaatgactaaaatatgaaaccttataacatgtgatttggacaaaacagaacgcatacttaacattgataccaaaaaaaaaaaaaaaaaacagaacgcatcttttactatacggcgttgtttgactctttagtcacgcaatctaatgtaacgagtgggttcacgcgccgaatctacatggtggcacccacttttgattgtgatatcttcccatgttggtaagtgggacccacttttctttggattagattttcatcatttcaacgagtgaattgtgtcgttttgtggcatcacgcaacgcgatcaccgtcatcaattattagccgttgattaaggtttacatctattccatcggacggttgtcacgacttcattgcacttacctctaatctccaccgtctaaataattaactagagttaaaaaaagtcaagagaaagttgacttacaaaggaaatcgatgacgaggcgtccgtcggataatcggccggtggatctctggaaaaacgaacgaccgttaggaagaccaatgctgtatccgagtccggcgacgagtccacccgtgtcggagttggaatcgccaaagttaaaaatcaccggcggaacctgacatcctccggccactgccaagttttgtcggagaatgaggataaacggaaggagaacaagaaggaaagagtgggagtgaagagagagagtagccattgtaacttgctagtagagatttgatcaagatagagtgaagatcgaaagctttgtaataaattgtaataatggtaagccttaagtgtgtgggccttatttctcttattttaagctatagtgtgtgagtgtgattctttagtgaatttaaaaacaaagcctaagactttgtatgttggtggttgacagtgacagacacataactcaagcttactgttggctccagctccaatgtagatgctaattgttcatacataaatatgcatatgcatcctaaagtatatatccaaaacgaatgtacaatggaattttccttttgtacgtaacaacgaaaagataagatcgaaaaaatatgcggcgaaaatttacgttggaacttggaagccaaagaggacgcggaaattaatcatctggacgccaacgctagcttgtttgacttatgcaaatggagcattactcataatttattcatcttcaactccaaaagcatttcgtataaaaattaaccactgatatccagcaaaatgttaagcatcacttactttctcaaatttcagccaacaaaaaagtttaacgtgtttggtatacctatgtgctgactacagaccaatgttttatctctatccatatgaaatgacattcttgctcaaggaagtcactgtacacctaaggaaaggccttttaagaataaatgaggccttttaagaccaataattggcccaacaatatatgttgttttgtatatgagattttcttatattatacaagttttcattatgcattttactttagtttactaaagttttatatataaatcattatgtttcagtatagtttttaattaaaaattaattagttttctgaaaattatactagccactctagttatatcctactttttaatgatataaattccagttattttcaaagatattcttaaattacgtatgtccaacccattgtgtaaatgattacctagttcatacattaaaaatatatagtatatatacagtatgcagtcgaactgaaacatgtaataatataatcatgaatttaattatatattaaattttagaaataattagatgcatacattttgcggatacttacctagttatatttatattgcataagatgcatgccattcaatatatattcgataatccatgcccaacttccaacccttttgggatataaatagttaatttaccatttatgatatatattacacacacaaaagtttgacaaaaagcaagagtgatataatgaaaatcaattcaaaatacgtaagataatactaattcgatattgttaatcaagcgataaaccaagcccttggtttaatatcacagaaacgagttttagcaaaggcaaattgattgcttgaagcttgagaaagacattcacaagctccaccaaacccatgaaaaaacggaaaccaaaaaaatggattaaaacgaggaaaataagttagatttttttttgacaaaacgccaatttggattgtattagtaatcagcaaggagaaaatttaaataaattgccaaaaatatcaaatgattcatatcacctattgtttcgtgttcttatgccctaaagagagtccaagtgttacaagcaaacttcattctcgaaccgtttctcacctttctgtttaaaacatctctctctatatatatgtatgtatataaataaatatatgtatgtgcatgtatatataaatgtgtgtatatatacatctttggctataaatataaggtcgaaccaaaataaaatatagatttggggaaactaataaatgatatagagaatccacctctctcccttatttttttttcttggtttcttgacctattattattgattagtaatagtgagagaggcatattttggagatacacataaacacataaattggaagaataaaataaaagagagtgagagatg

SEQ ID NO: 5076 - DNA, 3000 bp, Unknown
  misc_feature (1)..( 3000): cDNA_ID_1827379_gDNA_ID_1620761_Annot_ID_49995 3000 nt of promoter + ATG
ttcaactaattaatcagcgtcactttaccacttttttgtcttttttttctttaccacatttttcttcacattctgaattaatattattcatcaagaaacttatagcttaccatataccattatatgcgtattctatcgtaatctccggaaaataagacgatgtcgtgctaaactttttttcttaattattagtttagtgtttttaatttttagtcttctaaatggaggttcatttgttgccaaaattgtaaaataataagaagtaaattaatgaatttaaatctattcaacgtatagtactgatgaattaagttattaacatatatcaaaaaaaatcttgaccacaaaaaaaaaagactttaagcatgcagtacttctatgtcaataaattaaaaagcttgatttttgaaacttttggaaagtaataaatttaggtgacgcaagaaagttcaaagacgtaaaaacgttctacatgagactcacaaagccatttagtaaatggtttttcgtcgttaatattttaatatacgcactcaccattttgacgtttatgttgatgaatatgatttcatcattttctactttcgcagttaagacaaacttgaaaacacaaaaaaacaatgctaaaagaaaaatttagctaatcaaagtttagcatttcttgctgatctttgtaaaacatagactcaccacctaaaacctaattacttttaaccccaaaaaagtaataaaaacacccatatgctttattcaagaattaaaacaaattcaacatttcatcgatgcaattgttttaatcgtgtaattcatacatgtctaaaatcgttagttgatcaaataagatgtatatgggcagatattagtatggttttttttttaccgttcgagaaaaaatgcgaccggaaaagtggcgatagtggcaaatatctgacgataagcgaccaggatgagtggcttcataccggcctccatagccatcttcgacgtaatgttcatgcctgcgtagccgatttgcaccaacaccatcgccaagaacggcaacatatctgatttagccatctctcactctcttttattttattcttccaatttatgtgtttatgtgtatctccaaaatatgcctctctcactattactaatcaataataataggtcaagaaaccaagaaaaaaaaataagggagagaggtggattctctatatcatttattagtttccccaaatctatattttattttggttcgaccttatatttatagccaaagatgtatatatacacacatttatatatacatgcacatacatatatttatttatatacatacatatatatagagagagatgttttaaacagaaaggtgagaaacggttcgagaatgaagtttgcttgtaacacttggactctctttagggcataagaacacgaaacaataggtgatatgaatcatttgatatttttggcaatttatttaaattttctccttgctgattactaatacaatccaaattggcgttttgtcaaaaaaaaatctaacttattttcctcgttttaatccatttttttggtttccgttttttcatgggtttggtggagcttgtgaatgtctttctcaagcttcaagcaatcaatttgcctttgctaaaactcgtttctgtgatattaaaccaagggcttggtttatcgcttgattaacaatatcgaattagtattatcttacgtattttgaattgattttcattatatcactcttgctttttgtcaaacttttgtgtgtgtaatatatatcataaatggtaaattaactatttatatcccaaaagggttggaagttgggcatggattatcgaatatatattgaatggcatgcatcttatgcaatataaatataactaggtaagtatccgcaaaatgtatgcatctaattatttctaaaatttaatatataattaaattcatgattatattattacatgtttcagttcgactgcatactgtatatatactatatatttttaatgtatgaactaggtaatcatttacacaatgggttggacatacgtaatttaagaatatctttgaaaataactggaatttatatcattaaaaagtaggatataactagagtggctagtataattttcagaaaactaattaatttttaattaaaaactatactgaaacataatgatttatatataaaactttagtaaactaaagtaaaatgcataatgaaaacttgtataatataagaaaatctcatatacaaaacaacatatattgttgggccaattattggtcttaaaaggcctcatttattcttaaaaggcctttccttaggtgtacagtgacttccttgagcaagaatgtcatttcatatggatagagataaaacattggtctgtagtcagcacataggtataccaaacacgttaaacttttttgttggctgaaatttgagaaagtaagtgatgcttaacattttgctggatatcagtggttaatttttatacgaaatgcttttggagttgaagatgaataaattatgagtaatgctccatttgcataagtcaaacaagctagcgttggcgtccagatgattaatttccgcgtcctctttggcttccaagttccaacgtaaattttcgccgcatattttttcgatcttatcttttcgttgttacgtacaaaaggaaaattccattgtacattcgttttggatatatactttaggatgcatatgcatatttatgtatgaacaattagcatctacattggagctggagccaacagtaagcttgagttatgtgtctgtcactgtcaaccaccaacatacaaagtcttaggctttgtttttaaattcactaaagaatcacactcacacactatagcttaaaataagagaaataaggcccacacacttaaggcttaccattattacaatttattacaaagctttcgatcttcactctatcttgatcaaatctctactagcaagttaca

SEQ ID NO: 5077 - DNA, 3000 bp, Unknown
  misc_feature (1)..( 3000): cDNA_ID_1827367_gDNA_ID_1620761_Annot_ID_49998 3000 nt of promoter + ATG
gtctggtaatttggtccacctctccttacgtaaatgtgcattcttgatgctttcaatcttgtttcctgctcatggcacacaaaaaaaggtcagcatcgatttcattcttgagcattcctctcatcttcatcaaaatacagtagcaactgtttgttcgttcactaaagtttgtgagaaagagcaccttttctcttagcgctcgaatgataccgttgaaagtagctgccacatcagtgaaattggcaatgcctcctccaattagaagagctcgtttacgcccgtcaggatcagtagtggcacactgagaaagcccgaacgtttggtctgtgaatctctaaaattttatagatagaaacaattaaggaaaaggccaagttctttgccatgactcacatcaatgacaactcttgcatattgtaacacctcttcctcattaggtgctccactatactctgcgtagtttccaagctctgatgcataacctaaatccccaaccttaacaaaagcagataaggacaacaaaaacaaattaatgtgagaaattctttggagtcatcatttgaaggaattttttttccagtcttttgaaatggtaaggatatgagattttttaaaaatcataatctataatctatatttgagttgattcaaccatgaaaattagcatgccttaagttcaggggttgcaactcactgtatcagcatatatgacgctagcaccacctccagctaccatcgtccaaatgcggcctttaggattcaaaacagtgaacttcaaagaagcacttgtctgcaataagtaacaaacacacacacacacacagacatgaatggtcagtaacattactttcaagtctttcctgtctgagtcacaaaagtggtgtttttagaaaagctggatgcttaaaccttctcatctaaaccatggatgaagttctctgtagaactgaggacccttccaaatggcagaggaaattcaatgtctccccacctgtattaataaaacttatcaatccaatgagtttccaccggaaaaattgattgcgggtctctcaccgggaacttagaaatgttagacatacttgttgaaattcttgaaggcagcagtgtcatctaattctcctctcatatccagagggaatggttctccatcgactagtgtaaaaggattcatctccataaaactgaaatccaaatctttaaagaaacacacaagtagataataagaagatgtccttgagagatctcgaatcagagcaaagtcaagaagtggcctaatctaatatactcataccttgaaatacagcaaaggcacccattatgaagttgccgattttagctcgaacctgaaatagatagaagcatttgttagagcaggcatagcatagttcaaaacaacctaaattattaatctccttaaaaaagaatgcaagtactgagcagcctaagttcagactaacagatctttgaatttgcataggattgaaagtagaacaccatacaaagaccgaaaatgtacgcacatcaaaaccagatttctagggttatctaaagcaaatagttgcagggtgccgctggcttactaggaagttaatcacaggggaacagaaacttacctcaagaggaagagttgctattaatggagcacatacttctagcgtcatcgacttttccgcaggaagaaatatagtcttcacctgttgataccagaaaaccaagttccccaggagaaaacaacagaagtgagtcgaaaaagataatgcaacaaaacaagaaaagaagcacaaaaaaaaaaaaaaaggtagtactttgtcccaattctcttctatttcaatgccaccacattcagagaagcttatagtgcatccaagtctatcagatactatagagaggtagtattcttgatcatgaggcacaaaaggctccacaatgaatgtagtgataggtgctttacatccctccatctcgacctgcgactcataaacaaacatcaataccacaacaaaatttaccagctgatctataactctggctgcgatgagtcacctcagtgccgaggcgggctttgacaaagtctgcaacttcagcaagatccagctttagagctaccaaaccacttttcccgcgtttcccaaatagcatatccggtttcacaactagctttgtggacgatagccatgactcctggttggttaactcagtgaaatccgtagattctgtcacctaaaagtatacaacaataaacgaatcacccatcatcagtagttctagtaatcaactaatcatgccatgtccaaagtcatcagtagaaagagatctttcccaagattctcactttcattagctctatctaagtccaagattactctcaataacattcagacaaaacacgattcattcaagagttccaattgaattgtgctatcgaatttccacaaagcagatcgatgaaaacaaaactagaattcgtgagaatgacctgagcagagcgaatctgcaggtcaatattagcaagacgcttcaaatgctccttgagaagtctcttggagtcatattctctgatcttcttcctcgccatcgaattacaaacagtgatcgtcctcaacactaaaccacggaaagtgtttctccgcctgaagtagctgagaagaaaaggtgacaattttcgagacgataagatcgatgaagttgagaagaagatgatctcaccaactcaacgatgacgccgactcggcgggaccagaagagacgttgacgttgagatatcgaaagtcaacctacccacccccgcctaaaccacaaattcaattctctttcctcgagaaccaaccggtacggttcggtttagaagaacccgacgattatctgaaagttggaaccattaatggaggcgtcaatcagaaaacttaaacttgcactcgtcttccactttgatccacttaaagcagctttaaagctttgaacatgtttagctataatccctgaggaactatcctcatg

SEQ ID NO: 5078 - DNA, 3000 bp, Unknown
  misc_feature (1)..( 3000): cDNA_ID_1827363_gDNA_ID_1620761_Annot_ID_49999 3000 nt of promoter + ATG
tccaggaacatgccggaattgcacatgaatctccactctttcaacattaaggcacaccaatcaattgttatgacagttggatatgtctatgagtaggaataattattcttacctgtgtttaatgaggccagtgccaactcttacaaggaaaggtacaccatcccaacgtgcattatcaatatacaaggctgctgcacaatatgtagggtctacaccgttcaagatcacaccgttcttgtctcgggaactggatttatactggccaaggatgacatcacgcgggtctatcttgcgaattgatcttaaaaccttcacctgcagaagcaggtttgtcaccaagtcacttgacagaacaagagtacacaacttacatatataccataagacgattttgttctttacagtacaggttgaccttttcatttcggatatcttcaccatcgagacttatcggaggttccatggcaagtaatgcgattgtctgaagtatatggctgtgcactatgtcccgtattattccatatccatcagaaaaccttaaaaaaagcagtaggaaattagaaaataacattactgatttgtctaagaatgctgaaacaacacaatttactctcacatgcaaagaaatggtgaaaatagaactattgtgccttacttttctgtttgcgcaattgattctgatataataacctggaaacatcatttatacacaaagtgaacaaaccagaatgtggaagaggaaagttcaggcactatacacaactacaaacaatcagaaggaaacactacctgtatattgcgtatgtatgttctgttccatagtggttcaaaaactagatttgaaaaccttaacactgtcagattttcaatgaggtttcttcctaacatgtgatctatcctgtaacgggcacagaagtgtgaagaaatatgaacttgagagctgtgcatgcagaaagcaactagatttaaaagaaggacctgtagatttgcttctcttcaaacttagagagaagtgactttgttaactgatgagacgaatgtgagttaaaaccaaaaggtttctcaactattattcgagtccagcctcgtggtgcctgagcgttatctccaatggtgcatgccacatccaccagagcttcttgaggtactgagaggtaaaagattctatttgcttctgattctccctgaagaagaaaagctgttaatgtcttattctatcttgcttgtctgttcaaaatgttgtaaactcagaaagaggactacttctgggacaaaatgtaatcattgaaagaaagaaaaaaaggtacttaggaacctcaatctgtttcattctctcggcaagtcgggacatcccatccctgttattataacctccattgatatagtatgttctactctgaaatgcatccatcttgcccccacaattctccctgaacatttagcatcattctttagctagcacggccgtatatcagagataccaaatttaaggtagtaccaagaattatacatactgatgatcaacacggcaagtcagcgttgatgcaatgatggatctgaggtcttcatctgtcagattctttcttgaaaccccaaatatagcaacatcctgtgacaatgaagaccaatcaagaagacaaccgaaaaaaactatccaactgttttgctgcttactttgtaattgttcatgagcacaaaagtcatacctcaggaaggtagccgctataatacaacgcaaacaatgccgggaaaatcttccctcttgctagctcaccagtggctcctacaacagcaatgcaaagtgaggcccttcttcgaacatctgaaagatcatccgagagttgttttgacacaggtggtaagtctccaacattgtgaaacccatcattcaaatccgttcccagaatattctcttctggtcgtaaatcttcagctctagtttcttcagcaaaacctgcatcacattctacctcaggaagtgctaaagaatgatcaagtgaagacatgagatgtaaattgactcatatcttagaactagacctcgttcatcatcgctgaggaaagtgtgctttgagtgtgttgtaagctcgtttacaggctgatgttttctgttgttgccttgtctacgattcaagctcttaagtatccacagtttcaaaccacagaatctccggcagagattcgagcctcctccgttgagaacaaggcttccacttctggagaaactatagtctcttgacgaaacctattcacacaaaatagagaaatttcaacaactagaaatcaagttgatttcgaaggtcaataatatactaaagcttagattcagagggcatgtaacacgaatttgagatctttggtgagattgcagaaaacattagcataatccaagaaaaataataatctttgtttctcaaagtaatgaccttttgataaaacgaaagcatgcatgaaaggtagagcgaatacatgtgcttaccggaaaattagaaaaagaggcggcgagatggcaagagcagacggaggaagacggagccgtcgctgattgagaaaagggaagcaagcaactggagagagacatgaggatagttcctcagggattatagctaaacatgttcaaagctttaaagctgctttaagtggatcaaagtggaagacgagtgcaagtttaagttttctgattgacgcctccattaatggttccaactttcagataatcgtcgggttcttctaaaccgaaccgtaccggttggttctcgaggaaagagaattgaatttgtggtttaggcgggggtgggtaggttgactttcgatatctcaacgtcaacgtctcttctggtcccgccgagtcggcgtcatcgttgagttggtgagatcatcttcttctcaacttcatcgatcttatcgtctcgaaaattgtcaccttttcttctcagctacttcaggcggagaaacactttccgtggtttagtgttgaggacgatcactgtttgtaattcg

SEQ ID NO: 5079 - DNA, 3000 bp, Unknown
  misc_feature (1)..( 3000): cDNA_ID_1827359_gDNA_ID_1620761_Annot_ID_50000 3000 nt of promoter + ATG
cgcttcagctcatcttcaaggtcgattgattccatcttgatttttctaacaggcacatcttcggcagccaagttctcatcgcagctcgggatgagccggaaaactgaagtgttgccagcagaagacttgtctggggtttttagagacaatgaatcaaaggcatcattatcacatactgactcctggtgtatggctgagttttcaagtatcttagagagtgtgctcgaaggaccacaagtatgatttaacttcttcgaaattagccatttttctaatcttgtggacagatgtggcatctcaggaacaacttgttcacccatggtccatgtactagatttattgggagaaggactctcttctagaagctcaaaagcatcaatatcacgaaagtactccttctctttctggaagtctggagctttaacaacttttccctgagagtttgaaaagatactacttttatatcatctcacaagagaaaattagagtctcaagaaagaagaacatatatgttgacaatcttctaggggacattgaaaacccaaaggcaggacattgtttgttcagagaacttggtatcaaaaccacataagtcacagagcaagatagatgcaactaagcctacctttggaatagggggcttttttctcccggctgccttcttctgaggctgattgttgacataagcgcgcactgcaatactctctctccctctgtcaataagcaccagaagcaaactacagttattgcatcaatctactcaaataagtggtggcctttccttgacatttcaacaaacaagtgatgtgcagtaatttcataacttaagaaaagaattggatagacgagaaatggaacatgaatctcttgcagcaacaagccaaaaaccaaggagaacaaattagggttaagctcagaatgtacacctggtggaaagggaacgagcccagctatctctcttgggtccattgaccgaactagtacgagcccctttcaccaaccagccactatttctcagatacacagccaaagaaacttatcagatacaaagccaaataaccacacacacatttcaaattttggggtataagaagcagaaaaattacaaattgacagcttctgaggatttatcaggcttctttcttctctgaaaaacggcttcaatcttaggtatatctccgtcttcttcctcagatttaatgacctcagaccatagatcaactgccacaaacgcacaaacctttacacacagaaatcgaaatttaaaagcaaacccaataacgatttaaacttcggaactcaattgattcacctctctgccccattttaggttagagggaacacaaatcagtactgcaacagtcaccgagagagagagagaaagagaaaagtcgatttgaatcgaagttgtggaccgggaaggcgggagaaatttcgtgggtctaaaatttaaaatccaaaatcaaaattgggctccgaatctaatttcaagcccaagacttgtctgttcttaaaccgggtttctctaaccgaaccaaacgattattaatattggttttatcgcaagcgatgtgcaaggcttttcaatttgttggagtttctctttcaaggagaggaacgatgatgaacaaagattaagcaacaacatgtaaaatgttaattacttcacaagtcaaaagctattctagaagactataacttctctctattttcggatattgtatatataatgaaagaaaaaaagcttaacacaattgttgacgcacacacacatatattttggatccagtttgttgatctgcttgtagattaacgtctgttacgtaaagatgtactactctgcgattgtataagattaacacattattagtgtgctgtattcaagttatcacaacacaacatactaattatgtatgtatatgtatattatgctaattatatatttatacataccgaacaaaaatttagaacgtcgatgtgatcatgtgattgtgcggatttagctaaagccaaaaaaatgttacgtcaacattccaaaacaacaaatgaaaaaggaattaaattaccttaattgtaatttgaaatgtaagaaaaacaattttcaaattttgaggtcagccagcccccactactccatgattcatttgaacatttctctaacataaatattattaatttgataattactagtccttttaatgttttaacgcaatgccatcaacaatactttcttatttaaaggtttcttcatagccgtgtaatataaaagatcggacagttactttgggtagttaaaacatcatactcttcacggaaatgtagaggatgtttttatgttttgtaatgaaatgtaatttgcaatgcaagctctctctgtcacaccacctatattaaagaacaattaatagaaagaaaaaaaaattaagatttcatcacctaccacttgataactccatttcttcttccttctcttaagttttctcttccaccagatttcactgcctaagtttttaagttttctctttttcttttatttgattttgaaatttttcgtgatttcttgttcttttcacaaaaaagttcatcattcgtcaaaaaacaaaacactctgtttcctcagttccatctaaaacatctttgaagtgtttctcttgtcaaccttcattcatagaggtaataatcattaaattgtcgtctacttgttctctgtatttctatcatcattgatttgtcctatgcatcttccaaatagataatgaagatgttaatgattgctgcattttgttatcttcttgctttcttgggtttttagctacttagtggtcctttttctataattcgggaccactatatcaacttggagtctctctcccacagcatttttcatgtagctagttctttcaacatttacttctctattctttctcttttctgattgaatcaactttaatctcttagtttgatgattttgagtctagcagattaggaaggagaacaatg

SEQ ID NO: 5080 - DNA, 3000 bp, Unknown
  misc_feature (1)..( 3000): cDNA_ID_3409194_gDNA_ID_1620761_Annot_ID_50003 3000 nt of promoter + ATG
ggctgacgaaagagaaccgcagccgtggatgatgtcagaatgacccttctgacagagggagtttctttgcatgtattaaggacgttcatagtaccctttaaggctggatcaatcagctcagtctgataattattaaaaaaaaaaaacacacacattttgataagtttctttacggcgtcgaaagcaaaagatttttttaaaaaaatgtttcaattaaggtgttttcaaatttttaggtgtagttattgttcttttttcttctcaattttgcccctatgatatttattatttaaagaaaacttaagaaacatttaataaacataaggttataattgtcactttagaaatctctttaacatgtgtgaaaaaactaaaacttggatgaattcgaaacagagtgagtagttaaaattaacatgcattggattcaccacaacaaatttgaagttgttgaaaaacctgaggatctttgacggtgaagaaaactggagatgcggtgtggaagacagcgtcacatccttcaatagcttgttcgaaagaagattcttccaaaagatctgctttgaacaatttgagtctttcttttgcaccatcaagtgcaagaagatgttctgttttcttcctgtccgctaaagaaaaatataacatatacgtcaaaacacacttcaagccttcaaggtgacttacttactttacctaggttcgatgagtgatttacgtctttaattacttgtactctcctacagtcctacttggtacggaccggaatgatgtctctcaactttccatatttggtaatactattaaaaaggtattatatgaaaacactaaaagtacatttgtttttttatgttttaatatatatatatatatatatatatatatataatataactcaaacatactgtatccatacatattatctccctttccagcaaatttcatctgttcaaaacacaacagcttttttttttttttttttggccaacttcaaaacacaacagctaaacaacaaaattgctaatcaaataaatttcagttttgttgtttaagaaaaaaaaatcaatttggatttcatggtttaatttgatatgtattgtgttgtttaaagactaaagtaaagacataattggtttggttccgtcagaattttaagctagattccgatttggtttagttgtctactcttaatgatccctaataatggcagtctttctatactttgcaaaagaatgatgtatttagataaaagaaaagagtaatatgggaacaaacttagatctcgaacagtggccttgacggtgtagccacggaggagcaaaagcttgacaatccaagacgctatgtaaccggaagctccggtgacgcagaccaactttcctccgccgttcataatctcctttgacctctctttatctgaaaataattgtcttaaatgaagaatcaactcttcaaacgcatgggagtgttcaattagtaaatggtttggtaaattagggcggctcaattagaatatgggccttgtttaaaactggcccttcagttttagaagatatttgtaaacaagaaataaggcctacatgttatatgcataagcaaaaagaaaaaaaaaacatccacatgttaagtttttcaacaaatcacgttgccgtaattcattgttcagaatatttctccttttctgagtttatagatattatttaaaatttataaatatttttaattatacatattgtaaagcctagacatcctccatacaaaattatagttaaaaaatagaaacaaccagaaaatgaagctatatgcctatatatgatgaggatcatataagaagacaatcctccataaggctaacaatagtgtctctgagggtttcttctataggagtagtgaactcaattcccaaactcttcactttctccacacacactttgtatgccatttcatgcatcatctaactctcttcattcctaaaataaaagtccatcaataattaaaaaaagttgttctgtttatagattcaatatgagtatgaggaaaggatgaagggaaaaagataacttacttatcaacacgacacaaatcgggacattactcatgcaaaagctttttaatatctttcgtagttgtattcgatcggatctccaacggtttgatatggctgcaaaagtggtccgactacgtttacactatgcacacgtggctttctatagtttgaactttgaacgaatagattttgccgcgctacagtcaaacctagcaagttagctaactgcgccagatgcgtaggttagctacggattcgttactttaaatgacacaaaattcgaagccctaggctcggtaactccgaagctaaatattttagtcactttccttaaatgatctctcatccgaacctaacggatagggaccccatcctccaggtttcattttcactgtcactttcctcctctggagaaatcacgaactcgaacaaatctgcaaattgattcttcttcctaccaaacccagaaacctaatatttccaaccgttcgatggagactggtgggtcgcgagaaagtttggatttttagggtttgaaaattaaaaaaatcctgtaagagattttgaatttttaaaaaggtcacgtttttttggctgtatacttgtaaagtattcgtctttatcagagtttatttattgatgtgaaagggacgacacaagtttctttgtctcttttgcgtattccctacctcgataatggctgttatttataagaaattgattgttacaaacaagatttagaggatttaattcttgtggacatatttgaatgatttcacattctttaactatactgagattggacatttatgtgtttcattcgtttatgtacagggtcacgtgaagaacatgaatagctgcttccttttacgtttttgaattttggggttttctggagaagttatctgtctagattaaagaacagagcggtgatattccagtttcagaaaatg

SEQ ID NO: 5081 - DNA, 3000 bp, Unknown
  misc_feature (1)..( 3000): cDNA_ID_2994800_gDNA_ID_1620761_Annot_ID_167165 3000 nt of promoter + ATG
atgaaaaacaaaaaacaagtctcattttgattgcatattagaaacgatctaaaacattttcgactaatatattgacatacctggaagtacctgctttcaacagtttgcttatatgataatgtgaatgaagaagacgaaggaaaataagttttagcctttctatccacggcttgagagtttttgcattcttttgaaacgaaagcaataacaactaattatgttctctcttgttttgccctttttctctccttgagaatagtagatttgatcgttatacgaccataagggccaaattctttatttaaacttttttttttggtaattaaaacccaatttcataggaaataaaaactagtacattttaggaccccagctaaatatgatgataattaatgtaaaaatacgacttgggaattcatatgtttttaatgctcgacttttgagctgactttgcaataggcttaccacttccgttaaaggataagtttatgaaattattaaaacataaccaaacaatgacatgacgagttgtatctaagaagagatgcaattaaaaaaacacttaatctaaactaatactacttagttagcctggccatactattattaaagatgttttaatcttatgcaatagtttttttttttgtcaaacaatcttatgtaatagtttaagtttgtcaatttgtcttattaaaacaggaggaactgcacaactctaccaaaaaaaaaaaaagtctcaaagactgtgccaaatcttgcctttatgactccaaagtgcacgtttattcagataaagtattcaaaaaacaaccaaatggaaatgagattagagagcgaggttcagagatgatgggcgactagttgcaaatacaaagtgttgtttaaatgaaaagtgattaattatttatatagatctttattggacccaatgctatcacctcatctcaattatcaagcccatgggttggtctcatcaaagcccaatcaaagcttcccaaacaaaaaggaattaagatgaacaaacaaaaaaaaacacttcggagcaaaagatctggccaccacaacacaacgatcgacgaatacaataggaaaatttgaaatctcgtcgatgaagatgactgctaagatgcgccgtgaattcccgacggcgttccttctcttgtttctggttccggtgatgattccggtcggtgaggctgtatggctagatgtgcctcccaccggaacaaagtgtgtatctgaagaaatccagagcaatgtcgtcgttttggctgattacctcatcatctccgaggatcacgaggtcatgcccactatatccgtcaaggtaagtgtcttcgattttctgttcctatcatcttgcttgttcagtgatttgaatctgcattttgtgttactcgatccataatttcaactgattcatgagtcacgtttaggaattagaaaggcatgtattaattctcgatccaagtttccttatttggaaaattatgatcatgcatgtctttctttgattgtttgttatgatgattttcggatttgtataaatgctcagatgcttgtgtatagcttaatccctgtgaatacccttttttttttgccgtaatatcagtaattagctgtgagattgagataagaaaaattgaaactttatgtggtcttttaatgaagtctgtgtttttgatgtgtatgtttgggaacaatgataattattacgaacaagggagtttcttttattgagcaagtatcatttggtatttagtaatcattgctatgtgctagttccagatagtttgatggattgtttaagatagtgtcctttggattgagagcagtctttgaagtcgacttgaaaaaaggaatacaatgtttctgaatggtaacctctgttcctttttattcttggctctgagttttgagaatcattatggtgcaggtgacatccccatatggcaacaatctgcacaatatggaaaacgtaacgcatggccaatttgcatttacaacccaagaatcagggaactacttggcgtgcttttgggcagatgaaaagagtcacggaaacaaaaatgttagcatcaacattgactggagaactggaatcgctgctaaggattgggcctctattgctaagaaagagaagatcgaggttagctttcaagagattttacagttcagagagtggtattgcttataattttgcttcaaaatatttctaaaatttgttactctatgacaattgcttaagggtgtggagctggagatcaggaaactcgaaggcgcagtcgaagccatccatgaaaatatactctacctaagaaacaggtaaagtcatcttcagctgcatgaactgctcttgccttctttgctgactctcattatcaaaatggtaattgcagagaagcagacatgaggacaatgagtgagaaaacgaactcgcgggtggcttggtacagtataatgtcactaggtgtttgcattgctgtctctggtttccaggtactctacttgaagcagtactttgagaagaagaagcttatatagagattccctgatattcaggtcctttaatgagagtttcttcttaaagaataatattcaattcatctcctttctttcctctttacacgcctcctttttactgacgctgtaaaatttttgttcatggattgtttatgtagcttctctctgataagaagtcattatttctgattctgaaataataatattaacttcttgtcatctccaaagtccaaacgaaagagattctagaaccattgatattgggttgtaactgatactttatgttagtttggggctataacacgtaagtttgacagtacaagggttaagattacaagaaaaaactaatcaaatgggtattacatacaaatcagcccaaatttctgacccaacaggcccgttaagagcaaaccctaatttcaaagagaatatatataaaccctaatcacatttcgcaaccaccaaagcggaggaaaa

SEQ ID NO: 5082 - DNA, 3000 bp, Unknown
  misc_feature (1)..( 3000): cDNA_ID_2137255_gDNA_ID_1620761_Annot_ID_167164 3000 nt of promoter + ATG
tccgtattaaaaagaacatttaaaatctgttatcgtcactgtaataaacaatgtcaatggttacttatgtataagaagtagaagaagatgacggaaaacaatctttgtcactcttttgcaaggactgatcatcttcttcttcagtttgatgaaccaccggaggacatgaagaaagtttttcataataatcagtccctgcgactctgcaaagcatcctcgagatcaagttctaatccaacacgattccttatagacgcagctgcatgacaagacgacgtcattttaaataacctctccaattccttaaacctctcgcagtcaaacttatgactcttcaacaacttcctctgtctcgacaagaagagcctcttcatgaaatcctgatatgtcggatctctcgaagtcatcaagaaataagcataacccacaatgattccagtcgctgtagcgaagaaagtgattggttccatcacatcccatgagaattcccagaaagttaatctaaaaaagagtccaatttgaaccatcgaagtagctaaaccacaccaaagaatcttcctcacttgtctatgagccaaaacatcaatctcttctttcatgattctcaatttgttgaattcttccttgatttgatcttcctctggattctggtccaaaggcatcgctcttctaatcagatccaccacctgaacaaaacaaaaaagtccagatttttagagaaatcgagacaaaacagagtaaagtgagacaaaacagagtaaagttctgtttttgtgttctaattaagaccttgtctgggtgaagatagactttatcacgaaagatcaagacaacgccagcatcgtcaagaacacgagcaaagacatgagcttcatcgggagatctagcgatacccattccttgagaagcttctaaaagtgtagagtaagagacaacatctctatcagccacaccaacaagcttcttcttcatgtcttcaacattcacaagcctcattagcttcttcgcttccgctatagttatctctttcttcttctcctcttcatcctccgacggtgttttgacggtgacgcagcttcttaatccaccgtgaccaagccatgtcctttgcgaagaagctctaatggcattggacattgccgtacgccttatcaaacccattgaccacattatttgacccacgaatctgaagatcttagctctggatttggtgaaagcgaaattgaataaaagttaggttcacagatcaaacgattaaaagatatgagaatcggagaaagagatggaataatataacgcgcttaattatgattcttctgttattaatatcataagattacacgattaggaaaatcgaagaaaagaaaaaagaggacaagcacgaagccatttgctttttatctatcgaaaagtaaaaagattggtactagccaatggccattgttgacttggcatgaagaatggcttttacgaaaatctcaatcaataagttacaactttttgttaactcaaaaatccacattctaaatttgattttcttgataaagttgtatttattctatccaacaaccatcccgacaaaagaaacagtgaaaatgccgttgttgagacctatccttttcatcggagttgaaattgacgcggaatatatacggatttaggttactttattacccacatgacaaacaaacaacacgtaactgagtttaaaaagagaaaaacacgattagtttacgtaaactcttgtttagtttttcttgtcaaattgtttaggtggaattcctaattacaaatccatattctaggctactagcttgcattcactaatattcgttgtgaaaaactcatatgagcatatatagacatcaccatctttttgcactactatgaaaaacaaaaaacaagtctcattttgattgcatattagaaacgatctaaaacattttcgactaatatattgacatacctggaagtacctgctttcaacagtttgcttatatgataatgtgaatgaagaagacgaaggaaaataagttttagcctttctatccacggcttgagagtttttgcattcttttgaaacgaaagcaataacaactaattatgttctctcttgttttgccctttttctctccttgagaatagtagatttgatcgttatacgaccataagggccaaattctttatttaaacttttttttttggtaattaaaacccaatttcataggaaataaaaactagtacattttaggaccccagctaaatatgatgataattaatgtaaaaatacgacttgggaattcatatgtttttaatgctcgacttttgagctgactttgcaataggcttaccacttccgttaaaggataagtttatgaaattattaaaacataaccaaacaatgacatgacgagttgtatctaagaagagatgcaattaaaaaaacacttaatctaaactaatactacttagttagcctggccatactattattaaagatgttttaatcttatgcaatagtttttttttttgtcaaacaatcttatgtaatagtttaagtttgtcaatttgtcttattaaaacaggaggaactgcacaactctaccaaaaaaaaaaaaagtctcaaagactgtgccaaatcttgcctttatgactccaaagtgcacgtttattcagataaagtattcaaaaaacaaccaaatggaaatgagattagagagcgaggttcagagatgatgggcgactagttgcaaatacaaagtgttgtttaaatgaaaagtgattaattatttatatagatctttattggacccaatgctatcacctcatctcaattatcaagcccatgggttggtctcatcaaagcccaatcaaagcttcccaaacaaaaaggaattaagatgaacaaacaaaaaaaaacacttcggagcaaaagatctggccaccacaacacaacgatcgacgaatacaataggaaaatttgaaatctcgtcgatgaag

SEQ ID NO: 5083 - DNA, 3000 bp, Unknown
  misc_feature (1)..( 3000): cDNA_ID_3075548_gDNA_ID_1620761_Annot_ID_167162 3000 nt of promoter + ATG
ctttggtgtggtttagctacttcgatggttcaaattggactcttttttagattaactttctgggaattctcatgggatgtgatggaaccaatcactttcttcgctacagcgactggaatcattgtgggttatgcttatttcttgatgacttcgagagatccgacatatcaggatttcatgaagaggctcttcttgtcgagacagaggaagttgttgaagagtcataagtttgactgcgagaggtttaaggaattggagaggttatttaaaatgacgtcgtcttgtcatgcagctgcgtctataaggaatcgtgttggattagaacttgatctcgaggatgctttgcagagtcgcagggactgattattatgaaaaactttcttcatgtcctccggtggttcatcaaactgaagaagaagatgatcagtccttgcaaaagagtgacaaagattgttttccgtcatcttcttctacttcttatacataagtaaccattgacattgtttattacagtgacgataacagattttaaatgttctttttaatacggaagttttggtgtaaagaaccattttctttattttcgtatatagattattggccttgtttcacacaaatacacacattaaaaaccgagaaaacacatggtaatgaacagttgttttgagagttcaatatcaaaagagtgaaaatgaaatagctctcaaagggcgccttaaagttccaaaccatcacatccctagtgattgaagcgttcttggccggccattaagaagtctcctaagctcatatttgttttgttcttcaaagtgttattcctgaaatgggattagtaccttttgccaattcagatatgtgcaacatgggccatgactatgtctaatggatgatactgtgttgctaggacaacatttgcattatggaggcacatttttggtccaacatagctgtgccacaatatctatgctgaattgcgctgtctagataagacgttgtcgattcgatcttctccggagatttactgcaaaaaacttagggggagatttaactttaagaggatagaagcaaaatacctaagaaaacatggtaacgtggatttgcgataagaacgaatcgaagtttgacaatgatgttaaaacgatatggattttgtttgacgaaaaaaaaataaaaccttaataacgatttttttaccctttttatataaaaaataaaacaaatttaaattcttcgaataaacttaaattagttttacaaattttattactttctttcaacgataaaaaaaaatacaaaaaaggaaagtcccaactttgaagtaaatcccagaaacagattacaaaacgcaaaaagccgagaaaacgtgaagcccataagactatcgttgtcgtcttcctcaaaacccaactttctacttctggttactgccttcattaaacaactaccaccatctttctttctctctctctttctcgtttttttattttattaataatctttttttttttttttacttttgatctcttatcctttggacgattctcttcaatcggatttataagaatcaaccccattttgttcttcttccactttacttcttttttcctcattacacagtcttagtcacatcggtgaaaatatcaattaatattccccagaaagttgccaagatttacaagtagtagtacttgatatatcttaagcccactgttctgttttagcgaggaaaatgttaccggcgaagccgaccctgttcttgatatgtgtgtgaagtttgtcttttatccaaattaagcttttttcttcttttattttattccattataaaatatacaaatcgcccatactccgagacatgggcatacgtattcggggtggtcccattcatcgtcgtcgtctgtgttagggagcacaaataatagagaggcgtagcacaagagagaaggtggtgatcgaggccaagatttagaatttaactataacaaaaagcctctgacgagtgtgactagtcacaagatctgatcatggcttcttgaaacttcttcttcttctttcttctctttaaaggtacctactttccttttcccaaagtttcctccttttttttctttttttaactatatatattgaagcttgcttcgattgatttctgctgggagcttaccagctagctactggtctcactcttcttactgaaattgattctaactttgaagttaatttcttaaagctatcctctgttgtcatcaataccctcttgttttctgcgatataaaggttttgtaggtctctttcgatctggcttgatgtgtgtttgttttactcaactttttatagtgtgtgatcatttatgagaagaagcatccaattaattaatctcatccttttatcgcttttaactcctacgattgctttccctgtggggactttattgttccttttgaaaggtatagctagctataaagactcttaagagtttattattgagtctactttatgtatgtagctgtgtttgaatcttgagaggctgatattagctcagatcctcgttttgttagtatttgtgtagtggatttaccctgttaactatcaactattatttgtgcgacttgttcatagtcaagatgttgttgattttggattgtaggatgacttagaaaggaagtgttcatggaatctgactggttcagttactttgaaaatgataaatcattgaaccttggaatatgacacgatgattcctgcatctgttgcgtcctgtttctgggtttagctatgtattctcgatggagttagtcaagttcataactctttttactgtgtgtttgaaattctgaattggttcttagtgtttcaagtttatgcttatgcattcgcttgtatgactggtgatgaatgtttttgtgttcatatgattatggcatgaatgttttattccctcttttatcagagttttgcacttattttttgttgtcttgtctctgtgtcaggaaaaaaatg

SEQ ID NO: 5084 - DNA, 3000 bp, Unknown
  misc_feature (1)..( 3000): cDNA_ID_1839846_gDNA_ID_1620761_Annot_ID_167161 3000 nt of promoter + ATG
gatacatcaacgcttcatttacaaaatagacaccaaccagtctcaacaatcttttagtttccatcatttattggttaaaaacaaaaaaatgtactcacgcgtcgaggaagaagccagcatcgctcatgcattttactgtggtggtaggaggaaacaagttattgaaatcatcgcatcgtaaaatggcagaaagacccccagaagaacatccgctgagcaaagccttaacgtaataatattattagttattacattaacaacttaaatttaacctgggaaccaagattcaaatgcaaagcaatattatatgaaatatatatatgtgtacctgttttgcctgacgcattcccttttccatcaaatcttccatgacagctaaaaatatacgctttcctctatactgaagttgtgccgcctaattgcataaacaacatatacatatgaatcccaagttaattactagtgaaatatataatgatcatcttcatggttttaattaactaaccttgttttcgctgtcaccatcaaaggatgcaccatcacaataccggacttttactttgttccaattgtaaaagtctgccaataatgatttgaaatcaaagaagaggagaatattccttaaccatttcaccaacacatcacatttctgttctcaataagggatcttgagaaaaacctggattttcagcggctttattgcttagtaatcctaaaaatgccaactctttctccattaaggtagatgatccataaccactccctttacggctctgacagttttgtatgctgtcacaccatgcacctccctttcaacaaaattaattacccttatttatatggttatggcgataattaagtatctctatagtttatatacaaagagcttgctatatcttaagtaagaacctgcaactgaatgatccagttgtttgctcctgaaccatacccgcgacacaaatgatatccaggcactgacccatccagacacactgccacaaaaatttaattatttctccatgcgtcatgaaaatgacaatcaaaaactttgtaataatgatgaaaaataatgacacggtacaaacgaaatttcgtaaaaaaaacttgaaaactaacgtttgaaacattggagatctaacatgcatatcagaaatctaaatctcaatcgaaatgaatggtaagaaaattgttacccgctcctttagcagcagcggcttggacgagcgtgagtcctaccatcaggacatttgcatttgttccattggactcgttgaaggttttcatttccccatgtgcaagaatgctgaagagaatgagtcctgcgagactactccaaccccaatacaaaagcgttttcatttctcctcttaatgaaatttgaatgaaatgattatggagacgtactagagttgtcagtatatacgcagccaagaaaataaagcatccgtcttggtcttttgtagtatgcatatgtttttcttatatagaaactcaattataattgaagaccagagagtgagagagagagaattgcattaaagaccagtcatagtcataagagagatttattaagatattttctttccttaattagaaaaagtacatacatcatggacatgattcatgatcttgccatttgtaaatcacaagatcgtactgaagaatgtgactgatagaccacaactttggggcctaaacctccattacgctccattgatcattaggttaagaaattaagattttcacgaaactgccaccttgtatctttcgttgtatattttcatgtatatatttaaggatgatttgacactcatgaagttgtcacttcatttcatcaataggttaggtttaaaactagttttagaacaagtcagttttgtgattgggcttttatttaagtggtgcaagattatattaatagggtttattaatttcaaattcacactattactcatataatagtcagaagtatagagttcattatataattccaattttcttttcaccaaaatctgcagaacagaaagtctcaggaatcttcaaacattttgaaaaaatggtcctgaaaagtggaaagaaatttcagattttgcttgcaagagttcaaaaagctactagacaaagatttcatacaaaaaagtgtggaaaggtcttcaataattgtgattaagctttcaattaccgtttaaagacttgtaaataaaatttaatcaatcttttcactaataaatttaaccaattctattttctctacatcatgcactagtaaaaaaaaatttgcctcgaaacaaaaaaaaacacacgatgccgtataggaaggaagcaataaagaattcaaaacgatttgttgttccgtcttcaatgcattacgcgtcgtattagatgaggcttttaacactaaaaagcccaaaccaacggtatcgggtattatcacctaaacccaacccattaaagacaacgcgtagcttcacgcgcttcacgattcgcgtgagaagaactaaccctgaaacgcggacgttgcagattaacggtgaggcatgaacgagcgtgttaatatataatgattcttctctcacgatgatcaaaatacagaagccaacaagtaaaattagtttatgcagataagacaacatttattacctgatacatactttattaggtgataataattgataattgttttttataagccactaataattaaataaaaataatatcagtaccgtgtaaaagcaaaactagtgtaaacataaattttcaattggcaaagctctgatccatccgttttagtaattcgttgacctttgacatttcacttagacagatgtgtgcaagaaagaaaaacagcatgttgcttgctttttccctcaacgagaaaagtcaccctctcttcaattcttcaattctcctccctttataaaccataattcattaattctcttctctctcaacaactacttgtttagagagagtcccaccaccaccactaccacaatccca

SEQ ID NO: 5085 - DNA, 3000 bp, Unknown
  misc_feature (1)..( 3000): cDNA_ID_1827342_gDNA_ID_1620761_Annot_ID_167157 3000 nt of promoter + ATG
tataaattttaaaataatatgtatgaaattgaatataaatattcaaattatgacacagtactcagtaattttttttcttaaatctacttttgacccgttatagtatttttttcatgtactgaacaatttatattcgtttttaaaaattcaaattgtggcatatgcgaaaaaactctaattatttttttataacgatgatattattttttcgcaaaaatagaatcatataaagatgagaggtgaattataataattaataaaaaattaatatgataatattgatatcaaatctaatttgttgattttaattggttacttttttggaaattaataatgtatttcgtttttgagttaaatttaattaattaaattagtatttgactttttaatttttaaagaaatgaattaatttactctttaaaattttatttctaatggcatacgtatgtaattacttacaaaaaataaggttacattttaaaaattaatatgataatttagatatcaaatctaatttgttgattttaattggttacttttctggaaattaataatgtatttcgtttttgagttaaatttaattaattaaattagtatttgactctttaatttttaaagaaatgaattaatttactctttaaaattttatttctaatggcatacctatataattacttacaaaaaagaagattatatttcaaatgtacttcccaaataatatagtaggatcacttccattccgagttttcttctttctttgatatatatatctacttatttatttactcggtttgattttataataaatttgtttataattattttctgaacaagagatggccataaaatacagtgatgaaatcaataatggtccatgcaaatgtactcaaattatccacttggaaagtttatagtatacaatgggttgttacgtattttagaatctaatttgcatggcgatttaattgacatttcatcatcaaccgagctataacgagagataaaccagaagatgcaacgttcgtgaacaaactcgactgatattctagatggttttatttattttttacttatagaaaggaacaaattagatttaaagataatatgctctaatctaagagtttggaaccactataccacatactatatcccatgattaaaaaaaatctcaattattatagcgcaaatgattggttttcatcagttaatagaacttgctgagtgagtccccaaatttgaggatgattagtaatttagtatcgtaaagactaaaaaagacttaagaaaaatagtaatgattagagaagtcaaacctttaataattaagatagataaagagagacaaggttgctcaaccccacttggagtgtgatgcttttttggcagtgttcctttatgataacacatctcttcacacacaactttagtgtatcacaggcccatgtcactttaagataagataacatattctagtatatgattattttcatatttgtaagtgtattaaattattcatagacacaccatgaattaattgtaataatgcgaaggacctgtatcatgtaacagagacagacgaagtgtgcagaggtcggtgagaagcaatttggtcaccatgctccaactctcttctctaggtcccttttgctttaattttctcgtttaataacaatatcttatgaaagcagttaccatatcaattgaaggattgtataataccgtaatttatttatatatagtacatctaattaaacattaattatttctactaatagcctaaaaccactactaatacaacaactagtacttgtttacgataattattaaacttgtctcgatacctacaacatgcccaaaaaagtaatcaatactttgtttaatcacaaagatctcagtgagatggttctatagatagtatttctgatttgttagtatattagagaattgaccatctattaaaataagagaatgaacactatttgataaaacaatacatacgcaattatcattgtctttaatttttatcaaagtaatcatacgatcgactatttgtatgcaaaaattcatcattttatttgcaaaaaaaaacaaacaaacatggtagaattgtatttggtgtgtgttttaacaaattgttgcaatgtttagtgcaacatatataatccactatatataatcattgacataattaatatttgattatatgaagcaatttctctttaattatgtgtttataaatatagggagaaaagaaaaatagagagaaaggtaaagagtagagctaatgattcgggcgacgctaaaaggttgaatgttcgagagaaacggagtctcagagactgtgaaaacaaaaaatcaaaatcctcagttacagacgatttggtcccctctcttctctctctgcgtccgtcttgtgcgtcgatttgtctccatctccttctctctccgcctactttctcaggactactccaattcgccgactttttctcctctgttctctgcatttggattgatgccactttaatactttgaggttctcactctctctttctctcttcgctgacttcgattgcttcagtaccctttttctcaggtcagctacgatgatagctttattcagacaagaagatcaaagttttgatctttttgttttggttttcttaagagatggttaattaggtcttgagtgcgctgttttgaatcgttcttcagtgtgattaaacaattggttttgatttgactaatcatgttgccattaaactaagtgaaaatctctgctttttttatattgcatattgatgattgagacattgatttcttttctatttctttatttcccagtttctaatttgggaactgaaaagttttctaatttaagcattacaaagtgtacaatttttgtttctggcaagtttttcttggcctaattcgtctattttatgaattcacctttttaggatcaagacttcgtaaaagattgtttctgtaaaacgcaacacc

SEQ ID NO: 5086 - DNA, 3000 bp, Unknown
  misc_feature (1)..( 3000): cDNA_ID_1827352_gDNA_ID_1620761_Annot_ID_167152 3000 nt of promoter + ATG
caatatattgaaatatttatacatttaaaataaaatctataaaactgaaagaaaataattaatattctgaacttcattttttgcattttgtgtataaattaaaaaaaaaaaaaattactgctacgtgatttgttgaaaaaattaacacgtggggtgttttatttttgattacatgaacttgtgaaccttgtttctgcttacaaaaactgaagagcccatttcaaacaaggcccatattctgattgagcggccctattttaccaaaccacctactaatgaacactctcaagtcacctcattcgagttggaagttccctttaaaacaattattttcagacacagagagactcagacaggagatatgaactgcggaggaaaggtggtctgcgttaccggagcttccggctacatagcgtcttggattgtcaagcttttgctcctccgtggctacaccgtcaatgccactgttcgagatccaagtttgttcccaactctctctctcttctttattttaaaaaacaaacgactgcaattattagggacgattatgagtagcacaaatagaatcaaaatcggaatctggctgaaaaatctgacggaatcaaaccaattatgtctttacttaaattacatacataacatccaaatcgttcttttttttttttttgagacaaccaaattgaaatttgggactttgattagctgttgtgttttgaatgatgacttattaattagacaatatttttccgacctttataattaaattaccaaatacggaaagttcagagaactcattcaggttcgtaccaagttttgacttttgagggtacaagtaaaatcattcttttgaactttgaactttgaagtgcatgttgacgttatactcttcttcagaggacaagaagaaaacagaacatcttcttgcactagacggtgcaaaagaaagactcaaattgttcaaagcagatcttttggaagaatcttcttttgatcaagctatcgatggttgtgatgctgtcttccacactgcttctccagttctattcactgtcacagatcctcaggtttgtcagggaattattttaactattaatttgcaaagtcatatgagttaaaatcaaaatttgtgtttcttttcctattagactgagctgattgatccagccttaaagggtactattaacgtccttaatacatgcaaacaagtttcttctgtcaagagggtcattctgacatcttccacggctgcggttctctctcgtcagcctcctattgggccaaacgacctggtggacgagactttcttctccgatccaagtctatgcagggagacaaaggtcctttgattttgttgtggacttatcagtttcaagagttcggattctttcttacacttttcttattttcttcttcagaattggtattcactctccaagattttggccgagaatgcagcgtggcaatttgccaaagacaatggaatcgacatggttgtgttgaatcctggatttatttgcggaccactcttgcaaccaactcttaacatgtcggtagagctaattgtggatttcataaatggtaagaaccctttcaataaaagatactacaggttctcggacgtaagagatgtcgccttggttcatatcaaagcgttggagactccttcagccaatggcagatacatcatcgatggtccaaatatgagtgtaaacgacattatagacattcttcggaagctgttcccagatttgtctattgctgatacgtgagatctctttccctagctctacctttgcttatcatcttatgaagtttataaatttaatgaaagattttgaaaaacttacttgttgatgattttgttaggaatgaagaaagtgagatgaatgagatgatatgccaagtgtgtgtggagaaagtgaaaaatttgggagtagagttcactcctatgaaatcaagccttagagacactattgttagcctcaaggagaaatgtcttttatgattctgttcgtatatttgtaactattatgtgtatttttattttgttagtattactaattcaagtggtttaagttgttgagactctttaaaatctaagcattttataaacaataatatataattattgtttaggctaaatttgtcactaattaaggtttggatacatagtgtctaaactaagctaataatatcacttaacgtttacttgtaacgctaggtgatgatgtcgtcaagtcaattggtacaaggaataaacgagtggtcatatgacattatgaccatatgaattcaaactccagtaatccaatggtaattggattcaatgatcaagacttgaaccacgtaatccacccttatccttagaagctcataaatatcactaaagggacaggcaacacttaaccagtagttgtccaataatttagttttccaaaatgaaaaattattgttgtcatctattttaggtgttttagttcaatgtggattcctcgtcctaacaaatacttgacgaatatatctagactataaaattggttatgagttctacttttttttgtttgtgaaattatcaaaatttgttatatttatttatttattctcattaatttgagtactaatttttaaattatttatactaaaaacaattactaagatacaaaaatggataagagcatggtgtatagatatttaatgggatagaatatttcccataattgtatgtgtgtgagaggttttgttttcgtaaggaaagaaacaaaaaccatttgaccaaagaaaagcaaaagaaggcaaggaatcaaacaacaaatgttgcaaggcagaaataatggacgttatgttaatgtagtgtcgtcacacgtgacttaaaagagacgagtctgcgtgtcaaactaaaaatgtatgcaactataaaaatgggatttgattatctttttagtaccgaagcctaccaaccacatgcacactaattctactcgccaaataaagtgaaaagag

SEQ ID NO: 5087 - DNA, 3000 bp, Unknown
  misc_feature (1)..( 3000): cDNA_ID_1839377_gDNA_ID_1620761_Annot_ID_167148 3000 nt of promoter + ATG
gccacatcgtttcgctctcccatctaccatcccgcagaaaagcagctcgattggtattggattcaagattattatcccaagtaaaagaaagtgagtgtaccttttgaagttttcgagtttggatgcgtgtttctcgtaggcaaaattctaacttcagcaccttcttcttcagctcctgatcaattctcctttgattctccacctgatccagaagaacaaaggctttactacataaaaccaaaaataaatcacagaactaagagatgctaaagcatgacgtgttgttacctgatcttctaattccttggtcttaaacctccagtgagccgatataatcttcagttcatctctcagtcttgcaatttcatcatctttagccgtcaaaagtttgttgattctttcagaattctttggagtatcttcatttagcatgttccgcacctcagagttctccttggtcttgaccactgatacagcccgcataatgtcaccttcaactttcaaaagctcatctcttagctgcttctgtgaagattctctaactcgcagctcctttcttagattctctagctgctcaccaagtctagttacttggtcctcatgctctttcaaagaaccggtcctctcatgcaattgtttcgaaagcactctacaatgagaatgtgctgattcagctgacaaagcacttgcctctgcagttgcatgtgttgctgctagctgtgatttgatatcagccaattccttcacaaactgcacaataggagaacagaaaagttgataagttacgtcggtaaaggacgtgagatctcctgagttttggcagatttaagaccaaagtcaggttcaaaagacaatggaggaccagcaaagtttgaagaggcagacataagaattaagaaggctgatgagaaacaatcaatgaagttgatgctctaacagatctatgtgttcaagcagaatcaagcaaaactagagaaactggacaatcaagaaatgtgaaagaaaacaatcctaaccttctcagtagcaacatccgaagcacgaatctgctcaactttctcgtttagttccttggcaagttcatgcatttcatcttccattctcttaactcttgtttctgcctcctgctcatattgaaaacagctcaacaaaagtctcaacatccaaaccaaaagactaaatcacaaaaaaaagtaatagctgataaattcagaactttgctaacctgcctggacatagcttcttttgaacacgaccgctcctgttccgcaagacgagtcctcgcttctttcaactcagtggccaaagacaccacatttctcctgaaactctgcttcttctcactcaaatccttcaacaaaggatcatcctctcttagactaacagaagttggcattttctgaaactggaatatcaccgctctgttctttaatctagacagataacttctccagaaaaccccaaaattcaaaaacgtaaaaggaagcagctattcatgttcttcacgtgaccctgtacataaacgaatgaaacacataaatgtccaatctcagtatagttaaagaatgtgaaatcattcaaatatgtccacaagaattaaatcctctaaatcttgtttgtaacaatcaatttcttataaataacagccattatcgaggtagggaatacgcaaaagagacaaagaaacttgtgtcgtccctttcacatcaataaataaactctgataaagacgaatactttacaagtatacagccaaaaaaacgtgacctttttaaaaattcaaaatctcttacaggatttttttaattttcaaaccctaaaaatccaaactttctcgcgacccaccagtctccatcgaacggttggaaatattaggtttctgggtttggtaggaagaagaatcaatttgcagatttgttcgagttcgtgatttctccagaggaggaaagtgacagtgaaaatgaaacctggaggatggggtccctatccgttaggttcggatgagagatcatttaaggaaagtgactaaaatatttagcttcggagttaccgagcctagggcttcgaattttgtgtcatttaaagtaacgaatccgtagctaacctacgcatctggcgcagttagctaacttgctaggtttgactgtagcgcggcaaaatctattcgttcaaagttcaaactatagaaagccacgtgtgcatagtgtaaacgtagtcggaccacttttgcagccatatcaaaccgttggagatccgatcgaatacaactacgaaagatattaaaaagcttttgcatgagtaatgtcccgatttgtgtcgtgttgataagtaagttatctttttcccttcatcctttcctcatactcatattgaatctataaacagaacaactttttttaattattgatggacttttattttaggaatgaagagagttagatgatgcatgaaatggcatacaaagtgtgtgtggagaaagtgaagagtttgggaattgagttcactactcctatagaagaaaccctcagagacactattgttagccttatggaggattgtcttcttatatgatcctcatcatatataggcatatagcttcattttctggttgtttctattttttaactataattttgtatggaggatgtctaggctttacaatatgtataattaaaaatatttataaattttaaataatatctataaactcagaaaaggagaaatattctgaacaatgaattacggcaacgtgatttgttgaaaaacttaacatgtggatgttttttttttctttttgcttatgcatataacatgtaggccttatttcttgtttacaaatatcttctaaaactgaagggccagttttaaacaaggcccatattctaattgagccgccctaatttaccaaaccatttactaattgaacactcccatgcgtttgaagagttgattcttcatttaagacaattattttcagataaagagaggtcaaaggagatt

SEQ ID NO: 5088 - DNA, 3000 bp, Unknown
  misc_feature (1)..( 3000): cDNA_ID_2137225_gDNA_ID_1620761_Annot_ID_167145 3000 nt of promoter + ATG
ggaagcaaatattggagagagccagcaagctcaagttaggttaaattctaattagagaaaaacacagtgtttatagtttagataagcttatcatctctaaaaacttgcattgcttagggaaaggcatgcattttctcacaccagatgctatctgaatgaattatggtcaatgttatggaatacttacagcttatcaaagaaaatatgataaatgacaacttagtgtatgttcatttttgcagagagctgacgaactacttgaggaagtgatactctcatggactcttaatcaactaagagaatgtgagactacagctcagaatttgtgcccgacgtacataaaaactcaagagtacgtcttctcaggaacgagaatatgctggaaatggctattggttctgtgttataaatcttcttccaaacttatgtgcatcatcgttcacaaaccttttctcataatgttgttgcagtataaaattatgtcaaggtccctatgaccctatactgataaaagcatgggaagaatgggatgcaaaacatgggtctgagaatgatcacccagattttccggagaaacaagtcagattcttttcactccattagattttaaggtctgtttatataggatgctaaatgatttgtagaagcaatattcattttctgtgtggtgtttgcttccagtgttatgtcatgtttgttctggaacatggtggcaaagaccttgaaagctttgttcttttgaactttgatgaagcaaggagcttactggttcaggtaagttgtagagtatagattctatttgctgttacagaaattatgtaaaaatgatattttttcttccggttaatggcatgtgtttcacatctaaggccaccgctggcctggctgttgctgaagctgcttttgagttcgagcacagggacctgcactggtaattttagtgtttgatttggtaagtttactacttattagttttctctcgcttgaacttcttattttcatttctcttttcaggggaaacattcttctcagtcgtaataactcggatactctgccttttattcttgagggaaaacaagtttgcatcaaaactttcggagtacagatatccataatcgactttactctttcaagaatcaatacaggtgggtttctgattctcaatactgcgacataatgtaaaccataaggtccaatctaacacttaaacagttaaactaccaataatcatggtgctaatgtgctcaggtgaaaagatactctttctggaccttacttctgatccataccttttcaaaggaccaaaaggagataaacaagtaaggaaaattaattaagttccttattatcccaagagttaagagaaatgtacatttattttaagttttaataacgttattatgcagtcggaaacttaccgaaaaatgaaggcggttactgaagattactgggaaggaaggtaagcgtaacttttccaagccttccttttagttttcatgccgctaatttggaaatttctgcagactagactagaatattaagccacaacattatctttctttctagaaagcatgagactgtgatatgagcattagtacgcaaccaaactgaagtgtgcctaaatgatttgatgattaatttaattgccatgttttgttttgttctttctaacaacagctttgctcgaacaaatgttctctggctaatttatctcgtggatatcttacttaccaagaagtcatttgtaagtttgcaagacacagataattattagttgcatcaactaagaacagcttattgatactcctttcgttcgtgtgtatatgttttaggaacggtcttcaaaacacgaaagagaactacgatcactaaagaagcgaatggagaagtatgaatcagctaaagaggctgtgtcagatcctttcttctcagatatgttgatggaccaaatatcatgaagaatataataaaccccgtaagtgattaaccagaagctctctctcttgtatatttgtttgcctagccacttaaatcaacagtactagctcttgcttcgtaatattatctaaggctccgttatctatataccaatcttgattttcatctcttcaaatgaatccaagaactgatatgttagtcttttcttgtatgtgacaatagtttaatggtagcttttatctatagaaatacttttgaaaccatgaattcttttaagaagaaagtatcaagatctaccaattccacatgggttgtccctacttgcatgaatagatcttcttatctcaagaacaaaagttgtcacatttttattcttgtaatgagggaagaacaatattcaaacgcgtagatgataaaaatgagagatttgctttaaaattaggccaataaactaatccatttaaacagctaacaaaagctttatgttgtctgcttttttgttttttcaaaatctttccgctttgttgatttctttaaatctttgtgggttttgctgagctaagcaaaagatcatccattgtattaattaatctcatgatcttaatctgcagcaccagtgtctcttctttccttttctcctttttggataagagaaataaaaataccaatttgcagcttctttcttgaaaactttggagagctttatgcatatgcttatgtctgaaacggatctgacaaaaatgggtttttctctttcttgttttttttctggctagcataaggtaaaagcttatatctttgcacacaaaaatataaagaacagatgagattagtcagaggccaaatccaaaagacttcatagcaaagtaaacatcttttgcctactttcttctttttttctcacttagtcacttgcatgtagagtacagtcagcatcttctctctttttctcccccaattctctcaagagaatctctaagcttttgttcttcttacaaatcatgtacttataataaacccaagaaagaagaagaagaaaaacaaaaccaatcccaagctgtg

SEQ ID NO: 5089 - DNA, 3000 bp, Unknown; identical to SEQ ID NO: 5079
  misc_feature (1)..( 3000): cDNA_ID_1827359_gDNA_ID_1620761_Annot_ID_167142 3000 nt of promoter + ATG

SEQ ID NO: 5090 - DNA, 3000 bp, Unknown; identical to SEQ ID NO: 5078
  misc_feature (1)..( 3000): cDNA_ID_1827363_gDNA_ID_1620761_Annot_ID_167141 3000 nt of promoter + ATG

SEQ ID NO: 5091 - DNA, 3000 bp, Unknown; identical to SEQ ID NO: 5077
  misc_feature (1)..( 3000): cDNA_ID_2137210_gDNA_ID_1620761_Annot_ID_167140 3000 nt of promoter + ATG

SEQ ID NO: 5092 - DNA, 3000 bp, Unknown; identical to SEQ ID NO: 5076
  misc_feature (1)..( 3000): cDNA_ID_1827379_gDNA_ID_1620761_Annot_ID_167137 3000 nt of promoter + ATG

SEQ ID NO: 5093 - DNA, 3000 bp, Unknown; identical to SEQ ID NO: 5087
  misc_feature (1)..( 3000): cDNA_ID_1839377_gDNA_ID_1620761_Annot_ID_50004 3000 nt of promoter + ATG

SEQ ID NO: 5094 - DNA, 3000 bp, Unknown; identical to SEQ ID NO: 5086
  misc_feature (1)..( 3000): cDNA_ID_1827352_gDNA_ID_1620761_Annot_ID_50006 3000 nt of promoter + ATG

SEQ ID NO: 5095 - DNA, 3000 bp, Unknown; identical to SEQ ID NO: 5085
  misc_feature (1)..( 3000): cDNA_ID_1827342_gDNA_ID_1620761_Annot_ID_50009 3000 nt of promoter + ATG

SEQ ID NO: 5096 - DNA, 3000 bp, Unknown
  misc_feature (1)..( 3000): cDNA_ID_1827338_gDNA_ID_1620761_Annot_ID_50011 3000 nt of promoter + ATG
ttaaggtattagaggtaatgcatgattcgtgactatgttgcaagaagtcttggtttcaaacaattagctttggctcaactccatgaagaagcaaacatagttcttcgaacttaacagagatctattagctggccatatgaagtacacttagttttctgttagaagaagcacatggtgtgtgaagtaaaaaataagttatcatgttaattaagtaatcagttttattagacccatacgttaagagtctctcaagttgattattttatctgaaaagtcagataaattagcttacctgttttgaaagcttttagattagatcaacctcgacttcttacctgtctttagtcaactttgaacaaaaaataatatggattatacaagaagacgaatacatgagactatggagctcaaatgcacactgaagatcatcagttattgttccttttttattacagaagacaaatcaaagaagataaaaagatcttccctttagaaaaaaacagaactgtagtaatgaatataaaggaagggtgatgatcatttcttgggttggaacttggatttgatgtgtttaacagttcctggagaagtctgaaaggcttgagccaagatgttgtcaggaacaggaggagtagaaccaaacaaagtagcaccaagagattgagttccaggaagctgactattgaaagctgcaataacagaagcagggacatcaccattgttcttctggaaatggacaagtcctttggggaaagcaaagacatctcctttcttgagagattgagagattagcttattggcagtagtgagaaacccaacgtcaagtgttccttcgaggacgaaaacgacctcagtggcacgtgggtgggtgtgaggtgggtttaagcctcctggtgcgtagtcgatacgagagagggagacaccaagtgtgttgagtcctgggattgtcataacgttagctcctgtgactaaggcaccgaatgtgttgttggtaagacctggtttagctaatccttgtgagaagaaatcggctgatgtgactgtagctgcgtctttgcaagggaagccattgattttgattcctgcaaaaaagaaaaacaagaaagagattagaaattgaatctttttctaggaaaagagatgaaagtaaaggtttttgcaagtaccagagggaagatcagcgacgcagagatcttgaagcatgtcaggatctgcggaggaggagatgaagaaggagacggtggtgaggaggaggaggagagtaagagttggtgaagccattgggattgtggtagtggtggtggtgggactctctctaaacaagtagttgttgagagagaagagaattaatgaattatggtttataaagggaggagaattgaagaattgaagagagggtgacttttctcgttgagggaaaaagcaagcaacatgctgtttttctttcttgcacacatctgtctaagtgaaatgtcaaaggtcaacgaattactaaaacggatggatcagagctttgccaattgaaaatttatgtttacactagttttgcttttacacggtactgatattatttttatttaattattagtggcttataaaaaacaattatcaattattatcacctaataaagtatgtatcaggtaataaatgttgtcttatctgcataaactaattttacttgttggcttctgtattttgatcatcgtgagagaagaatcattatatattaacacgctcgttcatgcctcaccgttaatctgcaacgtccgcgtttcagggttagttcttctcacgcgaatcgtgaagcgcgtgaagctacgcgttgtctttaatgggttgggtttaggtgataatacccgataccgttggtttgggctttttagtgttaaaagcctcatctaatacgacgcgtaatgcattgaagacggaacaacaaatcgttttgaattctttattgcttccttcctatacggcatcgtgtgtttttttttgtttcgaggcaaatttttttttactagtgcatgatgtagagaaaatagaattggttaaatttattagtgaaaagattgattaaattttatttacaagtctttaaacggtaattgaaagcttaatcacaattattgaagacctttccacacttttttgtatgaaatctttgtctagtagctttttgaactcttgcaagcaaaatctgaaatttctttccacttttcaggaccattttttcaaaatgtttgaagattcctgagactttctgttctgcagattttggtgaaaagaaaattggaattatataatgaactctatacttctgactattatatgagtaatagtgtgaatttgaaattaataaaccctattaatataatcttgcaccacttaaataaaagcccaatcacaaaactgacttgttctaaaactagttttaaacctaacctattgatgaaatgaagtgacaacttcatgagtgtcaaatcatccttaaatatatacatgaaaatatacaacgaaagatacaaggtggcagtttcgtgaaaatcttaatttcttaacctaatgatcaatggagcgtaatggaggtttaggccccaaagttgtggtctatcagtcacattcttcagtacgatcttgtgatttacaaatggcaagatcatgaatcatgtccatgatgtatgtactttttctaattaaggaaagaaaatatcttaataaatctctcttatgactatgactggtctttaatgcaattctctctctctcactctctggtcttcaattataattgagtttctatataagaaaaacatatgcatactacaaaagaccaagacggatgctttattttcttggctgcgtatatactgacaactctagtacgtctccataatcatttcattcaaatttcattaagaggagaaatgaaaacgcttttgtattggggttggagtagtctcgcaggactcattctcttcagcattcttgcacatggggaaatg

SEQ ID NO: 5097 - DNA, 3000 bp, Unknown; identical to SEQ ID NO: 5084
  misc_feature (1)..( 3000): cDNA_ID_1839846_gDNA_ID_1620761_Annot_ID_50012 3000 nt of promoter + ATG

SEQ ID NO: 5098 - DNA, 3000 bp, Unknown; identical to SEQ ID NO: 5083
  misc_feature (1)..( 3000): cDNA_ID_1827334_gDNA_ID_1620761_Annot_ID_50013 3000 nt of promoter + ATG

SEQ ID NO: 5099 - DNA, 3000 bp, Unknown
  misc_feature (1)..( 3000): cDNA_ID_1827330_gDNA_ID_1620761_Annot_ID_50014 3000 nt of promoter + ATG
cttaagcaattgtcatagagtaacaaattttagaaatattttgaagcaaaattataagcaataccactctctgaactgtaaaatctcttgaaagctaacctcgatcttctctttcttagcaatagaggcccaatccttagcagcgattccagttctccagtcaatgttgatgctaacatttttgtttccgtgactcttttcatctgcccaaaagcacgccaagtagttccctgattcttgggttgtaaatgcaaattggccatgcgttacgttttccatattgtgcagattgttgccatatggggatgtcacctgcaccataatgattctcaaaactcagagccaagaataaaaaggaacagaggttaccattcagaaacattgtattccttttttcaagtcgacttcaaagactgctctcaatccaaaggacactatcttaaacaatccatcaaactatctggaactagcacatagcaatgattactaaataccaaatgatacttgctcaataaaagaaactcccttgttcgtaataattatcattgttcccaaacatacacatcaaaaacacagacttcattaaaagaccacataaagtttcaatttttcttatctcaatctcacagctaattactgatattacggcaaaaaaaaaagggtattcacagggattaagctatacacaagcatctgagcatttatacaaatccgaaaatcatcataacaaacaatcaaagaaagacatgcatgatcataattttccaaataaggaaacttggatcgagaattaatacatgcctttctaattcctaaacgtgactcatgaatcagttgaaattatggatcgagtaacacaaaatgcagattcaaatcactgaacaagcaagatgataggaacagaaaatcgaagacacttaccttgacggatatagtgggcatgacctcgtgatcctcggagatgatgaggtaatcagccaaaacgacgacattgctctggatttcttcagatacacactttgttccggtgggaggcacatctagccatacagcctcaccgaccggaatcatcaccggaaccagaaacaagagaaggaacgccgtcgggaattcacggcgcatcttagcagtcatcttcatcgacgagatttcaaattttcctattgtattcgtcgatcgttgtgttgtggtggccagatcttttgctccgaagtgtttttttttgtttgttcatcttaattcctttttgtttgggaagctttgattgggctttgatgagaccaacccatgggcttgataattgagatgaggtgatagcattgggtccaataaagatctatataaataattaatcacttttcatttaaacaacactttgtatttgcaactagtcgcccatcatctctgaacctcgctctctaatctcatttccatttggttgttttttgaatactttatctgaataaacgtgcactttggagtcataaaggcaagatttggcacagtctttgagactttttttttttttggtagagttgtgcagttcctcctgttttaataagacaaattgacaaacttaaactattacataagattgtttgacaaaaaaaaaaactattgcataagattaaaacatctttaataatagtatggccaggctaactaagtagtattagtttagattaagtgtttttttaattgcatctcttcttagatacaactcgtcatgtcattgtttggttatgttttaataatttcataaacttatcctttaacggaagtggtaagcctattgcaaagtcagctcaaaagtcgagcattaaaaacatatgaattcccaagtcgtatttttacattaattatcatcatatttagctggggtcctaaaatgtactagtttttatttcctatgaaattgggttttaattaccaaaaaaaaaagtttaaataaagaatttggcccttatggtcgtataacgatcaaatctactattctcaaggagagaaaaagggcaaaacaagagagaacataattagttgttattgctttcgtttcaaaagaatgcaaaaactctcaagccgtggatagaaaggctaaaacttattttccttcgtcttcttcattcacattatcatataagcaaactgttgaaagcaggtacttccaggtatgtcaatatattagtcgaaaatgttttagatcgtttctaatatgcaatcaaaatgagacttgttttttgtttttcatagtagtgcaaaaagatggtgatgtctatatatgctcatatgagtttttcacaacgaatattagtgaatgcaagctagtagcctagaatatggatttgtaattaggaattccacctaaacaatttgacaagaaaaactaaacaagagtttacgtaaactaatcgtgtttttctctttttaaactcagttacgtgttgtttgtttgtcatgtgggtaataaagtaacctaaatccgtatatattccgcgtcaatttcaactccgatgaaaaggataggtctcaacaacggcattttcactgtttcttttgtcgggatggttgttggatagaataaatacaactttatcaagaaaatcaaatttagaatgtggatttttgagttaacaaaaagttgtaacttattgattgagattttcgtaaaagccattcttcatgccaagtcaacaatggccattggctagtaccaatctttttacttttcgatagataaaaagcaaatggcttcgtgcttgtcctcttttttcttttcttcgattttcctaatcgtgtaatcttatgatattaataacagaagaatcataattaagcgcgttatattattccatctctttctccgattctcatatcttttaatcgtttgatctgtgaacctaacttttattcaatttcgctttcaccaaatccagagctaagatcttcagattcgtgggtcaaataatgtggtcaatgggtttgataaggcgtacggcaatg

SEQ ID NO: 5100 - DNA, 3000 bp, Unknown; identical to SEQ ID NO: 5081
  misc_feature (1)..( 3000): cDNA_ID_2994800_gDNA_ID_1620761_Annot_ID_50015 3000 nt of promoter + ATG

SEQ ID NO: 5101 - DNA, 3000 bp, Unknown; identical to SEQ ID NO: 5075
  misc_feature (1)..( 3000): cDNA_ID_3075567_gDNA_ID_1620761_Annot_ID_167136 3000 nt of promoter + ATG

SEQ ID NO: 5102 - DNA, 3000 bp, Unknown
  misc_feature (1)..( 3000): cDNA_ID_1827326_gDNA_ID_1620761_Annot_ID_50016 3000 nt of promoter + ATG
aatgttagcatcaacattgactggagaactggaatcgctgctaaggattgggcctctattgctaagaaagagaagatcgaggttagctttcaagagattttacagttcagagagtggtattgcttataattttgcttcaaaatatttctaaaatttgttactctatgacaattgcttaagggtgtggagctggagatcaggaaactcgaaggcgcagtcgaagccatccatgaaaatatactctacctaagaaacaggtaaagtcatcttcagctgcatgaactgctcttgccttctttgctgactctcattatcaaaatggtaattgcagagaagcagacatgaggacaatgagtgagaaaacgaactcgcgggtggcttggtacagtataatgtcactaggtgtttgcattgctgtctctggtttccaggtactctacttgaagcagtactttgagaagaagaagcttatatagagattccctgatattcaggtcctttaatgagagtttcttcttaaagaataatattcaattcatctcctttctttcctctttacacgcctcctttttactgacgctgtaaaatttttgttcatggattgtttatgtagcttctctctgataagaagtcattatttctgattctgaaataataatattaacttcttgtcatctccaaagtccaaacgaaagagattctagaaccattgatattgggttgtaactgatactttatgttagtttggggctataacacgtaagtttgacagtacaagggttaagattacaagaaaaaactaatcaaatgggtattacatacaaatcagcccaaatttctgacccaacaggcccgttaagagcaaaccctaatttcaaagagaatatatataaaccctaatcacatttcgcaaccaccaaagcggaggaaaaatgccggctggacatggagttcgagcgagaacgagggatctgttcgcgaggcctttcaggaagaagggttacattcctctatcgacttacctgaggaccttcaaggtcggcgattacgtcgatgtgaaggtgaatggtgcgatccacaagggtatgcctcacaagttctaccatggtcgtactggtcgtatctggaacgtcaccaagcgcgccgtcggtgttgaagtcaacaaacaggtctgatgatctctcacttcccttaaacttttgtgtccttgaattaggatttgagcttgttgtgctatttggattgttgatctgttgatttgatgttgaaatatgtgattgagtattaggtttgtagaatgtaaaccttctactgtgctccaatttagctcagattgttagttttggctcaaagatcttatcttctattatgcagtagtgtggttcttgatcctgtttcagatttgaagtttgattgcttaggtctcgtttagtctttagccttagcatgcattgcgttgtatcaatttggccctttttgcatcacagttctagctaagcatctagttttacttctccattgaactgctagtatgtttggtttcatgactatcgcattgctctagttttgctttaaatgaccaccaacattcgtatattaatcttgtttctataagtgtcttagagatgttattgtgtaatgctgattagcctatgaccagaacacaaacatttttgctagtactacttatattgggtattatgactgacatatgatggtggggttgtttcagattgggaacaggatcataaggaagaggattcatgttcgtgtggagcatgtgcagcagtcaagatgtgccgaggagttcaagctgaggaagaagaaaaacgatgagctcaaggctgcagccaaagccaatggtgagaccatcagcaccaagagacagcctaaaggacccaaaccaggattcatggtcgaaggaatgaccttggagactgtcactccaatcccctacgatgtcgtcaacgatctcaaaggaggctattagttctatcttcttgtgctttagaactctttttcatttgttttgtagcagacttaaaactaagaattatgatttactatataacaggagtttgcaatccagattttgtaaggatggtttatttttattattggtatttttgatcttccaactattgttcacttttgtcaacggtgtcttacgaattttaaatatgtctgaaattgatttaattatgagcctcattttaagatacgtttgacttggagcccatggaactccagcacgatgccacgtagcgtctgagcaacagaacctaattttgaacactgaactcaaaagagaagaagaaaagagtcaagtcttgggtgtccattaatgggagatctctgttatgttcaacacttgctcgagagacagatagaaaccaggctgcttcgtcattgtttctcctctgaagcattttcgttatttctgtttgctgtattaaaatttcctaaaatagaaagactatgaaacctcatttccctaaaatctctcatattcttgataggctcttcgtaatttcaggaatcactcacaattccaaatctctctctctctctctctctctctctccattaatctcagcatatctctttctctctaacccacaagtcttcctttgattctttgatttcaattcgttttcttcatacaaaaacattgagacacatatttaatccatatttcgagatcagtcttgctgacctcaaattttccagtttcgttacatctacagaaaaagctcctctcttttttttttgtctcccatttgattttaagattagcgtctaatccaacaagttccaacaaggtctaaagatcaaaagctcaaatctttgttctttgttggtggtgtgggtgggaagatttcattttcagtggagaagaagaaaaaaggaaagattaggaagctaatcaaaacatacagtttcctgattccggtcaggaaactgtggagcattgacggaatcacgaagccgtggagaatt

SEQ ID NO: 5103 - DNA, 3000 bp, Unknown
  misc_feature (1)..( 3000): cDNA_ID_1012102_gDNA_ID_1620763_Annot_ID_50053 3000 nt of promoter + ATG
tgatgcctacttccactcatcacataaccaagatcctcaaacttctgaatctcttcagcgttaagacccacttctcctctacgtgggatacgtttaccttgctgaacatactgtgcaatggcgtctccttcaccgggtcttaaagcaccaccataactgatgtgaccttcagctttaggtaatggcattggaccaacatcaccttcttcttcctcttcatcaacagctgaagatttcttctttaattcaatcatctctttgaacttcttcaactcttcttcatcaagttctagctcagtgttcttcaccgtttcgtctacttgcatcttcgaatcttcctcagtaccatcgctgtcactccctgacttcgtcttctctcccttgcttcgttttgaactagaatccgaagatttcttccgcctcttgctctttgacttggtatcttcttcctccccagacgaagaagcactaatctcagctttactatcttcatcgctgctctcatcagagtcactgtatttcgtctttctcctatgacttcgctttttcctaaaactacggctgcttctactcttcttcctcttagaagaactcttcctccttcgtctcctatcttcctcttccgaatcactctcactcccttcggattcactatcgctgtcataagatctctttctcctgcgcttagacctcgagctcttactcttcctcttcctagatctcaaaccatcagattcagattccgagtcagatttacctttcctttctttccctttcgaattatcatctctttcgccgccgttcttgtcctgaatctcgtcggcgttctcatcggaatcctcgttctgatctctaggtggactcggtgtgttctcccaaaagcagaacttggctgatttcctcatcttaagccgtttctgcctcctatactcttcgtgactcaatcccttcaattcttcatcggaatctgaaccagatcgtcttccgtttcgataatctcgatccaaatagccatgattcttcccaaatctcctcggaagcgagttcatcgtcattctcgaatccctaattcactccgacgacgacaatgaagaaaacaaaatctaagcagctgtctgataaattagggctttgattcatatacagtatctgcgcctttttacttattgggcccttaacgaataggcccaatatttatcattattcaccactgaaaatcatgttttgattttacacaaagcaccccacattttaattagagtcaatcgagtcctctatccttatcgtcgtcttcagatggcaagtctctccatgtccgccgtgtctctgtcgccgtttcggcctcaaacagagaatcttctttcaaaactcagtttccgaacgaacttacactcgttcaatctcaaaccaataaggattagtacgaaagttagaagttttggtgggaatcggagagagccgaaggattcaagatttgtcgatgaaaaaggcgtagttgatgacatggaaggtttcttagacaatctctctctcgaatacgactctgtttgggacactaaaccctcttggtaaatctcatttaagttcccaacaattttatttcaagtagtttggatttggtcctaagacttatgaggaatcgtatttgttggttgtgaatatgggattatagcttagatagagtcttaagttcacttttaagtggaccaatccttaatctttattagcattttcagtgatttatgcctgcccaagaacttttttgaatcatatatgaagctatatatttattgatgctacttaaaacaagacttaccccattacagtttcatgattgtgtgttgtggtttagaagatagaaagaaaaagtttgaatcttttggttaggaagatagtgaagaaccaaaatacagattatgtaatggtaattgggttaagaagggtttaacatttcgacctcagcatctacagctttgaatatctattgatctggtgtgtatttgcaatcaagaactttacggttcttcttagacgttttcagggcctagtgttcttccgtatggttttgaataagcaactggctatgtttctcaggtgtcagccatggacgataatgttaacgggtctatcaatagtggcatgtagctgggtaatactacactcggtcatagtttcatcgcttgcggttggtgtaattggtgcttggtggtacatattcctttatagctacccaaaggtatgattttcccttccatcatctaacaacctctccttttcattcccttactaaagaaatgttcgtagctctaatttactaagtctaagttaaagtaaaaatcctgtttaaacatcttcagacaatgctagtttctataatcttagtgaacaagactttactttggtcttgtctttgagattctggtggttttttcgtgtactttggttcagtcgtattcagaaatgattgctgaaagaaggaaacgagtagctgatggttttgaagatatttacggcaaaaacaagccttcataggatcttctcaatgttcaaaattacattcgtttcttgcataaatcttcccttctgttgtgtgtataatataaccatcatctatggatttatctcaatttcattcacagatgtttggatacataaatcttgatttcagagtcctctaatgtagtgggcattaaaatcgaattgaaccgattatacaaaccgaaattaacccaaatataccgaaacctcattactgaaaccaaccgaataaagtgccttcgaactaaataaaccaaacgaaccggaccaattttagttcaacaaaatcgacaaattcaaatcgaaccgaaccgagccgaagaaccaccaatacgagaaatgaggaatgaagggtaaaaatgtaattcccaagaggtcatggtcaacggaatgtatatatatgtaacggtgagagattcattgagatcatctccactctgctaaatccgacgagagacgacg

SEQ ID NO: 5104 - DNA, 3000 bp, Unknown
  misc_feature (1)..( 3000): cDNA_ID_1827542_gDNA_ID_1620763_Annot_ID_50054 3000 nt of promoter + ATG
catctttaattctttatcgtcactgtcaaatgagcgaccgtgacaaatattttttaattatatttattgtttattaaaattacaatgaataattttaaagacgtcgagatatttaactctaagtaattacaattagatatttaactctaagtacaacatatatatagtgtttacagtaggttttaactcttaagtaattacaattagatccttcatctttattatgccttacagtcgagatattgactgaatgatcattgagaaattgatacgaccttgagaaaatctcagattatgcattgtttgtttgtgataaaactttctgtgaaatccacggagacgatcctttgacaatgttttcatttcagtaatggaaataaacaagtttcgtgctctttcgcggcgagctcagcagctacattacacatccttgaatggacttaaacgaagatgcaacaacgcacacggtgcagctaattttcactcgttgaagagagctacacaaacccaaatccagaaatcgcagaccaaacctctccttaaatgtggagactcggatataaaagagtggaacgttgctataagcagctacatgcgtactggaagatgcaacgaagcgcttcgtgtcttcaaacgcatgcctaggtggagttccgtttcttataacggtatgatttctggttatttgagaaacggtgagtttgaactcgcccggaagttgttcgatgaaatgcctgaacgagatttagtttcctggaatgtgatgattaaagggtatgtacggaacaggaatcttgggaaagcgagggaattgtttgagataatgcctgagagagatgtttgttcgtggaataccatgttgtcgggttacgctcagaatggttgtgttgatgatgcaaggagtgtttttgatcgaatgcctgagaagaacgatgtatcgtggaatgcattgctctctgcttatgttcagaatagtaagatggaggaggcttgtatgttgtttaagtcaagagagaattgggcgttggtttcgtggaactgcttgcttggtgggtttgttaagaagaaaaagattgttgaggcaaggcagttttttgatagtatgaatgtgagggatgtggtctcatggaatacgatcatcactggttatgcacagagcgggaaaatcgatgaggcgcggcagctatttgatgagtctcctgttcaagatgtctttacatggacagcaatggtgtcaggatatatacaaaaccggatggtggaagaagcgagagaattattcgacaaaatgccagagagaaacgaagtgtcatggaatgccatgcttgcaggatatgtgcagggcgagagaatggagatggcaaaggaattgtttgatgttatgccttgtagaaatgttagtacatggaacacgatgataactggatatgctcagtgtgggaaaatttctgaagctaagaacctttttgataaaatgccaaagagagatccggtctcttgggcagctatgattgcagggtattcgcaaagcggacacagctttgaagctcttcgtttgtttgtacaaatggagagggagggaggtagattgaatcggtcttcgttttcatctgctctaagcacatgtgcagacgttgttgctctcgagctcgggaagcaattgcatggacgattagttaaaggtgggtatgagactgggtgctttgttgggaatgcgcttttgttgatgtattgcaaatgtggaagcatagaagaagctaatgacttgtttaaggagatggctgggaaggacattgtctcttggaacacaatgattgcaggttactcaaggcacgggttcggagaagtggctttaaggttcttcgagtcgatgaagagagaaggactgaagccagatgatgctaccatggttgcggtattatctgcatgcagtcacacaggacttgttgacaaaggcaggcaatatttctatacgatgactcaagactatggcgtaatgcctaactcacagcactatgcttgcatggttgatcttcttggtcgagctgggcttctagaagatgctcacaatctaatgaagaacatgccctttgagccagacgctgcaatttggggaactttacttggtgcaagcagagttcatggaaacacagagctagccgaaacagctgcagataagatatttgcaatggagcctgaaaattccggtatgtatgttcttctctctaatctatacgcttcttcgggtcgatggggagatgttggtaaactacgagtgagaatgcgggataaaggggtgaagaaagttccagggtacagttggattgaaattcagaacaagactcatactttctcggttggggatgagtttcatcctgagaaagacgagatctttgcatttttggaggagctggatttgagaatgaagaaagcagggtatgtttcaaagacgagtgtggttcttcatgatgtggaggaagaagagaaggagcgtatggttcggtaccatagcgagagactggctgtagcttatgggataatgcgtgtgtcttcagggagaccgatccgtgtgataaagaatctgcgtgtatgtgaggattgtcacaacgccatcaagtatatggccagaatcacagggagactgattatcttgagggataataacaggtttcaccattttaaggatggttcatgttcttgtggagactactggtgaatgatgattccatttcatctttgattcaatctaaccattgaccaattatacgtaatcaacacacattggaagaattaatttgttaacttaaacatgccaaattgaaaaactataatgttgtttttagtacataaatatccctacagaaaatccacataatttgaaaagaaatgaaaaaaataaaaaacgaacccggaagtttggaccttggaggcggagccatttataaacaacactcgagaaaacgcttgagaagacgtattcaacgttgggttggttccatg

SEQ ID NO: 5105 - DNA, 3000 bp, Unknown
  misc_feature (1)..( 3000): cDNA_ID_1827534_gDNA_ID_1620763_Annot_ID_50056 3000 nt of promoter + ATG
tgaaagtacatgttgcaattttaagaattatcgaagtttatggtggaaatttcaggagcaaaaagtgtggggggaaaagcagagaatgcaattagtttatggctataaaatcagccaacccttttcttaacggatataagtgattaatcgggtaaatcgcaatcgcggtacagtaaacgcgaatttgtggttaattccggtttaatgaccggttcaattggaaatgtatgtttaaggatgaatccgaaagtacatgttgtaatttaaagaattatcaaagtttatggtggaaatttaagaaacaaaaagtgttgaggaaaagctgaaaatgcaattagtttatggctataaaatcagccaacccaacattcaaacaactcaatcttaatcgttcatcaccattaatttcttctaaagtcaataaggttgtctaaggggatgagcgtgtaaaaccgaaaaaacataactagaataagtaaataatccaggtcatacagtagatttgggatgataagtagtaacctcggacgattagctagaattctgggaaaccatctatgagcggtacccaattgaacaaggcctatgtagtaagattctagaaaaagctaattttgattcaggcccaagtttcaatcttctaagctcaaagcccaacacatatagatgatcaatccaaatgatttggtcctctaatggtcaatgatgttctagattatcaggccttaatttgaattgatattgaaaaagaaaaagaaaaaaagaaaagaaagaatcagaacaaaggaggcaaaacgacgtcagataatatcagaataagatgggtaagagaaaaatctaatggttgaatcctattggttaccttatccacttaatccaacaaactctagcttctcatttcgcaatattatctcttttctcttctcatcaaaacataccaataagcaatttgctcattagagaacagagaaaaaaaaaacaatggcaactcaagccgccgggatcttcaactccgccataacaaccgccgcaacctccggcgtcaagaaactccactttttctcaacaacccaccgtcccaaatccctctccttcaccaaaaccgcaatccgcgccgagaaaacagattcctccgccgccgctgctgcagcccccgccacgaaagaagctcccgtgggattcacgccaccgcagctagacccaaacacaccgtctccgatcttcgctggaagcaccggtggtcttctacgtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagtgtttcctaacggtgaggttcaatatcttcatcctaaagatggtgtttatccagagaaggcgaatccaggaagagaaggtgttggtctcaacatgagatctattgggaaaaatgttagtcccattgaagttaagtttactggcaaacaaagttatgatttgtaagatctgtaaactaaaaaaaccaaaaactatgtgcatgtggtgatgattatgactatgtttcatgttaatttttaatggattttgttttgataatttgttgttccatttggtttaatggatcttttatgggcctaaactataacgtaattttggaaggcatatgttgggctttaatgggccggttgagtagaaaaaggaaagttaaaatcattatcgtagcccaacggttcaatttcaaacggtcgggtttaaaggattcggatcttatattcgccgatcgtctctgcctctttcgcagaagcacacttgatcgaacgatggccacgaaagaggactgacagtttcgtttcccagtctccgatccaaaaccatagtgaggttccgattgttcttgtaattaacgtttattacatcgccctgattatctgagtgttccttcacgcgacggagataattcaactcaggatcgtcttattggttgatcgtatccactaattcggctcacgtcttctcgattttggcaacggtgctgtggaatcgcgttaccgttcaaaatttccatttcggctgatctcattatgaatgtaagctacttatacactctcacaattggatttggtaaagcatgatcgaagcgtaaaatagagattttccaaaacaaaaaacgaaccaaaggcattgtttgtggaatttggcaccatttctctaccgttttctgtgcgttttttcaatctatagtgactatgtttaagagccttgtttcttattttggacgaaaattctgaactctatcttgatgatatcacatattttcgagtgtttatgtcatagactgtttatgctactcccacatggaatagacaaagtttgttggatacaaggtttatagcgagcttgtgcgttctaggatttgtagctaggaatgcacttggtttagctagagtttcgtgtagttgagacttgtaacttgtaagtatccttattttgaatgcatcccttatatatgacagttaaagaacaaccatttatcagatccaggctttgcaaagtttgtgaccaatacctgactgactctgagataatagttaagttttttttctttctattcagtagatatcttttgcctgtctgccgatatcaatcacttctcaatttttatccttttgtgcaaacactagtcttccggtgcgaatggtgacactgaaatgttttttttatcattctggtgtttgtagatttagcttccgggatgaataatttgttgcagatttatagtgaaagcgagacatgttctacatgaaagctcggacataattttgagcctttggataaatttgttttttcttgcattctctcctttcaaagaaactcctttttgacattcgtgtcatg

SEQ ID NO: 5106 - DNA, 3000 bp, Unknown
  misc_feature (1)..( 3000): cDNA_ID_4254642_gDNA_ID_1620763_Annot_ID_50060 3000 nt of promoter + ATG
atatatatactagattttaactcgcagtacaccatatgacgatttattttctataagtagtgtatttgaaaatttaatgattatatattatatataaaattttacaaattgcactaatttttgaagatccaattgtaccaattctataattttacaaattagtgaattttctaagcctttaagataactgggcctaagagtctttaaaaaagcccagaaaatgtcatcgtccaggtaatggggataaggggttttagattcttttaattttgtttccgagtttttcagccatgtttgctcagttagcaccatcgccgtctccttctccggcgaacgttagccacttcgttcaccgtcgcaccttccgtcaatgtacatacgccgtctccgcttctcttcccactgcaaattcctctcgtccaccaccaattcaggcaaacattgtcattctaattctactacttcgtggtcttcttcgttatctgaaatgaaattgagaaactcggaaacttgttttgcagattgttggaggaaaggatttgaatttggatgttacacggaaagatgattcaattgggttcaaattagaggcaaatgaagatgaaattgattggatgaatctagaatctgatattcgtctatggactagagcattacgtcctgttcaggtaaaacaattacgagattatgttgtaaagttttggtttttctgaatatgaatttgttggattgttgtttactgtgtgtgtgtacgtgggttcttggtttcatagtggtatccagggcacataatgaaaactgaaaaggaacttagggaacagcttaagttgatggatgttgtgattgaagtccgtgatgctaggattcctttatcgaccactcatccaaaggttagtactttgcatctaaaggtctttgatccggttttttagactatgctaattatattactcagtctctctaatctttgttcaataggagcaagtgaagtctatgacaaaacttttgtgttgttcaataatgtttgcacctacttttgggggttatgtatgtggtattttgtagatggatgcgtggcttgggaataggaaacggatattggtattaaatagagaagatatgatctcgaacgatgatcgaaatgattgggcgagatactttgcaaagcaaggaataaaggtcattttcactaatggcaaacttgggatggtatggtttcttcaagtttaaactttgctttgggattggtttttttctttctatatgtttaatctgagagatggttacagggagctatgaagctaggtcggttagccaaaagtttagcaggtgacgtaaatgggaaacggcgagaaaaaggacttctccctagatcagtaagtaaagtgtctcatgatccattattctctgatgcaacatatatgatttaaattttaagttcatttcaaatgatgcaggttagagctggaataattggataccctaatgttgggaaatcatctctgatcaatcgtctattgaaacgaaaaatttgcgcagcagctccaagaccaggtgtaactagagaaatgaagtaagaatgccttttgaaagcttggttttttttgcctcttaaaactcagtttccaaacttcatatctggcactggtcatttttcttatcttactgtaaacagatgggtcaagcttgggaaagatcttgatctcttagattcacctggaatgcttcctatgcgtatcgatgatcaagcagctgctataaagctggcaatttgtgatgacattggagagaaagcttatgacttcactgatgttgctggaatccttgtgcagatgttagcacggattccagaagtaggtaagtttctgaacattaccattttttgcgatttactcttttctctcattttcctgcgctaaaaatgaaacttgatattctctcctttataacaaaaaggcgcaaaggctctttacaaccgatacaagatccagctagaaggcaactgcgggaaaaagtaatgaaacttcctcaaagagagctcatttcttttggcaaaccattgttcatggattcttattgaatctctgctctctcttttgcagatttgtgaagacgcttggtcttaatttgtttggtggagatagtcatcaagctgcatttagaatactaacggattttcgcaaaggcaaattcgggtatgtctcgttggagagacctccactgtgatccaagttagtaagagatatgctcaaacttatgtgttaatttatgtatgcaatatatgtcttgatgtatgcatacttgtgtattccgtttgtcttagaggacatgataaatactagatatagaccaaatccatgacgacatcagtcagatgctgctaaatgctaaccatttttctcttaagcccaaatgtatgaataatttgttcatgtaaaatatggttaattttttttttgttgtcaatattttcaaaagctacgtaatggataattctataatgttcataatacaattcatgctggtgaaaattttgtttatgatttaatattcagattagtaaacttgtagtatttcagttagataacaaattaaatctttgacattaaaggtggttaaaccacgtaacaaataatgtttttttacaagattctattcgaatagttaagcttttacaagttcatacatctcaagagttctaaaaatcttatagagttgagaaacgaccgttggattatgaaagtgggacctactaatccatctgtagatttcttttgggatgcaatgaaaaagtcgtcgaccaaagtccccacttctagatctacttttgtctctttccattattaattgatcaaaaataaaacaaatttcgaaaggagttacgaaatcagaacgttgggccgatttttcgcagatcctatttaaattttatcttctttccacaatctctcatcttcaataaactagccgttacatctctctctttctctatctccatca

SEQ ID NO: 5107 - DNA, 3000 bp, Unknown
  misc_feature (1)..( 3000): cDNA_ID_1827518_gDNA_ID_1620763_Annot_ID_50062 3000 nt of promoter + ATG
ttccggctactaaaagtataataatcactaatatttaaatttctaatgatacctttccttgttgtccttaaactagtattaaaacttataattcgttgacataatgaaagctttttgttcgtttaatatagttttctcataaagtcataataacaaactttttgttcgtttaatcctgtctaagtaacttatgaatcacaataacaaaatacactaaacaaaaagttaatttagtttataaacgaatgaagtgatataatattaatatttttatcattaaacgtaaatcatagattaaaaaaaagatttggccaaaaaaaaaagattaaagaaaatattaaaattaaaaataaataatgatgattctaccatatttggtagtagtaatttgtaaaaaactttcttttaatgtaattgagttttcagaattcttattttttaccaatccacgtatccaactaatattacattaaataaataaatgttcaagaaactaattggaaatcataaaataaatctccaatctaaagtagaaccgcattataaatacaaactcatcccttctacttcccatcatcttcatcacacacccatactcttcctcgaactctcttcttctttctctcttactttgtgtttgctctgttttgctctcttaacacaacacaaaaaatgtccatcgttgttggccaagcttaccaacatcttcccaagcaagtaagccaaaatcctgacgtgggtggatggagtttcttgcaatatttctctgagccaaaaggcattgtccagaacagagaagacgacacaaagaaaacagcttatgtctacccgatcgagaagcgttccgtagctaaactgagccttgagatgtgcacagagagcctcgggaccgagaatgggagtgatagtggagacgagatgtcgttacttgcgcttgaagcaaccaatatttcaaagagtcctcgtcttactacgaaacctcaaaaagaaactagcttcatgacccgtgagaacagttttcctccgccgctaaactccgtcaacggattcaacaatagccgtatggtgaaatcgtataaagaagacggtcgtcttgttgttcaagcaattagggtttgttctccacctcgttgctttgtatctgaacgtcgtgaaggaaggcttcgtctctgtttatcacagaattcattgaatagccaagacgcagaagaagagtttgaagaagaagatgaagatgatcaatacgatgcagaggaagaagaagaagaagaagaagaagaagaagaagaagaagaagaagaagaagaagaagaagaagaagaagaagaagaggacgaggagggcattgtggggaataatgagaactttgagggtaaaagtggaaataaaaaggttagcaacaggccaaaaaggagatgcaatgaaaatggatgtgagcctaaaactatgcttaattggaagcagcagcaattttgggtgaccacttaatgggaattactcaactcagcaaataattattttttacggcttctaattctacatatataaatgctaaaatgtgagttaattgttacttaaactgtttaacaacatagagaactaatcttcattatctgcttttactttttagtatgttataggtaacctttgattattaacgagagttttagttatgttttcatagactaacgagagtgaaactatagttttaaaaagggtaataaagtaccagtaatagtgagactgacgaaaactatatgatatctttcaaaaaacttcattgaaattttggtaacatcatctacactagtttgcaacacatctttgtgcttctaagcgcagtcaatgtcaatgttattgtcatcactagtcttagtagcaccaagggataccacacttttatcatcaaccatcagtccatcaaatggtcattaattcatatttaagtcttttataagaactaaaggtttctacaattttcaacaaaattaagtaatgtaaatgtcgtttatgagtatgcgaataactttaacattattattgtagaccaaactctttgactgtcacgtgtgcatatttatagacacttgctcgtacggacgtaattgaataagaacatataatttgtaggtccattgtacacgatctctctactttcttgatattcttccctctgtctcgaccaaattcgtactatataaatctcggagtgatatcaaaatagattgcaagtatatgattgagccaatgagaaatagacaacattacgatgtaatgtccaatcttacgtacaaatgtgaagagcaatctttgttctctgcaaacgaataagagaacattacgattctttatatataacatgccacttgactccgcttataattgaccgaaatctaaagcaaatctcatcatgtacccatcttatttggtatattgatgattcgattttattttattttcaatatagaaaatgtattttccatatacttaatgttataaaaaaaaaatcatgtttatattttaattcaagttgaatcactttttgacgagattatgcgaaatcaagttttgatggaaaaaaatatggaattgtgtttttgacgggaaactacggaatcactttttgacgagattatgtgaaatcaagttttgactggaaaatttggaatcacgtttttggcgggaaaattatggaattacgtatttagcgaaaaatgtgaaatcacgttttgacgaggaaaattagttcttatttgttgtgaacagtgaactagtgaagttaaccaaagtgttgcagttttgataaggctaatgactactaattttagaatgatttttattgactgagagaaaattttgaaagttcttttatgtactgcttttattttggttttagattgggccgagacaaggcccaacaaagaaatagctcaaacacactcacttagcaaattactcaaacagcagagagagagagagagctcagtaaactaaacaaaa

SEQ ID NO: 5108 - DNA, 3000 bp, Unknown
  misc_feature (1)..( 3000): cDNA_ID_1827511_gDNA_ID_1620763_Annot_ID_50065 3000 nt of promoter + ATG
gtgtacgggcttctgctaaggtttgctcgtggcaactaggatgggactccaactctttggtatcttcgagttgtggaaatcacgcaaatttccgagtttagcttctcggaatcggtgtttcttctcttatttccgcttttggttaacgttaaccactattgctgtttgtttttgtctgtgtcttctgtagatttatttttccgctacatgtattccgtgtaacttctgttacaacttcgaaaatggtataaatacttaacattgataccaaaaaaataaaataaataaataatctgtttttatgtattaatcactaattaaaatggtgggccatcaaataaaaaattcaaataatattatttgtccgtgttgttgttggcttgttggtgtttgctatgtgaagtcaaaagatgtgtgatggaaagaaagaaaaaaacataactttgctcaaaaagatcgatcgagatatggggaagaagaaaggtgtcaagtactttgtggtaatctatttatttctctcttcaattctccaagttgtatttcagaatactcactgaatatttggtgtgttgaaaggtggatgctttcactgattcggctttcaaagggaatccagctgctgtttgttttctcaacgacgataacgagagagatgacacgtggcttcagtctctcgccgccgaattcaacatctccgaaacttgttttcttattcccatcactggtttccaagctcgcttcagtctacgctggtttacccctttagccgaggtttcaccaactattttgacttctgtttctctttaaagacttcgactttatattgttcattgattgatagaaactgaactcgactacacaatctctctactgttttagattgatcaaagtaacttgcaatttcttgcatttgaagaaaattctttttaaagacttcgactttagattgttcattttgactgataggaactgatctcgaattcactagctttttgatttgggtttgttgattgatttgtaggtggatctctgtggtcatgcaactttggcatctgctcattgtctcttctcaaatggtttggttgattcagacatggttgagtttgtcacaagatcagggattcttacagccaagcgtgtttcagatacttcagagctcagtgatggtgaagtgaaaggaggaacctttttgatcgaattgaatttccctgtggttacaacttgtgatgttaatctcagtgatgtatcctcttctatgatcaccaaggccttgaacggagctaccattgttgatataaaagctactgcaacaaacaacatcctcgtaagtttgatactttgttcacgcagtgtattcatgtgtgctcataggttaacctaatctttgtatgacttttgatttactcttttatgcacttgcttgtaggttgtgcttccatctaaggaatctgtcactgaattgcaaccaagaatggatgatatattgaaatgcccctgtgatggcataattgtgacagctgctggttctacaggatcgtcctatgatttttacagtcggtactttgctcctaagttcggagttgatgaggtaaaagagtagctgcaacttacattatagtctttgctcttaggattgaacaaaacaccaaagaatatgatttcttctgcctgaaatgtgtcgcctttttcaggaccctgtttgtggaagtgcacattgtgcattggcacattactggagcatcaagatgaataagtttgatttcttagcctaccaagtaatctctcttatctctttaaatttaaagtagcgtttagtgcttcctagtgaatgattttgagtttttggaaatgttgcttaggcttcgagtaggagtggaacgataaggattcatctagacaaggagaagcagagggttctcctgagaggcaaagccgttactgtgatggaaggccatgtcttggtctgatctgaaattatatactgtgttgaattctgctacaaaacaagctcctataatgaataacaatgaatttactcttttcaaaacaaaatagtgtcagctgactgatccaccttacatgaggtgtggtcgctcgtaggagccactgataggatatgtccatgttttctgaccatgtgtgttcattttgaatgactctccaacagttctctttcactcacagacaatacatttattgttgatggatttccaaagttccctaccaaatcttcccagattttactatcaataaatgtttgtttttggtctggagactctatcattattaaatagaacgtggagcacattgtttccagataagtagatttcaataggaagaagaggagctatggccatgctcgtgaagaaacctgtgaagtacttcatggtaattgtatattcttcttcgtcttctttggtttttgtttctcgcaatgtactagtataacttccttcctttctactttgctctgagtacttcttttagaaatgttattatccttgtaagcttcccaaagtgttacctgtccttttttggagattttaagaatacctaccaaatcttcccatgtactatcaatcagttattattgtttgagtgttcctttttgactaaccaatttttgtttgatttttaacgactagtaagctatgcaacacaattcatcacatgcttagcataagaataatggaataaacataccatatttgttttgtcaataagtgcgtttttgctttatgagtgcttgcttccacttgattagatctgtcctttgctgaatataaaattttgcaaagctgcagatttcataatgatttgagtacaattcaactgttagcatataaacaaaacaaaaaagattaaaagccgagatttgtttcaataagattttgccctacaaagattgtctgtttctcttaaaagatgaagtggcattgtaaattaaaagcctccaaaatggtataaaagtttagctttggtctaacgaaaacatcaatg

SEQ ID NO: 5109 - DNA, 3000 bp, Unknown
  misc_feature (1)..( 3000): cDNA_ID_4257535_gDNA_ID_1620763_Annot_ID_167258 3000 nt of promoter + ATG
tcgtaaatggcaaagaataatttatctcgagaatgaggaatataaacaatgactttataatataagtattatactatattatgtataatttaatattgtgtaaactatatataaagtccttttacagcatttaaatatagatatttattgacacactagtgcaacaatggaaatatcttgaattgattaaaaaaagttgttatctatacaatatgaaactctttgtatatcttaggtgcaaaactatttgataatataccgatacatagtataacgatattattggataatcctccaaaactcagctttttgtctcgaaacttaagttataacaaagttaattgaaaataatgagacagtactagagatgtatgataaaccaattaaagttgaaaaagttatattcttatttagctttgccgtcaaaaggtacgataaatggaaaatatgctcttgtcttctgagcctcaaaaccttaagaagattcttacatatcttacatgtcaaagtaaagagatagttggtaacacattcccatgtggtccggaaaacaaaagcttcctttattgttttggaatattaatcagcaactgtgtagtagtattctatgttgcatacgtaaaacatataaataacattataatcatattagtttgaataatagattctaataaaagatgatgtatctttagcctagtgatacgtctaatgatcttaattaaacttgtttaatgtaatgagttaacactcaatattaacaaacaaaaacttcatattctggactacgtatgttatacatatttcaaatatacatcaattgtctattctcaacttattatttatagtctctttgttttcttgacaaattattggtcatatttttctttcacatggttccgaaggttacgttttcatgtatatatacatttgtaaaaaaagtatatatataacatttgtacaaaaagcataaaaaaattaaaatgtttatcccgattgctttttgtttgtcacatcaatatttagtgctctaaatattttggttgagtcacgaaactgtaaattaaaatcgttgaagttgctcaattatatatacgtcaccgaagttgttgtatattaacattgcatgctaaaatatatttcagatgtttaggacacataatgcattttccgtaaaataaagcttaaaaataaattaaaatatggttttataagacactattttatcttcttttttttttttttttttttttttttttttttttgccaaacccctattttatctttttatcttttgaaattttttatgatgtatctatgaaaatgatttgtgactaatgcaccgaggcttcatatgatttcattaatcacatcccatataaaatcacgggttatgttcataatttgtttattcaatattagactactatgtgaacttttagtgaattcacttttttttttatccaatcaaacctctggtttcagaatttagtttccagttttaaacttttttcttgagacgtaaaagctctcatgctttgttgatgatgtagtggtggagaatcgtgatcttcaacactttcatgtaaaaaggcttcatcatcgttaatggcatcttgggtttactcttggctgaatataaaaaagaaataataggattgatatagactctatatattaagaaataaagtaagacagtccacggcaacgcatgtgattataggaaccactatcatgcaacgacgtggatcagtgggaaccgttgctttcgaaagcataagagagacatcaattaattacaaagaaattgtgtaaacacatttatatatatcagtgacatttgagattggttttgacaaagatatacaacttctctcccgacataaatgtctacaagaatacgcaagttaatcatatttggagctctttcatctatagttgtagacaatttgtacactctattagggagttctagacttttgatgaatagaaacattttcagaatttgctttatttttttaatataggaatgtgaatattattttaaatgattcgtttcaaactttggatatatagtcatgtattcttataactagaaacttcgggtatttgggtaaaattttcgattatttggatacaaattcgggtattgggtaaaatttcgggtatttggatataaaccgatctgaaaccgattggatccgaaccgaatccgaaccgagattttctatttaccctattgggtcctagaatagcatatccgacatatccgtattcgaccgattattacccaaacccgaccagcatacctgaataccaagccgtaatttagatatgcaatttataaaggctaaaaaatcgtgaaaaaccattgtgatatattataaattattttttgggagccctaaaaacattacatattttggaagctcgagacaaaagcctttcttttttttaaccctttaggcacggttatatgaatcatatgacatgtaatatagcagtttgtaatagtaccgtcatattgtttaaccttcaaattcaaatatgcatgatttatgttcttgacaaaaatatgtatatttatgcaaaattaaatattcatctataacgatcatattatctatactgttaattttaaaaggatcatatcatctatactgttaatttttaagtgatttttttttataatttggatcccattttatttgctcttaaaaactttggatatacttgatagctttttaacaaacaaaaataaaataaaaagtacttcgagcccacgtaaaatcgaataaacaaaaatttaatttgttgaacaagttggtgttttgaactaaggcccaataatagtaagaatactaaaatgggcttaagccgggtcgtcggatcgggtttaagaaaaaacagggtcgaggtttcaagagaaacccttgttactcaggcgactaaaaccccaaatctcatttgtgtgttcgcctttctctcgtacaagtcaaaatg

SEQ ID NO: 5110 - DNA, 3000 bp, Unknown
  misc_feature (1)..( 3000): cDNA_ID_3075696_gDNA_ID_1620763_Annot_ID_167251 3000 nt of promoter + ATG
attggcgattgactgtgagaaactgaaattccgggaaaagaggagaagacgagagaaaatggcgccattgacgttgttcttcttctccaacgacatttcatcttcttcctccgattctccgattttttctgcttctcgttcgaattttgtttttgattttctgtaattaaaattttggagaacatatctcacgtgccttactcgtgtgagtgaatgttgcgaaaatgcaaatgaatcctgaattaaaaagttagtacatatacactaatatctaagttggtaacattgtaacattgaaaagaatatatgtatatacaatttagattgatttaattagtaaataaatttgaggctttttaacttggttgaaatgaatacatctattaaatttaaccgcttttgatttaccatttataaattaaagtccgtagtagtactgaccaaaaaaaataaaagaaaattactacgaaccaataattgaccacttttacattaaaaatttgatttgttctcaaaaatagaacggagtaaaccgttgacggattgtccacccgccgactcgtaattattcgaatcttcgaaatcgaaaataaaataattatatagcaaatacaactattaaaaaagtgtaggtatagaaaataattactggaaatattatattgatgatatcagtttcaggactttatttatgttggatttgaattgcaatttaggaggtgttattggtttgtgatgccttttaaaactttagaattatatactatcaatttgtgttaagatttattttgaaaaatactttatagattttcaaaaaacaattctcatggatttaaagaaaaaatgcattagaaatatatatttactagatattaacccacagtataccgcgggccaatatttttattaaataaaaaataattgaatattttttaggatgatttaataaatttatgctattgtttgatttaaatgtataattcaccgcgtgacgaaattttataactcaaattttaaagtttaaagttgtatttgtttattttgttaaatgtttaatattgtataattgtattttgattgttgtttatcagatttcacccgtagtacaccatcccatattaatatcgaatcaaacccgtcaattctaagatttcacccgtgatagtatttaattgtataattgtattttaattgtcattctaggatttcactcctaattctatcgcaaattattatcaacccaaaccagtcaattctaaaatatcactcgtagtacaccatcccatattaatatcgaatcaagcccgtcaattctaggatttcacccgtggtagtatttaattgtataattatattttaattgtcattttaggatttcactcctaattctatcgcaaattattatcaacccaaaccaatcaattctaaaatatcacccgcagtacaccatcccatattaatatcgattcaaactcgtcaattctaggatttcactcgtggtaatatttaattgtataactatattttgattgtcattctaggatttaactcctagttctatcgcaaattcttatcaacccaaacagtcaattctaaaatttcacccgtagtataaagtttaaatatttataatgtttaaatttcttataaaagaatcaaaatgtgttttaaaaaaattaaagttttaagttttttttttataatattgttaattttttttagtgtttaagattatataattatattatgattgttattatatgttttttctatagcatactatcccatgttattatccactcaaacccgtcacaccatataaccccgtcccgtgaaattaaacacaaatttgtcattttattataaatttcaaatatttataaaattagaaacttcaaaaaaagattaatattgacccaaacttcatcatttaattttgagtgttatatctaagatttctctcgcagtatatcgtcccgtattaatatcttttatattgtttaaatttcttgtaaaatttaatttataattttttaaactttttaaagtttcaattttttaaaataaataaccctagtaaacaaaccatttaaattttggacacctcataaatcaagtttcatgctcattcgtaatcgaaatcattttggtcctttttatagtatggctcttgaccattgtccaatttttttaagcgatgttggacattgtaaaatcgtaattattatccacccaaacccgtcctaccatataacctagtcccgtgaaattaaacataattttgtcattttcttataaatttcaatattataaaatttgaaacttcaaaaaatacaatatcgacccaaaattcatcattgaattttgactgttatatttaagatttttcctataatatatcgtctcgtattaatatattttttatatatttataatatttaaatttcttgtaaaatttaatttataatttttaaaacgttataagttttaaaattataaatatttaaagcattttttaaagataaactttataaaaaaaatttaaattataatatttaacttttgataaaagttataatatttataatttcttgaaacattttaaagtttcaattctttaaaataaaaaatccgagtaaaatcggataactattttaattttggacgcctgataaatcaagcttcctgctcattcgtaattagaatcattttggtccttttataatatgggtctgaaccattgtgcaatttttttaagcgatgtgggacattgtacacatattatttctttataggttgaataatatatgtccattttaaaaaatttgaattacatcatattcagaagaaattataatattttattaactatatatattttatataaagtcaaaataaataaagtataagatcaaataaaaatgaaagaagaattatatatttatgtttaaattaggtaaaaatattttaggaaattagttaaggtaaataagaaatatg

SEQ ID NO: 5111 - DNA, 3000 bp, Unknown
  misc_feature (1)..( 3000): cDNA_ID_2131704_gDNA_ID_1620763_Annot_ID_167250 3000 nt of promoter + ATG
ttcgaaagggccacgagtgtttgtgccatatccttcacctaaaccgataaacaaacatataataaactcacaaggaagtcaaaatctgacaagggaagacttttacttaccctgcatttctaaaccctcatagataacataaggaagcttcgaatcttcagtagaatcagcgaacaatgtagctaaatctatgccatcttgttccatgtcaacaccaattagacttccggagttgtgtaacagcctttgcatcacgagcacattaggatctttttgtgcaccaaagttccttgtagaatcaagagaacctgcaacacccaagaagtaaaggtattaatatagttttttttattcctgcgcaatgtcttatacataatttgtgatgaaagaacgtaccttcgaacatgtcatcataaagattgaacgtgtctgtgtatataaggatattatcattgtcgtagttacttgggttttccctgtacgattcatatcccttcaagacttcttcatctgtttcttggctcggactattcttctccgcttccttggatcgcacgtaagaagaatttgatgattcttgagtcgatggagatatagggtcgtcggagagagtcatctctgtttcgttggatcacgatagttaaaacgacttagtactctttttcgatttcttcttcgtcggagagacttatcgttaaaacgatttgagattgagagagactgttagacggattagtgagaccgcgagtgacgagactcgtttctgtctttcttttctttttttttttttttaacatcttcattttattgatattatgaagaattgtaatcaaatcgtaatgctgtgtaaattacaggtggtatagtagagtaaaatttaaaatgttcttctcgaaacaagtgagctttggctagcagatctgcaggtttgtttgtcatccgagtgacccatgtgaatttacactctcgaaatcgatttctccatgcctgaacttctctaacccaattatacagatcaaatcgtgcctttccatcattgagaattttcagcagctccatgttatctccttcgaagcagactcttgtatatccatgactccagcagttctgcattgcaaatataagggcttgaaattcgttctcgattgcactgttgttggttcgtcctctagcttgtcctgcactaacaaaaaggcctgcttcatctcttgttacccaacccgctttacctgtctttcttttcttatataataataccggccttattttgttgttttgaataagaaaatgtatatgttttaaagaaaaaatcaaattacgaacacttcaaaacataatctagatcattaatttattacacgtgaaaagaaaacaaaaataataatttcatttaaatatttatcaaattaaaatatatttattatataataaaaatataaaaatatttattatataaatatatatttaatataaattatattattatataaaatatacttattatacaattaaaacataaacaaatttattatatatttctgatgaattcttctacactcatgatatatactctctccaccttttcttttgcagtgaaagctcacaaaaatatacaaaactacattctcatcaaaaaatcaccaacttaaaaaataccaaaaattgtatttaattctatagttaaaatcaatttgagttttattgagtttttatataattttagtcttttaggtgaatttggggaattgttatttgttgttaaatcctacttcaaatcatgaaatttgaatctttgtattttgaagtatgtaaattatctaaatccaagtcttctttagtccaatcccaagcattctgcatcatcagctgtcttttctcctagggtgcgtgtgaagtcattcctgagattgaaggtctcctggatctgcctctcatcatagccgcaagagttcgacaagtacgtttctgcccctagattgtcaaacataaccaattagataacactagatagagatgaaacagaaggcaatgccaatgctctgtgtcgtatggcttctgcaacaaggtatatagagtagctggacagtggacgtagaaatactatgggccagaattattatgggctcaaattagaagtatttctattgggccagcattatttattctctaccctaaaccctactatttcaacacttgaccaaaatggcctttaagacacgctgggcctacgccaataattatccacgtcggtctaaaactcaatgacttgacgaaaatgcctttgaggattctatgaaattaccgaaattacccttttgtttcttagccgcgtaagtttcgtctgatattatttttcttcttctccgagaaacaaaccctttaatttactgttgtttctcacaattctcaaaaatctctcatccgaattgcgccttttccgcttccttttgctctgtcaaatctctcaaccggaaaaatctcgggaaggttcgtctgatccaattctgaagattttgaaaaacccaccgagaacttcgaggtgaatttgatcatcttcttcaaaaacctgtttttttgtttgtttgttcttgtgtgtctctattgttaattttgacgaggagatttatatatcctatgatcaggtcgtgtttcacttctctaattaagttgctttcttttgattccaccgtattgtatctctggatcgaaattagggttttagtgtgtgttgtgaactttaaacgcataaagtttctgcctttcgcgtatttgaaagtttgatgcagccatattctgtagtgtctccaagcaattttctagggttttacataaatatgatgtaacttcttatttgttgattttactaattagatgatacttttcagtgaagttattgtcttttgggattacttgaatcaacccaatagctcttgcaccattttaacccagtaataatcgtttgtttttgctttcttgcagatttaattgaatttttcactg

SEQ ID NO: 5112 - DNA, 3000 bp, Unknown
  misc_feature (1)..( 3000): cDNA_ID_1827508_gDNA_ID_1620763_Annot_ID_167247 3000 nt of promoter + ATG
taatttgattttttctttaaaacatatacattttcttattcaaaacaacaaaataaggccggtattattatataagaaaagaaagacaggtaaagcgggttgggtaacaagagatgaagcaggcctttttgttagtgcaggacaagctagaggacgaaccaacaacagtgcaatcgagaacgaatttcaagcccttatatttgcaatgcagaactgctggagtcatggatatacaagagtctgcttcgaaggagataacatggagctgctgaaaattctcaatgatggaaaggcacgatttgatctgtataattgggttagagaagttcaggcatggagaaatcgatttcgagagtgtaaattcacatgggtcactcggatgacaaacaaacctgcagatctgctagccaaagctcacttgtttcgagaagaacattttaaattttactctactataccacctgtaatttacacagcattacgatttgattacaattcttcataatatcaataaaatgaagatgttaaaaaaaaaaaaaaagaaaagaaagacagaaacgagtctcgtcactcgcggtctcactaatccgtctaacagtctctctcaatctcaaatcgttttaacgataagtctctccgacgaagaagaaatcgaaaaagagtactaagtcgttttaactatcgtgatccaacgaaacagagatgactctctccgacgaccctatatctccatcgactcaagaatcatcaaattcttcttacgtgcgatccaaggaagcggagaagaatagtccgagccaagaaacagatgaagaagtcttgaagggatatgaatcgtacagggaaaacccaagtaactacgacaatgataatatccttatatacacagacacgttcaatctttatgatgacatgttcgaaggtacgttctttcatcacaaattatgtataagacattgcgcaggaataaaaaaaactatattaatacctttacttcttgggtgttgcaggttctcttgattctacaaggaactttggtgcacaaaaagatcctaatgtgctcgtgatgcaaaggctgttacacaactccggaagtctaattggtgttgacatggaacaagatggcatagatttagctacattgttcgctgattctactgaagattcgaagcttccttatgttatctatgagggtttagaaatgcagggtaagtaaaagtcttcccttgtcagattttgacttccttgtgagtttattatatgtttgtttatcggtttaggtgaaggatatggcacaaacactcgtggccctttcgaaaacaagattgatattggttcttttggaaagagtgggtcggtgatgaacgtagaaagagagaaagaaaagattgtgatgatccctaccccaagatttggcaacgcaacaccacaatggaccataaagaagaaactgagctcgtacgatattaggcctcgttgtggcagacttattctgcaaagtagctcctttaatgagcacattggaagacatttacctaaagaccaaatgataaaaattaatgtcggagtcaatgttaacgtatatgactacgacacgggcacattgcatgagctgcgtctggaatatcagaggcaatatggtctagcgcatggctggcaagaagattttgtccgcaggagacacttgaagcaaaaagacgagattggactcttatgggatttttcttcttctaggcttcaatttggcgtcatttctaggaacacgggacccggactctgggagaccaaagactaagagttccaattagaaacgcatatgtacttttttcttcttttctcaaacaattattggcatttttgcttatgaaaggtttttgtgtagccaaattgagattttgatggttttgacacaatcaatgtatgatatcaaatcattaaaaccactttattatctctcttatgtgtttcttacagccacttttatcattctctcttttatcaaaagataaaatgttctcaaaccctaaaccctatgcattttaagagttacaagacaaaatcttaagagtaattacacagaagactgagccaaaattttgacaaaagttttttatttaacaaaatttttacaaaaatgagattcattagaccatgtacatgggtgatatttctagagtatcacaagtccaaaaattattttaacaaaataattagaatgaggttgattagtattagtccaatgatatttgtgataccagtatcatctgacgtggctttttctaattggtcacatttaccaaaataaaaaaataatatatataattattaaacaaatattataaataatactaaaaaattttttaatgatactttgtgagtacatctatgaacatgctcttaaagtcacaaagatatatgcattacccgtagatgctcctgtaaccgtcggatttgtgttttagtcctctgttgtctttgcgtttttgcgttagtttgcggagaagctgtaggcgctttatcgagaggttttgtgtacgggcttctgctaaggtttgctcgtggcaactaggatgggactccaactctttggtatcttcgagttgtggaaatcacgcaaatttccgagtttagcttctcggaatcggtgtttcttctcttatttccgcttttggttaacgttaaccactattgctgtttgtttttgtctgtgtcttctgtagatttatttttccgctacatgtattccgtgtaacttctgttacaacttcgaaaatggtataaatacttaacattgataccaaaaaaataaaataaataaataatctgtttttatgtattaatcactaattaaaatggtgggccatcaaataaaaaattcaaataatattatttgtccgtgttgttgttggcttgttggtgtttgctatgtgaagtcaaaagatgtgtgatggaaagaaagaaaaaaacataactttgctcaaaaagatcgatcgagatatg

SEQ ID NO: 5113 - DNA, 3000 bp, Unknown; identical to SEQ ID NO: 5107
  misc_feature (1)..( 3000): cDNA_ID_1827518_gDNA_ID_1620763_Annot_ID_167242 3000 nt of promoter + ATG

SEQ ID NO: 5114 - DNA, 3000 bp, Unknown; identical to SEQ ID NO: 5106
  misc_feature (1)..( 3000): cDNA_ID_4254642_gDNA_ID_1620763_Annot_ID_167240 3000 nt of promoter + ATG

SEQ ID NO: 5115 - DNA, 3000 bp, Unknown
  misc_feature (1)..( 3000): cDNA_ID_2131647_gDNA_ID_1620763_Annot_ID_167229 3000 nt of promoter + ATG
attttatgtaatttattacatggccctacttttattatgggttagtatatctgattattgcaaaaataaaagcatttgcaatgttgcccaccaaaaaccctaaccctagtcccttatctgattctccagatttcaatcaaagccacttggattcgataatctcctccttggttacatttctggattctccatctctctccataagctcctccttcgagtacttgatcatcttctctcctctaatgatgaatttgttcaagatcaactcaaacgacaaacgcttttgggcgagtttatggataagttttaatcagttatattatttgaaaaaaccagaataattttttattgatatgaagcactatagaatatcatcttttgaatctctacctagctagagcctggtctcttatctcggaacaatcttcagattcaaaccactctatgagtttggctccatctagctaagtcatgtgctttaataatgcttctcaaagcaaaagatggtgtgcatggtttccatataaagatgtattaaattcttcttaaacataatcctttgagagattctccctccgtcctgattcaagccggtaatcttgaaagatatgattgacaactttaattaacctcttcttagatggtttgatagaaaaatataatgtcacgctgatgaaggtgataggacaaatatcaccaaaaagttggccactaatgagcaatccataagagacataggttatatgaaacataatccattggatccatctttctgcatgccccaacttcttcatattttctcaacaaaggtcccccattataacctgtcataaccgtttatcattccgatttgatttgaggcaatgtgacctttgtatgcagtagagcatggagagctaccaaaatattatcagaaaaagaactctcggtcataacatctggtctagtgcatgagccatctcaaacactgccttcatctctgatatggagactggtttgatcagttgatcattcttctcggtcgcctcttcaggctctagacctctcaaaatcccaaacatcactctcatctgggcactcacaatcttagtggataaaaagttagagaagtacttgcagtccattacacccgtctcctctttcttatatctcttcagattgatatctttatcaatgaggtagtgaattatgttgttttatcttctctatttttttacaacatgaaagagttttatagtttgtctccatctttcagtaaagtggcaatactattttgtgtccatggaagagttgagatgcatgtgactagtctgtaaaatggacggcgataatagttttttcttgaaagatatcagagagtttctttctttttttcattggttttacacttttagaaactcctatcgcattatcgcatagttcgacaacttctgttaaattcttgatccaaatacaaagatgaatcaatccattagtcaagagctacaagagtatccattagtcacatattatatatttgttctgattcaaatgttctcaagatcaacaaataacacaaatgcatgaactcatcaaacacatttctttttcatgtcccagtttctatatttgttatgcatcaaaatgttctcaagatacacaaaatgcaagaatccatcaaagactagaagaaaggttgattcttaatttcttgttcatatcccaaaatcaaacaagatgcaaattcaaaacctaaatgattatttacaacaatatttctaaattcttcaattcatatccagataggtatacttttaatgaagctgaaagaagaaagatcagttgttacaattgtagccaaatctgttttttttagctaaatctagatgaatattgaataataatcactatcaaatttagtggttttggttgtaaattcaactaaaaaatttcgtggacatatttattttgctgtttttacgtaaagatttgttaagtccttttaaatcctaaaacaatgttctgccttagttaaagtgatcttgtcctcaaattccattgttttcctttcccaatgtcttgaggtctccaccaaaactatgccatcagagcagtgatcttctgaaaattggtagtggagatcttaaaagaagacatagagtgtaagttgggcgagggcttaaggccacttagtagaactgttctcttatcctcagaaattgaatgtccaaatgtgatgcttgactttgacagattcaccttctgtcctaattcaagctggtaatatttgaggatttgattgacgactttaacctcctctgggatggcttaacagaaaaaataagttcacacttatgaaaatgtaagtattagggatattgtcccacattgaaacttgagtaggatctaagtgatatatataagatataagcatctccactcaaaatcaattggcaatgagtggagaggctcatattctatataccacttaagatcctactcaatgttcaataataccatataactgcaaatctgatatttcgtaagagaactaaacatatggaatcagattgtcatcaagtgaatgacgttgttcaagacaaactcaatactactaaacacatttctaccaataacaaaatcaaatgagagatctaacttttaagagtgatcataaagaggttatttcttaatcttaatcatcatattgtttgagtttgattataaattcagatcaaaagatttcgtggacatgtttaatttgggtaaatatcttgtaacgatagatatggattgacagtaattaattaggatataaaaaattactatccaaatttgaaaaaatttatgcataattttgagaaactttgtataatacatagaaagaaatctttttttttggtgaacatacatagaaagtaatcttatgtagtttattacaggaccccacttttttaatgggtaagtataaataaaatagttggaaaatctgattattgcaaaacaaaagcctttgaaatg

SEQ ID NO: 5116 - DNA, 3000 bp, Unknown; identical to SEQ ID NO: 5103
  misc_feature (1)..( 3000): cDNA_ID_1012102_gDNA_ID_1620763_Annot_ID_167228 3000 nt of promoter + ATG

SEQ ID NO: 5117 - DNA, 3000 bp, Unknown; identical to SEQ ID NO: 5112
  misc_feature (1)..( 3000): cDNA_ID_1827508_gDNA_ID_1620763_Annot_ID_50066 3000 nt of promoter + ATG

SEQ ID NO: 5118 - DNA, 3000 bp, Unknown; identical to SEQ ID NO: 5111
  misc_feature (1)..( 3000): cDNA_ID_1827500_gDNA_ID_1620763_Annot_ID_50068 3000 nt of promoter + ATG

SEQ ID NO: 5119 - DNA, 3000 bp, Unknown
  misc_feature (1)..( 3000): cDNA_ID_1827496_gDNA_ID_1620763_Annot_ID_50070 3000 nt of promoter + ATG
atatattattcaacctataaagaaataatatgtgtacaatgtcccacatcgcttaaaaaaattgcacaatggttcagacccatattataaaaggaccaaaatgattctaattacgaatgagcaggaagcttgatttatcaggcgtccaaaattaaaatagttatccgattttactcggattttttattttaaagaattgaaactttaaaatgtttcaagaaattataaatattataacttttatcaaaagttaaatattataatttaaattttttttataaagtttatctttaaaaaatgctttaaatatttataattttaaaacttataacgttttaaaaattataaattaaattttacaagaaatttaaatattataaatatataaaaaatatattaatacgagacgatatattataggaaaaatcttaaatataacagtcaaaattcaatgatgaattttgggtcgatattgtattttttgaagtttcaaattttataatattgaaatttataagaaaatgacaaaattatgtttaatttcacgggactaggttatatggtaggacgggtttgggtggataataattacgattttacaatgtccaacatcgcttaaaaaaattggacaatggtcaagagccatactataaaaaggaccaaaatgatttcgattacgaatgagcatgaaacttgatttatgaggtgtccaaaatttaaatggtttgtttactagggttatttattttaaaaaattgaaactttaaaaagtttaaaaaattataaattaaattttacaagaaatttaaacaatataaaagatattaatacgggacgatatactgcgagagaaatcttagatataacactcaaaattaaatgatgaagtttgggtcaatattaatctttttttgaagtttctaattttataaatatttgaaatttataataaaatgacaaatttgtgtttaatttcacgggacggggttatatggtgtgacgggtttgagtggataataacatgggatagtatgctatagaaaaaacatataataacaatcataatataattatataatcttaaacactaaaaaaaattaacaatattataaaaaaaaaacttaaaactttaatttttttaaaacacattttgattcttttataagaaatttaaacattataaatatttaaactttatactacgggtgaaattttagaattgactgtttgggttgataagaatttgcgatagaactaggagttaaatcctagaatgacaatcaaaatatagttatacaattaaatattaccacgagtgaaatcctagaattgacgagtttgaatcgatattaatatgggatggtgtactgcgggtgatattttagaattgattggtttgggttgataataatttgcgatagaattaggagtgaaatcctaaaatgacaattaaaatataattatacaattaaatactaccacgggtgaaatcctagaattgacgggcttgattcgatattaatatgggatggtgtactacgagtgatattttagaattgactggtttgggttgataataatttgcgatagaattaggagtgaaatcctagaatgacaattaaaatacaattatacaattaaatactatcacgggtgaaatcttagaattgacgggtttgattcgatattaatatgggatggtgtactacgggtgaaatctgataaacaacaatcaaaatacaattatacaatattaaacatttaacaaaataaacaaatacaactttaaactttaaaatttgagttataaaatttcgtcacgcggtgaattatacatttaaatcaaacaatagcataaatttattaaatcatcctaaaaaatattcaattattttttatttaataaaaatattggcccgcggtatactgtgggttaatatctagtaaatatatatttctaatgcattttttctttaaatccatgagaattgttttttgaaaatctataaagtatttttcaaaataaatcttaacacaaattgatagtatataattctaaagttttaaaaggcatcacaaaccaataacacctcctaaattgcaattcaaatccaacataaataaagtcctgaaactgatatcatcaatataatatttccagtaattattttctatacctacacttttttaatagttgtatttgctatataattattttattttcgatttcgaagattcgaataattacgagtcggcgggtggacaatccgtcaacggtttactccgttctatttttgagaacaaatcaaatttttaatgtaaaagtggtcaattattggttcgtagtaattttcttttattttttttggtcagtactactacggactttaatttataaatggtaaatcaaaagcggttaaatttaatagatgtattcatttcaaccaagttaaaaagcctcaaatttatttactaattaaatcaatctaaattgtatatacatatattcttttcaatgttacaatgttaccaacttagatattagtgtatatgtactaactttttaattcaggattcatttgcattttcgcaacattcactcacacgagtaaggcacgtgagatatgttctccaaaattttaattacagaaaatcaaaaacaaaattcgaacgagaagcagaaaaaatcggagaatcggaggaagaagatgaaatgtcgttggagaagaagaacaacgtcaatggcgccattttctctcgtcttctcctcttttcccggaatttcagtttctcacagtcaatcgccaattcgattttctcgggaaactgtcagagaaaaaacaaaaaaacaaatcgcctcctccaatctctggtaactcagacactgaaaaaacctgagatttcatcttcttttgaataaaattttgtactttttggtgatctctttaacaggatttgttgaacatttttggttgaaattgcgttgttaaagagaagaag

SEQ ID NO: 5120 - DNA, 3000 bp, Unknown; identical to SEQ ID NO: 5109
  misc_feature (1)..( 3000): cDNA_ID_4257535_gDNA_ID_1620763_Annot_ID_50073 3000 nt of promoter + ATG

SEQ ID NO: 5121 - DNA, 3000 bp, Unknown
  misc_feature (1)..( 3000): cDNA_ID_1827594_gDNA_ID_1620764_Annot_ID_50074 3000 nt of promoter + ATG
gtattgggtttgactaaaaaaaaaaaaaaaaaaaaaaagtacggtacgttgacaatccgttggtgaaaacttagagcaagtcaagtaagggtttttagtagatttcttagatgggtttttatgtaaaaatgggcccagataatagaaaaacagctgaatccatttaggatcgttcctaaaattagtttttcgcgacccaatagaaactcatacgtgacctcattttattgggtaaactgaatgacaaaaccaaaaaaaaaaaaccacacgcgtttatttatttcttcttcttcttcttcgcctacggagacaccaaagacgattggaatcgacgctgaagatctagtgatttgttcatgaaatcatgaaaaatcatccacctaaacgagtgtttcaaccaacgggatgatgatcgagctagattttgttccccaaatcgattcttctaaccaaatcgacgagaggtgcttggacttgcaaaagaagaagatatctcaagtctctaaaaagaaggtacatgttatcaacttgtattatgagaagatttatctatctatgaaagtgtgttccgtcttgcattgctggtagcctctgaatacaaagcttccaaattaaatgaatatctgcttgtttcgtcattgttaatggtcatttagctaagtagaataaaagaaagatttttgctaactaatggaaacatttcagaatttaggtgcaaatgtaagaatagtacgaaccaagcttgaaaaatagtgttgttatcatagacgaggctcacaatttggctgacacttttctcagtatgcacgatgcaaaactaacagtggcacatatataaatttcagtttcatcagctttctgagcacatgttgtttggatggacttttgcattgctattgggtcctctgtttcaggccatatgtggagtcatgtttttaaatgatttgtattgcagttggaggatatacactgcagcatagagagttatctgggaagattccagaatctcttgagagctggaaacatgagatatatccaaattatgttgattctcacccgagctttcctcaaacctcttgctagtgataggaatctgaaggaaagcaatatctgaattggttcttaatattttcccctttcgtgatcatgttgaagctgttctcttcctgcagtttcttaaagatgagcttgatgcaagctcagaagtcatagagccttgtaatagcaaggtatgtgtcttcttgtacaacacaactcgtgtgatttatacacacaagcttggcgtgctctttggaatgtattatatcattggcaaccaatttgtttgtttgtgaccattttcaataattttggaccacatttaattagcccctaaaacttcctttcattttctggttttatgttgaagcagaagagcctttctttatctttttataatcgacatgaagctgtttcaagctttgcttgagttcaagtctcaagtttctggaaacaacaagagagaggtcatggcttcatggaatcactcctccacattttgtaattggattggagtcacatttaaaattttataattcctaataataatcatgtttaatcaaataaaaatatcaacaatttttttttttttcaatttttttttgttttagaaaccaacttaaaagattccaccaatggaccataaaattttcaaaaactctaaaaaatctctaaactacaaaactatccaaatttattaataaaaaatacatagaaactttgtttagaaactaatcactggacttgctcttagttgtcatgtgtaatgccgaaaggaaagcgctacaaggagtttcagccctatccatatacgtaaataccaatgtttttacaagattctgttggcaacaaagaaaaaaaacaaagggaagaagatgtataaaccaaagctgttttattttgtctcttgtccaaatgtaactaaatttttgttgggccatatctcaaaagaagtagaatgatataatattgggctttccatgggccttatataaacaaacaaccttgtaaatcgggtttggaactcatctcgcaagggctagccaagcagtacacgtagcgggtcggatccaccattttacgacagtagtacaaacatcgatttggcgcaaaagaaaccaaaaaaaaaaagacacatagtaattggtgtcgtcgcatgaacattcatcctttacccgacaaacacaataaaaaatctgacttttttgtttaaactcttttataaaaaagaataaaaaagtttcgttgaatccctcaaaactttttggttccttacaatcgtcatttgtaactttcccagatcctctcccttttattgcatctctgttcttttagctcagggtttgtctgtcgtgcaaaaagcaaaccctaaatcaaatctgggtttcgtctatctgattcgtcagatctaaagtctcaaggcccaccatcgtcttctttttttgaactctctgctctgctttgctctgcctttggttttctttttttccatttcgaggtaatgtatgttgttatggtaaagttttgttattttcgctaatctttgacatttcatttatgtaatttttatttggctcagattgggattttagcttttgacctaattttgttgtcggagacgactttatgtagctctagtttaaattcgttatcaagattcttgctttaatgtccgaacagagatatctacattttattttctcttactttggttactgtgttgattattctatatgagatgaacactctagtgttaatcgaaattgaaaagtttgcatcttttcatctgcagctgcttggttggctttgaggtttcacttcaaagagtttgcatctgctaatgtagacaagttttcgtggagatatgagatttccaacaaatagtcccctactggttcaggatatcattgtcctgaaaacaaacatccaaagttttagaaggtgatgtgagttctccatatg

SEQ ID NO: 5122 - DNA, 3000 bp, Unknown
  misc_feature (1)..( 3000): cDNA_ID_1807073_gDNA_ID_1620764_Annot_ID_50077 3000 nt of promoter + ATG
gaactgtacaacatacaagatttgcctatatctttcttggatacgttgcttcagtttgctatacttatggtgtactaattcatgagtgttgctttcaatcccaactacctcaacttgacaattaaaagaacacataagagcaagtagaaagagcatcatgaatatgttcaacgaatcctaatccggctttccttcttaaaacctcaaagttgactacaagattcataaaccattgactttccatatgcaatgtactactactactagcaagaatcaagatcaaatccaggaaaacaaaacaatattctaattcctcactatctttctagatctcaaagcttagggatcccaaattcgatccttattggaagactcaaatcacagacacaaattgttaaatttccacaagaatggttcctctgaacctgacattatcatttctcattgaaacaaccaattcacgtgccctccatagatactaactcacagatactagctcagagaccaaggaagtcaattgatagaagaaaatctgaagttatctatagtttctatgtgaacatcacccatttaaatcgttggagctaacacactatcaaatcaagaacaatttaaaatagagattaaaaagggagaactgaactggtggtctgagagaagacagcgagacgaagagcccaaatgttgaagaaaccaaaccaaacagaagctagtctcagtgaaccaaccaccattaaccaataccccaacgccttcatctccctcttcttccttcgtttactccttcctcgttatccaacaataccctaacgcatatattttccgttttaaaaccagaaaactatgagactgacaccaaaaaaaaacgtaaactcagattcggcggaaagattccccgatcagaacacgtaagccacggaggttaatttcgtacatttcagttagttctcaaaccaccggagaaactgtttgatgggccgacaatagttggagtctccgccgaattcgattattatttaattcagtgggtttcaaatgggcttttcaattgggcttctgtaatattctgatggacttctctacagttactactgtaaaaacaaaaatatggtttacgtaattttgtgttgctgaggcaagaagaagacatttccttcatcctctataaatgaatgtcattaaaaaacaaaaaaagcagaaaaaatacagctatcatccacgatcctcgttcagctacttatctaaacaaatactactactatataaaaaagaaattgaatctaagttgtcgtaaacgtgcacgcatatctctcgcccaatccccaaagaattctactttatttttattttattgactcgcacgcattatttaatttcttaatttagaaattttgtattctatataatacagaagctgcattctcagagcgaatagagtggtgagtttacctttgcagtagaagaaaaggtgactatttgatgtcatttttaaatgacggttcctcgaaactttaaaacaccttactaatttcatactgtacacaaatgtagaaaagttttgtggctctaaaaagtgtttgtttccttatttgatcaaacttttgtttctaggtgaatgtagaaaagttagaccgatggctattaataaccaaagacaattcaagaatactttgtggaaaataaccaagaacacttcactatggtgtaaataatgttaggaagtttatcattccaaaactcatgcacatgaagaaaatttaaatgtttcgtagtgttcatctttcatcactgttagcaaatacattggaaactagctacgccaattatgaaacggaactaaaaataaaataaatttaacagaagaaaaaagaaatctcttaatctgaataaaatgtgtgttaaggaaaaaccagaaaactatgagactgacacgaaaacgtgagttccgcatagaggcggaaagattctccccgatcaaggcactaatcagagcctcgaatgtacacgtaagcatcaagggtaatttcgtaaacttcaaagaagtggagccctatgtttttgtgtggttggtcacttatcaggtagagagagaaaccaaacaaaagaaaattacgtcaacctctctccgacctggcacttcttcgccagcctgttcccagctgtgctccaatgtcttttaattttctctaccagccctcaactaactctaaatttcggatttaccctttatccgtacgtattttaaatactcaaaacaaattgtttaaaaactttcaaatgtttaccaaagaaacattatttgccaaaataagcgtcacattcgagcagagagttacccaatctacatcattgttacgattaccggatgtttagccacaatttagggggctacttgaaataaaaaagaattagggacaaattttctcatttaattctttttttatgagagaataatggaatattcatgctctaataacaaactctttacaacatgacttatagttatagaatgtaattaaaaattattcaaatgattttttcatcggtggatgtagcttaaccgtctatattaatgaaaaaggggattaaagaacaaaattaaaaaggtttggtaccaatattaaagttgtggtataataaaggcgaattggacaatttaggaaaatacagcaaacgaaaggagggaatgcaaaaatgggaaaaatgtaaattgtgcttgcttgtttgtctccacttaaaaaccagagacatacacagaaagaccaagaagacgactgcttcctccaatggttaggtcgtgaatacggcgccattaaaacgctgcgttttatcgtcgtcacctccttttcctttgcctaattcccctaagtcatcgtctcttgaacggttcctgccattaatgtcgaactcttcctaaaccctttttgttcacatttccttctctttctcttcctccgtctctctctgaaaaaccctaattgactcgttgcgattgaaatg

SEQ ID NO: 5123 - DNA, 3000 bp, Unknown
  misc_feature (1)..( 3000): cDNA_ID_1827575_gDNA_ID_1620764_Annot_ID_50080 3000 nt of promoter + ATG
tattgtgagcgagaaatctttgcagcgttcctctgaaactaacatcaactcgttcccagctcagttttgttaattctcttatcatctcctctgcataagtttgttgtattatgatgactagaaatcaagaataagaaacacgagaatgagttttccactgaaccaaccttccatatctaagttcttgaacctgtctgctttggtccttgaatgatcttcctcatagttacttgcagtatccggtgcttcaacattcacaatgtgaggatacttctcattgactggaccacgttgaagctgcgaaggttatatcattatatgtgagacttgattcagcataacatacacagcattatcttattaaacactgaaagtgaaaggtttaaccttaggaagctcattgtgacgccggatagacgatgtactccacccaacaaggtctaagaacaaaggaggtcaaggtttcaaatgaattgtaatagccacaacagttctgagtcttttttttaagctcaattcacattgtccgatcagtgaagaagtagagaattagtttaaagacgtccaacaaagaaaggatacggtcgaaacttgtattcgcgtaagcaatacgccgtttgaagcattgcaaagcagaactgttcacaaaagcagaggagacattagaaatcatttgaactacgcaaaagcctcaatcagctatatatagaaaaatcattgaaggaactcacatgaatttaagatctctagaatctttaaccatccggaggagtaatggaggctttccaccatcactatcagccagaaaaagatgttttcccgttttaccaagacaacccgacatacgcgtagctaatctctccaaagtgtaagatccagaaaacaatgggacctaatgcagtcaaaatgccacaccattaaccaaattgtaacttttcatgttgcaaaattccacaaactgtatcaactatcaagcttacaggagaatgaggcataaaaggatctcaactttgctgtaaacatattgacagcttcaatgtaagaaaaccgttttcaaatcacctgtttatgtcctcttgaaccaaggtgtggtgttgcagaagttataaaatacacaggctctaatccagcgattcttgctttcggttcctctatcgagcatttatcaccaatgtcgtcactattatgtggaagctcttctcgggattcttgctcataaagacgcccaatagcatacctagcaatcaggccacctaaagaatgtcctacaaaggaaatcttctgaagacttgggtgacgtttgatcaccgacctaacctaaacaaaagagattaagaatatcacttgagctggaaaactcaagcagagacaaagatagaaacttctacataaaaggttctagcattgcgaaaacatctagccaagcggaagacaatataacattagatagaaacaacgctgaaatataagcagcctaaagataagaaacacaaacctcttcagctaatctttctcccataacatcaacaccatcaaatgtctgtgtggaatggttgcgtttactgcctgcaaaatgattataaagtatcacaagccattatttaaaaactattataaaaatccagtaaagtgagatcaaaatatctaaagtgtgattctttcttccttccaataatcaatctgtttcacttgagacttccaatcacaaatttactatagaccattaggaggaaactctgttttaattgaaaaaatatagagaaagaagaactcacagtgaacgaggagatcctgaggatacttcttaagcatctgcttagcggcgaatctccaattctgagcactgtacccacacacaaaatttaaaatcagcttaaaatagaacaaaatcaagcacataacataggaaacactaagaacctgccgatgagaccgttgaccatgacgactaggtgagtcggctcagtgcgttcgccagggaaatcaacagtcaaatcgacgtttccactttcgtctgattcagctctgagacaacccatccaatactttttcttcttcttcttcgtctctttatcatcactcttcctgcttctcatcttcttcatcttctttggcttacggattccttcaagatcacttccaacacgcccatctccttctgtattcttaggaatcacgctatcttcttcctccatgatcacgaaacgaagaatgaaaaatggaaactttatgcaggtgttaattcaaggtcgccactttgggaagattcgaaggtctcgcgtaggtttttatagacttcaaacatcaaaagttcaaatggtcagagagaaacagagaatagtttcagtcgttagggaaagtccccacagaagtatttgttgtcgtcgttgaaacgccattgacattttctttcttacacatctgagatttggacactgttgctttttctagaacacaacacatgttatataaagtcattaacttgattaaatgagccaaaaatgtgatttggcataagttaaaaagcatattcagacatgatgatgataattaagattatttttatataataactttaaaagacaggcccggcccatttaatgtcaaagattggatccaagttttgcccagagaaaaggaagcttcatgaatcatgagtttgtttcttcttctggaagagtcaaacaacaattttgacttttttatcagcaaccacaacgtcgaaagcacgacatgaatcattaaaaaaaaaaaaaaaaaccgacgagatttttgtacctttcttctccgaagtgttgctgattgatgtctgttggatttctctttcttcaactaatcacctttctgtgtcctctcgcttctctcttctcttctttcccattcaaaggtgagatttttaatttgactttttttttttgggttgacccatttcgaatttttatcatctactggttaatgttgttgatttgattatatccgaatttagtacaggctaagctc

SEQ ID NO: 5124 - DNA, 3000 bp, Unknown
  misc_feature (1)..( 3000): cDNA_ID_1827571_gDNA_ID_1620764_Annot_ID_50082 3000 nt of promoter + ATG
ttttttttttattaggttcctcctccgggcaaaggctcgttgtatctcagaccgttgttgttcggaagtggagcaagcttgggtgtggctgcagcatcagagtacacgtttcttgtgtttggctctcctgttcaaaactacttcaaggtcttaatcgccttgaagaggtattcttgttttctttgtagcaaagagtcttggtcttaaatttgattgcttgtataggaaggcacagcggcgttgaacctgtatgtggaggaggtgattccacgcgcttatcttggaggaactggtggtgtaaaggcaatatccaattacggtccagtaagtttaaacactcatcctatatagtttcaagtactaagcaaggtgtttcgttccaaagtaagtgttaattgttttggtgattaactgtgaaaggtgcttgaagtgatgagaagagcaaaatcaagagggttttcggatgttttgtatcttgatgcagatactgggaagaacatagaagaagtctctgctgctaatatattccttgtgaaggttaacaaacactctatttaagacaaaagtggaagggattttttttgttctaatgatgctgttgtatactaattgaagtttattgagtctttcagggcaatacaatagtgacaccagctacgagcggaacgattctcggagggatcacacgtaagagcataatcgaaatcgcccttgatcttggttacaaagttagtagttattccacgtcttttttcttctaacaccgtttccaatcttgagtcaaaaaacagagcaatactctgtttcaaaataggaatacttttgatgcatggaagttttgataagtgtgtaatggactcaggtggaagaacgaagtgttccggtagaagaactgaaggaagctgaagaagttttctgcactggaactgccgctggagttgcttctgttggaagcatcacttttaagaacacaaggtctcttcttcctctctggatacatgtatacatatgcttagaattttacatttatctgttgataaataatctgcaggactgagtacaaagttggagatgggattgttacacagcaacttcgatctattcttgtcggaatacaaactggttctatccaagacactaaagattgggttttgcagattgcctaagttactttcatatcctataaataatgttgcactctcttgatcacccatcaaaagcttttgaaatagtttttggtaaatttgtgacataaatttgtgatatatcaccacatcgtattagtattaaacatttgtttcactcttccaaagagacaaaagcaaaactaaagaccttcaacttcaaggtcaggatatgtaatctaatggtttgtctttgtggcattttgccaccattggttcaaaataccattgctgtatgatcagcctcctcagattctatttgccagactctacggcggtatattcgcttttagaaaaaaaacaattttgtcgaaacttttttttttttgtaaatattgtagattccacacacaagactgtctaagattctttgataagacacgacaaatgcgatttaagatttttcaaagaaatgaggttcgttgattgttccactaggtttggtatatttataatttgaatttttttttttaaagatatttataagaaaacgaaggagtgtgctcgcgtcaagtgtgtactaatagtcgatgacactagtgatacgacgatactggaaagggacatcaatattcattagtaagccatcttagcaaaaacgttgttatcagataagaaaagttctcagactgacgtggctgtcaatctccacaacgtgtttatctcccatttgggtagttacggacaaagacgttgaaaagacaacaatatggtctaaaagattgacatggaaagaaaattgtttatccgacaaagacctcttggtccaacgtggctttcacatcactagtttactatttcacatctcatggaaaattactgaaattagtacttgtctgtattttgttttttcgtcaagtatttgtttgtatactttaggtaattgcgtgccgaagaaacattgctaaattgatatttataccaacttacaatagtttacagttcaaaaatagaaatctccattttgaagatacaccactaattttcttcatttatttaccccataagagaacgagaaaagaacaatagtccgttgatttcgttaaaatctagtttcagaaagacacgtctagatctgtctgatcagggcagatagacacaagtgacgaagcaaaagaaacacaaaaataagataagaactcttaccactaaaagataaaaataagaaaaaaaataaaacaaattcaacgatttgccaagataaaagcagacactgtacataagctccgcattcacttacgtgttggatacttaatttgacactcttctttgtgttttctcttccaccttctttttcggtatatcattcaacaaaattctctcttcatttctttattttgttgttttttttattattattgaaatcaagagaattaaaacagaggctctgcaaaagaagatgatcaaaacaatcacatctctacgcaaaactctggttctacctcttcatttacatattcgtacggtataaactggattcttacaatctaatgatgattacttacttagagacataactcggatctcagatacaaacatgttttatgttctgttttttttgtcctgatgaaatagctacaaactttcgccaagtacaacgcacaagctgcatcggctttgcgagaagagcgtaagaaacctctttatcagtaagttctctttttcatgatccagccaggtcatatagatattttgttaccattggaaaaagctctgtttcaaatttgttgtaattgtatcatatagaaatggagatgatgtatatgcggatttggattgggataatctcgggtttggtctaaatccagctgattac

SEQ ID NO: 5125 - DNA, 3000 bp, Unknown
  misc_feature (1)..( 3000): cDNA_ID_3075744_gDNA_ID_1620764_Annot_ID_167292 3000 nt of promoter + ATG
gacaagctgatgtggtaacctacgaaacatattactcattacatgtttggaacgaaaattaaacttcacatcaaatgctctttctctgttatgcaggttcgtaaacgcaatgtttgcctcaagttctcaggtttagatcctagcgaattgtctggtgcaacggtgaagatcagacagacacgtaacagtttcccactcgggtcatgcatcagtcggagcaatatagataatgaagactttgtcgatttctttcttaacaatttcgattgggcagtgtttggttatgagctgaaatggtactggacagagccagagcaaggaaacttcaattaccgggacgcaaacgagatgatcgaattctgtgagagatacaacataaaaacccgaggccattgcatattctgggaggtagagtccgctattcaaccgtgggtccaacagctgacaggttccaagctggaagcagcagttgagaaccgcgtaacagatcttcttacccgttacaatgggaaatttagacactatgatgtgaacaatgagatgctccacggatcgttctatcgagatcgactagactctgatgcaagagcaaacatgttcaagactgcacacgagttagacccattagcaactctgtttctgaatgaataccacatagaagacggatttgactcgaggtcatcacccgagaagtacataaaactcgtacacaagctgcaaaaaaagggtgcacccgtgggaggaatcgggattcaaggacatataaccagccccgtcggtcacatcgttcgttctgctttagacaagctaagcacactcggattaccgatctggttcacagaacttgatgtgtcctcgactaacgaacatataagaggggatgatctagaggtgatgctatgggaagcctttgctcatccggcagttgaaggagtgatgctttggggattctgggagctgtttatgagcagagaacactcacatttggtgaatgcagatggtgaggttaacgaagctgggaagaggtttctggagatcaaacgcgagtggttgagttttgtggacggagagattgaggatggaggaggattggagtttagaggttatcatgggagttacacagtggaagttgtcacatcagagagtaagtatgtgacgaactttgttgttgacaaaggcaattctccagttgatgtgattatagatctttaacgtttcataatactaaagatctaaacattacaagtctttatctttattttcttctgaagatgggtttttgctgaaatgatagttcttctttatttccgatacttgcatcacaagaaaacattactaccttatttaaacagaaaaattatatgtattaaatttgaatttcatcaaaatatttcaaaagaaaaaaaattaccttatgaaaatgcgtacaaggtttactataagttatcagatgcagtggacgaaagaatatgatccgttagttgagtcgatcattctaataagagcaatcacgaatgatccacaccacctacaatctcatacgtacttgtccagcttcactgcacctaccatatccttaatttagttggcagatattatgtagatatatgtatatttcaacttggtgttctccacaaccacccatacatacaactttcgacaattgatgagacaagtatacaaataggttgggttttaaagcatttagtactatcctaaatagaaacgagaagggatcatttaatgatgaccttgaggaaataaagttggtttgcatttagtttcccattgatatttatgtgaatagtgaccatacgtaactgtaccatacttttatgtttccaccatcagggcaacacaataaaattgaatgccatctaaaacaaagcaaaaagatttactataattattttcttactcatgcatgtactcccaatctcccatagatattttcgaaggtatttttgtggtaacgtacaagtcttggcttcgtaatctaaataccgaaaaagaaaatgcctctaacttcccttcctctctctatatatttcaaccactctctgtctctcttcctctttgtagtttctcaaatattttcttcagagttggcacgacctcattaataataatcttctctacacctatcaataagagatatattttagagtttcactttggtgcacaaacaaagctcgtacaacattcttcgtatatggctcttcgtcgctgcttacctcaatattcaacaacttcatcttatctctccaaggctcgtactttctccaatataccatcatactgttcttttttctttttcttttttctatacagtaaggaaactgtacaacttacataattttattttatttttatgtaatagtaaaaataaaagacatttgctttgtttgtaataacacagatctggggatttcgtatgcatgggaccaaggcagcagcttctgttgtagaagaacatgtctcgggggcagaacggtaacagtaacctccaatcaaattcaacatttgtccgttcttattcattgttaccatttacaagaaatatgcaagaaacaaaatggggaaaaaattaaaggaaataaaaaaaataaaaaatagatgctaaaattgtatacttttagaaaaaatattgcgtgacggaaagcgcttattggtggtggttgcacaatgcagctcaagcccgtgatcgtttcgatggagtaaacaaattttgtaaaaaaaagtgtagtatgttttttttttaaaatcagtaaaaatagtgctttacatttccaaccattaaaagttttaaaccaaaaaaacaaaagtttaaaagttagtgttttgttaggaatatgaatagtccttgtcttggattctagttatcatataagaaaataggcttcaataggcaaaatattcttcctgtgatgcagtgaggatgaagaatatgctgatgtagattgggacaaccttggattcagtcttgtacggacagatttc

SEQ ID NO: 5126 - DNA, 3000 bp, Unknown; identical to SEQ ID NO: 5123
  misc_feature (1)..( 3000): cDNA_ID_3075752_gDNA_ID_1620764_Annot_ID_167290 3000 nt of promoter + ATG

SEQ ID NO: 5127 - DNA, 3000 bp, Unknown
  misc_feature (1)..( 3000): cDNA_ID_1032288_gDNA_ID_1620764_Annot_ID_167282 3000 nt of promoter + ATG
acacatgtcctaaattgagactagttaggcaaaatctaaatgatatcaaatgaacaaaatccttgttcatctgagaaaaaatgtctagaaaactgaaaaatctgtgaaaaacaatgctgataaagacacaaaatgaatttgtttatatgaatccataccaaggtaagatcggacgacgcccatgtaattatagttgcgtgttccggtgatggagtccggcgaacggtaacagtcggcgagcaaggtggacgtgtagtaagtaatgatggcgaaagcgaccaaaactgtggttcctgccacccaaccaagctgtgctatagcccaagccaacgacagcacccctgagcctatgaccgccgtgattatgtgcgcactcgccgtccaaaatgttcccgttctcttctctcgaccatcgtcgtcgacgcttttcacggcggcgtcacccgactccaccgccgagggattgttgtatgcgtccatcattgtgagagaaccactgaaccagaggagagaagagaggggaagagagttattgacagaggtcgtcttattagagtactccctcacaatcacgtacttacatgtattatatacacaaatatcgatgtttatatggaaagagcatctttgtacgttgaatcttatttattaagagaatcttctattacgaggatttatttcttttgactttgattttgaatgtgtaaccactattgcttattccggaaacaaaaattggtccgcatgttgaaaagaggatttacctacattaacgacactacgaataatcgaaattaggtaactgattaaaattagatgagtaaaacagagagatatttccttcagatcttggcctcttgcatagctatatcctctcttctatcttgctcatttatcttctcaaatcctcacatgcacatgattcattaatcgggaaattaaatcattaacattgagttataatgatgtattgatgtgaatctatatatatatattgttgtatcaactaaatattatgatatatctacaacattttgttattagtatcgcatcaaatacaaaattatgtggatttacatgtttgtattatattttactactattttaacggtttacaaaaacatgtaaaccaaaccataaatttcactaatttcaattatgtacgattttgagtcttcattacttcttatcgtttctttcactcttatagtcttatctcacaatccgtaatttgtgcacaattaatgaattcaatgttgtattttgtcgtattaaatatggattttgaccaacataaacctgattttttagtggattattttaaaatatatccacaaaatattccttcgaataaaatcccattctaactatatccataaaatgcccatcccaattgtcgagacagaatcagatatctaaaatgacacataataaatgtcgcatattacaccattaaagtacggtacgttgacctcctacctgactatgaacagctcatcagacagctccctgtgccctcaagtaggggtgtggataaattggtctggttaccggtaaaatctggagagtatacctcaagatcaggttacggggtaacatccttgacagtgctaccaacagctcaggtccgctttaactggcaagcaaacctttggaaactccacactatgccgaagatcaaacttttcctatggaaggcggctgcaggagctctccctgtgggtgcacaactcgtaagaaggcatatatcatcaacttgggattgtgcacgctgtggggctccggagacttccacccacatgctgtttcactgtgattttgcggcacaagtttggaacctagcgcccctccaattgggtcacatccctatcggtacccctattttggaagctcttaacttacttaagaaaaccatcgttctccccccggttgggattcatacagcaaccctcttcccctggatctgttggcacatctggaaagccagaaatcagcttatcttccaaaattctcatttctctgtgatagagactgttacaaaggcggttcaggatgccttagcgtggcaatccgcccaattggcgctcccaaaagttcgtgtagcgaccccccgcccaaactccacaacaactctgactcatgattttctctgctacgtggatgcggcttggcaacaacagagctccctcgctggctctggctgggtgttccaagcaacctcacactcggagaaagaaattaccaccttctcagccggatgccgtcggttcccctcgcccttagcggcggaggcttgggctatcaaatcggcgatgctacatgctttacaactggaaagatccgatctccttgtgttatcggactcaaaatccatagttgatgctttgaactccaatgtctccctcaatgagatatttggccttctagtggaaattcgatctattcgaaacagattccgctctatctcctttcaatttatccctcgcttagttaattcgattgctgatgctgcggctaagctctccctttgtatttctggtaatatcgggcttgacccgggtactcttgtttttgtttgatttggaatggaaagtattgggtttgactaaaaaaaaaaaaaaaaaaaaaaagtacggtacgttgacaatccgttggtgaaaacttagagcaagtcaagtaagggtttttagtagatttcttagatgggtttttatgtaaaaatgggcccagataatagaaaaacagctgaatccatttaggatcgttcctaaaattagtttttcgcgacccaatagaaactcatacgtgacctcattttattgggtaaactgaatgacaaaaccaaaaaaaaaaaaccacacgcgtttatttatttcttcttcttcttcttcgcctacggagacaccaaagacgattggaatcgacgctgaagatctagtgatttgttcatgaaatcatgaaaaatcatccacctaaacgagtgtttcaaccaacgggatg

SEQ ID NO: 5128 - DNA, 3000 bp, Unknown; identical to SEQ ID NO: 5121
  misc_feature (1)..( 3000): cDNA_ID_3075762_gDNA_ID_1620764_Annot_ID_167281 3000 nt of promoter + ATG

SEQ ID NO: 5129 - DNA, 3000 bp, Unknown
  misc_feature (1)..( 3000): cDNA_ID_1827567_gDNA_ID_1620764_Annot_ID_50083 3000 nt of promoter + ATG
ttattgttttgtcttttcttttgtgggtaaattttttgttcgaattatctacgatctcgttgtttgttgattctcctcaatctcctcttcgattttgatcgaatttcataatctgggctttggtttcgctcgctttcttgtttccattgtcgtagtgagttctcttcgcgaatcaaatcctttgattcctctgtttttggtgttctggttttcttaggttctatggaatcgtgggtcgttttagttcaatcataaatgacgattgagttacattatcttatcatcagccacaacttttaagagttgattatattttgatcccgtatctttggttgttccgaacatggaaagttttaggtttttagttttttcatcccttgtctaagtaatcgctgttttacaactgatcaagtggcaagtacgttacttatgcaacttttgagatcagtccttacttgttagagtaaccacaattcatgtttcaatgttaccacatgcttcatggccatatctcttatcctagattatttcttgcttttccttacagatcttttgacgacctaagtttctgctgtgaattgttaaacagccatcagcctgggcttgattagccaaccctgttaaggcagggtttgaactaaaagtgagatagtgagatggatgtctcagcacttttaacgtctgctgggattaatatagcgatatgcgtagtgcttgtatcgctttattccattctacgaaagcagccagccaattattgtgtttactttggtcgattgctttctgacggaagagttaaacgtcatgatcctcgttggtatgagaggttcgcgccctctcctagttggctcgtgaaagcttgggaaaccactgaggaagagatgttggctgctgctggtctggatgctgtggttttcatcaggatggtcatttgcaggttaatgatacttcacctataacatgcttactgtaattgaatagacaagcatggtattttctactgtttctatgttccagcacttgttttatttctatgtggtatttgtgtgtttcgttcttaacaactctcacagttgggttatcgtgttttttttaaactctgcagcattcgtattttctcaatcgtcgcagtcgtttgccttgcctttgtgttacctgttaactattatggacaaaagatggagcacaaggaagtccatttggagtcattgggagtattcacaattgagaaccttaatccacgctcacgatggtaaagtggcggcatataatattaatattatcagataatatgcatagcctgtttttctatctgattatgtttctctgtgcaggagaagatagattgccagtattttgtacaatgaagtgctgatccttgttttactatttttatttccaggctctgggttcattgtctctcattgtacatcatatcctctgcagcatgtgctcttctttactttgtgaggatcttataccttggttcatttcacgcttactgtttctctttattccatcacttcctcatcgttttggtctctcgtctctctctctcaccctgtttatacgtgtttcaccactgtaggagtataagaacatagccaaaaagaggcttgcccatattagtggatctgcctcaaagccaagtcattttactgttcttattcgtgctattcctcagtctcctgaccagtcctacagcgagacagtgagcaaatactttacaaattactatgcaccaagctatgtgtcgcacctaatggtctaccgtgatggcttcattcacagactgatggtatgtgtttttatttatttttgcaacatgctgacttgattatcagtcacttgtctttttgttatgattttgtcggattaggaataaatttttcagctaacaccactgccgctctgcttggttgaccttagcagaataggaatctcctagaatagaaaaaggaagctgtgatagctctatgttccggaatgtgatttaacacttttcacactttacatgtttcttctttctttataaaatgttcaccataacacttcccctgtgttctgtcataaatgcttcttcatttgccaagggcatcaaagattgatgaaataacagaacagtaactttgttgtaaagatttgattgatagtcatgtatcagttaaagatataggaagttctaaggggattatatgattgatccacattcttggagtactgattttgtttttggctcatttgtaacgcttttatttgtagttcatgttatctgatattgaggttcttttgatattacatcagttttttgctttggttatctgatcagcattttgaatggcaatatctttggtaaacaactagtggatggtgtgtgctcatgataacatatagttgaagtgcagtggtctattttggagaacaattgagttaattagattctaatattaattgtgtcactttctattttagaatgagacggagaggatgtgtcaggctataaaacatgtttctcctgatttaagttgtaatccgagtttgaagtcatgcgtcctttgtggacctgcagccacaaattcttttcaaatcatctcgaacgagacagacagtgtcaaaggattggagcttggtgagttgactttgactacgacagaggaagtaaggaattattttcactttgataggtgaactttgtgctgtacatgatataggcatagtgtggggttttacctgttgcatgtcttcacagttttacagctgaaactggagaattgactcttttgttctttactgagatacaaattgagctttagaggtaacactgagacttaggggaacccaaaaaatactacaatgagacgttaatggaccttgaattagtgatacaaagagctttttgtttaaaacctttaaaagctagatctaaaaggaatatatctccattcatgactgcatttgtaaacattgcttaatgaagtatcagcgcctgaaatatgtatg

SEQ ID NO: 5130 - DNA, 3000 bp, Unknown
  misc_feature (1)..( 3000): cDNA_ID_1827563_gDNA_ID_1620764_Annot_ID_50084 3000 nt of promoter + ATG
agctgtgttgtattgttgtaaaaggtactaaaagtctaaaatattctacaatgcgcatgaccggtagaagagtttgaccaagttgaattttgtaaactgccctattaaagaaacaaccaagttggattttgcaaaaagtacataatttctctcttggtaagctatcatggcgacagtggtttggacaacaaagatagttaaacagtttgttgtcatgctaatacagagatgattgaattagtgacttatttgagttgttatacttttttcttccaggcactatggcttcaccggcggttcctctctcttaattggataatgtatttcgcttgcaatcattcagatgcttcacctgaaaccggagagagtattattatgaatgaagaaattgccatcttcattgataatgagatccgtcttctagattcttctatgaccgttccggataccaaatttgaagattttcaagctcaagcattgcatgctgctgtctacacgctatggctgacaaaggtaacagtggtctcttcttgtccaaataaagtcatcaaaaaaattgccactattgtcaatctcacaagtgcagaaaaatagattgggagttttccgtatagcagaacgatagaaatatggttgactttgatttctgatatgcattcgtttataagcagagcattccagtactgtggagaatgctcgaggagaagcttggaacagagaaagtgaagtgtgtactgaacacaattgctcaagagagaccctcgcttctgcatcatttggtgaatgtctgaagaccctccataaattggtgtcaaaccatgtctcaggatctgtttgaattgtttttttttttttttttttttttttttttttctattttcgccgatatagcttaatgagttgattaatgaagaagttggccgagaaatctctgtcatcaagtgttacacgagtcttcgagtggtgtaaccaaacctattaaaaaaatgaatgaaggttatataagcttccaaaaccagatatgtcgtattccgtagagacaaacgagaccgtcacagctatcaaagggaactaagtatattgtgtcctccttcgccttctcccaaggagtagggatcttgaccgatgatgaggaacccaacaccagtgtagttagatgttttatatccggtttacaataatcgtcacgccatatggagaccatgagacaaacgagaccgtcacagctatcaaagggaacgccatatggagaccatgagaacatctggatcacctgattgctgacgctctgtcaactgtctttgttggaagaatggagattcgataattgatttccattgtttagacacggcctttgaatctcagcagagaatccacagcaagtctctctaggatgcactctaccacatcgtggggcagcgattccgtcctcgagcagcgttgtttttacttgtgattgcagactagtccttgttgatgaatatacagagaggcttatttgctttataagcaagtaatctcacaaataaactggaaagaggaaacctatcactcttttacctatttcttatgagctttgaataaagatactgaccgttgggaatatcaaaccgataattatgtaaagatgctaaaccagttatatgcataccgcatcataaagcatgtatcataattcatagtcacacctaataaagagaatcgagttattatatagtcatacataataaagagaatgaatagtcaaatgggcataatttaatatgaccggtccttgttatggggtaggtctcacactctcaccacgcggataatagatatgcgaccttttttaattttcccgggcaaaaactgttgttaactgtcaatgttaattccacgtgtcacaatcgtatcgctttacaaaaatctaacggtcataatttcgccgacaaggtagtcactatcacaggctaaaaagacctttgccgacgagatattagtttgggccattcacgttatgccacgtcacatgatctggcgattccacatttacaccaacgtggagaattttgcccaatgatttttttcagttatctttccgtctagagaaatatcctcaccaaaataataacatgtaatgtgtatacagtatacctaatcaatcattatctttctttaattttgttggattttttgcatattgcaaagtttagaacgcgagcgaattctccgcggaattggggttaaaaggaagaacttttagggtttttgattcttcgggttttctcgtgctttgattcctttcaagtcaaagcaaagcattaccttttctcgtccatgtaagtcagaattgttcaaattattgttttgtcttttcttttgtgggtaaattttttgttcgaattatctacgatctcgttgtttgttgattctcctcaatctcctcttcgattttgatcgaatttcataatctgggctttggtttcgctcgctttcttgtttccattgtcgtagtgagttctcttcgcgaatcaaatcctttgattcctctgtttttggtgttctggttttcttaggttctatggaatcgtgggtcgttttagttcaatcataaatgacgattgagttacattatcttatcatcagccacaacttttaagagttgattatattttgatcccgtatctttggttgttccgaacatggaaagttttaggtttttagttttttcatcccttgtctaagtaatcgctgttttacaactgatcaagtggcaagtacgttacttatgcaacttttgagatcagtccttacttgttagagtaaccacaattcatgtttcaatgttaccacatgcttcatggccatatctcttatcctagattatttcttgcttttccttacagatcttttgacgacctaagtttctgctgtgaattgttaaacagccatcagcctgggcttgattagccaaccctgttaaggcagggtttgaactaaaagtgagatagtgagatg

SEQ ID NO: 5131 - DNA, 3000 bp, Unknown
  misc_feature (1)..( 3000): cDNA_ID_1827546_gDNA_ID_1620764_Annot_ID_50089 3000 nt of promoter + ATG
acttgtcttcttttattttattattttccaaaaataatacttcgctttttagaattactcatactcaatgaaataaaaaacaccacttgaaatcacaaaattgatagttgaaccaaaaaaaaaaaccaaaattgatagttgccttaaaccctcattaactaataaatttttatgcatataacttatagaacacacgtctttaaagttgggatttgggaatatgtgaaaattcaatgtttgaatgatcaaataaaatttcatcatgtaccgtggttgttataagttataactcagatatattatacagctttgtcaaataatactgatgtggaaccccattaatgaaacaagaaactttttttcactttgactttctttcttatttaggcatgaccatgttcgatctgacttcttcttacaaaagcaaggttaaacaaaattttattttatgtttaaacgaacaatatctcagtcatatatattagttgttggtggtaaatcaacttacataaaactttttaatctttttgtactcagaaaaatcgaagatggggtagaaacaagtaaaacaatacgtagttagggtttattgtacgaataactctctctttttttattgtcaacaaaataatcctagattagtacaaaaaacaatatacataataggaggaaacataaggaataaaagggaatcttatataggtcattttagaaaattaataaaacaaaatatgattatatataactcctagtcaagttacagctgttaataaagacttgcagaaagtagagtttcgtagttcataagcatgggataaataccctctaacctaacaacgaacaaatcatttggtcaaaccttttaattatttggtcaaaccccacaatcttgggttgttaactagctgtaacacccaccagatatgaggcctctcgtgtatgtagacatacatgtgttttatgctactataaactcaaaaactgatattatggtcagtattatacgatttttgttctgatctcaaaataaataagtcgggagtagaatactattttctgattaaaaatcctttatctgaaacttcgttgcagatcatttctgttttttccacagtgatataaaaaaagtacacttatgaattatgtatacaaccttgtaataagggatgttcttacaaatgtagttaggttaggaaatatgacttgtttattcaacttggaaatgcttctcatcattgcagacaagcagaagatttaagatccaaccaaattatgataagtgaaacttgcacacaactcctctttctacattactccaataactatgtctatatgggaccagactatattactgtttcactaattaaacgcatataaccactacacattcattagaggcggaaacgtaaaagtaaattatgtagtagtaaattttgtaaacaaaaagaagtaatatcactagtccttaaagttacaagcatcagatcttaaatgtgtacagttgtatagtttaccaactaaccaatgtataaacagaatagtacaatctaatttccgtttcatgtgctgtaaaagaacaatgacacacgtaaaaagtgagcaaaggaatgattaagaaaccttaatggagtaggttaaattaaagacacaggttccttattatactccattttcacttaaattatgttaactttgattagagtgaaaccaattaaagtgagaagatcctgcgaccacgctcgcggactacttatgtggaccctcttttttaactaaaacttacaatggcccacaagaagtggaagtggtccatactcttttatttgcaatgatgtcaagattcctagtatcttaattatgatcgcaaatcatatctttctctctaatctcatcgtttatttctcaaagccataacaatttgctttatctaaaaaagttaagaaaaccgtatagtctagaaaccaaattaatgtcgctggtccaatgatgcatgaagaagtatgataactttggttctcattgatgtcgatgatagactaaatgcatatatatttacgtgaaaagaagtccgaattccacattagaaagtaataaatcttgattgtccataaaaaaaaaagattgattagaaattatatttcttcattaccaagtttatttggttaccagatatatcaacgatcaacaacttttcattagaaaatggggtactactaaaccacagtattaaaaaaaacattcattacataaaaatgatttctcgtgaccaaaaattgttttgtattttaacgaagctgtgtccttttagagaacatatatgatttggaagctccaagtcacacatacacacacgtagtttagagaaaaattgtttgttgacattattaacgataacaaaaatatttgaggatcatgagtggtgacaacgacgttgatttcagattggttagtattcattttcggttacatgcgaaaaaagtggtgaccacggatactacaagcttcacatagaaatatttacgcattgataatgatataatatgtaataacgtgaaatctcttagtggtattagtagaaaaatcatggtccataagccatatctatgacttgtagttacctccttttttctccaacttttttttctttctctagttatttttgagatctgacattataattttaatttcaattttgatgatagtttgaagattttttttttttttttgaatctcacattttaatttaatttgagttttgatgatatatactaaatgggcctcacgtgagggaagaagcctacccgctaattcatgtaaagtgtatctcagcacttgactttcagtctcagcgatcggagacggagaagctcatggaagctgctggcgttacaagttctcatcttctctagtcttttacatttcacctccctttcgtcggcgacccaaatccacgttttgggaattcctccctaaaaatcagaaacccttggcttttccaac

SEQ ID NO: 5132 - DNA, 3000 bp, Unknown
  misc_feature (1)..( 3000): cDNA_ID_1827643_gDNA_ID_1620765_Annot_ID_50092 3000 nt of promoter + ATG
cttgaaagctaaatctgcaaaaatggttgatctcgagcttaacctgtcacctgcgcctagatccatgaagcctagctgctccgctaccctcatcgaccaacgttctcattgggttttagaatcgttggtcccagtgacgaagttgtcgacgaatggatcaaccctaatccatcaaaccaattggtaccgctgtctctcgcctttatctcctccagtgccacatccctcggcggtaactctttcaactccgatcttctgctcgccgtcgtctagccgccacactcaaagtctcatcgcccatgccaaaagaaaactagggttttcggttttgggcctattccagttcggcccatcaagttccttgtcttggcaaattcatttatttgggcctttaaggtgtttgaagcccaactccaataggtgtgatcctaatcaatttctgcaaaaatctaggtttaatcgaaaatcttatttgtccattattagccaacgttggtgtcgatatttgaaaccagtttttcatggacaacaattggaacatattcggtcaatgttgctttgttggtacaattatatctcgagaaccctgcctttcgaagcacctagagagatttttcataaaaccaaaagagtgaagaagaacggcactatgatcccgtctccacagagcggtgattaccgtagctttttcaactcttcatccccgcttcctttgattatcgagctcgttcatgtgcaaatcatcaagttcaaggatagttctcaaatttttaaaagcttgaagaagaacggcattataaccgcatttccatggaaaagtggttaccgtagtattctcaatcttttttatccagcagcctcctctttggaatttgtttctaaaagctcgtatgcattgtttgctcgagccgtctatgaccacccgttggtcgaggatttcgcgaagctcgtcttcttggtcgaatccgctatagtttcaacaaatttttcaaccattgcaaactttttaaaagtgaacatccctttggaaaactcatggaacttgtatctttctttctgttgtattatcgtagcttgtatcaactttcctctcttgaggccttaatgaatgaaagttgtgttttgacaaaaaaaaaatctagtggcagtcatcgtaaataagtcccaactacatgatttatttcacaaaatggctgcaaaaatgtatatgtagatataacgaaagaaatcttatattttcatagaaaattaaaaaagttataaaattagagaaaactctctctaaattaataatttaataaattaatacatctataaattaatagaatgtggcccaacattattaatttatagaggttttatacttgaaaaaaaaaaagaaaaaactcgctaatgcatgcaatcccataatattacacattgatcttgacattctacagattaatgcttcagtttctttaattgttgtgtgaagaccatatatgcactagaaattatgtacaaacagaattttgaaaaaacaaattagtttaagagaatcttgaaagactaaaacatgagtttcaggtaccaaaaaaagaagagatatactctaaaacagattgaagatctgccggaatgtataacagtcagagataacaagcatgtgagaaatttgtaaagctcgggagaatctataaaggaaaactgaggccaagatggaaaccaacaagatcacggtgcatctatctccatgtcgtttgttgacaataggtgttggaagtcattcataattgcttctaaagtatttctacatcttcatctggattcacctttacttccggttcattcatagctgcatcaatgcccataagtggctggagcttcaccaaaggtacgcataagtggttgagttcatcgaaagcttgagttagcgtgacatcatcttcagccttatagatcatgtgactaacagccagcagaaactggggagaaggaaggcgatgttcgtattggtgccatccacaatgcctattttgcttgtctctgaatataaatttttgtttttccccgatgatatgaccttcctctttaatctcaatcttcttgtcatgcattcacctccccttttcttgttccttatgcccatagttcgcttcatcatgttggatggtcctttgtgttttctggttacaaagtgtaccaatattctcctttgtgaaagtagtctctcgattggtggatgagcaaatcaggatgatcatacacgtataggtgtttcatgagacagtcacctcccgcagttccggactttgtctcccgccatgctcccacggcccgcttccaaagaggaataagagctaaacggaactgagaggagaaccgaatgaatgcaagtggtccgggtgctcaactttacttttagtagatcgtgagaactagaagattccacctttggaaagcgcctacacctaatggcttaaccttatgacctcttcgtcagtgggagaaactcgaaaccattttggtataacttggccgttcatacctgaaaagcaaattatagtacataaaaatcaatgtaaaaacatgacattgtagagtcaaaataaaagtcgaggaaacagaagcaagtattcaagacacataagagccctaaccatattttcacttgtgatcaatccgtaaagactatttaaaaataaataagcactcaaaacaagtacatgttctgagtatcattcaacaactccttatcagttttgattcatttcaatatgaaaaataattcactggattccatcaactagaatataacaaaaaaagtacgaataaaacaacatttaggtactaaaacttttttttcaaatttatattaaatataaaaattgatccttaaaatatgaaataggattcaatcaaatttaattgaatgaacggaaaaaatcatctatatacacaaagttttttttcgtctttaataattttttttattgacgagccacataaattgcacctatg

SEQ ID NO: 5133 - DNA, 3000 bp, Unknown
  misc_feature (1)..( 3000): cDNA_ID_1827622_gDNA_ID_1620765_Annot_ID_50099 3000 nt of promoter + ATG
caacttaatgtattttaaaaccctttaaaacaaaaaaatgttaaatgtatttaaaagtaaatcttataaatgaagagatgaaaaaaaacgtaccttcgtaactgttcgtggctacttaaaagaccaacaaagactctttatctcttttcatatcacaactctcttctcatcttcttcctcagcaaggtaaaaaatcctttgatcttctcttcaatgtttcaagattattattatatctatctttaaatcttttttgtttgcgtgttctctcagagctatgaaagaccatgaaagagctatactggaagaaagaattaactattacctagcgaaacgtaccgaaagaattgtttttgctgagcttgatactggaggaaaaataatcgaatgtccaaattgtcacgttcaatttactcctactctcggtaaaatatataaagaacaaatctcttttgttatagatttttttttattttctcgaactattttttaacattttgatttggttattactataggaaactggatcgcggataagtttgcatgtaaaagctgcaaagctaacttatcttttagaaacagcacagcaaaaacagcgagatgtccttgttgtactatctcacgtcctgtgccaagtatgtgttcttgaaaaaaatcaagaaacttaaatttttttttgtttagttcaaaaattggatctatggttctgatttgtctaatctcatcttttgtttcataaaaatgttctttagacaattttacaatgcttgtgtgtggcggatgtccagtgagcgtcgttcatcaaaaacgtgataaaactgtgaaatgttctgagtgcaaacatatcaatattccaactgtaatgtctttgattttctcttatgatttaaatactgtttgtaaatttcttcaaataactataatgtttgtttttggtttagtttggaagaacttatggggttcgtccagagaaccaagctcgtcctccgcaagtttaccggattgttcctcctcaaggtaacggggtagctcctcctcaagataaccaagatggtccgcgaagttaccaagttgttcctattcctcaagttaacaaggatcttcctcaaacttaccaccttgttccttgtcgtaacggagttcctcaagttaaccaagatccttcgacattttaccaagttgttcctcgtcaagttaacgaggttcctccgcaagttaaccgagttgttcctcgtccagctaacgaggttcctccgcaagttaaccggattgttcctcctcgagtttaccagcggaggaaccgtgcagcaactgctgaaactgaatcaactgcgagttcttctttcaatgtgagtaaatgttaaatcttatctctctctttctcttaaaatgtactagctactttctttataataataaagtgcttttacccctttttgcagcaaaagcctgagatcattgtagttgaataccctgatgattctgtagctgaaactgtaagattatatacaattcttttgccttttgaggtgcttgtaattgattcttgaaacgttttttgaaacattgtgctttttggttgtgttttgttaggtgagaatggttgcaacaaagagagtagtagaagtagaacaagacaagacagaagaagcaggaaacaagaagattcgtctctaatcgattgaaagtacaacacaagacttgattaaaagtaccacaaatttgcatctttcttttgttttacacattttgtttcttttagttttcctcagttgatcaaactctcatgtggagatgtttttgtcgtgatttattttatttctaataagattcaagaaccttatttttattctacaatttgacttctctgtactttctgatctatctcaaaagtatagctacaaaaaataataaatactaaattacggggacgaaataatgaaactttcatctccatttcctttaaaacgacgcgttttggataaaaaaacgaaacggtcaaactctttacttttccgacgcggagagaaacctaaaaccaaagacgacgttcgacgaacgatcacggaagaacaacaaatggcatagaaccgtaaaataaacagaaagctgagggtaattcagtattttccgcataaatattagatcatcgtacggtacggtgtggtgatcaaacgctgatccgttaaaaactcttgagagtgcgttttctttggcgggtgttctctaacttcctcgtttctccagattctttacttcaaatcactctcttgtcttttctctgtctcaatctcttatttttaaatattcacatacttcaattttcatggtttttattttttttatctaaaattatataatatttgatagaaaaaaaaagaagattcgtataacatcatcagagataatctcaaatacacttcttcttcttctcgaaatctcagccgttcgtttgtggtaatctccttctcgacttttcctttttttttttaaacctcttttgtaattttgtagtaaataatatttttaagttccttatcgtggttaagttcggtttgttttgttttataatgtgttccttcttattcgtcgttactactaggtcaattaaatctctttcttaaattttcccagatttgggtatttctaactttaactgcgaattcaattcttatagcattaattgggccaaaacaaaagaaccaaaaaactttcaagctttttctcctttgataggtaaaaaaagattgattttcatgaatttaaatatctgtgatttttgatgttcttgttattgttcctctgtttgtgaattcaattagggttaggaactttttttttttttaacttctctttattttgatatatcgatatttgtttttgttgataacatcgttttcttatcttttttttttttctcagtttcattggctctcaatcgaagaaaacttttagcttacaaaatctgctttgagtagtattgatttttcaattcatatg

SEQ ID NO: 5134 - DNA, 3000 bp, Unknown
  misc_feature (1)..( 3000): cDNA_ID_1827619_gDNA_ID_1620765_Annot_ID_50100 3000 nt of promoter + ATG
gcatatgatactatgtttacattatcttggtttgtttttgtgtgttctttcagaaaactaagccgacacagcatagtgtcaaggggctacgaggattgggcttgacgccggatatcttagcttgtaggagcacaaaggttcctttgtttgcttgcatctccatcttgactttaaatctgtttcattcagaaacgtttgtattagattcttgttctgatataaaagtctcaaccttttgcttcatgtagccacttgaagataatgtgaaagaaaaactagctcagttttgccatgtcccggtaagattctgccttttgtctcatgttgttatgttctttacttgaaatctctttaattaccagcttacggttcttgtttcagcttgagtatatcttcactctctatgatgttcccaacatttggcgtattcctttgttgctaaaggtatcttttctcaactaaaactatttgtagttattacattggtttttataaatcattaagacaacatatttacttgtacaggatcagaaagctcatctggcaatctcaaaagtgctcaatcttgctaggtatgtattgtgtcttgttttgtcttttgttttcttgcttgatttgcgactgaaatggattggaactgatcttgaattgtttatgaaacagtattcttaatgagccttctctaggggaatggacttccagagctgaattatgtgacaatttacatgtgccggtgggtctcagctctcagttactctttagaaaccgtaacctgtacatatatttcttaacgcatcaaattattttacaggtgagaatcgctgttgtggggaaatatacaggcctctctgatgcttatctctctgtcttaaaggtagatattactcattacctctcagtggatagtgtctggataacaaaatgatttccttgcctcggttctcacatttggataacttgtttaggctctcttacatgcttctgtggcttgtcgcaaaaagctcgtagttgattgggttccagcttgtgatctcgaaaaagaaactgagaaagaggtactgtgactgtcttttgattacacaactatgtttttacttattcacagatcttaatgcagagtcattttttgttttgtttcgtataagcagaatccagatgcgtataaagctgcttggaagttgctaaaggtttgaaacgtttgccattttacaactttaatcatgagaagccttgtgttttagctcatctctattggtatcttcttcagggtgtagatggaattcttgtacctggaggttttggtgatagaggagtggaagggaagattcttgctgcaaagtatgcacgtgaaaacaaaatcccgttcctcggtatttgtcttggaatgcagattgctgtcatcgagtttgcacgatcagttctaagcttgcaagacgcaaacagcacagaatttaaccctgaaaccaaacatccttgcatcattttcatgcccgaggttcttagattctctgtttctatacttaaaatgtactttcgttactgtctttcttgattttaatatattttcatgcttggtgggtttagggttctaaaactcatatgggaggcactatgcgcttaggatcaagaaaatccatcttcaatgtcaaagacagcaaatctgcaaaactgtaagaaccattcatcttatatttaacttcgttggtcctacagatgaatgctatagattacttagcatgattctgtctacctggttcttatagatacgagaacaaaagctttgtagatgagaggcatcgtcacagatacgaggtatggatttgtatacacattcatactaaccagtgaatatgacaaaagtggagttcttatacgcatacacaattctcgtaggtgaatccggacatggttgaacgccttgagaaggccggtctttctttcgctgcgaaagatgaaactggcaaacgcatggaggtctgttttaatctttaaaccatgctctagtttaaatccatttgcttccaatttaaatccttgactaatcttgtactgatatggcagatcattgaacttccaaaccatcctttctttatcggtgctcaattccaccccgagttcaaatccagacccgggaaagcttctcctctgtttttaggtgtgaagccttttcttaagttcagttatctgaactcaactcaagtcttttaaacaatcttttacacactcttcttattgcagggctcattgcagcatcgtgtggcgagttagacacagtcctgaatccagcttctgctcatcaacattcgattagtaacggtccaacaaacattttcatcaatggaacttccaagaaatctcccaatggcttggctgatgtaagatataataacggctactgcaatggcctctacactagatagctgcatttgctgaattctccctctccattagaattattgctttgtgttcgatttagtttggattttggtttgctttcttcttaataatcttaggatttttcctctgtacatatgatccaagcttttgctcagttttttttagactcttttaacagacttatgatctggaaagactctagaaacgtttgaaaatggcggtttgattcccctggttcgttttttttttccaccaaaagggatttcatatgatcttatgtaccgttggaacattttacatctctcgatttggtctgaatgtgtaagaagcatttgataaataaaactttaaacaagtctttataaatgacttctatgataaaaccgaatgagtaaatcaagagttacaataaaatgatgtaacgtataagacatttattcataatttcatatcaaaccaaacaatcagcgagaatgtctattaatcctaaccatgagtggtaaagaaatgaatatacacaatgcttttgcaatgaaagccttattcgctaatgaatcaaagtacattgtcttccttctttagaattaattctaatcttatatg

SEQ ID NO: 5135 - DNA, 3000 bp, Unknown
  misc_feature (1)..( 3000): cDNA_ID_1827616_gDNA_ID_1620765_Annot_ID_50101 3000 nt of promoter + ATG
aacaaagtcgttgtaaatttccacgtttatgcggacataaatcaaaccggtgggtccggtccgaccaatgctagatctcttacgcatgtggtcacaagatcttgatccagtaaaaaaataaaaaataaataaatctaaagagtaaataacttcgttgtaataaataaattctgctttcaattaaaggaaagtccaaatacggaactaattcacccacatcaaaagtggccagagcctatgtaatccggtttaaacaaatttacatccaatcgaaatcgttttaaccaaaagtaaatcaaaatataaaccataagaaaatttaatcaggtttttttttttgggtgcaataattaggtgttgtttacttatgtatagacaaattttattcgaaatcaaaccaagttagagtaaaataaactgatcacaaccgagagctttacaaaaatctttttataaaagtaattttgtttaaaattggatccaaggagaattattcgaaattagacgaatctttggttttctatacttaaaaattattttcgaaaatcatcacattcaatccaaaattgaaccaaaaaccggttgaacttctttgctttgaaagaaaattatatttaacaaattaattgtacaaatttctatttcctaaattatgtacaattaagatacttgaacatcatcaacaaaaaagaaagataagattagtgattagttaataccgttatagtggtccatctgagtggtcagagtgctaaagacaggccaataactcatatccccaaaaccattcaaacttcacatccaataggcgaaacagagctcatacatattttaactataaagtttactacatgtaattaaatctgcgtaatatacatgacttcttgaattaattgaataccacgatattattttaaaaagaaaacaattatcttttagacatactgtatctatactttcctgtaattcaatctcacctttaaatcaatcaacattattctcatttatctaattatattatgtatatattagctaacattttgttgtgtacaaagtatactaatcgtaaggatctttgtttaaaggtaagtgatacaaaagtatacgaaatcacaaaaccttaatcaaccaacataaaatcatgagaagcgaggagaattcatttttttgtgactctttgtcatggggaggttgcatgaattaaattattatcccatgcatattgttagatcatgccttgattaacgaagattgtcacgccttttttatatacgcacatatgcatgtggagtatttaaaatagttggcaaacaatctccaaggtcaccaaatcaccgaatttagtgataattcttctccaacgtaacactataatagacggtatactttttctttgggtgtttgtgaacattgttatgtcataaaaaaaaatattattttttttatatctttgattaagttttatattcaaattgttggttttcaaataaatgacaagtatactatcaatattttttgaatgttttcgtttctgtaatatcaaatttttaatcaaattaatataaaatgataatgtgcacaaatgttttcaaataaatatcacattagttaaaattaaaaatacattataaaacttaattaaacattaaaaacatttaattacaacatttaaaccaaacaaacataaaaaccaaatgcaataaggtaaatttaaaattcagcagttctaaattaattagtatttatcaaactattaaaaataactattattaagtattagtatttaataataaaaattttgtttttggtgtgagatttggtgtttatggttggagataaaaaaaatctgaacaccaaaacaccaaatttgatgttaaaatttggtgttttggtgtcaatggttggagttgctcttaaaccgattttgtttactattggttcaaatgtcttttggtttgaaaaaaagatcaagcaccaataaattattacatcaaatataattaattttttaagatgtatctttaaacattaagttaaatttagcacatttttttttgttataacatctcaaaagaattaggttatgatacgaaataaatcaatattttaaaacaaattagaaattggtatacaataaatttgctaagtacaattactatcatatgatatcacaaataaaactaataaattatttagtaatgattacattagtgattaaaataactttgtttacatcttcataatggttttatagaaggtaaattaactataaaaaatttggtcgtatccgcaaatatacagaaacaatccaaatatagaaaacacaatattataaaaataaaaaataggtggagggtttacattggggttttgagagaggcgcttctctgctgcaaattgcctttactgtgtttctctcttcccctttataaaaccgcttccgtcgtcaatggcgtgagcctaaacaagaaagaaaaaccattcttctctcttttcgtttttttcattctctctctctctactccatcgttttcacacttttctcgccgccctttatccttatccgataaacccacaaataaagacagactcttttgttctttaaacagagattgtaaatccagagccgccggaaaatacaaccgccggtttactctcaggtctctctttcactctctgtttctatctctggttcatactcttgtgtcttctgggtttgatacaaatgataatgcaacagcttttgctctatttgaatactgatttgaaccaataagtttttattttttaatctttttggtcatcccctgtttctgattctgcgataaagagatgttaaatctagaaaaatccaaattctctctctgttaagcatttctcaaaagcttcacgctttctcagtttctggtttctagattgttgttgactgattttggttggtgatatctctgcaggattagttgatattattcgattttaaaaatcagtaggaagaagatg

SEQ ID NO: 5136 - DNA, 3000 bp, Unknown; identical to SEQ ID NO: 5135
  misc_feature (1)..( 3000): cDNA_ID_3075789_gDNA_ID_1620765_Annot_ID_167313 3000 nt of promoter + ATG

SEQ ID NO: 5137 - DNA, 3000 bp, Unknown
  misc_feature (1)..( 3000): cDNA_ID_1827598_gDNA_ID_1620765_Annot_ID_50107 3000 nt of promoter + ATG
gcatgatttctccatctcggacttgatatcgtcaattagctcgaagcctcttagtgttttgctagccggagatcttctctctgtcccttcgtagtctagaagaacagacgcatcacatccctgaaagttgtgttaattcatgtacaaaaatgtcaagttgttatcttttaaaatgcataactatattagatatgcgcaaaacactcagatgcgtttatacacagaataaagtgcgcaagtccgtcttcaatattaagaaacttatatctatatactatcaatgttccaagtatggtctagatagacggaagaacaattctaatctctaatagagtaatagtgaaacccatttttagaacaatgtaaatcatatatgaatcaaaacattggctatatataattgaacgattaattgcaataccgtgacgccacaatcgtggaagataaggcggaggagggcgggaccaagggaagagtcactcttagtccattccctcactttcgtaacaacgattttctcaaaatctggacaaatcctatcataataattcaacgataataggttgtccaaagggaacaatgactttgtatcatcatcgtcatcgcctccgtatcctcccgctccaggtaagtcttttcggccagccgataccggccaagccacgagaactccgagtatgacaacgactgagaccacggccaacttcattattttgctttcttgatatctctctcaatttgattggctttgatgaatttgtttgatgagaggtgtgttgtgtagtaatttatatatacaattgggtttggaaactaatgtgatgcttttacgtgggaggcacaactttaagatttgaatattcgagtgacttgcctgcatgtcgtatataatgtttatgatatataatttttttttgatcaaatgatatatattaatagtataattttaaaaaacctttttacaagagaaaaaatgatataatgatctttacattactgaaatcagggttttgacttatttggattagattaattgtaaaatttatttgtcaacaacttccattgatttaattttgtttgttttttggtcggttatgtgagactattattattttattttgttgtctacaattaacatacgtatatatacactggatgatgacatcaaagtatgttttcgagtaatccgtaaagcaaaatgtgatatatcgaaattaacaaattttttgcacaatcattaataatgaatttgctcagatcctctaacaaaaatagcgatattacctctgcacattttttagcacggaaaaataggtccattagagacatgttgacaaaaaaaaaaaaacaattcaccataggctacgtttattgaaaattgatgcatctcaacaagttttcaaacgttcaaattttgagtttttttgaactatacaacaaattctcactagtcaaaaccttaaactttttcatatatttttctagtttttataatttatatttcttacaaataattgtagaaaactcaatttttgggtcatgaaaatcgccaacagtgtgaaaagaggccaaccaaaagcagttgattctctagaactcattgttaataactgaaatatatgtatgtaaactaatatttgctagaattataaaggagaaaagagtacaatcgaagtcggaaccaacgccggccggtcggaaaaatcacagaagaaaaatcgtatcaatcgctttttcaatcgtccatcttctttatctaccggataatacttcctaatacttaaactttaagaaaaaagattgtcagctagctatacgaagtgtggaagaatacattatcacatatgccgcaactaatataaacgatacccagttacctgaaatatatatacgaaatatatgtcgtatgtgccaatatcatagacactaagtctcgattaatcggtcgttttactctatcgttgactaatcgttaactcatcgggatccgaaaatgatcggttgtgaaccttattattggtttcaattatcgttattttgtatagagactattttttcttaaatcgttttataagagtcacaaatcacaactcgtcctaagttctctctctattcgactaacccaagcacgacattgaccactatgcctgggcctattgaccacactacaataaaatcgcacactacatgaaacttgggttgaacatctaattttctctaattaaattatttttactttgcttaaaagtttttgttcctgtcagttatacaatttaaaattgtttgttatctttagttcttcaatttgatttatgatgtggcataaaatccagaaagtgcatggttcccactcgacaacggctaaattcctcaacggctcctttttgactctagcatatttaggagccttaattattaaataatttaatcaccctttaattagtataacaatccaatgttaattttttcatgcattacacaattaaatgcttttaccagtataatgacatgtgttatacaatatctttcaaattcaattttgtccaaaattataagtagcttttttatttttctataacaatttatcacttttggccacataaggcttttctttctctgtattcttacacctcattctttattgccttgttttacagacacgttccccagtttaagggacaaaacagagccattttaggactcttaacatttataagtcctcttactaaatagataagcacaaatactgtttggttctgttttgcttcttcatcatcatcgtatctccaccgtttgtttgttgttgttctgtttctttaacaggaaaaaaaaacagagagaaaaatctgtctcttcactaacacaaatccattttctcttcttcttgtagagagacagagaaaacagagttgtcctctaacttctttcgatcgattcaaaaactctaatgattatttgattttatgttcgtttgttcgattcttagatcgtaaaaaaatg

SEQ ID NO: 5138 - DNA, 3000 bp, Unknown
  misc_feature (1)..( 3000): cDNA_ID_4359960_gDNA_ID_1620766_Annot_ID_50110 3000 nt of promoter + ATG
actctatagagtcaatttttctgaaagaccagttacagacgaatgtgaaagctatatatgctatatgatatatactagtatgaaataaatttgttgtcgtttcaggtaatttagaagacctgtataaagttgtacaataattttctatatcaaataacttaacatattgtaagataaacaataagtcaataacctaattcctatatgtatatatattatgtttttgaaaaattcaaatggtatatatacatgtttagatagacgtatggataaatacagtttcaaccaaattatcatattgctatagaagtgattgacaaacagatatgataattcattaaaataaaaatgcataggtaagaggtagaaaaatagatgcatacaaaatataagcatacgaataaaattttttgtcgtctttcttattgtcgtcttataataaacaaataaatacaaattctcttaattgacaaatacgaaaatggatatgtgctagctggaataatacaatgatataatcctttatagagatttatctgatacagaatcgaacgttaactcttccttttggtttaacaatttctatttcccccgaattctatcaaaagtgaagctagaaaaatccaaatctagaactagaaacaagccatgaatgtgtaaaaaataaaagtttgtgaactcttgttgatgatacactgaactgaaaaaagaaagacaaatggaggagagataggtgaagatgccatgcaaaaatgtccaaaaatatttttatttttaaaaatgtggaaagagccaaaaactttaaaaagaaatataggggtttgcatgcatatggccgcgcgtgtgtatcgcgtcatcctacgtttttagtcgtcgagtttaaattgtttggacaaaacctcttgtatcttccaatcacttccataattttaggagaaaagaaaaacaaatatagaaaatataatgcaaacccagggactcgcgttttccatggttttcggaattttgtgggctctttaccttacgaggagcttgagcttcaatgttttgattaaaataatagaaggcttcttgtaatataggattattggtcaacaaattcttattgtccaagatattaactgtttgactgagtctcaaagtggaattagaaacatcttattatgatatgtgggtactttctagtttcgacaaacatgtttatggctttcatctatcaagattcttcactctataattagaattcaaaagtagagttcactgtcagaattcaaatttattatgtgttttttttccgtggtcgagattgtgtattattctttagttattacaagacttttagctaaaatttgaaagaatttactttaagaaaatcttaacatctgagataatttcagcaatagattatatttttcattactctagcagtatttttgcagatcaatcgcaacatatatggttgttagaaaaaatgcactatatatatatatattattttttcaattaaaagtgcatgatatataatatatatatatatatatatatgtgtgtgtgtatatggtcaaagaaattcttatacaaatatacacgaacacatatatttgacaaaatcaaagtattacactaaacaatgagttggtgcatggccaaaacaaatatgtagattaaaaattccagcctccaaaaaaaaatccaagtgttgtaaagcattatatatatatagtagatcccaaatttttgtacaattccacactgatcgaatttttaaagttgaatatctgacgtaggatttttttaatgtcttacctgaccatttactaataacattcatacgttttcatttgaaatatcctctataattatattgaatttggcacataataagaaacctaattggtgatttattttactagtaaatttctggtgatgggctttctactagaaagctctcggaaaatcttggaccaaatccatattccatgacttcgattgttaaccctattagttttcacaaacatactatcaatatcattgcaacggaaaaggtacaagtaaaacattcaatccgatagggaagtgatgtaggaggttgggaagacaggcccagaaagagatttatctgacttgttttgtgtatagttttcaatgttcataaaggaagatggagacttgagaagttttttttggactttgtttagctttgttgggcgttttttttttttgatcaataactttgttgggcttatgatttgtaatattttcgtggactctttagtttatttagacgtgctaactttgttgggcttatgacttgttgtaacatattgtaacagatgacttgatgtgcgactaatctttacacattaaacatagttctgttttttgaaagttcttattttcatttttatttgaatgttatatatttttctatatttataattctagtaaaaggcaaattttgcttttaaatgaaaaaaatatatattccacagtttcacctaatcttatgcatttagcagtacaaattcaaaaatttcccatttttattcatgaatcataccattatatattaactaaatccaaggtaaaaaaaaggtatgaaagctctatagtaagtaaaatataaattccccataaggaaagggccaagtccaccaggcaagtaaaatgagcaagcaccactccaccatcacacaatttcactcatagataacgataagattcatggaattatcttccacgtggcattattccagcggttcaagccgataagggtctcaacacctctccttaggcctttgtggccgttaccaagtaaaattaacctcacacatatccacactcaaaatccaacggtgtagatcctagtccacttgaatctcatgtatcctagaccctccgatcactccaaagcttgttctcattgttgttatcattatatatagatgaccaaagcactagaccaaacctcagtcacacaaagagtaaagaagaacaatg

SEQ ID NO: 5139 - DNA, 3000 bp, Unknown
  misc_feature (1)..( 3000): cDNA_ID_1827675_gDNA_ID_1620766_Annot_ID_50112 3000 nt of promoter + ATG
tatgtccatttgataaactattaaatgagttactctagtgacatattcgcatagtagtatcttgaaatatcttttggttgtattaagaagttttcagacagaattctcacacactaacttgttcacatgaaaattaagaaaactatgcagtcataaggaaaaaaatatactcaaaataaaataaaagtatatcatgaacttttgaatcacttttttatttttagtaaagttaacatctatataacagttaccaggatcgaatatataggtatcgtatacacaaccgtcacaaaactgtttgtctagaatgtccgtccgtctagacaaacagtcatccaaatcattttgtacaacactggttagtaaatagcacgaattaagctcaatatgtatattcaaagtgaaggaaacatactctttcttatttataacgtgtacaatatatccatataaccggttgttacggaatgactttgtcaccaaacatgttcttcaaagaagaaagtgacgagaaaagtaaataaaacagtggagataatattagaaagaatattcagatatgtttatcttttaattctctttaaatattttaagtggattgttgaaatcttggcaagcttgttttctcgagattattatgatgtgtataagttttctttgcttttcatattcatttcccaagatacgcaatctttacccatcactgcttttgcttttgtaattgacggcaaatcttctttctaatcataaaaagtatataaatcgacatacctgtaacgacatcaattgtttagatcaaattaatattttttaaacatcaatattacaattacaaattactagagtacaagttaaaaatgctataagtaaatacatttctatattaaaagtgcgaatgaaacagtattttttcttaatgtcattttttattatattttaacattgatttggaacaacagtcacattacagtttgtttagctggcacattctgctttcttcgggagagcattgaacctgatccgtcgtctttccacaatgcccaagccggctaaattcattccaaataagtcatccaagtccataatcccttatctagtcgtttttcaaacagtaggcatcaccatatctattgtgttcagcctaatgttttggagacccttaaatttgtctaaactccacccaatctctcttgtgtcctttccttctttattgctttctctacagttgatccaaaagtatgatatatccaatttcttgaaaaccatttttggggaaaattttgaaaaccatttttagaattttacaaacacaagtaatatgttatttttcagtcaattttttactgtttgttttgattaaaattatgaaagaagcatacgatttctaaagaacacgacttgtcaatcccactcccatcatcgaagatgaacaaagccaatcacagggaaaaaaaatgaagaagaagagagctgcaatgtaactaacaaatcttcctaaaactgagtttgaatatctctctgaatcgctttagattgagatatttaataataataataataatagtaaaattcaagtctgagatgtaccatctattagacatgaaaaaatggatttgttggttacatactttacaattgtagaaacgaaatatatgatgtttttgatacaattaatcggcgatatagcgaaaagaatgtggtaatagcgataatgtagacacaaaattgttgcaaaaaatgaaaatgtcaatgaaacaatatttacgcattgttaaaacttcaatcaaacaaacaaaatatcaaacaagattttctttgtttcaccaaaatattaattttaacaaattgcatgtacgcttaaaactttaatatacttattaaatcttacttttatggtccttcatatgtaacataataacagtaaaagattacagaaacgtttaaacctaacaattatgaaagtttagaaagtgttataaatcttaaatgaggaaatggagcagctcaatgcactcaaacaagtgcccttgattagttgatttcaatcacccaagtagataagcacgtaaacataaatctggttattgccaatatgaaaaagaatgaattttcggatctgactcagatacgttttgcaagaataaagttaggcatttttgaaaaaacaagaaagccgtttaaatagttcttatgtaatactctacccaaagaaaagaaaaagtaactatggaacaaaattcccatatagaccaaaataaaatatatcataccataaatgattgaacagatcttattttcttgaaagtataaatatttttaatgcttggtgtgaaccgcaaatttttgtccccaacatttttagtggataaatatttctatgttgcaatttattatcattttctatataaataatatttccagcttgtatatgctatattctcgttactaaaaatatatgtatatatgtatgtacatatatgtatatttaaaaagttattattaaaaatctactactttctcaactatactctctttacaagaaaatctgattttaaagaaatttcacagttttctagatagcaaccaactttcaccaatcatacttaatttgaggaattacttacaaataaaatctttaaatcataaactagaagccacagtatctgttaaaataataataattgaatttaggatctgccattagtcgacgaattttcttgaatattcgtttctatgttaaaatggaagtcgtgttaagaatacaaataaataagtatttgttttgaaaaagctgaaaacatttttgaaaaagtaaaaatgactaaataaaataacaagaataagaattatcgttttaactccactgcttcctctgcagcactataaatatatgctttggtactctgcaaggttgttccgtatctctcaccaaaccatctctttctctctttctcaaaatcttgtttatttttttaataaaacaaagaaattaaaaagatg

SEQ ID NO: 5140 - DNA, 3000 bp, Unknown
  misc_feature (1)..( 3000): cDNA_ID_1827671_gDNA_ID_1620766_Annot_ID_50113 3000 nt of promoter + ATG
gtttacgtttttggcgggaaaattacggatttacgtttttggcgggaaaattatgagtttacgtttttggcgagaaaatcacggatttacgtttttggcgggaaaatcacgggtttacgtttttggcgggaaatttcaagtttacgtttttggcgggaaaattacggatttgcgtttttggcgggaaaattacgagtttacgtttttggcgggaaaattatggatttacgtttttggcgggaaaatcacgggtttatcttttttagtggaaaaattacgagtttactttttatcaatttcatcgcttgtatatttaagaaatttggaaaaatattaattttattaaattggtttaaatatgttggttaaacttaaattgacattggtttagagattttagttggtttaattcaattttacaaaacttgatgggttaattgggtaaaccattgaaaccattaaccattacaacccaactcattttactcatcaaaccaattgactcatcaactcatttggctcatcaactcatttgagtcaaaattttcaactcattagggttcatgggttgagttgagttgagttgacccatgaattttgacccattttgacatccctagccacatgtcatgataagtaatgattttagttttttcttttcactcttaaaacagtcttgaattaattgataattagaatttacaataaacttctttctataaaacatcaaactattaagagcacaggactaagatgatgtatgaaatgtaatgagcatgagatttgatgtatttggttttgtgtttacaagcatgagactaagtgatttgagtgttgatttcttagatttttttaaaattagcatgttagcattttgaatactactattgtactatgtcctcacttgggcaacaacactacctctggattcttaatttttccaaacaacattttttttttttacaatcaagtgttgtacaatcaatacaaatgtcatgtataagaagtagacttttaatcataaaaaagttcttacaaaattttggtaactttttaaatctgtttatccaaaataatttaatctttttaaccttttcactacaaaaaagtatatataaaaagcgggcatttttaattttaattgtaagttttacctttatacaaatacacaacaaaaaattatctattttaactatccaaaatggtcagctgttttggaccattaccaattgacaatatatattctacaacacttcaaataatttgacttcccctgaaaatataaaaagtttctcgccattacaacttgtaatctagtagttaatttgtgtcgttgtgtcacaagccaaattcaaacacgacataacaaatatttcttaagaaaaatacaaccctctcatatgtaaaacataattttaataacaacaaaattacaataaaattatttatttgtgctatgacttagtatcccatctccaacctacttcatcattttattctttcttcacacacatgcttcatcattttttggacctttttgtacatcaattttgttttataattttttttttaaagttaaaatctggactattttataaatatagttttgaccttattttttttgaactttttaaattttttttttttttgtgtaacaactgtgttttatttatttatataaggccaaataatacagagccaaaattaacaggtcataacactaaattaaaagaaaagcccaactaaaaaccctaaattgaaggaaagcttgttgtagacagcacatgaaacacgtatccaatggtaaccagacttctagacacgtgggaagtggaagagataggagtttccgttcactggcagaattgtgtgtcgtcgggaatcttcaatccgaccaaaatcaccagagaacttgatctatcgacaagtctcaaacttcgcccaaagaaatcatggcgagattccaattttagctttgatgagaatatgactctttgaatcttcttcttcttcttcttcaatcgacaagctttcaatcttcaattgcaggtcatcaaacctaaaaacgaaaattcaatcgaatccaaagtatcgatctttaattcagctcccaattacttcaacatgaactattaactaagagaaacatcaatccaacaatacaacttcgttcttaaaattttaaaacctagaaagcatgaagaacgaatcaagccctttaaacaaagaaggattgaagaattagaaacttagatcaatagaaagagaaaaaactagcgagagccaaagaaaaccaaaactaattggaaatcgaaagagtctaaagaaaaaaaacaaaagctagagcaaaagctagccaatactcgctagagagataagcgacgagatcgctagaaacagagccaaccaccggtgttgacaaaaccaccgatgccagaaacaaagccggacgaagatgctatgaaagccatctacgccggaagcaaagccaacctacaccactgagaaagctgatgcagaaagacgagaattgtgcctcaagcggaaccaacatcagtggagaataaccgccggcaaatcctgaacgaaaaaacttctttctctctgaaagatgaaagagagagaagagagaaggaaaccgaactttttaaaatataaagcctctttttctgtaaaagaagaaaaaaatattttgaaaaaactgaaaatacaaaggccctttaaatattttatttaaaaagtttgggtcaatttacactttttcaaaaacataatgggccttttattttttatctaaatgtttccctctgcccacgctatttgggccgggcctgcatatcccaactcgtgtcgatttcaagtttcaccgtcaatggaggatttgacgaaaagagactaataaacctaaatcttccccttcggcgttaaaccctaaaccctaatttcgtgctctgtatctctctgtttttgtttttttttgtttgtcaacaggtttcaatg

SEQ ID NO: 5141 - DNA, 3000 bp, Unknown
  misc_feature (1)..( 3000): cDNA_ID_1827667_gDNA_ID_1620766_Annot_ID_50114 3000 nt of
taagaaagaaagtagctagtgaacttaactaatgttatttagaggctaattgctcatgttactattatactagtattgtttattaccgcgatgccaataggcaacaaccataatctcctaaagtaatttttgtgatctttaatattaataagataattaaatataccgtatgttcatctttagataaaggtacaaatggagtgctacacgtcaagacaataagaaattaaattggactctctagatccgaaaaaaaaaaatgaaagagtaagaacttttttgtggaaattgttttttttttaatagaaaatttgtaatattataaaagttttgggggaatggaagatagagaaaggaagagcattaagaaaataggagaacatatggaaagttacaataaatacttggtacaaaagttgcagaaaataagtaaaaatatgatccagaaaagattagaggaagaaagattcttccaacgtagattcaaattattcaatattatacaaagggtactttggaaaatccacaataaccacataagaaaacatgcatcctcatctttcgactttctcacgttttggtgattggtatcttttttttcttcgaaccttccgtgtttgatttatcgccctcttgttcttttgtcccttttatattgctggtcctaatctgatgaagaaaattaatcaagaaattagaatgatttttctttaaatcaggatctttacagttaatgactgattatttctataccgttttggcgtagccttgctgggccggatacccacgaactgaatgaggagtacaagatatgttaatttccttcaaggttaaattagttaattacatgaatctcaaataaccaaaactcctatatatatacacacctggtgcaccagaggaagaatccatagttgagaaataactaaacaaggaattgtgagaagagtagattcgttaatgataagaagcttggttttgttttgaagatgatgctcgatcttcctatatatatatatatatatataattttctactgttttttccttagagacacgactcataattggtttgcaattttgcatacaaagtcaaaccacacttgtttattcataaaaatatagatttatgagaaagtgtactaccatatacaaaccaagaacttaacgtgttgagattatactcgccaataatctaaaatgatgtaatactctatttaatagtataagtttactacaaacgtttatccggattatcatatatgattgttttttagtaaatttgttatcttgaattgattattggggggcaaggtctcctgtaaatataacaaataaaacacgatatagagtggctcttaaactcttaagttagaaatagaaaaataataaagtgaaagactattaggtgagtagatgagagagtagaatggaaaatgtcggataacataaagaagaggaggtatagtcactccatgccgatgaaggatggtcaacgatgtatatgttaagttaagaggcatataaggtgaaataagtaaaaatgaaagtgttaagtagacgaaggcgtgacctagaagtggtctttggatgtgaccgaaataggtcggaagtacgtatgagtgaaaactaaaggaggttttgcgagcgaagataaagaaaggtgtttatgctctctagaataatcatgaactagtaactaagtgaaagtttggatccccttctcgttaaagaaagagttgtaccacgttggcttagtatattgggtttaattagacaaatccggatcatattcagattcatcgacttgtgcatgtattatgcactcgagtagttttcacctaccatctttgtctttatctccctataagtaaactagtgaatcccgagatgtaaggtgatatcatctctataccgtttgcagtgcaaaatgcggcgggtcagactatcactatgtggagcaaatatgatatatcaaccaactaacccttcatataactagagagatcttaaccggaaaaaatgatccgcagtttcatacaaaaagctctatagtttgttctttaagcagattaaagccagtcaatagcttttgattaagatttcaataaaaagagcaatttattttcctactttacttaaatgaattatttgtggaactttagtatctacggaagtgacgatgggacaatgaagtatggtgacgtatgacgattgttttggttagattggcaagcacacgtaacggaacaatccaaaatgatccaaaaatttaacaaaaataaatgtcagccaatgataatttattatattattcttaggttattattattgaaaaaactttaaaattcataatcttcctaaaattcacttaaatttatccaaatttaaaatccttcaaactaatccttaaattatttgtagctagccaaccaactacattagttaaatttaaatgcattgcaagctcacatgtatcaattatatataatgacatgtggtcaacatcacattaaaaacaaaaatattatgttttctgcgtagaaaaaaacaagctttgtggttaattttttttaatatcattttttatttcaataaatattttatggataaattaaaaatatgttaactccattagacttaacactaataacagctaaacacaaaaattgtaacatcttttgcaattcattgtaatgtttgcaattagtgggccttctttcgagccttcttatgtaccgaatatttgcctatttgggctttaaaacatattgggccgataaaaaagagctacaaaataaacagctaaacaatttttgatttaccatagttttttagtttttacccgacccggaaacaaaatccggcttttttcctccgacccccccaatagatctgactgaaatcaaaattttccgactctttctttctctcacactagtctttcattttcctcctcaactctgggcttgcttcgttctatgtttctccactgctaatg

SEQ ID NO: 5142 - DNA, 3000 bp, Unknown
  misc_feature (1)..( 3000): cDNA_ID_1827663_gDNA_ID_1620766_Annot_ID_50115 3000 nt of promoter + ATG
atccggcccagcaaggctacgccaaaacggtatagaaataatcagtcattaactgtaaagatcctgatttaaagaaaaatcattctaatttcttgattaattttcttcatcagattaggaccagcaatataaaagggacaaaagaacaagagggcgataaatcaaacacggaaggttcgaagaaaaaaaagataccaatcaccaaaacgtgagaaagtcgaaagatgaggatgcatgttttcttatgtggttattgtggattttccaaagtaccctttgtataatattgaataatttgaatctacgttggaagaatctttcttcctctaatcttttctggatcatatttttacttattttctgcaacttttgtaccaagtatttattgtaactttccatatgttctcctattttcttaatgctcttcctttctctatcttccattcccccaaaacttttataatattacaaattttctattaaaaaaaaaacaatttccacaaaaaagttcttactctttcatttttttttttcggatctagagagtccaatttaatttcttattgtcttgacgtgtagcactccatttgtacctttatctaaagatgaacatacggtatatttaattatcttattaatattaaagatcacaaaaattactttaggagattatggttgttgcctattggcatcgcggtaataaacaatactagtataatagtaacatgagcaattagcctctaaataacattagttaagttcactagctactttctttcttattttagttaatacgaagttgcctatgttgactaacttttaattattttagttaatacgaagttgcctatgtcgtctttgttaaggaagatggtttccagtacatatactataaaattttgtgatgatacaaaatttaatatttgttagtactatctatagcaaaattttgtacgtgatagtataaattacataagcggaaaattgtactattttttggcaacacctttcgtaactaaaatggttcaaaatttaaagcggatatacaaaatttacttgaaattaaaatgtataactaaacgagaaaaataagaaaaacaaattgcttattgctcacgaactccgttagtagacaacatacatcttcaccgattcagaacagtttgtggcaaatgctattgtcatcttttgttgatcgatcagacagtatataactgatcaaatgagtgcagtctaattcagattatatcggagagaggcttcttcgtttgttttgagcttctataatggatcacatatcttcaaagcaaaaccatttcaaacatgcaaataagtttgtgttttttttccaagaggcatctactagcatatatatagaaacattatatgctctaattagttatttcgttgtttgcttcgcagttcaatccgaactaaaaccaaaaatatcaatttggtcagtttggtttgttctggttttacctaatgctgagggctactggctaggtacacttcctcaaaaatttctattttatgaattaaaaagtatggactgtatggttgaccaaatcagaggcttctgtgagggaaaaaataatcacataattaatatctatatatatggtaacagcatcataaaacaaaaccaagtttcttatcattaacgaatctactcttctcacaattccttgtttagttatttctcaactatggattcttcccccgttcaaccaggaccaggtacgttcaagctaattggtacctgatgagttaagccaaaatagtttgtatattgcttttgattatttaagattcatgtaattaccttatatgaaattaatttatcttcttcgtcatttattcagttcatggacaggatgacaaacccaaaacggtatataacctatcacatacttatgaactgttaggatccagcaactatttgctggtttttagaaagatctgagaggaaagactaatcaatttcttgattattttccttcatcagattaacaccagcaatatcaaaggggcaaatattaagaccagcaatatcaaagggacacaagacaaaggcaccaaataaatcaagcacggaactcgaaagatgatgcatgttttcttgtctaattattgtggattgaatcatttggattgggttaccaaaaaaaagagagaataatttgaattgacgttggaggaatctttcttcctcttatcgttttcttcatatttctactttttatcattttatgtaacttttgtaccagtatctattcaaatgccattgaaataaaaatatggtttcgtattccaatgttgttttactcacatatatattaagaagactttttgcccaaaaaaaaatatattaagaagacttttgttttattctaatttttttttaacatatgtagctataaagaaaaactacaaaaacttgggaaactatataaacttataggattgaatgaattttcatttattcgatgagaatcatagtatattttctttctgtttattttattaatcataatttatttaaaatagtttgacatgaagtaaacttatgagattactattaattattaaagttttttaaaattaatttagtgaaacgattgacaacgcaccctcttatgcaagtataatatataatagataaaaaaatataaaattataaatagcgcactctcttgtgtaatttttatttttctaatcccaaattgccattttttaattcgaaattctctctttgttatcagatccacatccttctccaatttgtaatttttttaaaaaaaagacttaaaaatcctacttccatagctcatttacatccgtatcacagtaagcttgtgtttccttaattttgtgtcttaaatctcataagcataaagacgaacttttacaacaatttcttttttttcttcggtatctctttgatttttttttaactattattgatgttgaaaatataaagctcataagcaattggag

SEQ ID NO: 5143 - DNA, 3000 bp, Unknown
  misc_feature (1)..( 3000): cDNA_ID_1807318_gDNA_ID_1620766_Annot_ID_50117 3000 nt of promoter + ATG
cgaaaaaacgtaaagcaaaatagtacaatatggatcctgatcttttgacttgctcacttctttccaatcatgttctttcctttggttgttttctctcgctgcgttgttgttccatctacgttattaactattgtcgttttctctctcgtcactggttttgtcccttttaaattgcttttctgaagctgatgaaggaaaaataaacaagaaattagacaagacacttccaaaaaaaacccagcatcgagtcactagatcataaaacgtttatttatctaagtatatgattatatacccctttcaacgcggtccgacctgcatagataaacaagacatgttagtttcatacaaggtagtacttagttaatcatatataagttatttcagctatcttaattattcatcatgtacaaattagcccgaacgtacgtaccttcttcgcctgcagaattactggatgaagaatccatagatggaaacaactaaacaagagatcagagatatccgtgaatacgaagcttgttttttttattttatttttattttttaatgttcttaatttcaaatatatagagagaaaaattattattcttgttctcttagggacgacgccttgtaattggtctgctcacaaagcaaccgcacttgtgttttttgattcattgaatataatttatgagtgactaactaaatatttagtaaagaaagtgggaaaataatagtcaacaaattgaagcgttaaccttgccataaaatcgtcttttcattcaaaaagtgagggattaaattacataagaaaattacaaaacttttatttcataggccagaagtctagaaggtacgtaggccaatattctagtttgttcatcataggctcatcgcgataaactccatatgattaactgcaacactatttgttatgaatttccaaataatgtattttaattttgagctaggtttcatatgaaatcagaataacaaaatagtagtacgaagtacgaaaaagcaattttaaaaaacagctaaaaacataacaaaatagcagtaagaaaaagtggaaccaaaaagctgaaagtatcaaagccgtgttgctaatcaaacccaaaaacaaataatccacccttaccaaaaagacaaaacttgatagtattaattcacaaccatttatcaccaaaagtggggaaaaaccaacgagcatccttgaaaagttttgtcgaggaagtagttagatgttcaaactcttggaccacataatcgcttccgatttggtaaacgcaaatacggtcagcgttataaccatcgcgtagactaatcccacaacatctatgatactgatcattactaaaatatatgcaatctctcataactccatctttggccggaaccgtaattcctaaatccaaaagcaatgcctcgtcccctatagacttgattagtactgtaaattctgatgattttggatccatcttattgacagtgaagacgcatttagcctctggagaactatccattttaccacctacaatgatcaaaacttctccagacaaagtcacagcaagattgctgaaatacttcatatgaaatctatttacacacacagacgatccgaaacttgcacattccatttctactggagaaacaccaccggagaaatcaaaaacagtgagacattgatgtgcactaatcatgtaaagcttgctttctttaaacaccatatcaacacagccttgatgctttattggttgaagaactttccagctattgttgtcatctcctctcttgtgatgatatgctacataactagaaagattacaaaacacaaagtaatctctgcttttgtcatctacccacagaaccgctttgtctatttctatatggctaccgctaatgggtctcttgaatcgcatataccgttctccatcgattgattcgagagacggaagaagaatcctctctcgagtaaaaagattcaaaagatgaaaatcagctctatggtcgaacataaggaaccaactaccggaactcgctaaacaacgactcgtagacatatcaaaccctaaatctctgattatgtaggttttgttttcatgaggatcaaacaacttacatgaaccgttgttttcgacatttttgtttggaaaaagaatgatccatggagttgttggatttgttactccgatgactgatttcgaagcaacataccatgttgaagaaacgcatctcgctcgatgaaaatcaacgaagctcaagcgctccaagattaatctaactaggtccacgatataggccgcttcgaatcgtccttccatattttttccgtcggaatcgctcatctccttcttttgtgctatttcacgattttcaatcttagggtttgtgctcagagacgtgggggagaagatgagtcaataaagttaatgaggctattgggccattatgtaaaataggcccatatattaatgggtttcgttggattagaaatcttaacttgtaggaaaaaaaaaattcacgccggcaaaagaaaagaaaaaaaaaaccttcgccgtcgtttgcttagtcttcttcgctctatcccaacactcgatcaaataatcccagtgagcttcttccattccaaggtacgaatcgataaagtcatcaaacctataccttttcaggatttaatggtaattagtcaggatctaaatcgtttcttcgaatttgatttcggtgatctagaaccctaatttggtcgggaattttcaaatcaattgatttccctgccctaatttaatttgatgattgttctgtttgcctatgaataagtttgatttcaatggcaaacaaaaaaaagagagacattgatttgaatatttttacttaggtgcattgattctgcagattgtgttaatgtgtgtcactcttaatcttctgtcttatgtttttctcagttgataaggaatttgaagaagcctttgtttaatggaaagcaaaggaagaatccatccatctcatcatcat

SEQ ID NO: 5144 - DNA, 3000 bp, Unknown
  misc_feature (1)..( 3000): cDNA_ID_1827655_gDNA_ID_1620766_Annot_ID_50118 3000 nt of promoter + ATG
ctccttcttttgtgctatttcacgattttcaatcttagggtttgtgctcagagacgtgggggagaagatgagtcaataaagttaatgaggctattgggccattatgtaaaataggcccatatattaatgggtttcgttggattagaaatcttaacttgtaggaaaaaaaaaattcacgccggcaaaagaaaagaaaaaaaaaaccttcgccgtcgtttgcttagtcttcttcgctctatcccaacactcgatcaaataatcccagtgagcttcttccattccaaggtacgaatcgataaagtcatcaaacctataccttttcaggatttaatggtaattagtcaggatctaaatcgtttcttcgaatttgatttcggtgatctagaaccctaatttggtcgggaattttcaaatcaattgatttccctgccctaatttaatttgatgattgttctgtttgcctatgaataagtttgatttcaatggcaaacaaaaaaaagagagacattgatttgaatatttttacttaggtgcattgattctgcagattgtgttaatgtgtgtcactcttaatcttctgtcttatgtttttctcagttgataaggaatttgaagaagcctttgtttaatggaaagcaaaggaagaatccatccatctcatcatcatatgaggcgtcctcttccaggtcccggtggctgtatagcgcatccggagactttcggtaatcacggtgctataccaccttctgctgctcaaggtgtgtatccttccttcaacatgttacctccacctgaagttatggagcaaaagtttgtggcacaacacggggaattacagagacttgctatagagaatcagagacttggtggaactcatggtagtttaagacaagagttagcagcagcacagcatgaaatacagatgttgcacgcgcaaattgggtcgatgaagtccgagagagagcaacggatgatgggtcttgctgagaaagttgctaaaatggagactgagcttcagaaatctgaggctgttaagttggagatgcaacaagcacgtgctgaggcacggagtcttgttgtggctagggaggagcttatgtctaaagtgcatcagttgactcaggaacttcaaaaatctcgttctgatgtgcagcaaatacctgctctgatgtctgaacttgagaatctaagacaggagtaccagcagtgcaggtaatggttgtagaatggaagtttctgatatcactggctcccgacactcttcttatagttattgagtttgtcagcttttgtatcatcctcttatgaaggttgggatgaatttgattttatctgattctggcagggcaacatatgactatgagaagaagttttataatgaccatctcgagtcacttcaggcaatggagaagaactacatgactatggctagggaagttgaaaaacttcaagcacagttgatgaacaatgcaaattcagatagaagagcaggtatattgaattatttagttagtttctgctctatttagcttcattgttccacgaacttttttcagtaatttaagagttgtatctgtcaatcaaatgaaggtggcccttatggtaacaacataaatgctgaaattgacgcttctggacatcagagtggaaacggttattatgaagatgcttttggtcctcaggttcgtgagtttctctttgctagctcgtctttttgagacccattatagttttccacattagttgatttagatgtgcttgagctatatacgttttgttacttttgcagggatatattcctcaaccagtagctggtaacgcaactggaccaaattcagttgttggcgcagctcaatacccttatcaaggagtaactcagccaggatacttccctcaaagacccggttacaactttccaagaggccctcctggttcatatgacccaacaacaaggttaccaacaggaccttacggcgctccattcccacctggaccatctaacaatactccttacgccggtacacacggaaaccctagtcgcagatgagtccaccagctaagagtacatatataaataactcaccagctacagattccttcaactgtggaattgttgcctgtttggtcccataatctttatgggtaaagagaagttggtacagtggtgaacgttgagtgctattgtttaactgattttgttgagagcttgacttttgtgagacggttttcaacaagttttgtgatacagagagatgtaacatcgggaaagaaaaaacaaagaaagagaaatttgttgtttgcccttcaccattttgtctctatgactctatgtttcactcagttaaaaagtttacaaatgaatcgaaagttaaatttatctttgtaatactgtagtttctagttttagtttacttttgaagggcccattttattttttattttattttgtgagaagggcccatttcatatatatatatatattatttattttatttttggacagaatacgagttgttttaaaaaaaaaatatttttgaaacaccgtccgataaaattattgaaattttttgatatttttaaattcccgccagactcccatctaaatttcgcttctcctttagccatttgcttccattgtcacggacctgagaaagaaggggaagagagattgaagcaaacaaagagataatcgcagcaactttgtaccaattagaccaggtaattcttctccaataaagaaattgcaatttctaaggtttcattgttcgatttctgtaaaaaggtttttgatttctcaattcaattgctgaaatttggttcagttacctcgattttaagtttagggtttaccgattctggcccatttgatacgaaagatgtaagcttttcccaatattgaatccccttggctatataggggtttaatcgcacaatttgatttagaagaaattgttgcaatccccaatttacgtttttcatttgggtctgatatttgtaggt

SEQ ID NO: 5145 - DNA, 3000 bp, Unknown
  misc_feature (1)..( 3000): cDNA_ID_3074727_gDNA_ID_1620766_Annot_ID_167351 3000 nt of promoter + ATG
tgttattccatgactttgatagaacaagatgttatcaaaaacatatatttgttccggctgtgtttaaatatatttcaaagtatagggtgatcattgaaaacttgaacattctgtacatcacatacaattaaaaaggttcgaatagagccagaatatgtgtactgtgatatctagttaatcttaatgattataaacctttgaaaaatattttcttttttcttttgtcaacagctttaaaactttggaaaatcttactaactaaataaatatgaaaggaccacgtaacttagaacatctaactttttcttcttttaaaagacatagaagattagctaatttaatatcggaataattatgtttttcatatttagtattaaaataatacttttaattagtttgttaattttcttaattttatttatttaaacatataagtaaatctaaaagaagtcatcgaagaaaattataagtaaaattattttttaatttaataataaaatatttgttatgatcccgacaactgcctagtagttttgtgaggacataaaggagaacagtgtggacaggaaatgaaaaagaaaaaaaaaaagaaatatagaagttgaaaattgtacgtgatcttgaaaatatctcttacgacgcaacttatgacttatgattccatattcttaagattattttaactagttagaagcatgaaacatgtgtagttgtgtacatcaatatgcaaacagctatctcatacgttttttcttttggttacagatagccgtaaaaaagaaatatatatccatcaagttggtaaaaattggtgagttttctaattcttgattcgatcgtaatttgtgagttttctaattcgtgattcgatagtaatttgctttaaacaaaaactacggattggttgaaacaaaatcactccattttaactagtatttagtctgttgccgagagactttatgatttcgtaggctttgaactaaaagaagcagagagtcataagatgaatttgttggaggtaagtcctcggtcataaaccaagcacaagagggaacaaaatcaatattcaagttcttaatgaaattagggttaaagcttacaaaatcttagaattgtatatgtatttgttgtttaagacaggtttcattttttgttattaatatgcataattactagaaccaaaactctttttaatccagagaaaagcaaatgttcttgcaaactttctcgtaaaactgcttttcagtcttatgactcctattgatgctaccattgtttaagcttttggtcttttaaataaatacggttggtcaatctatatatttatcaaccatcgaagggtctacaaatcaacaagtcatctctgtaaatggattggctaaacctttgactactttgcaatttgcattcgattatatggttagatattccatgttatgaaactttaatttacattggtcaaataattatttgattttgggccttataattgttgcagtggtccttaatactattcatttactataattaagactagcaactgactttattttaattctgattttgttaccaagttaagcacaccatctccaaagttccaaaaaggtaaggaatttattattaagaaactaatataagcatttgattgatgcttcatgcgatcgtattctaatcatgattctaaattgtaattgattttattattgtacataattagatacgatataataattaatgtgtaaactcacttatgttaattttgaaaaattatggagtgtgtgtgttatatgtgtctataaaatttgttttcgtgttattttagggtatttcttttaaattattgaccaaaatcacttggctttgtctcaattgtgatcatgtatattagatgtgcaaaataacccttacttaaataattaactctatctctcgtggtctcatctaaatgaaccgcaaggatgctcgccgcgacatcaagtttatatcacttttcgtggagaacagctacgccacaacttcgttagccatctcgtggaagcccttaggcgaaatgcgatcaatgtgtttatagacaatgatcaagagcttagaggtgaagatatcagcattcttttgaagaggatcgagtattcttgaatctccattgttgtgttctcgagcaggtacacagaatcgaggtggtgcttgagagaggctgtgaagatcaaagactgatgtaattttaccttacttgcctttcttgcctgttggcacaatccattagtcaagtttgatagtgaaagcaatgccaatgatcatcgtcatgttacttaagtcatctcgtatcgttcgattcaaattagttgtcgtttaagtttttgaagcatatactaaaaaaacatttaagttttcagttgtcaattaataataataaaaaaaaaaggaaaatgatgatgggtgagttttataatagttacggtgaacttggtcacattggataatttgtcattgttcttgggcggaccaataaaagcctctcttttgaatcccccacacagatctatcgcctcttcttccctcgtgtctgccagaatttttgtttcccgttgataaaggttaaacctttcttcttcttcttcttgtttcgatttcaagttcttctctttcgtgacctacggtgccgtttcatattccctaatttgattgaaaagggttgcgcaagggctttgaagtgaaacacttttgattcttgttgttgcttcaagttttcatttttatcaattgggttttggagaaaacactatgagctgtgattgaattgtctagctcgaagaatcttgattttgtttacacagagaattggtttcttctttcttgatgatagtacaattggattctgaatgttgtgtagagtttttggaattgctcattggtgtatgcttttgttatgcagggtttatctttggtggatgattagtgaaactttttaaggagataatagttcacatgttttagttaaaa

SEQ ID NO: 5146 - DNA, 3000 bp, Unknown
  misc_feature (1)..( 3000): cDNA_ID_1827663_gDNA_ID_1620766_Annot_ID_167345 3000 nt of promoter + ATG
gatggtttccagtacatatactataaaattttgtgatgatacaaaatttaatatttgttagtactatctatagcaaaattttgtacgtgatagtataaattacataagcggaaaattgtactattttttggcaacacctttcgtaactaaaatggttcaaaatttaaagcggatatacaaaatttacttgaaattaaaatgtataactaaacgagaaaaataagaaaaacaaattgcttattgctcacgaactccgttagtagacaacatacatcttcaccgattcagaacagtttgtggcaaatgctattgtcatcttttgttgatcgatcagacagtatataactgatcaaatgagtgcagtctaattcagattatatcggagagaggcttcttcgtttgttttgagcttctataatggatcacatatcttcaaagcaaaaccatttcaaacatgcaaataagtttgtgttttttttccaagaggcatctactagcatatatatagaaacattatatgctctaattagttatttcgttgtttgcttcgcagttcaatccgaactaaaaccaaaaatatcaatttggtcagtttggtttgttctggttttacctaatgctgagggctactggctaggtacacttcctcaaaaatttctattttatgaattaaaaagtatggactgtatggttgaccaaatcagaggcttctgtgagggaaaaaataatcacataattaatatctatatatatggtaacagcatcataaaacaaaaccaagtttcttatcattaacgaatctactcttctcacaattccttgtttagttatttctcaactatggattcttcccccgttcaaccaggaccaggtacgttcaagctaattggtacctgatgagttaagccaaaatagtttgtatattgcttttgattatttaagattcatgtaattaccttatatgaaattaatttatcttcttcgtcatttattcagttcatggacaggatgacaaacccaaaacggtatataacctatcacatacttatgaactgttaggatccagcaactatttgctggtttttagaaagatctgagaggaaagactaatcaatttcttgattattttccttcatcagattaacaccagcaatatcaaaggggcaaatattaagaccagcaatatcaaagggacacaagacaaaggcaccaaataaatcaagcacggaactcgaaagatgatgcatgttttcttgtctaattattgtggattgaatcatttggattgggttaccaaaaaaaagagagaataatttgaattgacgttggaggaatctttcttcctcttatcgttttcttcatatttctactttttatcattttatgtaacttttgtaccagtatctattcaaatgccattgaaataaaaatatggtttcgtattccaatgttgttttactcacatatatattaagaagactttttgcccaaaaaaaaatatattaagaagacttttgttttattctaatttttttttaacatatgtagctataaagaaaaactacaaaaacttgggaaactatataaacttataggattgaatgaattttcatttattcgatgagaatcatagtatattttctttctgtttattttattaatcataatttatttaaaatagtttgacatgaagtaaacttatgagattactattaattattaaagttttttaaaattaatttagtgaaacgattgacaacgcaccctcttatgcaagtataatatataatagataaaaaaatataaaattataaatagcgcactctcttgtgtaatttttatttttctaatcccaaattgccattttttaattcgaaattctctctttgttatcagatccacatccttctccaatttgtaatttttttaaaaaaaagacttaaaaatcctacttccatagctcatttacatccgtatcacagtaagcttgtgtttccttaattttgtgtcttaaatctcataagcataaagacgaacttttacaacaatttcttttttttcttcggtatctctttgatttttttttaactattattgatgttgaaaatataaagctcataagcaattggagatgggatctcaagacccttgtatatacagagtgccaagccagttgcgtgaagtgaatccagaagcttatagacctcggatgcttctcatcggccctcttactcattccaagaaacctaaagttcatacggattcaaggtacgcagacatagcctggacgacctttgtagcctataatcaatttttttttttttgcatataatcatcttcttaacatttatttcatacaacgtatttttttttaatcgtaagaaagaaaaaaagaagaagaggacttttgttaagtttttggctgagttttaccctctttgttttgttagcaaaaaaaaaagtaaaaattctgcaatataccactttcagtttgctattgttcatatatttcgtacaaatttgtataatctatatatatgtaagtattcatctctattgttttgtggtacttttgagaatatctcaaaacataacaacgaaagtaacattaaatccggtaatgtcaggattttaattttgttccgagagctttttacgaactacattttacaatcaaattaacatttaaaccaaacaaaaacaatttgcagttatataaaacagaaaacgtaaacagattaatgagtctcttcaagaaaaagtttagtaaaatcttgattaaagtagaatccaataacatcaaaatttaacagagcttaataacatattgattgaataacaacaaattcttcataacattagaacactctgtaaatcacaaaccaataacaccactttagtctctttagctcctacttcatatcttttgtttaatgattaattacttacacaatatagatattaatgtttagatgctttattaggtatctagaatataag

SEQ ID NO: 5147 - DNA, 3000 bp, Unknown; identical to SEQ ID NO: 5141
  misc_feature (1)..( 3000): cDNA_ID_2144243_gDNA_ID_1620766_Annot_ID_167343 3000 nt of promoter + ATG

SEQ ID NO: 5148 - DNA, 3000 bp, Unknown; identical to SEQ ID NO: 5140
  misc_feature (1)..( 3000): cDNA_ID_3075821_gDNA_ID_1620766_Annot_ID_167341 3000 nt of promoter + ATG

SEQ ID NO: 5149 - DNA, 3000 bp, Unknown; identical to SEQ ID NO: 5139
  misc_feature (1)..( 3000): cDNA_ID_1827675_gDNA_ID_1620766_Annot_ID_167340 3000 nt of promoter + ATG

SEQ ID NO: 5150 - DNA, 3000 bp, Unknown; identical to SEQ ID NO: 5138
  misc_feature (1)..( 3000): cDNA_ID_4359960_gDNA_ID_1620766_Annot_ID_167336 3000 nt of promoter + ATG

SEQ ID NO: 5151 - DNA, 3000 bp, Unknown
  misc_feature (1)..( 3000): cDNA_ID_1827749_gDNA_ID_1620767_Annot_ID_50124 3000 nt of promoter + ATG
attatttgcttatgctctccagataaccttctgcaatgtgtttcagggaaagctgcaagatgggaaagaaattgctgtaaaaaggctttctagcagctcgggccagggcaaagaggagttcatgaatgaaatagtactcatctcaaaactacaacataaaaacttagttcggattttgggatgttgcatgtcgcccattagaagttgagagatgtgtgcagattggtcttctctgtgtccaacaccaacctgcagacagaccaaacacacttgaattgctgtccatgctcaccacaacatcagatcttccaccaccaaaacaacccacatttgtagtgaacacggtagttgatgaatcaccgtctaagaggttgatcactgtcaatgagatgacccattctatgatcctagggcggtaagagattatgtgatgaaacctgtagagtgaatgtgtgtttgattgttcacgaaaggaatcagttttcgaatgtatataacttaacctttcatgctttttgtaaaagatttttcacttaagtaaatagagaaaattactatagatgagcttccaatttggttgaccaatgatttactatagagtttgcatttccagttgttctccagcagaattgtctaatcttgtgaggagcttatctgcagagccaaatgagctcataattttgggtttccattggttagatactatcatatcctcatagtataaaagtagaattagtcaatgccttaaatctaaataagggagccatgattgaatttgcacgtattaaaagtgaagaagaaactcaagtccacaggagaaaagtgtgacactccaaccaaaacaactcataattggtactaacaaaatatttcacatagattccaaattttgattagtgtatagcgaaaaaggaaaaaactgggcttgttacatatcttcagctcaattcggaggaaactgatagatagtaattccaagacaaagatgttacatgagaggcttttgagtagattctaactttagattcattaaagtatttactaaagagcaatagtcataatattgagagaattgttttgatggacaataaaagctgaaagttaaatcctaagcatataaagaaagaatttgcatactagcaacaagacatgctaaacattgagggatcacaatacgtagttccttccttggaccggtatcgggatgtaacatctagtcatcataagctgttgctgatgctgctgctgctctagttgatattgctgatcatcagctcttcttccagtactctcctttctactattgaccaaatcgaaaatcaacttagtgaagacacgagccgtcaattcgctgtctgatccagcgtgatgagcttttccaacacgcctcatctgcaacacatccgctattctctgtagtccgaaacggctacttagtccgctgcataatccagccattttcttcacatcataaacaaaccttcccaaaagctgctggacggtttcatcaaactctttcgaagtctcgggtaatggttttctagttaaacctttaagtagataagctttgtcgtaagagccttgaaaagtcacccatctcatttttccatgtttctcattgagaatctgagaaaactccatgaagaactcttcgattccaataccttcttctctgatcttatccagatccaaaccattgttttttaaaaacgctatagatttatcatttttcaagctcttagattcgttgaaatctgacaagttgatctcccaggttttagtgattcctttgccgaatagcgttaaccctaactggatgagatgggtgttgtccacattgaatttcatgtctctataacgaatttcatcacttgcgtccatgggagtctcctttaagcatccgggaaactctgtgtcgatagcgatggaattacaatgtttcaaacaatctcttatcgaattcatctctgcttgcttgttccatctccaaacttcaccgctcatctcgaacgaaactaagaaactgtttgtttatctgaaagagaaagtgagataacaaatgaattttatttggttggcgttatattattagagaatttatagggattagattaagacaccgacttcagtttccttatttttaggatactataaagttttcattttttttccatcaaaagttcgtgttgacttttttgactcctaattcttgttaaacacgagttttcaatttttctcttaaaattcaaaaacaaaaaaacgcgtggttccgaagcggttttcaatttttaacactaaaccgaattaaattccttgcccgaaccgaattaaattctaatttctctctcaaaactcaaaagccttgtttccgaagcggtttacgatttcaacgctaaaccgaattaaattcctattacaaattaaagtctaattttccatcccgaaatacacgaaattgacaaaagactttattttaagtcttcccggaaggttcttctctgggttagtggcttgacgacacaagtcaagcaacctgtcatacactgacacaagtcaatcttgactgttgaattattcggctgcttttggatagtgacagttaagcccatatggttggagtacgaatcaatcgattggggtcattaaggtcttcaagacatcaccgaagctctgactttttgttatgcactgcaagtgttcgaggaaatgcctaaacgagataattcatagtctgcagttcaagaaaaatataggttcttctgggcctaacaagctagtaaggactggaacaatgaaaacgttgcgtatctgatacggtaatgacttcttcgtgccaatgtatctatcatgtatttattaaataatgcatatttttggaaaataagtaaagtagttctgacaagacacagtgttttttttttccccggctctcttgcttcatacacactaatccaaaaaagatagttattggagaaagaaaaaaacaaacaaacggggacg

SEQ ID NO: 5152 - DNA, 3000 bp, Unknown
  misc_feature (1)..( 3000): cDNA_ID_1827737_gDNA_ID_1620767_Annot_ID_50127 3000 nt of promoter + ATG
acgaacttacgatatatcgtgaaatacaacaaatctacactaaactgacggaattttctatgttctctttggtacattggttttggctggttttaaatactcttaatatgctcatttggcactgactcacaaattctaacccaaatttcagctcatatatcagaagatgcatggaggaatgatttgcaatcacaagacgtcccaggtttagaattttttgagatgaataccatacaaactgccaccagtaatttcagtctatcaaacaaactcggacatggtggctttggttccgtttacaaggcgagaaacgttttatcctattcgctctttttcttttctgttttttctgaagatgacatttgcaacttttttcagggaaaactgcaagatggaagggaaattgcggtaaaacgcctttctagcagctctgagcagggcaaacaggagttcatgaatgaaatagtactgatatcaaaactccaacacagaaacttggtacgggttttgggatgctgtgttgaaggaaaagaaaagctattgatttatgagtttatgaaaaacaaaagccttgatacctttgtttttggtgggttacatcttgcctctttcttgtaggtttcctctggaactgcttattttatagtttttacatggtatttttgcttaggttcaagaaaaaggctcgagcttgattggccaaagagatttgatatcattcaaggtattgtgcgtggacttctctatctccaccgtgactcacgcctcagagtaattcacagagacctgaaggttagcaacattcttctggacgagaaaatgaacccgaaaatatcagattttgggttggctcggttgtttcagggaagccaatatcaggacaaaactcgcagggttgtgggaactctgtaagaaccattcttcgataacatgataaactaattcccttgtcatgatagtcatatgtgaaactatgtgatgtttgcacagaggatatatgtctccagagtatgcatggactggagtattctctgagaaatcagacatctacagcttcggagttcttctgttagaaatcatcagcggagagaagatttcaaggttcagctatggtgaggaaggaaaagcacttcttgcatatgtaagtcagcctttatgttttcttgcactttccgattttgtaaaaggtttgttgctcttgtattgttaagatctgaaaccaatgcaggtatgggaatgttggtgtgaaacccgaggagttaatctcttggaccaagctcttgatgattcttctcatccagccgaagttggaaggtgtgtccagattggtttgctctgtgttcaacatcaacctgcagacagaccaaacacacttgagttgttgtctatgcttaccacaacatcagatcttcctctgccaaaacaacccacatttgcagtgcacacaagaaatgacgaaccaccgtctaatgatttgatgatcactgtcaatgagatgacagagtctgtgatcctaggacgttgaacatcaatgtgtgatggaaaattttagaattggaattattctccaaaggatcaaattttctaatgttgctaacttcaacgtagattatttcattatgttaaaacttaaaagagaagatcacatccaaaattatgcaaaaaggcttgttcaaagagaagagagaagagttggtcatttcctaaacttccaatttggttaaccaaagattatccagttcctgtttcgtaagcatctcttgtgttttacttcgatttcccgattgatcagtgtcattcgatcacagctcaaattaagctaaagacgagaaaccataccagtgaagaagaagaaggagaagagtagaacctgatcaagcatgtcctagaaaccataccagtgaagaagaagaaggagaagagtagaacctgatcaagcatgtccttgaaaatagagatttgacatagaatcgcacctgaattctcgatctccaaatctctctatctctctctcaactctcgtgcttacgcttgttttcaaattcaaaaacataatcgttaagagttgagttgggtgggggggggggggaataatattttactgggccttatgggcttatattggccattcgtattttggaccttttaatattcgaaaatacgacccgattcggaatgtgtttggttcggtttgtatttttttgtggtccggttcagatttcgagtttggatttggagaaaagcttgtgttcgaaattctagtgttgtagaattgactgttgaagtcgtcttcttctctccggcgaaactggcacaccaatattgactgtagaattcttcggctattttggagaaaacagtcacgcccagtcgcccagatggttggagtcttggagatggaattgggcactagtggagctctgaaagttttgattatgcatttcaaatgttcggtaaaatgcctgaacgagaattaatgtagtctccaattcaagacagctgttccaatgaatcaagtaacatttaaagacgagtgttgatgtttatcatttgcagattctggaaactaagagctggcgacaagaacatgggaacatcacgggatttttaatctgcggtcaatcaatggattcagacttgtgaaagttctcgtctttcgatatggttgcagagtatcggtggctatctttcactggttctcagcgcaagaagctaaacggacatggaaatgacaatgttgcgtatttgaatgggtaaaatagttggactttgtttgttgaagttatgtaactattttgataaaattttgtttgtattcattaaatagggtttaacttgatcctgtataaagataagtgtggttgatctggtcaacattgtttataggtgcttgaaaatagttctcactaagtccctctgtgtttttgttttggctttcttactctgtttgcttcttaaaataatctgaagaagatagtttttggagaggaaaaaaaccag

SEQ ID NO: 5153 - DNA, 3000 bp, Unknown
  misc_feature (1)..( 3000): cDNA_ID_1827733_gDNA_ID_1620767_Annot_ID_50128 3000 nt of promoter + ATG
agcaaggatctaatggacacaaggcaattttctgcagcaggagaacttctttccattcgtcttgcacgttctgagctaggtatgacttacaatataattcaaggaccttttgtatcttttgtaattatatcttccacttctttgatattgatgttttcgatagaagcatgacttattgttcaattcttatcctaaattcctcagatgtaaataagcgcaagatgaccattgttgctagtacagtgagcctgaccctattcgtgatctttggatttgctgcatttggtttctggagatgcagagtggaacataatggtaacacattgatgactttactatcgaacaatctctcactgttcatctaatcatttggttgtcaataaaattgctctgttacatttgttataagatatcgttaaataaaaaggtgttttttccactactaaattgactgacttgtatattatttttctggtacattggtttcggcctgttttaaaaactctgaatatactcacttggcactgacacacatattctaacccatattttagctcatatatcaaacgatgcatggaggaattttctgcaatcacaagacgtcccaggtttagaattttttgagatgaatgccatacaaactgccaccaataatttcagtctatcaaacaaactcggtcctggtggatttggttctgtttacaaggcgagaaacgttttatcctctttgctctttttcttttctgtcatttcttgacatgacatttgcaacttgtttcagggaaaactgcaagatggaagagaaattgcggtaaaacgtctttctagcagctctgggcagggcaaacaggagttcatgaatgaaatagtactgatatcaaaactccaacacagaaacttagtccgggttttgggatgctgcgtcgaaggaacagagaagctattgatttatgggttcttgaaaaacaaaagcctggatacttttgtctttggtgggtcacttcttacccctttcgtgtagttttcccctttatatctggaatttcttatctgatagcttgtatacttagatgcaagaaaaaagctcgaacttgattggccaaagagatttgagatcattgaaggtattgcacgtggacttctctatctccaccgtgactcacgcctcagagtaattcaccgagacctgaaggtcagcaacattcttctggatgagaaaatgaacccgaaaatatcagattttggtttggctcggatgtttcagggaacccaatatcaggaaaaaactcgcagggttgtcggaactctgtaagaaccatcccttgataacatattaaactagattggtagtcatatattaaattgggtgaaactatttgatctttgaacagaggatatatgtctcctgagtatgcatggactggcgtattctctgagaaatccgatatctacagtttcggagttctgttgttagaaatcatcagcggaaagaagatctcaagtttcagctatggcgaggagggaaaagcacttcttgcatatgttagtaagactttatgttttcatgcatttgcagaggttgcaaaaggtttgttgctttgatattcttaagagtggaaactgaaaaacaggcatgggaatgttggtgtgaaacccgagaagttaattttttggaccaagctcttgctgattctagtcacccatctgaagttggaaggtgtgtacagattggtttgctctgtgttcaacacgagcctgcagacagaccaaacacacttgagttgctgtctatgcttaccacaacatcagatcttcctctgcccaaaaaacccacatttgtagtgcacactagaaaagacgaatcaccgtcaaatgattcgatgatcactgtcaatgagatgacagagtctgtgatccaaggacgttgaaactgtagaattggaattattctctataaggatcaaaatttctaatggttgtaaaattacatcccttcctttattattcagaaactttttatctatgtggaaactgtttggtaaaattgactaaggtatattttattaggcatgattacatgattccacttcccactaaattgacaaaatactttgctcaaaaacaaatcgttgactctacttcattttaagacttcccgggagattattctcgggcctagtggcacaccaatgttgactgttgaattcttcggttcttttggacagaaacagttaagcccatatggttggagttgggaatcagtcgattagggtcattacgggtctaacgacattagcgaggctcggaggttttttttatgcactgcaagtgttcgaggaaatgtctaaacgagataaaacatagcctgcatttcaagaaagttattgtgttgtaatggtgaagcaaggattggattctttcgattgatgcagaactaataaggacttgaacaatgacaacgttgcgtatctgattgggtaaggacttcttcgtgccaatctatcatgtatgcattgtttctattattgatgcagagctaataaggacttggaattgtctcccactcattcacgttgttatttgtttagtgagcagttactttctgaacaccttttttgtgtatttaagtaaatgattgtctttgaatggaatagaagaaaatttgcagtaacttattctaaagtctttgataaccaaagtcttcttctttttgttcttgatagcattgaacaatgacaacgttgcgtatctgattgggtaaggacttattcgtgctttgacacttttgttctctattatcaaataacgcatgatttttggaacattagtaaagattattaaataacgcatgatttttgttctgtattattctcacaagtcagtccctgagttgacaaaacaaaaaatgtgcaaagagagtttttttttttttttttcttgctttctcgctttatgtaaagctaatctaaaaaagatagtttttggagagaaataacaaat

SEQ ID NO: 5154 - DNA, 3000 bp, Unknown
  misc_feature (1)..( 3000): cDNA_ID_1827726_gDNA_ID_1620767_Annot_ID_50130 3000 nt of promoter + ATG
aagttgagagatgtgttcagatcggtctgctctgtgttcaacaccaacctgcagatagacccaacacacttgagttgctgtctatgctcaccacaacatcagatcttccaccaccagaacaaccgacatttgtagtgcacaggagagatgacaaatcatcgtctgaggatttgatcactgtgaatgagatgacaaagtctgtgatcttagggcgttaagaaatgatgtttgatcttagggcgttgataacaaacttcaccttttattctttttgtaacatattttttgtatacatgaacctccattctggtgcaccaatgatccatggtgttgaagataatgtgaccagaaacactaatcagataatagattcatcatttcatcttccatgtaagccaaaatagagttcttcacatctaagttcttctcctccaacatccgaacttcgttgtcgagaaactctctttccaacaataaattcctgaattcactgtcttcaatctccctttgaaacccaaaacacatcttcacaaaaccttccctgtgtaaaaaaattccataagcaatgctttatcaatcagaggatcaagaacacaaatgcttgtttacaacacaatcgatgtttaccgcttctcggttagtcttgtaattagctcactatgctcatttctcaaacgacaaatctcatcctccaatagcttcagagagtttcttgaatcagctttaagaaaataaaacatagtgatagagatttaacaacacagaaacaaaaaacaaattcagaaattagaagcgactcaaattcagaaacctgtaacggagatcaaaccattgatctcgaactgagaagcaaggaacgatttagtaagctcagcttctttgacagacagagccgattccgtctcagaacaatttccgatctgtgattcgatctctcgcgtgacctgaatgtttgcttcgatttcccgattgacctgtttcattcgatcacagctcagattaagctaaagacgagagataccaatccagtgaagaagatgaagaatagtgaaacctgatcaagcatgtccttgaaaatggagatttgacatagaatcgcacctgaatcctccatttcctcttgcttcctcttcttttcaaattcaaaatcaaaatcgttaagcgcgctatgggaagataagcttttactgggcctgatgggcttttaacttaaatcacggcccattgagaccttgtgtttcgtcgcaaatcgaatattccgatctttcaatatttttggaaacacgaaccgaatatcggcgactttgatcgagatcgaaacaatggttgaatcggagaaaacgaaacacacatgtctccatcttgaaatctccggcgccgatccaattttcgtcaaaggaacatggtatcactctcgtttcgatatctccgtcaccgatggctccttcacttggacttgcaatgcgacggaggaggaggtagcggagagagcagcaatgggaccagcctgtatctgagtatttagagctcgccgagcaatacttagggtttcagcagcctaattcggtctatggtttctccgatgctattgagggatctaaacggctctcttggacgtttgagaaggaagggactaaacttgagtggaggtggaaatgtaaaccatcagatgatagcaagaagatcactgttaggattttggattttcttatggaggctaacataaggctaagtgaagaagttgtgaacaagacgagatcgtttgagaagatgaaaagtgaagctgagagatgtctcgcgcaaggtgaaaaactatgcgatgaaaaaacagagtttgagaatgcaacttatgcaaagttcctttctgttttaaatgcaaagaaggcgaaactgagagcagtaagggacaaagaagattcagtgagagcagttgaggaggaagagtcgacatacaaagctgaaagcttcgagagtggaagaagtgatgatgagcagagtggggaagaagcgtcagaaaaggcaacaagcagcaaagcccgtggcggaaagagagctgcacggagctaagacttagagattcccctgccttgagatttcaggtgggagattccattcagtgttttgtgaatctcatagctaggaaatgagagttttcgttgaaaaatcgctagaatctgtattgcttgtgaaagaaaatgcaatagacttggagataaagtaatttttaatttcggatccagtttggtttggttttttaatttccttggttcagttcagaatctggtttggtttttaaatttccttggttcagttcagaatcgagtttggtttgcaatctttcacgtgcgttcgaaattgtagaatgatcgtctcctcttctatctggtgagtcggtggcaatggtacaccaatattgactgttgaagtcagctattttggataaaaacagtgaatccctgatggttggcgttggaaatggccatagtgtgtagattggggcattattgtacaacggtatctctgaacgtttatgattatgcattacaagtgttcgatgaaatgcctgaacgagatttcacgtagtctccagttcaagaaaactggttctactgaaccagtgagaaagagtgttaatgtttaccattcgtaggttctgggtatatcaatctatggtcaatcaatgcgttcagatttgtgaattttctcatcttttgattggtgaagagtatatatataggtgcctatgtttcactggttctcggcgcaacaagcttatgtagtcatgaaaaatgacagtgttgcgttattgactgggtaaaaagttgactttttcgtggaaatgacgtaactattgacaaatttagttggttttattagatatggtttaagttgatcttgtatatcagaattttggaacaagagtactgtctggtctagtctggtcagtattgtatataggtgcttgaaaatagtcttacaagtacctgagtatttgtttcc

SEQ ID NO: 5155 - DNA, 3000 bp, Unknown
  misc_feature (1)..( 3000): cDNA_ID_2992534_gDNA_ID_1620767_Annot_ID_50132 3000 nt of promoter + ATG
cttggtatggaaccgggagctggtagacacagttcaatttttatctgatggggaatctctctcccttcggcttgcaagttcagaattgggtaggaatgaaaggcccttattacatttgaagtttcagctttctttatatgatgttttttccctctgcagcatggttttaagtttttgtttttctggtgattatttcagctggtagcaatcgaacaaagattattctaggtactactgtcagcctatctattttcgtaatcttggtctttgccgcttataagtcctggagatacagaacaaaacaaaatggtgagacacaggcactttgttctcactcactctctttccttgtcctcttttttaatctaactcggtaccaaatccgaagcaaattaatctcttcctcttcatctgatacacactacatttctagaattcttaagttgtgtcccaaggtacagtctcaggttgacagttcttttgggaagtctatatggtcagtttaaagctagatgtcctaacggttaatatgttcgcttctattgaaagtcaatgcttatgctaataaactgctacaaattaagcactaatacatgcacacttgttactcgtagaaccaaatcctatgttcatccacagttcacaagatgcatgggcgaaggatatggaaccacaagatgtctcaggcgtaaatttatttgatatgcatactatacgtactgccaccaataacttcagttcctcaaataaacttgggcaaggtggatttggtccagtgtataaggtaatgtatcattctgttctatttaccttttcttgttttcctattctgtattttcttcttctgtagatgactatgtgcaactattcttccagggaaagttggtagatggaaaggaaatagccgttaaacgcctttctagcagctctggacagggtacagatgagttcatgaatgaaataagactaatctccaaactgcaacataaaaacttggttcggcttttgggatgctgcatcaaaggagaagagaaactgttgatttatgagtatctggtgaacaaaagcctcgacgtgttcctctttggtcagtcctctataactctattccattgacctcttcgttcttccatcatatgagaattatgaaatgtgtcgttgtcactactatcactgatctgtactatcttattggatagattcaactctgaagtttgagattgattggcaaaagaggttcaacatcattcaaggtgttgcacgtggacttctctatctccaccgtgactcacgcctcagggtaattcaccgagacctgaaggtcagcaacattcttctggacgagaaaatgatcccgaaaatatcagatttcggattggctcggatgtctcagggaacgcaataccaggacaacactcgcagggtcgtaggaactctgtaagaaccattcttcgaaaacattctctacaagattcatagtcatgatattccatataggtgaacctatttgatgtttgaacagaggatatatggctcctgagtatgcatggactggggtattctctgagaaatcagacatctacagctttggagttctactgttagaaatcatcattggagagaagatctcaagattcagcgaagagggaaaaactcttcttgcatatgtaagttttttggtaaacttgcatatgtaagttaagacttaggtttcctacacttgcagagtttcttgctctaatattcttaggatgtgaaactaaataacaggcatgggaatcttggtgtgaaaccaaaggagttgatcttcttgatcaagctcttgcggattcttctcatccagctgaagttggaaggtgtgtccagattggtctactctgtgttcaacatcaacctgcagacagaccaaacacacttgagttgatgtcaatgctcaccacaatatcagaacttccatcaccaaaacaacctacgtttacagtgcactctagagatgacgactctacatctaatgatttgatcaccgtcaatgagattacacaatctgtgattcaagggcgttaaagaaacagtgtgtgatcgaaatttgttcgaatttgaagtgtgggttctgctcaggtaaattaaagtgatcaacttttcttcattaccttttaaaaatattttctctacttgtaaaagagtttgtactctttattgttgtccatgtgctcatgaagctccaatgttttcgttgacttggtcacaaactcaaacaaacaggtcatcatcatttttttattatattctttaacggttttataaatttaagataaacggtcgaaattaaaatcacaatggttaagttcgagtttttgaggcaattgtgaatttgtgagttcatttattcttcttctggtcaaagtttgcaacttttggctacaagcacatatttttctgagtcgtcgtcactgtctctgtctcttcaaagtcccacgatagttgaagtttactttgaatctggctcatctgaattatgcattgaatgtgttcgatgaaatgcctaaacgagaatttaaattggttttatcattcttttgttttttgctggtcttctaaggttttggatcttcactttgcaacttgcaaaacgtttgtcggtaatttccagttttgtgttgtccttctcgaagaatgcaaaagctcaacttcttggcttagtagaaacgagaaagttgacttatgagtaccacacgttattttctgtggacagtaaggttgggagattctttgtcaaggtcgtctattattttattatttttgtttctctctttgctggtcaatagggtattgtttagtacttgtaatattcaaagaagtagtgtgaaccaagatctagatatttaattatctcaggatacgttaacataaaagtttttttttctcttggtctcaatgctcactctatccccatgaagttttgctcatactcaagttatcttgcagagaaatagaaaaaag

SEQ ID NO: 5156 - DNA, 3000 bp, Unknown
  misc_feature (1)..( 3000): cDNA_ID_1827718_gDNA_ID_1620767_Annot_ID_50133 3000 nt of promoter + ATG
tcagaattgggtaaggataaaatacatttcttccgagattatgaaattcaactttctttataatgttttgtagcagcatgatttagcgtttttttatctgtttctggtgaatatctcagctggaagcagtcgaaggaagattatcgtaggcactactgtcagcctttccattttcttgatcttggtatttgctgcaattatgttgtggagatacagagcgaaacaaaatggtaagagactgagaaacttagaagctttctctctctctctctctctgttactctcttttcctctatatcgaaactgtagtaaaagacacttctatatatacacactaattagtctataatctgtcaaatcttgacgttaagcctttggttgttaaactgctacaaatcaagcaatacaacatgcacatatcttattcgtatttctgttgtctttgatactttataagatgcatggaagaatggttttgaacgacaagatgtctccggcgtcaatttctttgagatgcatacaatacgaactgccaccaataacttcagtccttcaaataaacttggtcaaggtggatttggtccagtttacaaggtatgtgaaattatgttttagttcctcaaatggaaagtttggtgttctctagataactttctgcaactttttccagggaaagttggtagatgggaaggaaataggtgttaaacgccttgctagtagttccggtcagggtacagaggagttcatgaatgaaataacactgatctcaaaattgcaacacagaaacttggttcggcttttgggatactgcatcgacggagaagagaagctactgatctatgagttcatggtgaacaaaagtctcgatatttttatatttggtatgtcttttattccatacatctctcgttattccttttccttccatcttatgagacatttttaatgtgtcactttcactaatctgttctactttattggctagatccatgtctaaagtttgagcttgattggccaaagagatttaatatcattcaaggtattgcgcgtggacttctctatctccaccgtgactcacgcctcagagttattcaccgagacctgaaggtcagcaatattcttctggacgacagaatgaatccaaaaatatcagattttggattggctcggatgttccagggaacccaatatcaagacaacactcgcagagttgtaggaactctgtaagaatctgtccacaacaacattcttaagaaaggatttatagtatagtcttatatattgacattttagtgaaactatttgatatttgaacagaggatatatgtctcccgagtatgcatgggcaggattgttctctgagaagtctgatatctatagcttcggagttctgatgttagaaatcatcagcggaaagagaatttcacggttcatctatggtgatgaaagcaaaggccttcttgcttatgtaagtgaaacaacttactgttttaacaatctaatatttcatcaaatgcagacacttccctgtttccttttctaaaacacttcttcacattctttagacatgggattcttggtgcgagaccgggggatcaaatctacttgacagagatcttactgatacatgccaagcattcgaagttgcgagatgtgttcagattggtctgctctgtgttcaacacgaagccgtcgacagacccaacactcttcaagtactatccatgcttacttcagcaacagatcttccagtaccaaaacagccaatatttgcagtgcatactctaaacgatatgccaatgttacaggctaattctcaagatttcttatctgtaaatgagatgacagaatctatgatccaaggaaggtaagcctaaggatcttgttatctcactacagaagtagtagtatatacttgtaaattcatgaacatttaaagcttaagattttgatatctcactctattttcttaagcatgtgatctcataaagccccaatattgcgttgacacgtcatcattttcggtataatattgttattaagcgtcgcaaagataaaaatatgctttttgatgacttctctggcattctcttctctgcattttataagatcatgttgatggaaagtcttcgactttggttacaagcgtcgatgcccagttggttagatttggatttctccgctatactttgtttctttgtaattaaaaaccatgttgcttcgaactttggaacgtttgggttatgcactgaatgtgttcgatgaaatgcgtgaacgagaatttaaaattcaaagttttgggcagtgggggcccaatgtttgaagccgcccatgaaaagtcatacctccactataggaaatcggagctagaactctgcactcttcttcaggtaagcttctcctaaatccaaagtctgttgctttcgatttcatatcagggtaacattctttcccaatgaattgaaaagttcttgtgttggtatttattccccaaatttgattaatctacagaggaaatagaacttttagctgcaagtaaaatgttgcaaaaacgttcttgtgctctgttactttctagaaaatggagaaagttttagctgcaagtaaaatgttttgcttttgtctttctgttactttcctagaaaatgtgttggctttatttatggttaaggcccagagatgggaatatacaaagttatcttctaaagcaacatggaatataaaactagtaaaacatttagttttttgacttctaatttggtgtcaccgtgtgattttgtgaatggaaagatgtgactctagtggtcaacgaggtctatgatttttctttccttttttatattgcggtcacgatggctttactagttattataataatataagttaggagtctccatagatataccatccaagaggtttcatattttatttgttctgttattgcattgactttataaagattcatacattcaaatccttagaagagctcttgcatatcgt

SEQ ID NO: 5157 - DNA, 3000 bp, Unknown
  misc_feature (1)..( 3000): cDNA_ID_1827714_gDNA_ID_1620767_Annot_ID_50134 3000 nt of promoter + ATG
attgaacaaattggatgtttggtatggaatcgagagcttgtggatgtaatgcagtttgttgctggaggagaaactctttccattcgtcttgcaagttctgagttaggtacggcattaagctgagcataaagtaattctaaaaaatttcgagtttcttcgtgatgttcttgtttgctgcagcatggtttacagttttattttatggtgcatctctcagctggaagcaatcgagtgaagattattgttgctagcattgtcagcatttctgttttcatgatcttggtttttgcctcttattggtactggagatacaaagccaaacaaaatggtgagacactgaaatgcgtagtagcccttatttctctgttttcttttcaatcagctacgttagtgtagcctttgaatgctaattttctacaatttagtactgacttggatacttgtaaatcatagattcaaatcctataccattggagacatcacaagatgcatggagggaacaactgaaaccacaagatgtaaatttctttgatatgcaaaccatattaactatcaccaataactttagcatggaaaataagcttggtcaaggtggattcggtccagtgtataaggtaaactttatcatgctttatctactctttttcttttgtcatcctctttcttgttcaccatatgactatctccaactgtggatccagggaaatctacaagatgggaaagaaatagccataaaacgcctttcgagcacctctggacagggtctagaggagttcatgaatgaaataatactcatctcgaaactccaacacagaaacttggtccgccttttgggatgttgcattgaaggagaagaaaagctattgatttatgagtttatggcgaacaaaagcctcaatacctttatctttggtcagtcccttattgtgcatatctctgcatctttccaattatattcatcatgtggaactcttgtacccttgtttatgtgtgaagctgaccaatctgtttttaatttggctagattcgacgaaaaagcttgagcttgattggcccaagcggtttgaaatcattcaaggtattgcttgcggacttctttatcttcaccgcgactcatgtcttagggttgtacaccgagatatgaaggtcagcaacatccttttagacgaggaaatgaacccaaaaatatcagattttggattggctcggatgtttcaaggaacccaacatcaagccaacactcgcagggttgttggaacgctgtatgtatctctgcctcctctatagatagataacaagcgtttacttgtttaaataatcaacctgaggaatttttgtcaaaatgaacagcggatacatgtctccagagtatgcttggacaggcatgttctctgagaaatccgacatctacgcatttggagttctgctattggaaatcataaccggcaagaggatttcaagtttcaccattggagaggaaggcaaaactcttcttgaatttgtaagccattgccctctatatcctccttgaatctgagtataaatcaaaatgtttctaataggactgtgttcatcgaatttgaaggcatgggattcttggtgcgaaagcggtggatcggatctactggaccaagatatctctagctcgggttctgaatccgaagtagcgagatgtgttcagattggtttgctctgtattcaacaacaagccggggatagacccaacattgcacaagtaatgtcaatgcttacaaccacaatggatcttccgaaaccaaaacaacccgtattcgcaatgcaagtccaagagagtgattcagagtctaagactatgtactctgtcaataatataacacaaactgctatagttggtcgataaaagcaatgatcacacatgtctacaaaagaatctcattgtaaattttagaggttttaatattcaaaaaaaggtgaccttggttattgtaaaacaacaaaacaaaaaccatttaatccttatgcacgagggatagagacagagatattacttcaacagtacggcacaaatctccaaaggcacgacgaatatttgtgttatttgagttttgacttaatcttcccaagccaatacaaatcgagagtgtggcttgtttctcacggcctttgaattcttttttatctctaaagttgttgtctttcttttatcatcaattgtgtgttgttgacattgtttctcagccaaagtttgagactttggatcgaatcacttatgcccagatgatctctgcatgattaatcacaatttctttttaaaaaattgtttagtcttgcactatttaaggtttgaccgcttctacaataagatatgcactgaatgtgttcgacgaaatgactgagtgagatttaactttcaaatattttgacttcgtgcggtttcttttttcaacagatttaccaaagagacatgttgaagcgactcgagaaagtaggtacattgaattgctcttaattgagagaactgtaagtaaactaaaatttgtgtactgtgttattattattaagctggcttatctaatagtggttttgtcattatatcactcttaggagattattcgagaaatggaaagcttatgtaacatccaggtaaattctgcaaatgggtcctgtttaattgtgttaatctctttcatggaatggaaggtgacaagtgtgaaagcttaaaagtatttttcagaggttggagaaaaagttgacttctttttagacttaatgcaattggaatgtttcaatgttttattgtttattctgtttaatattagaaaggaacatattgcattattgtaccagagagagagctgaactttgaataagtcaagttttgtgaacaaaagcttggtcaacttattaggtgtcttaagtagaagcagaccccatgaatttttatgtatatacatgaaacttgaggaagattgttctctcaattctttgagttcaccaaaataacgttttttttttgtcaac

SEQ ID NO: 5158 - DNA, 3000 bp, Unknown; identical to SEQ ID NO: 4948
  misc_feature (1)..( 3000): cDNA_ID_2994827_gDNA_ID_1620767_Annot_ID_167379 3000 nt of promoter + ATG

SEQ ID NO: 5159 - DNA, 3000 bp, Unknown
  misc_feature (1)..( 3000): cDNA_ID_3074936_gDNA_ID_1620767_Annot_ID_167378 3000 nt of promoter + ATG
atatacagaaacaagttctttccgaagattattttgggttcaagagaatcttgatgaagatcatcatcatcatcctctgcctgttaggaggaagaagatgggaagaatttttttgtcttttttggaagaggttcgcaactagttttgttagaaaagtttgttttgtttttgtttggagaagagagactaccagttttgggaatcaccccaaattagccgatgacaaatcttttgttaaccaaattagcaaatgtgctaagaatagtttgtgaaataaacaaaacaagacaattttacttggactatgattacaacccaaaaccctatatagtagaaacattaacctgaatcgcttcgctttatcgaggttgttggtatgatgccctgtgaactgaaaccaacagagacaagtcagtgtagaaatattacgcgaaatactcagctcaatccaacacaagttcccaaagttcatatatgatgcaaagtttaagtcattcttaaaagctaaaacctctctttgttaaaactgaaccagaagaactaagttatctcctttcggcctaacccgatgaagacctccaaaagctctcttctattaaacaagtctcagaaactagttctcatccctatttatataagcaaagcactctaagaaggaaatagaaaaatggaattactagatcgcttacaaaaactccaatagctctcttcttgtgctttagctcaagtaacatattctaaataatactcaaaatcacattctctctcagaaggtctgaaccaaagcctggtttactactcaaaagcagcaaaaatgttttttcatgtaaacaccaaaaccaatatctctccacaagattctaaagcctgtatcactcacacacatatctatctacgcttcacaacaacactctagatgtaaaaatagagacatatacacacagaaacaaccatcatatcttcaactttgtaacaccaaatgatccagtttttcctttgaatttgaagaacattcatttgttcctgttacttacctaagcgaaattcgaacaaaggccatcacttggcaagatgtgaatcgaacataagatcgttgattcttgtaatatcaatgtcagagattggatctattggcctgtcttccccattcttcatcaaaggaagaaaattcacatcttctctactgtagtcatctgtcacaacaagcaacataaccaaacaactcaatcaaactccgaaagtctaacaaaactgaaatgagaatcagtaactcaccaaacaaagtattgagagaggttggttttgaagtagacatgaagttgagaccaatgtaaaacaccaaagctactaacagagtcaccatcgaatacatcggcatcgccatggcccagtacttgctcgggtagtaataaatgcctatggactctaagaacttatctggtacatatccccaaattaagaagatcacagtggcaacaacaatcgaaatagatcctacaaaaccataaacctcggaagtttttggtccgtgtacttcttgattcaagcttaacattcttctcggactatattgcaaaatcgttgagaaattgacgaagataagcgatgtgttttttcttaagaaaagaccaatttgaaggacgagacttgctaacactcgaaacctcacaataagcgaatctttcaataaatcaggaaagatgcaatcgaaatctcaaatcacagattgcttaatcccaaaatgcgattatgaaaccctaaatcccactaatggcctcaaaatcttcgaaaattcatttacttttttgcaataatcagaaagttttgggaactagggatgattgggggatgggtgtagggaggcccgcacgaggtgagttctgcaaaagtaagcagcgtcaacacatcggccagcctataacccctccataaattattgcgccaattttgtgttttacgattagcgccgcgaccggttctcaccggacgctttgttttccttactcattagtttaaggcaagtattccagatgctgtctatcactttcttatagtagtctcgataggtctccaacgagttatagttccgatgtgggacaaaaataatacttacaatcacgatactcgttgaatgaaagctactctaataacaaatgaaagcccaataatcaattcaaggcccattttcaattttcttgcaaacatgagtctatttaacataatgcccaaagattttgcaattgtcgtggtactaatatgctaatttcgacatgggataacacacgatgaacttcatttattttatttaccattttttatttttattttattttatatccctaacaacgagtataataacaatatatttgagatctatgtaaagttgtgtatctcttatgaaattttattttattttaggaaaaggtaaactaatgtgggttaaattctagtaaattgaccaattaatttaactttcttaacattatctataatgtaataatacattttcaaggttactgataagtgattcacctaattgcattcgtagaattcctacatctcagtgatgatggaccccaatgagatgtagatgagatggacacaaaaaaaaaatgggctctaaagatcccagcttataaaattctgattaaacaataataacaattatggaaattttccaatagtgacatagaatcatatacaaatagggttagtgtgtaactggtggagtcattatgaacattgtatccaatcaacgaacatttcagtgcgagaaaaaaaaatgacaacacacaaaattttaggccatttcaagaatacaaaatcaggaacaggtcatagaattaggcattagaaccagctaataaacttcagaaaatataatctcccttcaatgaggtaaaagtcaacttttattccctctctatctgtctctctatctctcgtgcacacaacttttagaaagattgtctcgcaagtcacaatattcctaagttgaca

SEQ ID NO: 5160 - DNA, 3000 bp, Unknown
  misc_feature (1)..( 3000): cDNA_ID_1827683_gDNA_ID_1620767_Annot_ID_167377 3000 nt of promoter + ATG
ttataagtcccttcgggccccggagtgttttgagaatgttttcttcaacgttgtttccgaatgtccaaaaccctacaagggccacagggaagtaacagaaagctacaataatataggctacaatggctcccttccacatgggtcgttttgatggattttctggtgttgatggaatcgttgcttgaatttctaaaacaacattgtgacctgcatacgcaaaagccatctcccccaatgcgcctaagaaggctaatggcactgaggtgttgtttcttcttttatatccatattcaacattgttcgcgacaccctttgtcagtgaagctacccaagcaattgtggaatagctatgggaaagtaataaaacataggtcagagacctcaatgttatgtttgcacaagatatatgatatacgattttgtataatcgcgagaagtggtgttctattagcggtgttttggtcttttccttttaatattggttttgagagtattcttttttcacgttaggttttaagatttctttaaatgcaatgtatcgtggcctatataaggtatcttcctcttaatgaaagaaataacttccaacaactaacctaattctataagagagacttggcttaagaggaagcttaaactaatatattctctagttctaaggctggattactgaccacatgtttatcgaggttaatctaaagcacaagctcatgatacatagaaacaaagaggatgagattcacttacctcatagacatgacggcagctaccaaagagacaccggaaatggagttgaaatttttaagaagggaaagcacaaactgtgaagaggcaaagatcaaaatgaagtgtcgaactttcaactttctacactcgtagtctcccacagaaagttgatgaatctttttcagtgattcacctcctgtcaccatatacactatgcaagcacttgtctcaacaagaagttgaagcggcacgacgatgtacaaaccaagctttttgccaaaggctgcttgtcctagctcgtggtacctatcaaaccgtttcccttcaaacatttcgtgcatctcaatcatttgccagaacgtgtataacgttatgacccatgacaggatcaacaccacaactccaggtcccctgaaaacaaaataatttttatatctctagactgactcttaaaatataattctcaggaaaaagatatataccatccaagttctgacatggcgtaagggagaccaagaactccagcaccaactatggcagtgacgttgtggaaagctgaatagtaccaattagcatttcgtgatgctgtaattggaagccaatcttccagctcaaatgattgatcctgtaagtctcttagagttttcattcctcaaatttatatacgcaaaattatcatcttacggcacatcaagcttcaaaagcggaacaaactctctcaagaccaaagtttccaaattcattataaacatgatcatcacaaatagcatacctcaacaagatcttggtttaggatctggtttgacgaacttgggattcctttcattgtcaacttaggaatattgtgacttgcgagacaatctttctaaaagttgtgtgcacgagagatagagagacagatagagagggaataaaagttgacttttacctcattgaagggagattatattttctgaagtttattagctggttctaatgcctaattctatgacctgttcctgattttgtattcttgaaatggcctaaaattttgtgtgttgtcatttttttttctcgcactgaaatgttcgttgattggatacaatgttcataatgactccaccagttacacactaaccctatttgtatatgattctatgtcactattggaaaatttccataattgttattattgtttaatcagaattttataagctgggatctttagagcccattttttttttgtgtccatctcatctacatctcattggggtccatcatcactgagatgtaggaattctacgaatgcaattaggtgaatcacttatcagtaaccttgaaaatgtattattacattatagataatgttaagaaagttaaattaattggtcaatttactagaatttaacccacattagtttaccttttcctaaaataaaataaaatttcataagagatacacaactttacatagatctcaaatatattgttattatactcgttgttagggatataaaataaaataaaaataaaaaatggtaaataaaataaatgaagttcatcgtgtgttatcccatgtcgaaattagcatattagtaccacgacaattgcaaaatctttgggcattatgttaaatagactcatgtttgcaagaaaattgaaaatgggccttgaattgattattgggctttcatttgttattagagtagctttcattcaacgagtatcgtgattgtaagtattatttttgtcccacatcggaactataactcgttggagacctatcgagactactataagaaagtgatagacagcatctggaatacttgccttaaactaatgagtaaggaaaacaaagcgtccggtgagaaccggtcgcggcgctaatcgtaaaacacaaaattggcgcaataatttatggaggggttataggctggccgatgtgttgacgctgcttacttttgcagaactcacctcgtgcgggcctccctacacccatcccccaatcatccctagttcccaaaactttctgattattgcaaaaaagtaaatgaattttcgaagattttgaggccattagtgggatttagggtttcataatcgcattttgggattaagcaatctgtgatttgagatttcgattgcatctttcctgatttattgaaagattcgcttattgtgaggtttcgagtgttagcaagtctcgtccttcaaattggtcttttcttaagaaaaaacacatcgcttatcttcgtcaatttctcaacgattttgcaatatagtccgagaagaatg

SEQ ID NO: 5161 - DNA, 3000 bp, Unknown
  misc_feature (1)..( 3000): cDNA_ID_3075842_gDNA_ID_1620767_Annot_ID_167374 3000 nt of promoter + ATG
gtataattgatttgcattctggaatgtgttgtgttgttcacttggattatgtttttcattttccttttgtattccctaaaaagttttgcatcctgttcagactacatttttacacaatcaacagtttatccgtttaggtaaaatccatttgttggtttctctttcatctttcagtgtccttcttctatctgttgtttccagtatgtttgtgttgttcgattaagtgacagataagtcctaagctatctctagtgtagtggctttcttaatcttgttgcatgttatggttatttcttaatccttcttttttttaacttccctttacgttctcctcctatagattccctctgtttatgatctctaactagatttaagactcagttcgttttctccgctatcccttaagcatcaaatcaaggatttgaatatgcttcccctcagaaaagagatctaggaatctctacagagccaccacaaaaccatccgaaaccaattttaagctcttttccaacattcaaaaggatgaaaaggttattaatagaaattgactcttaccgtaaaacgtagattgcattgcatgatcaaaaacattcaccacaatcctctgtaaaagtctctgaaaactgaaacgtttattttcttgtaaactgtcttaacaaaacctttaacagacatgaaatttcataaagttataatcttaataaattctgatacaaagagagggtcttaataacatgtcccaagtcaaacacatcataaagctttgttttcttccaatgtttccatgtaccaaaaattggggaaaaaaagaatttcctctcctctcaaatttgtaacaatgagcttttatatgttcctccacaaaataagcagttttgaattcaagtgcagttcttgctggaacatcatcaaccacatgttttaaatcattcttgacaagctcaaattgttcgatgtttctaggtttagccgcttaagacactttttcttcttgataactttgttaatttttcattatccaccatacatcatatatatacactaaacttaaccatataacctatggttttatgcaaacctctaaactcatttactagttgggtcttatgtacatttgtggcccaaaagaccatttatacttaaaccgaagtcttcttcttctccctcaatcttggacgcttcttcttcttacgtcttctcttgtcaatcttcttcactttcccatctagtctcaatctctggttcctcaattcgaatttagataataatcatagtttgattccaacacaaatgtcaatctattcttttgacggtagaacattctgttttcagatgaacaaatccttgacatccataccactgtatgttcaacttctcatcttctctagcttcattccacactataaagctattggatatgcaaaagattcatgagggttccaattaaacaataactcaaaatgaaggtttcgttttcttcactagtcccttgagtcatcaaattcttcattgagtcatcaattttttcattaggcatcttaaaaccccccaattatttgcacctggtttcctcaatataaatcttggtgttcattttctaaatcattcacatctttgtcttcaacaaacaaagtctgtaaaatcttcttccatcttctttctctgatccagaatcactaaagacactacttctgaagcttagtgaaggagctgcagaccttggtcctttggagcatcatctactagttctaaccatgacgatacctacatagttaggtttggatcaacatttcggcggtcaaaggttggtgaactgcatcacttcgctgcatattcatgcttttcaagaaaagctattcaatacatcatcactggctagtatggagaatcttcatcatctctatgtcgaaagtagtcatgtctaggagatgtatagattgcaggaaagctaaatggactagtctaatttaaacaatccgacaattccatgctttaccagtcgtctctcagacgtgtttatacgtgagtgcataaatgatctggcttggcttctgtttgcctgcagattagatgttcagattatgtgtcattaatttttcaaaatttaaagaaagatgcgtattctactcttttaagttttaatgatcaaatctcacaaaaaataataatcttttcttttcctaagaataagttcagcttctttagatattgataagtaattaggtagatggggtgttagggatatttctcaatttcattcagttccacaattgtcaagtgtttttttttcttattttgcttcttcttcttctttagtgatgtgggttagtcataagttgttcactagctaaaagcagagtccatggcttcttcttatgttgttctccctttcttcttgtaatttggatttttttcattacttttcttttgcatttttttctttctccagtgtgttgttcacttggattatgtttttcatcatttccgtatcgtattacttaaaagttaaaacggattgaattaatccttttcaaactacatatttatacataatttcttttctagagttcaattctatatacaatttatttagttaaaagacttgatatcagagcgacaaaggacttaaatagttctaccaaacatgaaagatactaatttccaaacatgaaagaaagaattattcaatttttactctaacagtctacacgaaaatgaaagagttgtcattttgagaagtccttagatgccatattattgccagaaactaatttgtatggactctagctaccaaaaaaagaggagaaaaatcaaagtccttcatatggaaaatgggtggtctgaaaatcagtgacagcaatgtcttttattatcttctatctttctttgataatctcaacccacccgtactggaacaagatgttatctaaaaaacttcttcaccttcagctttagcttcgttgttgcttactgaaacttttctctctttacatcaaattt

SEQ ID NO: 5162 - DNA, 3000 bp, Unknown
  misc_feature (1)..( 3000): cDNA_ID_1827699_gDNA_ID_1620767_Annot_ID_167371 3000 nt of promoter + ATG
ccccaatccttgacttctggtatttcatgtaacccggcacttgcttgcacaacaaaattctctttctgtttcccaaaatcggaagcaatccataaagccatttcacgaaccacgtcatgcatcacacaatgatatatactaacctttgttagtaaattagcaagttctgtaccaacctttgttagcaagtttgcacgggtaagggtaccgagcatcgcataacccttattcctcgctctttttataacttggtcttctccgatgaatccttcgcatatcaatttgtctatcaaggtttcggtatatatctgaccatcttcaggaaacagagcacaatataggaaacacgacttgatatgttcatcccccaagctatcgtagctgtacttgagaatcggaagaattttgttttccatgccagaaaactctgcagcggatctagtcaaaacatcgattgcatactcccattcttgtaccatagttttagatgccattgtctcaccaatgacgttgagcgccaatggcagaccacgacatttttgagccacctctcttgccaaccccacaataacaggatcactacttaatgtgttgtctccgaccttgtttttgaacaactcccatgcatcctctggttccaaacagttgacttgcatcggcttatgatcccccatctccccacaaacttcccgagaacgtgtcgtgaatgctactttgcatttatttacttcactcggatagggaataccaatggcctctaaatccactttctcccatatatcatctagcatcaaaacaaatctctttccctttaaaactctgtgtatatcagtggccttatcactttcattcttgttcttccacaggtcgtcacaaaggtgcagtttctctgcaatatcttcttgaagctttgaaagctttgcgccttgagacaccacgatccagatcacaatgtcaaacgtaccacctatttcagcgaacttgttgtggattttcttgaaaagggttgttttgcctacaccacccataccgtgcagacccatgattccgactccatcttccataaggcggttccatgccttttcgagcatttcttcttgacctatcgtaggctgagtaggcctctcttcaacttcagatcttggaggtggctgagaaacttcgtcaaaatttccctccgattttagtatcttaacctcttccagtaacaagaatacctttttcccatatttgtagcttgaacatacatattttgtacacaaaccgcagagacacaacttttgaagctcaacgggactaacacttagcagatctttgcactctatatcaatgctattgacacggtcaagccatacctggacagcttcaagcctttgttgatggcgtgactcctctctcgctaccttgttctgtacctcatgttgagttgctctcagatcttccatttccctctgcagagctctgagattcttctcgagggttcgaatataacttttaccaattaagcaatcaaagatacgattcatcgtttgatcaccaacagcaatttgaaaagaaaaacaactccccatgatgatgagaatagagataaacttttagtaagcaaaaacgaggctaataatagtggaacaagaccactgcaaagttctgtggttacaagcgaagagaatgagaagaagaagagagaagaagagctaagtacaatttagatctggaaaaggagaacaagtgtttttaggtgaaaatattgactagcttctattttagcatacagtaaaatttatatcgttggttagtacaaaccattaaaacttttattgaataaaataaaaatacgaagctgagtactactacagtggagcttgacctgagactgcaataatgcgtgagatgtcgagttcatacctggggatttggaagctttccaggatgttttgggacttttcgtggcttatgatgaagagagatggaagaggaagaagaaattgagttctgtggtttacttatggctggtttgattattctccgagctggtttaagcgtaagtgtggttctgttttttttaggtcaatgtggttttgttattaaaatctggttcactagaccaaaccaaatctaagggttagaaaacgggtttatgactaccacatattaagcatcgtgaccaaaatttagtggtctaagcaaattgattaagttcctaatcctagtgtgaattaaactcaaacacactaaaatcagaaaaaatggaatcttcttctattagatcctgatctaagtactactagaacatctcgcttaggttgtttgcgtgttcttttcttggttttagttctaggaactgaaaatagtgacctattcttttttatttttgttcattcgagagagctcgaaccaacctttttctgaaaactaacttcatattaaaaagtaattagactaaatttaagtaaaacaaaagcaaattttatattgaaaaaagaagaagcaaatcatatgtatttgtatttggtttcttttatattcatcaaattttcagtttcgtttttcctgacacctatttaaatcaagtaaactacatgtgtcgctctacaatatgttcagctgtatctgatgatttatatggaaaacgttttatatagcaaacatgcaaacaatttctaaagaaataaataaattatattggaaagaaataacataaaatttaatagatatgtaattttttagaaaaaataaaaaatattcgtcaacataagtaaagttgttgttgagtttcttctaaatgcaatccagcatttaaaacaaaaataaatataaatgtttaataaaaattaccctttattatatttctttaaaaagacaaaagaaaaaaagaagaagcaaaatttaactaaatgtctaaaacaaaagcaaatctatagttgttcacaataagtgtgtgtatatatatatataatcttcatatatcatatcttatcaccacagaaaaatcaatccatg

SEQ ID NO: 5163 - DNA, 3000 bp, Unknown
  misc_feature (1)..( 3000): cDNA_ID_3075849_gDNA_ID_1620767_Annot_ID_167370 3000 nt of promoter + ATG
ttttttaacagtaaatcaagtactagacaaagaggcatttaaaaatagagctgcttaaataaaagaaatatagcctaaaattaaggcatagatagtaagttccatctccatggcagctcctcaagaacgttgtccaacgaagatatgcgggtggagatcactctgttaaaggtggatatgagattgtcagccggtgtatagtcacattggtgacgtctcccattgcgttcacgacatatataggtggtagatcgtaggttgaaaaaacggaggaaaacaaaagaccatcgccagtccggattagctctgtgtctgaggatactgagccatacagtgtagttagctaggccttttaaaaaaaaaattaaatttggataaagaaaatggaaagatagaaacataaaaagttgaaataacaaaaaaaaattggtaacttagaaaatttagaggaataaaactcacatgtgttgctatataagaccatctccaaggagaaaccaaaacaccatatttggtgatctcaactccaacgagactctataatggacgacatcttttttgttttgttgtttaatttggtaaaagttcacaaagcaccaaaaataaatcataactagattttaacccgcggtataccgcgggatgatttattttttaaaagtaatatatattaaaacttgtaaattttatttttataaaatatttatatttttacagtttataattattattaagtatttatatatattattttttattaaaaaataataaatcaaagatttaacctgtattgaaacggtgaattaattatattttactttttattaatgttgattcaaaaacccgtccctccaaatccgtcttgccaaaaagccatttattttattaatattaattttatttatgatataactctgaattataatataaacattttagctaataacataggagtgcaccatatttatttaataaggggaatgtaccatatgacccgaatgcacttttacccaaatccaccaaaaaagtcttgcaaaactactatagacccgaatgtaccatatttttttgtgctaatttttatgtgattaagatttaattgatttcgtatataaaatattaaattgttttacgaacttatttgtttataatttggtaacagatagataattgaatattcagtatattttgtttcagtttaggaaatctttaatgacccatctttaaatccaataagccctataattaagagatgaatattgtcgttaaatgattttggtaatcttaatgatgtcattaaaagattttgtttttgattaaatttttttaatggcattgtcatgtaattaattacaaaaattaaagttacatttaaaatgtacttcccaaataatatagtagaacgatatgcacttttatccaaatccaccaaaaaagtcttgcaaatatactatagagataagaaacgatagtcggttttgataggtataagattagcaaatatattagttcgcttaaattagttaaagaatataaattgaaaaggtatattacactttattcgaatatagtatcaaaacttatatagagatttgataaatttttaattgttgaatactttttttttgagcaaattttatgtgattaagatttagttgatttcgtatataaaatattaaattgttttacgaacttatttgtttataatttggtaacagatagatatttgaatattcagtatattttgcttcagtttaggaaatctttgatgagttgtctttagatccaataagccctgtaatctagatattaacttgcagtataccgcaggtaggcttatattttagttcaactaaaaacttttaaaaattcaaattatggcatatgcgaaaaaactctaattatttttctgtaatgatgatattatttttcggcaaaaatagaatcatataaagatgagaagtaaactataataattaataaaaaattaatatgataatttagatatcaaatctaatttgttgattttaattggttacttttttgggaattaataatgtatttcgtttttctaattaaattaaattaattaaaattcagatatcaaatcttatatgttgattttgattggttattttttttggaaattaataatatatttcgtttttaattaaatttaattaattaaattagtatttgactttttaatcctcaaagagataaattaatttactccttaaaattttatatctaatggcatacctatgtaattacttacaaaaattaaggttatatttaaaatgtacttcccaaataatataataggattttatttgtgttttagatttaattttatattttaattgttgttcgtttatcaattaaaagacaagtatactatcaatattttcgaatgtgtcatctctaaaagatatgatatggagccattcaaaaatttaccaaaaaaacaattaattttactggtaaataatatgacatatttggtcccaaatcctaattaaattctatgtcaatttaaatataatttattagtaaaaaatggtaataatatcacatatctggcaacaattcataatttaaaacaaaagaagaagtaaatctactattttgtcaagtttggaaagcaaatgtaagattaaagaaacaaatatttaaagttgttattaattaattatttgataacaatacataaaatatagattaaatcaaatatatatttttggagaaaaacatttacatataccttacatagccaaaaatatttttttctttattaagaaattcaatacttttcaaaatatatctgcatctaaacaacccagaaacaacaattgactaatataaataagtttcaacacacctgttttgctacaattgaaagcaacaaattcatactttgtaagaaaaatacatagccaaaccataattttcttttccgaagtaatctaaactagagaggaatccatcgcgatcaaaatg

SEQ ID NO: 5164 - DNA, 3000 bp, Unknown
  misc_feature (1)..( 3000): cDNA_ID_2135573_gDNA_ID_1620767_Annot_ID_167368 3000 nt of promoter + ATG
gatgggcttaataatggccaaacaagttatctcataactgataattatgtatgaagaaatgatcagttcaatgttgggccaactttttacttaagctatctaattggacttaatataaataaattgtgtaaaaagaaatgggcttaaggcctagctcacattggagctccgagagaagtcggatcgggttgaacgtgagactcggtctcctttgttattcacgatctttgtgaatcgggttttatggagatatcgtctctcgtaatgttgcctacctctcttggatttgtgggggattgtggttgattgattccacatcagacctaacacaaacttctatttaaaacccatatttcaagtcgtcttctttaatagattaagaacttgatcgttttacacacaaatagaattctccagcattttctctcttttaaaaagtaatttcgagagtattgtagtgattttgtttagagctctgttttcgagtggtgtgaaaccagtttagagaagttgtatcgtaagatccttgaatcacataatgtgttctctattatgatatcatatttgtattttagttattaattacaatttttttttaaaataaaattttgaccaaaaatataaacatattattttttaaataaatacctaaacttttcattgaagaatagtcctaggcgttaagattcggttcggttccactcagttttgattcttttcagttgtagattttatgatcaattagaatattttaatattttagttcggttttggttcagttcaggttttttggttttaaattttggtattgattcggtattttgttttgaatagttttagatattttggttatttttggatattttcatacatatatatttggttatttttaagtattttttcgcttttatatatttttgcatatttttgattatttcatctataaataactaatattttcgatatacaattgtcttttcaaatattattaggttcggtgaataatatcattcagctctttttgctaatttataataggttgataaaaaaaacttacaataagaaaaaaaattcttaactagatgtacctaaaattagttaataatttagtaagatcctcaactaatgggcatgcacacttttttcaataagagtttgggaataaaaatagagatatataataatgatcattaatctatgcatatttttggaccttgatttttcagtaaataacttaagtaaattatatatatgatatatcatacttaggtacaaaaattcaatactatatatatatataatttaatttaattagttttgtcaatttaattaatgtaatatttgtatctcttaattattaattactgttttattgagaaataaaaaacaaattgaccaattttaaaatatactttaaacatatccttacattagccaataagttagtaaaaatatgaacaaatggcatgcatatatttttttccataatattgtattttttcaataacattgtggaaacaaaaatagaaaaatataacaattatgcatgcatatcttatatttttttatttgttaaaagcttaatttggatcttgatataatattgacctaaaacaaaatcaattgcatatataccataaaaaaatgtcaaaaagactcaataagaatggattaaaatgaaagttaaccattgataactaaatcttaataaatgtgtcgtcattagtgtgtcggactgcaaaactgtggactgcgcatctgccgtcgctagtgtgtcggactctctgtttcacggtgtctccaggatataatcctcctttccggtgccaggttattattctccgatttgcatttttgtaactgtgtttctcgttgtgtattaccgtgatccaatcccatatttggggaaaacctttataaatgagaagtccatatttattaaaaaaaaaaaaaaaaaaaacttaacaaatggcatgcaaatcttcttattttttttcaaaaacaaataatggattaaaatgaagagttaatcaataaagactaaatctcaacaaatggcatgcaaatctttttatttctagtaatattgtaattttctccaataagaatgtggaaataaaaatagaaaaatataacaatgatatatacatataacatctatagatcttgatgatacaatattgacataaaagaaactaattgcatataccataattaaatgtcaaaaaaattcaataacaatggattaaaataaagagtaatcaataataataaataaattaaacaataatcatctaatttcttttggtcggtgataactgataagtgttagattatcaaagattgtgtcagtgactcgaaagatttttactttttgcgaatcctaagaacaaaacaaaaccgtgtgaggcgactaaaccgtcaaacgaacaacttgtcgccacgtcagcacacgaaccacccacgttggttcctcctccggctcaaagttcaccacgtgtctttccccaacggctagtttttttgtaagccgtcttttgcttaccagcaaaaagtaaggaagagagggagaacaacaaaatttaaaaaatttagatatttttttttgcttaggaaatttccagcattttctactttactcgttttcatttaaataataataaattgacttaaaaagaaaaagaaagataattaatctactataagtagagaagaagtagtagttcatttttctttgtcataatattaacaccaaaaaagaaaaattactcatttttctctcagcttttgttcatttcccacaaacatatactttcaagactcacatcaacaaatctcggaaaatcttcggaaaaatcttatttatttgtaagtttgtttcttgctcttaggttcacttttcattttctctttatccaattcctctgttttggggattctctgaaatttggggaaagatctgattttttgtacttttgctgttgcagattgataaaaatg

SEQ ID NO: 5165 - DNA, 3000 bp, Unknown; identical to SEQ ID NO: 5155
  misc_feature (1)..( 3000): cDNA_ID_3075855_gDNA_ID_1620767_Annot_ID_167365 3000 nt of promoter + ATG

SEQ ID NO: 5166 - DNA, 3000 bp, Unknown; identical to SEQ ID NO: 5152
  misc_feature (1)..( 3000): cDNA_ID_3075870_gDNA_ID_1620767_Annot_ID_167360 3000 nt of promoter + ATG

SEQ ID NO: 5167 - DNA, 3000 bp, Unknown
  misc_feature (1)..( 3000): cDNA_ID_3075874_gDNA_ID_1620767_Annot_ID_167359 3000 nt of promoter + ATG
ctcagggcagggcaaagaggagttcatgaatgaaatagtactcatctcaaaactacaacacaaaaacttagttcggattttaggatgttgcattgaaggagaagagaggctgttgatttatgagtttatgttgaacaaaagccttgatacttttctcttcggtgggttctttcttgcctcattcctttactatcggcagctttttttctctatatggaattgtcttttctgattgttttcacgctgtattgttgcttagattcaagaaaaaggcttgagattgactggccaaagagatttgatatcattcaaggtattgcgcgtggaattcactatctccatcgtgactcatgcctcaaggtaattcaccgtgatctgaaggtcagcaatattcttcttgacgagaagatgaatccaaagatatcagattttggattggctcggatgtatcagggaaccgaatatcaggacaatactcgcagggtcgtaggaactctgtaagaatctatttcaaaaacataattgactaaagactcaaagttataatcagatattaacttgggagaaactatttgatatatgtgcagaggatatatgtctccagaggatatattagaaatcataagcggagagaagatctcaagattcagctatggcaaagaagaaaaaacccttattgcatatgtaagtacgactttaggtatacagttgcaaatatctcaaatcgtttcttgcttttataattttaagatcaaacaacaggcatgggaatcttggtgtgaaactggaggagttgatcttttggataaagatgttgctgattcatgtcgcccattagaagttgagagatgtattcagattggtcttctctgtgttcaacaccaacctgcagacagaccaaacacacttgagttgatgtctatgctcacgacaacatcagatcttccatcaccaaaacaacccacatttgtagtgcactggagagatgacgaatcatcgtctaaggatttgatcactgtgaatgagatgacaaagtctgtgatcttagggcgttgagaaatgatgtttgattgaaactttagtctgttttgtaaacgattttttctatttatgaaaggtatattccaacagatgaacctccattttggtgcaccagtgaattactgtagagtaagaatttaccatggttaaagattaggtgactaataatagtacttagattcgaagccaatggctaaaagtttcatatttccagaaacactaatcagataatagattcatcatttcatcttccatgtaagccaaaatagagttcttcacatccatgttcttctcttccaacatccgaacttcgttttccagacgctccttctcagccaataaactcctgaattcactgtcttcaatctctctttggaatccaaaacacatcttcacaaacccttccctgtgtacaagtttccatataaatgcttagtaacttcaagattagacaaaatcaagaacaatgcagttattgatgtttaccgcttctcggttagtctttgtaattagctcactgtgctcacttcttaagcaacaaatctcatcctccaatagcttcagagagtttcttgaatcagcttttaaggaaataaaaccatagtgatcaaaattacgaatgtgaatattgaacaaatccttcggaaaatttagacacctgtaacggagatcaaaccgctgatctcgaattgagaagcaaggaacgatctagtaagctcaggttccttgagagacagagaagattcaatctcagaacacgctccgatctgtgattcgatctctcgcgtcacctgaatgtttgcttcgatttcccgattgacctgtttcattcgatcacagctcagattaagctaaagacgagagataccaatccagtgaagaagatgaagaatagtgaaacctgatcaagcatgtccttgaaaatggagatctgacatagaatcgctcctgaatcctccatctccgcagaaatcactctctgtctctctctctctctcgctcgctcttgcttccgcttcttttcaaaattcaaaatcaatatcgttatgagttaggggaagataagattttaccgggcctttatgggcgtttaccaaaatcggcccaatcggatttcggatctttcaatatttgtaaatacgaaccgactttttaatttatttcggatctagtttggttcggttcagattcgagttgggtttgtaatctttcaatatgtgcgttcgaaatggtagaattgatgatcgtcttcttctctctggtgacactggcacaccaatgttgactgttgaagtcagctattttggacaaaaacagtttcacgttgggaatggctatatgtactttcaattgtgtaatcggggcattagtgtcaaacgacattatgggagctttgagcgttctgataatgcattacaagtgttcggtgaaatgcctgaacgagatttcacgtagtctcccacttcaagaaagctcttccggtgaatccactaacatttaaaccgtgtattgtacgggtaaaaacaatgatttcagaaaccaatgtcatctgatttattcatataccaagagttttgatgtatatcattggcacgttctggatttaaagagctggcaagattatggtcaagcaatgcgttctgcatcgaaaaatttcttatctttagattggtggagagtaaatttgcacatctttcacttgttcacgtcatgaaatatgactatgttgcgtaattgactgggtaaaaaattggactttgtttgtggcatttacgtttccattgaaaaatgagtattttggaacattagtgcggtctggtcaacattgtttatagtaggtgcttgaaaatagttttgacgagtccctcgaagaaaaaaaatccctgagtgtttcttcacttggctttctttgtcttgttatatgttcgtttcttagttattagagaaaaaaaaatacac

SEQ ID NO: 5168 - DNA, 3000 bp, Unknown
  misc_feature (1)..( 3000): cDNA_ID_2135548_gDNA_ID_1620767_Annot_ID_167356 3000 nt of promoter + ATG
gttcaacataaactcataaatcaacagcctctcttctccttcaatgcaacatcctaaaatccgaactaagtttttgtgttgtagttttgagatgagtactatttcattcatgaactcctctttgccctgccctgagctgctagaaagccgttttacagcaatttctttcccatcttgcagctttccctaatacagattgcagaaagtcatttcgagaacataagcggaaaatacaaaagagcaaagaagattaaaattctccaaccttgtaaactgaaccaaatccaccttgtcccagtttatttgagagactgaaattattggtggcagtttgaatggtgttcatctcaaacaaatatgaacctgagacatcttgtggttccaaatcatatttcggtgcatcttgtgaagctagaatttcaggaatagataaagagataataataaggccatgaatatgaataaaaacaataagagatcgatatagagctagtaagatcatcagagtgttaccattatgtttaactctgtatctccagaaaccaaacgcagtagaacccaatatcagaaaaagagaaaggctgacaatactagcagtaatggtcttcttgcgcttattcccacctgagatataagacaaaaataaattgaacaactagccatgctgctaccggaacgaatagtatcaatggagttctagataaagttgtaattgaagaagtagctctttcttgatatcatttaagccgtacctaattcagaacgtgcaagacgaatggaaagaatctctcctcctgcagaaaattgcactgtgtccatgaagtcttggttccatattaagcacccaattccatgaatataagaaaaggccaagcaagaacagttgtggaggcaaattttgtagcatccttctgcatccacagcacttgcaaattcgtaaaagtctggaggctttatgttggcaactggatggaagaagtttgcatcttttttagttgagttttcctgacaatgtagtttggtacgcctcacacaaccatcagtccaatttcctcttttccactcctcaatatattttggtataaaccctttgaagcatttacacactgacttgacacaaatcccaaaaggtccacatacaccgtaataatcacatgagtgcgctggagccacaaagttcaatacccaatcagtcccactatgcctagaaatctccagtgaacccttcgatgttatcactatacgtggaagtttgaagtttctgtttaaataagtaagggatcctgacccgtttgcatcttgctaaaggcttaatggatttgtaaatgaatcatccattagtggtacccccgtgaaccttgttttagcccatggaccgcttctccaataaggcttcgagcctctcatagttaaagcttgtgttggcacttgcgttgtaatctgaagcacaaagtcaccaaccgctggattagtgtaacttttccaagaagtcaagacctgcttctcgccagtggcgaggttatacatcagagctgagaaaggaagcatagtatcaccaagatggtcaaagctttgccaaagagttcttcccgaaaaattgtctatgacaataagatttccggtgtctgaaagctctgcacgagacccgttagaagcaagagtttcaccactggaccatgcaacgccatgttttccattatataacagaagacttgcgttgctgctgatagcgagatttgctgtggaatctgtaacaggattttctctattggccacccacacaaccacccggggaatgattcccttgaaccagattccaagataatgattttccgagttattaaaactgaagaaacccaattcataaactccattagaggagctgagagtttgtcctattgacaaaggactctctttgtttatccctgcaattgcaaagctaaaacttataaagatggtattggtaaataagagcaaagaagcaaagaacgtgatcctcatcgtccccgtttgtttgtttttttctttctccaataactatcttttttggattagtgtgtatgaagcaagagagccggggaaaaaaaaaacactgtgtcttgtcagaactactttacttattttccaaaaatatgcattatttaataaatacatgatagatacattggcacgaagaagtcattaccgtatcagatacgcaacgttttcattgttccagtccttactagcttgttaggcccagaagaacctatatttttcttgaactgcagactatgaattatctcgtttaggcatttcctcgaacacttgcagtgcataacaaaaagtcagagcttcggtgatgtcttgaagaccttaatgaccccaatcgattgattcgtactccaaccatatgggcttaactgtcactatccaaaagcagccgaataattcaacagtcaagattgacttgtgtcagtgtatgacaggttgcttgacttgtgtcgtcaagccactaacccagagaagaaccttccgggaagacttaaaataaagtcttttgtcaatttcgtgtatttcgggatggaaaattagactttaatttgtaataggaatttaattcggtttagcgttgaaatcgtaaaccgcttcggaaacaaggcttttgagttttgagagagaaattagaatttaattcggttcgggcaaggaatttaattcggtttagtgttaaaaattgaaaaccgcttcggaaccacgcgtttttttgtttttgaattttaagagaaaaattgaaaactcgtgtttaacaagaattaggagtcaaaaaagtcaacacgaacttttgatggaaaaaaaatgaaaactttatagtatcctaaaaataaggaaactgaagtcggtgtcttaatctaatccctataaattctctaataatataacgccaaccaaataaaattcatttgttatctcactttctctttcagataaacaaacagtttcttagtttcgttcgagatg

SEQ ID NO: 5169 - DNA, 3000 bp, Unknown; identical to SEQ ID NO: 5163
  misc_feature (1)..( 3000): cDNA_ID_1827703_gDNA_ID_1620767_Annot_ID_50137 3000 nt of promoter + ATG

SEQ ID NO: 5170 - DNA, 3000 bp, Unknown; identical to SEQ ID NO: 5162
  misc_feature (1)..( 3000): cDNA_ID_1827699_gDNA_ID_1620767_Annot_ID_50138 3000 nt of promoter + ATG

SEQ ID NO: 5171 - DNA, 3000 bp, Unknown; identical to SEQ ID NO: 5160
  misc_feature (1)..( 3000): cDNA_ID_1827683_gDNA_ID_1620767_Annot_ID_50142 3000 nt of promoter + ATG

SEQ ID NO: 5172 - DNA, 3000 bp, Unknown
  misc_feature (1)..( 3000): cDNA_ID_2137064_gDNA_ID_1620768_Annot_ID_50143 3000 nt of promoter + ATG
gcaggttcactggattacattcgcatgagactccaaattattgaatgccaaattattcagtaagaacttctgcaggttgtagctattttttaatatatgcgactacaagtgaatgttcaccacagatattcactacctcatatgcagctccttggccaccattgcaagccaagtcctgctctgtttgtgaaaccgtcatcagtttccttgcttcaactagcttgctcatttcagtaaccagagttacatgctttgaaacgttgccttgcatctttttgtactcagggtagttgtcaacaaatctggccatatcctctgtacaaccaacgaattcacagatatataattgtcactagcacgagaatctgttgttacaaaagtttttgcagagaatagtttaagactagccatatttgtacctactgtctggatattttggttactcttggccacctgctgaaagtcatctaccattcgcttgatgttcattccaatatccccaaaattttcatacatgttagatttgaaaaatgcatcttgttctgatgataaaaccacctcctgccaggataagagacatattagctgtaaggttctcaactaaaaaacaatggcattggagaaaactaaccacttgctgatcttttggaagacttccaatggatttcaagtccactttattatcttgaagtcctatgagttcgtgcaccattgcctacagaaaatctcgttaattagtaagtcgtagtcttacaaaaaagcaagacagcgggaggcacatcttatatcatagagtagcacaataattttgtttagtcaagttacctgatatgtccactgattcagcaatggggtaaccgggtcatctcttctgtcaattacaagtagcaacggagagctttcagtccgtctaaagtcaaaaagagcgctttcatgctgatacatcaatttctgaaacataaacagcgaattttcagactattggatagacacaagtgggaattagttccatcacatgcatgcaaaatatagcgggaacaaataactttacgagagcttgtcaaacaacttcacttacagctgtttcgtgtgcaatcctttttgcagtatcagaggtcctctgatatctgatgacaggtcttcgtttcaacgccagaaacactgccgcaattccatcaacaacccgatcggaaaagcgttgcaaaccagagggatcgacaactgcggggatcatatatagatgatttgatgccatattcaatgtgaaatgatatggatcaccagaaacaaagtctgcataatactcctgcaatataaaaaaccacaaagactatgttaaacaagccattatacagtactatgccgagtgcaccaagcaatataagtttaaatcagaaaactaaagacaggtaggggggatactaagctccacaagtatggccgtttcatcacaaaccaagcaacttctcagagacagctaaaaatctatacatatattgatccatcatataggctatgaaacattcttttagcattagcctcctattcaaaaacatcatggatgagggaagtctaaaaatcacctgaacttgctgtacaacttcctgctcatcggaatcagccaaaatatgaatctgagtatccttcaacagattggagaaaactgaaagaattcataacaaaaacaacatcaaattttgtatattgtgagtgaacaatgataaactcgaaatagttagaagatgaaaaaatcatacataaatggtattctccaaatctaggattcgcaagctggtatcgtaatttctgaatattatctgaagttggacggatgaaataaacagctttcagatgtgacatcgattcttttgacacagatattgaatctatcatctccaccagaaacacttctttctgaagcagctctgactgtgaatacacaatgcttacattgctaacctgcaaattcaacaattaatccaataaacaagtaatcacgaagatgtgtttccggttacaagggaaattatgaaccacgattccagaaacaaatcagagaagattagcaatcgaagaagacgagatcggactttaccgtttcggagtcgagtatgagaaccttcatgccggagatgtcctgaagcatccggttaatgtaatcacgcacagacgtaaccaaaaccatcgtttcaccgcaaaattctgctactgttacgacgttgattcagatctacggcgactaatctgatgattcttgttaacaataacgctggcgaagtgatttcgcgttcactttcagatcttcctttccttaatcgagaaaactaaaaggtccccagactcgtcgactcatacgaagaaaagtgtttttgcaaaacaaaccctatattttattggttattcctcttttcaacacaaacttaatttttgattaactgaacctaatttgagggtttatttattaagtaataaaacatcagggttttacaaaggaaacatctaatagatcaggatttttccgcaaaaaaattcaaacttaacattgacccatcgtgttgattttgttccgatccgtccgctaatataatataatttggattagcgtcaaaaacgtgtgattattgtaatgctcgatgcatccagcttcatgtagtctctcactcaggaaagtcaaacttaatattcttacagtgagaatgaagctctcttctgaaagtcccatggcgccgtcaagtcagtcaagtcatcgactttacatttccaggtaagtctttttctcttctacttcatcagtttcttgagttcaatggaaactactttacctaacttaggggaatcagataggatcatagatcatgagagcaatgtggttgagtatgtgcattacagagatctgtattcatctgttggcttgacatagtgcatttgttttacatatatagtgagaaaacaaaaacgaagagattccaaagaaacggatacactctcgatgttgaaatg

SEQ ID NO: 5173 - DNA, 3000 bp, Unknown
  misc_feature (1)..( 3000): cDNA_ID_1827819_gDNA_ID_1620768_Annot_ID_50144 3000 nt of promoter + ATG
gacgaagactaactttgagaacgagagtcgatgtcttgactccatgggacttgaggaaggtatcatcgtctccgtaagaccagggtcggtttcgagaatttcataatcgcctggtaaacaacaaaagacgagacattttagggatttgggaaggagaaattaatttgattttggaccaaggcacaaaacggtgcgtattaggaaaatgagatttttagaagtccgtgttttgcaaaacgaacctttacttatcaggtatttgttattttaacccctactctaatgtttgaataaattttaaccagaaaacgaaaatcacacacagtagtacggttttacgcggtggaggaagaatcagcagcgacggtggagttggtctgagtctcaccccaatgccaaagcatactctcccagaaacagaaatcttcaaaacaagtcgtaagtctcttatctttgatcttaatcctccaatgtccgtctctgtaattcgctttctcagcttgtctccgatcccactcaagttgcgccttttgtttcgaactcagtagacaaaacctctgcaatttcttaggcatcgcgtcgtgcactctccaccaagttttgtgtgcttcatcgctcgcgaattgatggtatccaacgacattccaattgcaatcgtagtctctgaagcatacccatggtttgttgtaacctaggtaatgaagaacgtagagtatcggaggatcagctccaaatagtctcgtcttagatttcctgtgcttaggtgtgtctccttcccagaaatgcttcaagaaattcatgtgttttggaatccgatgccaccatgtgaatatctcgttaaggtaaccttggtctcctccattgtaggaattgatatcgttgatgtgatccattagtaactggaatgttgaatttgatggttcaatcaccattagaccggagttgaagagcgtaccgtcgtttccagttgtggagatttcggggtactcgaagaggaaatccatgtttctgaggataagcatgtctgcatcaatgaagatgatcttgttgtattctgtcaattcccaaagacggaatttgctgtagttccattggttatatgcatttgcttcagctttcgggtttctgattctttgaaatgtgtgaatcttccatccagctgattccaagccacttctatggtattcactgatcgaatcatcgactagtattaccaaattgcgagtagagcctgacattcgaatgctctgtgctactgcaatggctccacagacaaaagcatcatctgagtgcaagatcgtcgcgtacgcttctttcttggcatttgccgagtagaaattatctgcaattgaatcataatcagcttaggaggagagaatagagatgtcaaatttagctgatacaaaagacgaagaaacttactactgagtcactgacctttagcttgaagaggaacagaaagttcacaggaaccaacaggaagttgtaacttttgtcttaactggtgaagtttaggcttatacagccatatgtttccttgacgggcaacaagttcttgacccgtaaaaagattcggtattggaaagcaatctgataccaaaatcacatgaacatcatgaagcccttcagaagatgccgccactcgagctgctgcaagttgtaagtgcaatctagccacatctcttgaccattttcctgacttgttacatgggagcttggcaatgataagatcgattcgagacttgtcaggaacttgaatccaaggaagagaaggacaagtggggactttgaatttttcttcctcgtcaatccattccgggtataaagatttccaagttatgttacttgcagcatggtctagatgcaaagctatatgctgacagtgagattttatgaccacctgccatcgattaatctcgttatcgttgagatttagaaagccaattccttgatactcgcttctgccagataagtaatgctcaacaacaagtgacatactgttccagttgatctcagatgtagctatatagcgaggatctgtggttacagcaggttctagtatccatttgtttgcaaaacttgatggatcttcaggaatttgcaacggtggagaacagtagagtgtgaacatagcaaccagcatcataagaaacaaaacaagtttcagactagagaagttgacacacatttcaacatcgagagtgtatccgtttctttggaatctcttcgtttttgttttctcactatatatgtaaaacaaatgcactatgtcaagccaacagatgaatacagatctctgtaatgcacatactcaaccacattgctctcatgatctatgatcctatctgattcccctaagttaggtaaagtagtttccattgaactcaagaaactgatgaagtagaagagaaaaagacttacctggaaatgtaaagtcgatgacttgactgacttgacggcgccatgggactttcagaagagagcttcattctcactgtaagaatattaagtttgactttcctgagtgagagactacatgaagctggatgcatcgagcattacaataatcacacgtttttgacgctaatccaaattatattatattagcggacggatcggaacaaaatcaacacgatgggtcaatgttaagtttgaatttttttgcggaaaaatcctgatctattagatgtttcctttgtaaaaccctgatgttttattacttaataaataaaccctcaaattaggttcagttaatcaaaaattaagtttgtgttgaaaagaggaataaccaataaaatatagggtttgttttgcaaaaacacttttcttcgtatgagtcgacgagtctggggaccttttagttttctcgattaaggaaaggaagatctgaaagtgaacgcgaaatcacttcgccagcgttattgttaacaagaatcatcagattagtcgccgtagatctgaatcaacgtcgtaacagtagcagaattttgcggtgaaacg

SEQ ID NO: 5174 - DNA, 3000 bp, Unknown
  misc_feature (1)..( 3000): cDNA_ID_1827803_gDNA_ID_1620768_Annot_ID_50149 3000 nt of promoter + ATG
cttatttgaagcccaaaagatcatagtcagtgactcagaagctatggatacagactttgacggttatataagcattacctaggcaagctatcaaatatctctcgaaacaatagagtgcaaaagcttcataacaatctctaatcacctcgcagttgaaagctgcttctgaattcaccaaagacaaaaactgctcggaaattataagaaaccccgaattagaaaaatatctgaacacaaatcttaatggaaatttcactacaaatacaggattaaagtatatagtaacttattaaacctaccgattccacggcataaacaggaaccatcagaataagtccaataagaaacttctgttcctgtaatttacaagagaaagcgttatgcttagttactgatgatggtgatattatcaatttaatggatcaattcgataatagcaatgtcagtgaagagtcataaagatgaatcagtatcatttattatgagtaagagaatacgacaaagtgggtgttaaagaagtaataacaaacctctggttgattataagaagctaagtgctcaaagataagatacatggggaggaggatggcaataaccacgaatacactagcacttaagattggccaagtcaagtattgtccagaatcaacaccaagattaggatgccacattatcccaaatctacttgacgactctcccacggaaacaataaaaagcaacgagcagaggattcccctccactccattaagaaacagcaaacaacaagaagcaatcttcacatcaagcaagaggacacgttcctccaaacaactactccaaatctcatagataccaatatcactgatattaaaaatagatcctttctcaagctatgacaatagcagtgatgaccctttcagaaaacctgcattacgagtaacaacacacaacaattagattatattctgatcaaaaattgaatctttaaaacccaaattgactcataacaagaaataagttccttgatctaattcgtctttctaaatcacccaagcttaatcacccagcaaacaaaacgattttgcaaaaccctaaatcaccaacacccataaaacagaagaaaaagagagaaattgcacttacacgagtatctaattacgttatccagaagaaaaccctcgagtctttaaacttgctcgaatcaaggactccaacaaaaatcgagccagagattatctttttgctcttcgctatcttcaaagtttggatcttttttattattaatttccgcgtggaagagaaagagcctaaaaaggaaaacttcagcctttttgctttggcggttgtgtcaagctaaaccattttcttcgatcccttaatttgctgacgtgttatgttaaataatctgatgtgtctcatcctcattggactttattcttttgtccgatcactttgtagaaattattattattagctcgtttaaaacaattcaacaatcagtattttctatcattcaagctaatcgaaaatgatggatcactcttaaattgatatcacaaagtagatgagttctttaatcggtgtgttatcatgagctacgtataatattcaaacttttgacaatttcccttgtcaaaataatagtttgatgggtgaatggtgatagttgataaaaatggcaaacacatcttattttaaaaattaactcatcgtagatatcatgtctattacgtaaagttatacatcgtaaatgtggtgtgtatttagatatatgttttacggtacatttttgtaatgcggatagataatcagtttagaaatccctaaaatatctcacatgatcttttcacgttgcaaaaccgtatcagaaatcggttttgtattcttattaccattgctctctctctctctctctctctctctctgatctcattcatgtttcgttgagtttataggttgagatcccttataggttcgtagaatctatggttgtttaagagcgatgcgcaaaggaagcttaatgcggatgatggattggatacgataccaacttatgtccaaacacatgtaagttcaacaaatgcatgtcctttgtatctattaatcttatatgtaattaagccaaataatgcgtcaaaagtatatgaaccaacaattaccacaatgtaggggccggtgaaaccagtaacaagaagaaaggtataagctatagaaaattagtatttggtgaagctaactcaagaaaccctcaagccaacaaaggaatgtttatgtggtagaggacacagaggataaatgatgtcttaaagagtaaaaatattgtttatctccttttagcatctctctttcttttgtttgtatctgtggtagttataaacaactcttacaacatctttcttttttttctgtcatgtagatcgccaaaaaatgatgacattgtcactcaaataacattcatcaagttcgatccaactttggacacaccttctcaataccttgtgcaaaaaaaaaaaaaatctctagatcaactgaacaactcaggtaattaagacggttttaatatcaaagttatgatacaattcaatagaaagggaaatgtattttctcatttatggagaaaataattaatggtatgctagcattaaattatggataaaatatgacatggagtcgagatatactataatttatatagaaaatgatctaaatatctttattttttagatcatcaccatatttgaaatttctttaaaaggacatagcttatcaagaaaattattaccaactagtcattgtaataatcaagaaagatgaagtcatatatatatccttagaaaaagggataaggaaagatagatggtcaaagtgtaacagctagtctgctaatatccaacctttttatttatctctaaaatcttgatcatagtgatcacaactagttcacaaccctcagtcaaattttattacaaagagggagaccagaatattcctccttttgtcttcaagattttaaagccatg

SEQ ID NO: 5175 - DNA, 3000 bp, Unknown
  misc_feature (1)..( 3000): cDNA_ID_1827799_gDNA_ID_1620768_Annot_ID_50150 3000 nt of promoter + ATG
gttaataaattgtggtgttttttttgcctggtttccgaatccaatgcctatgccgaggaagattcgaccaaggattaacatgaggatgtttttggctgcagcgttaatcactcctccgaggaagaagctgacagagccaacgaggatgcttcctctcctaccgtagattctggtgacgtaagaagctccgaaagttgagattaaaccggcgaagtagagagaagaagtgaagagtgtgaggatttgattgtcgtatttgcagtaatctgtttcgtttagatgcatttgctttcttttgtagatccctgggaagaactctttcaagaaatcgtccattgatgtaacaccacctgcgtttaacaaggacgaataaacaaaaatgagcattggtcttgcataggttccttgatttacaagaaactaagcagtcgacacttaaacaaagctgaagctaactctcgtcagagagggaactgatattttcggacaaaacaggggaaatttaacaaaactgaagcaggcccttttcaaaaacaatacttggcagtttcagaatctggctatttgattggtataagataaaaccagatcgagaaagttatctaaccagagactccaagatcatagccgaaaagagagcctcccatggatccgacgatgcaagcgaagatgaagtaagaagtgatccgatgttcatagagatgagctctctttaggcctccttcatcggtaagagctccaccggccatggctttaaaatcttgaagacaaaaggaggaatattctggtctccctctttgtaataaaatttgactgagggttgtgaactagttgtgatcactatgatcaagattttagagataaataaaaaggttggatattagcagactagctgttacactttgaccatctatctttccttatccctttttctaaggatatatatatgacttcatctttcttgattattacaatgactagttggtaataattttcttgataagctatgtccttttaaagaaatttcaaatatggtgatgatctaaaaaataaagatatttagatcattttctatataaattatagtatatctcgactccatgtcatattttatccataatttaatgctagcataccattaattattttctccataaatgagaaaatacatttccctttctattgaattgtatcataactttgatattaaaaccgtcttaattacctgagttgttcagttgatctagagattttttttttttttgcacaaggtattgagaaggtgtgtccaaagttggatcgaacttgatgaatgttatttgagtgacaatgtcatcattttttggcgatctacatgacagaaaaaaaagaaagatgttgtaagagttgtttataactaccacagatacaaacaaaagaaagagagatgctaaaaggagataaacaatatttttactctttaagacatcatttatcctctgtgtcctctaccacataaacattcctttgttggcttgagggtttcttgagttagcttcaccaaatactaattttctatagcttatacctttcttcttgttactggtttcaccggcccctacattgtggtaattgttggttcatatacttttgacgcattatttggcttaattacatataagattaatagatacaaaggacatgcatttgttgaacttacatgtgtttggacataagttggtatcgtatccaatccatcatccgcattaagcttcctttgcgcatcgctcttaaacaaccatagattctacgaacctataagggatctcaacctataaactcaacgaaacatgaatgagatcagagagagagagagagagagagagagagcaatggtaataagaatacaaaaccgatttctgatacggttttgcaacgtgaaaagatcatgtgagatattttagggatttctaaactgattatctatccgcattacaaaaatgtaccgtaaaacatatatctaaatacacaccacatttacgatgtataactttacgtaatagacatgatatctacgatgagttaatttttaaaataagatgtgtttgccatttttatcaactatcaccattcacccatcaaactattattttgacaagggaaattgtcaaaagtttgaatattatacgtagctcatgataacacaccgattaaagaactcatctactttgtgatatcaatttaagagtgatccatcattttcgattagcttgaatgatagaaaatactgattgttgaattgttttaaacgagctaataataataatttctacaaagtgatcggacaaaagaataaagtccaatgaggatgagacacatcagattatttaacataacacgtcagcaaattaagggatcgaagaaaatggtttagcttgacacaaccgccaaagcaaaaaggctgaagttttcctttttaggctctttctcttccacgcggaaattaataataaaaaagatccaaactttgaagatagcgaagagcaaaaagataatctctggctcgatttttgttggagtccttgattcgagcaagtttaaagactcgagggttttcttctggataacgtaattagatactcgtgtaagtgcaatttctctctttttcttctgttttatgggtgttggtgatttagggttttgcaaaatcgttttgtttgctgggtgattaagcttgggtgatttagaaagacgaattagatcaaggaacttatttcttgttatgagtcaatttgggttttaaagattcaatttttgatcagaatataatctaattgttgtgtgttgttactcgtaatgcaggttttctgaaagggtcatcactgctattgtcatagcttgagaaaggatctatttttaatatcagtgatattggtatctatgagatttggagtagttgtttggaggaacgtgtcctcttgcttgatgtgaagattgcttcttgttgtttgctgtttctta

SEQ ID NO: 5176 - DNA, 3000 bp, Unknown
  misc_feature (1)..( 3000): cDNA_ID_1827789_gDNA_ID_1620768_Annot_ID_50153 3000 nt of promoter + ATG
ttccttccccgcaaagcctctcggttctttcgttgaatatctttggttttaaccactgggttagtctttgaaatcgagttatgatctgctctcccaatctcagtcttcagtctctttgaagctctgaaaattgtctgagactcatcatttctcgtattcttttcttgagagtctctgacatatcttgtaggctttgattcgatagtgttcttggccacagaaatcttccttccacgtcgagcatctccgttccgttctttggtgtctctgacataacttctaggctttacttcgatagagctccttccacgtcgaacatcatctcctttcttttgctgggtttctttggtccttaagacagtcctcgaaatcgacttatgatctgctctaccatcctcagtcttcaacctcttagatacactggaaatggtaggagactttggctttctccctgctttactcttctcggtttctactgcttttcttaaactcctgtcaggtgcttcatgatacattatacgcactggagaactaccccttacattgtcctcaagcaaatatacattccgcgtttcactaaaatgtgccaagtactttttatattccaaatcatgaaccaaaccggaatcgcaatcatcaacacaaacaatctgcaggttggttcttttggttttgccatctctagctaaaagatcatccccggatgcatccactttaccacaaagagacaacgttttaccaccaacttcatctgtgtctgtgtctgtggctgactcaatctcaattatttcctgccacacaatggtcttagccaccacagacttcttcggtttcttagctaaaacatcatcacctgatgcattcaccagcaatctaccaccaagttcatctatgtttgactcaatctttatttctttcttcacaatcgtcttagccacagagcacttcttcgggttcttagctaaaacatcatcccctgatgcattctcttcattacaaagaggcaactttctaggaccaacttcatctgtgtctgtatcagactcaatctcaatgatttccttattcaaaatggtcttagccacagcagatttcttcgggttcttcttagctaaagcatcatcctttgacgcgttcctttcaacacaaagatccatcattttaccacaaacttcatctatgtttgactcagtctttatttccatcttcaccgaagacttcgcattctcttcaccaaaaggagccaactttgtagcagcaacttcatcatcagtgtctgtatcagactcaatctcaataatttccttcttcgcaatagtcttaagccaggcagacttcttcggcttcctcttcatattcaacttagcaggctatataactctaccagatcctgaaacaaaaacaacttgggaaacgaagaaaaattgaccaacgaccaaacttttcttcacatttgaaatttgcagcgaccagatctggttgattcaaccacaaagaaattaccaaatcaatcaaacctagtctcacaaagtagtacaaaacagtccactaaactcaagctcgggtcttttcacgaaattccaacatttaaagaacaaataaacaaatgtaagttagaaattgagaacccaattgtaacgagagggaaaggaaacagaagaagaagactgaaatttgaaatctttggtctcgctacttacctgaaatttgttgttggagagccaaccaaataacgaatccagcttctaagtagagacgaagaacccaaattcacaacaattctcgaggaagttttccgattagaagaaaaccctagaatttttataccgtatttgacggtaaaccataaagctcgtcgaagtcgccagtcaccggaagtagtaaagcaaccataaatgcatgatcccaacacgatatacggtgttccgtaccgttaaagtacgcgctcaaatatgtaataacaaatattaagaatctaatctctattccaaagtattataaatgggccgaaatgaaggctttttggcccagttgagattatttccaacttctatcctcttattaatttataaacatggcctttacaaaattctattctaaacataaacatggcctttacaaaaaataaggctaccacacacaaaaaaggtccatttagcaatggtgctaaatgagaagagcttctctatttacctagcagaatcaataagtctaagagcattttattaaatacaatcctctgtataaattccattactcatccactagtataaaggttttcatttatagaaaaaaagatttttaagttttttatattattttcatcatagtttaaaataaaatttgaattgatattttattggtacgaatgcactctgtaaattaaagcacgtgagcatgtggttgatataccatactctctcttaaagtcagcaagtcaacacaatacctaactgaaacttgtcattcaatttagatcctcaaccatcacattaaataaataaaatctcatcttctaacagttaaattaaaaagttttaaaatccacatttaaaagacactagtttctgatttgtcttgaccaaaacctgtaatttatttccattaggggaatgtaagcaaatcataaaaaaatagagaccttatgctataaacttgaattataggtactaattaggtttataatacgtttttttattttttgcttaatctgtacactttcttctttttcttcttctgtttcattgtcttcatgcgactcgtcgagtttcgtcccttcactctcttcacatcaaattccgcaccaccacatccacgtgtctcaacctccactctcctacgtctctccaccgtcgccggcgtctgcagcgtctgcttcatcaattcctcgccgtctctctgaaagaaaaaaaggaaccacctttctctctctgttttgctcgatctgttgtaatttactctgtagcgatcatcagatcgccggcgttttaaaccgccatg

SEQ ID NO: 5177 - DNA, 3000 bp, Unknown; identical to SEQ ID NO: 5176
  misc_feature (1)..( 3000): cDNA_ID_3075901_gDNA_ID_1620768_Annot_ID_167402 3000 nt of promoter + ATG

SEQ ID NO: 5178 - DNA, 3000 bp, Unknown
  misc_feature (1)..( 3000): cDNA_ID_3075907_gDNA_ID_1620768_Annot_ID_167398 3000 nt of promoter + ATG
taacatgaggatgtttttggctgcagcgttaatcactcctccgaggaagaagctgacagagccaacgaggatgcttcctctcctaccgtagattctggtgacgtaagaagctccgaaagttgagattaaaccggcgaagtagagagaagaagtgaagagtgtgaggatttgattgtcgtatttgcagtaatctgtttcgtttagatgcatttgctttcttttgtagatccctgggaagaactctttcaagaaatcgtccattgatgtaacaccacctgcgtttaacaaggacgaataaacaaaaatgagcattggtcttgcataggttccttgatttacaagaaactaagcagtcgacacttaaacaaagctgaagctaactctcgtcagagagggaactgatattttcggacaaaacaggggaaatttaacaaaactgaagcaggcccttttcaaaaacaatacttggcagtttcagaatctggctatttgattggtataagataaaaccagatcgagaaagttatctaaccagagactccaagatcatagccgaaaagagagcctcccatggatccgacgatgcaagcgaagatgaagtaagaagtgatccgatgttcatagagatgagctctctttaggcctccttcatcggtaagagctccaccggccatggctttaaaatcttgaagacaaaaggaggaatattctggtctccctctttgtaataaaatttgactgagggttgtgaactagttgtgatcactatgatcaagattttagagataaataaaaaggttggatattagcagactagctgttacactttgaccatctatctttccttatccctttttctaaggatatatatatgacttcatctttcttgattattacaatgactagttggtaataattttcttgataagctatgtccttttaaagaaatttcaaatatggtgatgatctaaaaaataaagatatttagatcattttctatataaattatagtatatctcgactccatgtcatattttatccataatttaatgctagcataccattaattattttctccataaatgagaaaatacatttccctttctattgaattgtatcataactttgatattaaaaccgtcttaattacctgagttgttcagttgatctagagattttttttttttttgcacaaggtattgagaaggtgtgtccaaagttggatcgaacttgatgaatgttatttgagtgacaatgtcatcattttttggcgatctacatgacagaaaaaaaagaaagatgttgtaagagttgtttataactaccacagatacaaacaaaagaaagagagatgctaaaaggagataaacaatatttttactctttaagacatcatttatcctctgtgtcctctaccacataaacattcctttgttggcttgagggtttcttgagttagcttcaccaaatactaattttctatagcttatacctttcttcttgttactggtttcaccggcccctacattgtggtaattgttggttcatatacttttgacgcattatttggcttaattacatataagattaatagatacaaaggacatgcatttgttgaacttacatgtgtttggacataagttggtatcgtatccaatccatcatccgcattaagcttcctttgcgcatcgctcttaaacaaccatagattctacgaacctataagggatctcaacctataaactcaacgaaacatgaatgagatcagagagagagagagagagagagagagagcaatggtaataagaatacaaaaccgatttctgatacggttttgcaacgtgaaaagatcatgtgagatattttagggatttctaaactgattatctatccgcattacaaaaatgtaccgtaaaacatatatctaaatacacaccacatttacgatgtataactttacgtaatagacatgatatctacgatgagttaatttttaaaataagatgtgtttgccatttttatcaactatcaccattcacccatcaaactattattttgacaagggaaattgtcaaaagtttgaatattatacgtagctcatgataacacaccgattaaagaactcatctactttgtgatatcaatttaagagtgatccatcattttcgattagcttgaatgatagaaaatactgattgttgaattgttttaaacgagctaataataataatttctacaaagtgatcggacaaaagaataaagtccaatgaggatgagacacatcagattatttaacataacacgtcagcaaattaagggatcgaagaaaatggtttagcttgacacaaccgccaaagcaaaaaggctgaagttttcctttttaggctctttctcttccacgcggaaattaataataaaaaagatccaaactttgaagatagcgaagagcaaaaagataatctctggctcgatttttgttggagtccttgattcgagcaagtttaaagactcgagggttttcttctggataacgtaattagatactcgtgtaagtgcaatttctctctttttcttctgttttatgggtgttggtgatttagggttttgcaaaatcgttttgtttgctgggtgattaagcttgggtgatttagaaagacgaattagatcaaggaacttatttcttgttatgagtcaatttgggttttaaagattcaatttttgatcagaatataatctaattgttgtgtgttgttactcgtaatgcaggttttctgaaagggtcatcactgctattgtcatagcttgagaaaggatctatttttaatatcagtgatattggtatctatgagatttggagtagttgtttggaggaacgtgtcctcttgcttgatgtgaagattgcttcttgttgtttgctgtttcttaatggagtggaggggaatcctctgctcgttgctttttattgtttccgtgggagagtcgtcaagtagatttgggata

SEQ ID NO: 5179 - DNA, 3000 bp, Unknown; identical to SEQ ID NO: 5174
  misc_feature (1)..( 3000): cDNA_ID_1827803_gDNA_ID_1620768_Annot_ID_167396 3000 nt of promoter + ATG

SEQ ID NO: 5180 - DNA, 3000 bp, Unknown
  misc_feature (1)..( 3000): cDNA_ID_3075911_gDNA_ID_1620768_Annot_ID_167393 3000 nt of promoter + ATG
gaagaagagctggtaaataaaatacggaaatgtgttaaataatgatataaaaatgtggtaaatgaacattaaatatcgaatgtatggaagaatgatgataagaaaaatgaaaattagaggagattaaaaagaaggcatgtgggaagggtgttgacaactgtcagaaatgccatgctcagatgggggcaaacagccttcactccttgtgggtctctcttaattatctcttttcctcttcccttcctctcaattctcatcatttctaaccccaaaacaagtaagtaaatcatactctatgatctgtttatttgcatttttattaacgttaacccgactttctagactagagagagctcatattttttgtactagaaaggtgtaagcaactaatatctatgcatcaaagatgaatgaaaaagaccaaagttttggccaaaaaaatgaaaattaaagagaccaaacatgttatactaatatattatgtgtagtatttcataatttcttgattcgaactttgatctagttggggaactcggcttccatcgaaagacattcacttcctactaaattgtataattttttatttttcgaaagatacaagacgacaaacaaacacacacatatatatatatatatatgattgtatttctccattttagctatatattgtataagtaaacactagtcgacaaaaaaaaacacacaatctcgaattatagacaatttatattgatcgtaaaatgatattctattagtgaatagaccaagttaccaacgagacctaagaaaacatcgctacaaaaaatcatagtctagttgtatggtcgtgttagcattctgattaatcgtcatattgtatcaatcgctatattgttgaactcatagtagcatatttggaaataattcctaatgaaatattactatcccattaaaattaaagttgaaataagctcatggacacattataataggttaaacatatttttgatttttttctgcccattctccctttactattgcataagttcttagtcaattttaacaaaacaaaaatataagttcctagtcaattccgaatgggaatgttattaccccattgaattgatcaagttcatacatggaccatgcataggttatcacgaagagataaataaacatttacttgccgaatgcaaaatatcaacattaaataaacgaaaacaaaaaatgggtcattctcaaataatattgatgtgtgaatttataatgtgtacacacctgtcatcataagtaagcgatcgactgtccttttctaactaacttcaacatttcacttcaatacttcaactctctttctctctctctctagtctttatataaaccctacgtacgtactctcttcacactcactgagtcaaactcacgtgtcaatgaccgagtcatccattatctccgtcaaacaatcgtctccggtgccggaggaggaggatcatcatcatcaccaacaagactcccaccgaaccaacaccaagaaacgtgtaagatccgacccgggttaccgaggcgtccggatgcgaacgtggggcaaatgggtctccgagatccgagagcctcgcaagaagagccgaatctggctaggcactttctccacaccggaaatggcggcgcgtgcacatgacgcagctgctctcaccattaaaggaacttccgccgtcctcaacttcccggagctcgccacttaccttccccgtccagcttcctcctctccacgcgacgttcaagccgcagccgccgtagcggccgccatggacttctccccctcctcctcctctctcgtagtctccgatccaaccaccgtcatcgccccagctgagacgcagttgtcttcctcgagctattcaacgtgtacgtcatcgtcgttgtcaccgtcaagcgaagaagctgcgtcgacggcggaagaactaagcgagatagtggagttaccgagtctagagacgagttacgatgagtcattgagcgagtttgtgtacgttgactcggcgtatccacctagttcgccttggtatattaataattgttatagcttttattaccacagcgacgaaaatggcatttcgatggctgaacctttcgactcttccaattttggccccctttttccttagttttatttttaaataatctcttcttttaaaaacatttagcctccaaacctctgaagtttatttaattattggattcagaccagagtttaatatacttgattaaacctgatagtaccatataatgtttattgctctcttttttttgatcggatcttctagatattttgtacgaacacgccaattgtgattggacgataaatggttttttgtttatattttgctaattaacttatatagtttaggtgaccattttttatactttaggtgaacatttgagaattaaactatttatatcaaagtagcggtagataaaagtattatctgagatggtttgttagttgacatatattgaatcttttcaacttggtatttattatcaccctctgtatttaattcacaaaatttctactgttagcttcatataaccaactttttcaatttaaattattgtttacagtgaatgagaaatacaagtacaatgcaatatttaggaaatacacttttgagaagaaaaatagaaactcattttctttccctaattaaaaacaatttgtaccagagaagtaaaagattatcgttctaccaaaacgaatttgcaggttaaggattatttatcatttcctcttgtttgactttgtttgcattagtcagacataattaatggcttgacccttaatttaacatgtccatgcactaactcatatgcaaatccaacgatgtgaaatttaaaaccttttttttattcatttttaatctttgtaaaacgaacttatattatgtttgaacaaatattttttcatacgcaatccttagatggggaaattaatacctttgtaacaaaaaaaaaaaaaaaatg

SEQ ID NO: 5181 - DNA, 3000 bp, Unknown
  misc_feature (1)..( 3000): cDNA_ID_2137078_gDNA_ID_1620768_Annot_ID_167392 3000 nt of promoter + ATG
agctattcaacgtgtacgtcatcgtcgttgtcaccgtcaagcgaagaagctgcgtcgacggcggaagaactaagcgagatagtggagttaccgagtctagagacgagttacgatgagtcattgagcgagtttgtgtacgttgactcggcgtatccacctagttcgccttggtatattaataattgttatagcttttattaccacagcgacgaaaatggcatttcgatggctgaacctttcgactcttccaattttggccccctttttccttagttttatttttaaataatctcttcttttaaaaacatttagcctccaaacctctgaagtttatttaattattggattcagaccagagtttaatatacttgattaaacctgatagtaccatataatgtttattgctctcttttttttgatcggatcttctagatattttgtacgaacacgccaattgtgattggacgataaatggttttttgtttatattttgctaattaacttatatagtttaggtgaccattttttatactttaggtgaacatttgagaattaaactatttatatcaaagtagcggtagataaaagtattatctgagatggtttgttagttgacatatattgaatcttttcaacttggtatttattatcaccctctgtatttaattcacaaaatttctactgttagcttcatataaccaactttttcaatttaaattattgtttacagtgaatgagaaatacaagtacaatgcaatatttaggaaatacacttttgagaagaaaaatagaaactcattttctttccctaattaaaaacaatttgtaccagagaagtaaaagattatcgttctaccaaaacgaatttgcaggttaaggattatttatcatttcctcttgtttgactttgtttgcattagtcagacataattaatggcttgacccttaatttaacatgtccatgcactaactcatatgcaaatccaacgatgtgaaatttaaaaccttttttttattcatttttaatctttgtaaaacgaacttatattatgtttgaacaaatattttttcatacgcaatccttagatggggaaattaatacctttgtaacaaaaaaaaaaaaaaaatgttaaatcaactaagtattgggtgagtcttctcaacgaaaacatcaatcaacaccggcctcataagttgattaaattaacacatttattataatcatcgtacattgatttgaatcaaaattaattgttacgttaattagtaatgcatctaactatcccgtaggaaaaggccattatattgggatccgcggtcaacggaggttccacccacgagcacggtctttatttgttttttcctttctcaaatatatatacggatgtatgattttttgcttttggggttaaacaaatatgaattactgtgcttagatcagaaatagacacttttatacaaatgattatatgattactgttcatagcataagctcctatgaaaacaaataataatcgcaacagccgtttaacctaatcgaatgctgaaaagccctcaaaatagttcatctaatccatgaatcgatttaacagaaaaagttgaaaattgtatgcatatgatatactcaagtatattccgagttttgagttgtgtaatgcaaggagtcaaggaccatagtttgtcgttgaacacaaccacgccaagttgtccaccaaaactggaaactaactaccatgccgttgtttccatagaagcaaaaccattaaccttcccattatcccgcatggccacatatatgtttaataatatttctcaccatacatttaagtctctctcgtagtcgttatttacatagcctacgtagttcattcatatcatttttgtttctttaccttatatcaaacaaattggttgttgattagaaaaacataaattggttcattaaatatcaaactaacgccatcaatctattgtttttttataaaaaaatgaaagagaagaaagtttgttgatatgaaacttacacttgctttgagttttgatagacaaaccaaagcctaactagtatttcctctattggtacttgaattctgaactttttcaccttccctttcgaggtggtttaacagtataccagttgagatgtaccaacaccaaattcttatacttttttttcttttaaccttgaattcagtattttaaacgaaactatgggaatgtgtttgagacggattttcattaaggacaatgcaaataattatgagatgctcagaattgttgtatatatcaaaaagccaacacctatagttatatatataactttcttcgatttaaaaacaataagtcgctttggccgagtggttaaggcgtgtgcctgctaagtacatgggctctgcccgcgagagttcgaatctctcaggcgacgttatccttttcgttttttcgtctatttttaaaccgacttacatagacactgcgtataagacaattgattccttttttttgttgttaatcctatcaaccctagaaaaggcttcacgcccgatttcttttttccccagaaaaaggcttcacttccgttcgttgttcttcatcggtctgcgccgcctcgcacatcgtttcacctttctcagaatctctcttcccgtcgattagtttcctcagaggttagcttcttcgatttctcagattcaattctgctttttgctttcctcctgttgtttttaggtttttgtcgatctctatgttcagcgattcctaaaccctacttgttttccgctctattgtagtgaatccaacccagatttttcagattttaatcggaattattcgggatctaatgctcgcgtcgagtttatcgctagaaaaccctaatttcggaggatctgtcacttttattatcagaagcttgttgttgtaattacggattaggtatgtcctgatcgttattgttctttgtttgcaggttgcgatttgttgaaaaccttgatttagactatg

SEQ ID NO: 5182 - DNA, 3000 bp, Unknown; identical to SEQ ID NO: 5173
  misc_feature (1)..( 3000): cDNA_ID_3075917_gDNA_ID_1620768_Annot_ID_167387 3000 nt of promoter + ATG

SEQ ID NO: 5183 - DNA, 3000 bp, Unknown
  misc_feature (1)..( 3000): cDNA_ID_2137064_gDNA_ID_1620768_Annot_ID_167386 3000 nt of promoter + ATG
aatttaaactgaaaggaaacagatgatagtctgactgtacccctggtttgtacttgggagaccgtgaagccaatttgttgaacaattgcatcaactgaacaggattttctttctcatagcgcaaagcatatagcattaccaaacgcagccggtcgatgtcagacacactttcattatttaagagatccgtaactgcctgcaaataagcatgaatagagagtcagagctccgtgcttacagcagagtctgcacaattttgcatatttcgctaacttctgcaggttcactggattacattcgcatgagactccaaattattgaatgccaaattattcagtaagaacttctgcaggttgtagctattttttaatatatgcgactacaagtgaatgttcaccacagatattcactacctcatatgcagctccttggccaccattgcaagccaagtcctgctctgtttgtgaaaccgtcatcagtttccttgcttcaactagcttgctcatttcagtaaccagagttacatgctttgaaacgttgccttgcatctttttgtactcagggtagttgtcaacaaatctggccatatcctctgtacaaccaacgaattcacagatatataattgtcactagcacgagaatctgttgttacaaaagtttttgcagagaatagtttaagactagccatatttgtacctactgtctggatattttggttactcttggccacctgctgaaagtcatctaccattcgcttgatgttcattccaatatccccaaaattttcatacatgttagatttgaaaaatgcatcttgttctgatgataaaaccacctcctgccaggataagagacatattagctgtaaggttctcaactaaaaaacaatggcattggagaaaactaaccacttgctgatcttttggaagacttccaatggatttcaagtccactttattatcttgaagtcctatgagttcgtgcaccattgcctacagaaaatctcgttaattagtaagtcgtagtcttacaaaaaagcaagacagcgggaggcacatcttatatcatagagtagcacaataattttgtttagtcaagttacctgatatgtccactgattcagcaatggggtaaccgggtcatctcttctgtcaattacaagtagcaacggagagctttcagtccgtctaaagtcaaaaagagcgctttcatgctgatacatcaatttctgaaacataaacagcgaattttcagactattggatagacacaagtgggaattagttccatcacatgcatgcaaaatatagcgggaacaaataactttacgagagcttgtcaaacaacttcacttacagctgtttcgtgtgcaatcctttttgcagtatcagaggtcctctgatatctgatgacaggtcttcgtttcaacgccagaaacactgccgcaattccatcaacaacccgatcggaaaagcgttgcaaaccagagggatcgacaactgcggggatcatatatagatgatttgatgccatattcaatgtgaaatgatatggatcaccagaaacaaagtctgcataatactcctgcaatataaaaaaccacaaagactatgttaaacaagccattatacagtactatgccgagtgcaccaagcaatataagtttaaatcagaaaactaaagacaggtaggggggatactaagctccacaagtatggccgtttcatcacaaaccaagcaacttctcagagacagctaaaaatctatacatatattgatccatcatataggctatgaaacattcttttagcattagcctcctattcaaaaacatcatggatgagggaagtctaaaaatcacctgaacttgctgtacaacttcctgctcatcggaatcagccaaaatatgaatctgagtatccttcaacagattggagaaaactgaaagaattcataacaaaaacaacatcaaattttgtatattgtgagtgaacaatgataaactcgaaatagttagaagatgaaaaaatcatacataaatggtattctccaaatctaggattcgcaagctggtatcgtaatttctgaatattatctgaagttggacggatgaaataaacagctttcagatgtgacatcgattcttttgacacagatattgaatctatcatctccaccagaaacacttctttctgaagcagctctgactgtgaatacacaatgcttacattgctaacctgcaaattcaacaattaatccaataaacaagtaatcacgaagatgtgtttccggttacaagggaaattatgaaccacgattccagaaacaaatcagagaagattagcaatcgaagaagacgagatcggactttaccgtttcggagtcgagtatgagaaccttcatgccggagatgtcctgaagcatccggttaatgtaatcacgcacagacgtaaccaaaaccatcgtttcaccgcaaaattctgctactgttacgacgttgattcagatctacggcgactaatctgatgattcttgttaacaataacgctggcgaagtgatttcgcgttcactttcagatcttcctttccttaatcgagaaaactaaaaggtccccagactcgtcgactcatacgaagaaaagtgtttttgcaaaacaaaccctatattttattggttattcctcttttcaacacaaacttaatttttgattaactgaacctaatttgagggtttatttattaagtaataaaacatcagggttttacaaaggaaacatctaatagatcaggatttttccgcaaaaaaattcaaacttaacattgacccatcgtgttgattttgttccgatccgtccgctaatataatataatttggattagcgtcaaaaacgtgtgattattgtaatgctcgatgcatccagcttcatgtagtctctcactcaggaaagtcaaacttaatattcttacagtgagaatgaagctctcttctgaaagtcccatg

SEQ ID NO: 5184 - DNA, 3000 bp, Unknown; identical to SEQ ID NO: 4895
  misc_feature (1)..( 3000): cDNA_ID_2993602_gDNA_ID_1620768_Annot_ID_167384 3000 nt of promoter + ATG

SEQ ID NO: 5185 - DNA, 3000 bp, Unknown
  misc_feature (1)..( 3000): cDNA_ID_1827785_gDNA_ID_1620768_Annot_ID_50154 3000 nt of promoter + ATG
aaagtagcctcctgctctaagcattctattaacttcaagaagaagtatcccatctgtgtaattcatagaaacaaaatgctgtagtcacttactatgctaaagctcaaataacattagaggagaagcaaaaagccagaaattaaccatcgcgtgtccaattaattctgcatctggaacaatgaatcatctcaaaagactggcttggatacaacaacctccgtgtggcaaagacagccaccatcgcaggaacaccacgctccaatgcaaactgtatctgattctcatgaacatcttttggtgctacagacaaggttgtcgtgttacgctgcatcaaaaacgcaccaaagctcgccacaccacagccaatgtccaaagcaacacgggtgcgtgatccaaatgtaatatcaggaatcatctgcaaatttcaatctaagagaatataagatcaacacaaaaaaaaacagattagccaatacaccaaaaaaacaggtaggaagaatcaaaaaacaaacctgggagatctggtctaagtactgatcagctccatggatgaattgagttccacctccagggaaaacaaacttatctttctctcttctaatccaattttgacctcctttatcttccactaaacgtgtatgaggcacattattgaaccatatctacaaagcacaaatcaaagttagtgactttacacttaaggcttagataaaggtaagaacttgatcacactatttcaccttgtctctgctctgtggccattggattggtttcttataaccatctggaggtggaatcaagcaatctaagctctgtttaggacaatgtctctcgtaattttctcctcgatctgtattgttcaatctctttatctcttcttcgttgtctaagcaaggaatgtaatctatcttcgtcttgtcacacaatttgagtttctcaatctgaaaaccgacttccggcgattctttttcctcaaccgacgaatttccggtggctgatttaagctcgtcgatggaatctggatcgaatccgccgatttcgaaggaatcagacatggcaccattctcgttgatgatacctgttctcaccactgtcggtggaagcggaggaggtgatattttgagacgaggacgcggtggaggagatggtgccaccgccgcgacggatgttatgttggtttgaatagcttcggtgacgtttgaagaagaggagatgggaaaaggaagagatggataagagaaggaatctgagaagtgattgaagagaaaaattgttgagattgagagaaacgcaaacgcaatcaatttaaccaatctcggagttttgacaacgtctaatccaacgtcggagagtttcatggcggtttaaaacgccggcgatctgatgatcgctacagagtaaattacaacagatcgagcaaaacagagagagaaaggtggttcctttttttctttcagagagacggcgaggaattgatgaagcagacgctgcagacgccggcgacggtggagagacgtaggagagtggaggttgagacacgtggatgtggtggtgcggaatttgatgtgaagagagtgaagggacgaaactcgacgagtcgcatgaagacaatgaaacagaagaagaaaaagaagaaagtgtacagattaagcaaaaaataaaaaaacgtattataaacctaattagtacctataattcaagtttatagcataaggtctctatttttttatgatttgcttacattcccctaatggaaataaattacaggttttggtcaagacaaatcagaaactagtgtcttttaaatgtggattttaaaactttttaatttaactgttagaagatgagattttatttatttaatgtgatggttgaggatctaaattgaatgacaagtttcagttaggtattgtgttgacttgctgactttaagagagagtatggtatatcaaccacatgctcacgtgctttaatttacagagtgcattcgtaccaataaaatatcaattcaaattttattttaaactatgatgaaaataatataaaaaacttaaaaatctttttttctataaatgaaaacctttatactagtggatgagtaatggaatttatacagaggattgtatttaataaaatgctcttagacttattgattctgctaggtaaatagagaagctcttctcatttagcaccattgctaaatggaccttttttgtgtgtggtagccttattttttgtaaaggccatgtttatgtttagaatagaattttgtaaaggccatgtttataaattaataagaggatagaagttggaaataatctcaactgggccaaaaagccttcatttcggcccatttataatactttggaatagagattagattcttaatatttgttattacatatttgagcgcgtactttaacggtacggaacaccgtatatcgtgttgggatcatgcatttatggttgctttactacttccggtgactggcgacttcgacgagctttatggtttaccgtcaaatacggtataaaaattctagggttttcttctaatcggaaaacttcctcgagaattgttgtgaatttgggttcttcgtctctacttagaagctggattcgttatttggttggctctccaacaacaaatttcaggtaagtagcgagaccaaagatttcaaatttcagtcttcttcttctgtttcctttccctctcgttacaattgggttctcaatttctaacttacatttgtttatttgttctttaaatgttggaatttcgtgaaaagacccgagcttgagtttagtggactgttttgtactactttgtgagactaggtttgattgatttggtaatttctttgtggttgaatcaaccagatctggtcgctgcaaatttcaaatgtgaagaaaagtttggtcgttggtcaatttttcttcgtttcccaagttgtttttgtttcaggatctggtagagttatatagcctgctaagttgaat

SEQ ID NO: 5186 - DNA, 3000 bp, Unknown
  misc_feature (1)..( 3000): cDNA_ID_1827781_gDNA_ID_1620768_Annot_ID_50155 3000 nt of promoter + ATG
ctcctaccaaattattcaaacagagcagattctaatttcattggagcagtgggggttaaacattcaagcaacttaaaactacatataatccaaaaaagagtcatcaactgatcaaacatttcaccaaattaacattacaggagaaactgttaaacctcgaaacttcaacaaagagagattcatatctgggactaaaaaggggctgaagcacgataatgaaggaatcgaatcaaacacatgagcttgaaaacatataaaacataacagaacagaacagcgtcaaacagagattgaagcaagcaaagacaagaactgacgaaatatgacaagacatacccaataaaactgaacaacaccttcgagaaagaaagacgagatcaagaactgaatcaaatctagacgaaaaagagaaaccttcgtctagttagtttctcgaattgaagatttctatagaagttttttttttctgaagggagacaaatactattacagctagatttggcctgaaaaaaaaaaaaaaattaggaaagtgcgagagtatctaattctccactgcttacgtagatgtacatgtgtactcgctctcagatgttgccacgtgactctggtcaactatccgtcaaagtcaaatgcttttaaggatcacagtgtccctcaaggatatatctgtctttccatttctttttcttttttacatacacccaaattattggctctattattgcatccaaagtgtcagtttttttctttcattttttggaaaggataaaaatgatatatctaattttagaaggtttttttagtggttacaagtatagtaatacttttacaccataccttaaatttatttcctaaaagataatttcatataaagtaaatctattgaatttaagaacttttatgttgtaggtctagaataaaaaatgattaagttaaaggtatattgaatctaagaacttttatgttgtaagcaagcaagattgtgtctaaaggtctattgattatataacgcgaatgaaatactcctctctttgggcctaaaaatgattgtcgagagagttcgtgtaagatattgaatctggcccaattttagtcataatttataagcccactttggcattgacagttatataaaattcagcagaaattatttaattgaaagatttctcgtaaaatgttttgagtacgatggatattcattataacaaatagcaaaacgactgaaaaaaaaagaaatatacttatataataataacatataattgacgtgcatggaccaaaaataataccaacctctaaaacagaagggacaataaataaagagcatccaaatatgtgacacgtaactagccaaaaatattacaaaggtcacattcatcataaatctattgaatttaagaacttttatgttgtaaccaagattgtgtcttcctttctactcatttttcgcccaagaaaaacaattatagtaggtccaaaagtaatcatttacccaaacaaaacaaaaaaacgagtttttcaagactttcatgaacaagctagttagagaaacatcaacgtcatgcatgttgcaaattcgttcatatatcttagtcattactcatttgtgttactaatggttttgtatagtgaagagagttgaatttatctacaggctgcatctagttttgtaaaacataaaattacaaaactcctttacatatcttagattaactcttttctttttctttttctgtcataaatcaaaatcgagtttttatttgattgatggtttatgtatgtcaagtagtagtattatatttaatgtagatattttagactagctagtgtccatggtcatttcgtcttaagtttgaattaatgatccattaaataatacacgtgttttatcattgaagggtatttgatcaatgaaagagtggccaaatatcaattaatttcgttattttgcttcacatttaattgtattgaattggcctaactgtgacatgtccatgtagctatctctttcgttttaaatgacatgctattgtttggtcaggatttgtttttggttataactattatggtcatgattcacgcttctttgcaaaatcaaattcgatttttgaaaaataatttaaagtattccattcatctaaattgattttgaaaccgagtcaactctcacaaaatatttggaaaatttaaagtattccattaatctaaaagttttgtttgtttgttaaattgatcatcatatatgttagtacaagccaataagatcaagggaaattccaacatttaataaaagggttactaacatataaagtattaggctcccaaagatcatgcgaataattgggacacggtctttcgattccatgtattaattacgaatttacggcacaagtacagaaaaatgattaggtctaaaaaactaattaagattaaagaaatgagatgctctcttattatcatatgtaaagatcgagtggcgttgtcgtggcagaaacaaaagccaccaactgagtagtctacatttccttatcttccggttaatgtttttgacctctctctcagtttgttgccactttcatttctcatcaactctgccattcaagaattcatcatcatcatggaccaaacaatacattcatttagttttatcttcaatattaaatgtatcttaaaattgtctcaatagttgaatattttggtattgggtctctgtttttgagtcatgtttgattaattaatgaacaaaaatcaattttgttcgagtgagttcatttgaaaacagtcgggttggtccggtttagatgccattgagttttctctccaatgataaaagaaccagcttcctataaaacctaaaactaggtgacataaaacatggaaaaatgttgaaattagttgtttcataatatatagtactccataatatatagttgttttattttgcttgaaacaaaaataaaagtaagatggaaatagaagaaagagaaggtagggtccatg

SEQ ID NO: 5187 - DNA, 3000 bp, Unknown
  misc_feature (1)..( 3000): cDNA_ID_1827773_gDNA_ID_1620768_Annot_ID_50157 3000 nt of promoter + ATG
acgagcgtggtctcctctttgaggagttcaactttaagtaatttccgatcaccggcggtcaatatctcagacgagattttacacgattcgttgaaagttggaccgtcatcggttgggagctttggttcgtcctccatttagtgaattgggtcgggtcgggtcagagttagactctgtagagacccgaataggagaggacgtgactctgggacaagaatcaaaggagtggggaattgtgatgaggaggagaatctgagagagattggaactgagaggacgatttttgttacaacgttgcgcgggatatccagcaatgagacgcttcttaagcttttatttattttcttttattttattttttctcctcctcgtaaacaggttttaattattactatttatttttttctgtctctcggaaaatgatttttgtttttttagtgcaaattaaatgtaaacaaacatatttaggtttcaatttttcaaaaaattaaaatgactaaatatgagagaatcctaagaatcacttttcaagagaaaaaagtgtctattttgtctataaaataaattaaaatttgttagaggttaaataatgtttttattaagcttttggtttcataaaagtggatgtggtaatatgtttaattaattatgaaaatatcatgtgtcattctttgttttgtccgttaattaatgaaacatcaagtaacgaggagttgttacataagttattctaagaaattcgaagagacaacaattttattttgcttgccttgcttatgtatttgccttagaattgttgctttttgcattaatattgttcttgaggaaactgcgtcggaataggtcaataccgagagacggcattacagtaagactacatcaactccaaactacaagtctgttttgttgatcatacaaaagcgaaacaattagttttagtgttcgtatggtttgttctcatatttccaagatgcatccaaaagtgcgttgagagaagtgagtgggacatggttatgtgtacaagtagattataacttgattagttcaattcccgcatctcatatttttgttctcaactccattgtttttctctctttttttagcaatggaatgatgatccatagcttattgtcatatatcaaagcattccttggtttccatattatcaaaactatgaattaggcacagattttatgcatcatgtgtagctagatgatagcataagtttttctcttagctcttaattctcccttggattatgatatcacctccatggctccatatagacagacagtaatgcaaacatcaaaatatagtaattatcaacaactacaacactataagcctatataacacccttgcagttccacgcttcccagggatcatggcgatactcttctgctctctcttttattgtgatgcttctttgatctcttataaagtcgacatagtctccaacctctaagttccgccgcaactgctcattcatcttcaatatggacggtgtccgacgacatatatgatatggatgagaagatgaagtggatgaggtggacaacaagaagaaatactgcgacttcgtgtatgaatatcctccccttagcttccacgtttttggcttctaatgacagggatcatagcaagggtttggtcacattcaaaccgtgactcaatatcgttaacaagactctgattcggataaatgcttggctcatcatcatcgcacttatttgcatcttcaacgaggagaacacaagtcagttaaccatcgttgtctggagctatgaaacttattcccgcttgcttggtcgcgaaagtctccgccgatgttatgattgcgaatgagtggggctgtgtgagtcttattgtaaaataataatacaactagctaggtttggtagactaaagttattacatgaacttttattctgatatacacatacaatatatatttcttttttctaatgataaaccattatggaagaatactagcgagaatcttattagaacgaacgactaatcaagtaatcatagactaaagaagctaattaaacgactaatcatgtctttatggaccacctttgggaccattttgattgaacacaactccccaatagatctgaatatcttggaaataaattggcaatgtatttttagtaaaagcttgtgtgaattttctctacaaaaaagttctaacttttattgttttgacatatgtttgggtaagatttaaaaaacctatgactttatcgaaaaatataaatatttttttgtttgtcaattaaattttcatcgtaatcattgagattaaaataaaataaaaaaactaagacccacacaagtccaaatcaaacaaattagcaacaacaaaaaaatataagttgggaatagcaaaatagtatcgtttggggattttacaatttattttactgaaaaagagaaaaaaaaaaaatcggtatctctgaaaaaactgaccgcctcgcgttgtctcttccctacttcctccgattccttctcctctctctatatctgatatcgtaatcttctccgcctctctagggttttctccgttactcgtgctccagttttacgttcgttggcattcgctcaatcgcttctgattcatgaggttagggtttcgttattttcaggaggtgacaagattttattttattttatttagtctctgttgcggcgtgtttaaaatcagaagagatcggagggtttttgtcatcaatgttgatgattgagccatccattgtcttgtgttaggtctttgagttgaccttcttaagttttttttttttttttttttggggtctctgtttggttgattttgtagatcatgttaatacggggctgggttctattgagaatctgttaaaggtctttgaaccattgcatagtttgatttactaaatagcttactgatttttcattaaaaatccctttttttgagaatgttatttgtttggctttgaatcaggtagcattacgatg

SEQ ID NO: 5188 - DNA, 3000 bp, Unknown
  misc_feature (1)..( 3000): cDNA_ID_3076129_gDNA_ID_1620770_Annot_ID_167460 3000 nt of promoter + ATG
aatgttttgtgatcgaatctcttaaaatacatcaataaagagtttaggatgtcaagtttgcatcaaatatgcccacggagccccaactagaccatgaaaatccgatgttgtatcaggtcaaatgacctagctagaggtgtcaatgccaaaaagaattttcaaattccaagtatttctttttttttggcaccgatgccaaaaagaattttcaaattccaagtatttctttttttttggcaccggtgtctcctcagacatttcaatgtctgttggtgccaagagggaaaagggctattaagctatataggggggtgggtgttgagggagtctgggcagtccgtggggaaccccctttttcggttcggacttgggtagcgatcgagggatggtatcggatatcggcacgaggaatgaccgaccgtccggccgccgggattttcgcccgagttttctcagcagttctcggacaaaaactgctgaatcgtcgaggagccgagttttctcagcagttctcggacaaaaactgctgaatcgtcgaggagaatgggcttgccttgcgtgggctgccattagttcttcgaggcgttagggtggcggcggtataaaagtgtcggagttttttcagcagttctcggacaaaaattgctgagtggccgagaagaatgggcgtgccatgcgtgggctgacatggattcttcgaggcctaggggtggcggtatataacttgttcgcatgatattacgtgtcatggcatgggctgacatggattctcctaggccgtttgggtggcgggtgtcatggcatgggctgacatggattctcctaggccgtttgggtggcggtatagttgtcttgcgtagaaataccgagatgtccccatgggcatcgattccacccgcctaggttggatgggcgtgcttcgttggaaagcatggatccgcctaggctgtcccgagtgtgagcgaggtgtgagtgtcgcccatgggcatcgacaccttgcggctaggaactggaacgagacgggtggcaaagatttcgagtatattccgagaattagcaaaccgtaacgaagatgttcttggcaaccatctttattccgagaattagcaaaccgtaacgaagatgttcttggcaaccatcttttgatgggagtccggctgttcgatagccggccaagggtgatgaacgaaatgtgaacccttgtctcgcctaggttggatgggcgtgcttcgttggaaagcatggatccgcctaggctgtcccgagtgtgagcgaggtgtgagtgtcgcccatgggcatcgacaccttgcggctaggaactggaacgagacgggtagcaaagttgttgatgttattccgagaattagcaaaccgtaacgaagatgttcttggttgttgatgttattccgagaattagcaaaccgtaacgaagatgttcttggcaaccatcttttgatgggagtccggctgttcgaaagccggccaagggtgatgaacgaaatgtgaacccttgtctcgcctaggttggatgggcgtgcttcgttggaaagcatggatccgcctaggctgtcccgaaggtatctcgcgcttgtacggctttggctcggattcgtccgtcttctttcttcttagccgagtacttcgtatgagtggtgatcggatagctagtgttcgtaggctccatgctcgcgccgtatgagtggtgatcggatagctagtgttcgtaggctccatgctcgcgcatcgaactacctaccacctatccttctcagttaattcacgggcgatgttacgctcgatgatgagttccggggcctgtgtttcgtacctaatttgaaggaattgttgagtttggtttacacctttgcccgcggcttctccttcgtggggaagtcgtgggcacaaacatcggcgcttgttcacctctcgtcatcgcatttgtaaaagttgtcgacggtgactcgaagtgattcagtcccgccaaagctcatcaaaagttgtcgacggtgactcgaagtgattcagtcccgccaaagctcatccgtccttcgggcaaaagatgacggtcaagacctcgtcctttctctctttccattgcgtttgagaggatgtggcggggaattgccgtgatcgatgaatgctacctggttgatcctgccagtagtcatatgcttgtctcaaagattaagccatgcatgtgtaagtatgaacgaattcagactgtgaaactgcgaatggctcagtaattctagagctaatacgtgcaacaaaccccgacttatggaagggacggtaattctagagctaatacgtgcaacaaaccccgacttatggaagggacgcatttattagataaaaggtcgacgcgggctctgcccgttgctctgatgattcatgataactcgacggatcgcatggcctctgtgctggcgacgcatcattcaaatttctgccctatcaactttcgatggtaggatagtggcctaccatggtggtaacgggtgacggagaattagggttcgattccggagagggagcctgacctgacacggggaggtagtgacaataaataacaataccgggctctttcgacctgacacggggaggtagtgacaataaataacaataccgggctctttcgagtctggtaattggaatgagtacaatctaaatcccttaacgaggatccattggagggcaagtctggtgccagcagccgcggtaattccagctccaatagcgtatatttaagttgttgcagttaaaaagctcgtagttgaaccttgggatgggtcggccggtccgcctttggtgtgcattggtcggcttgtcccttcggtcgctttgaagaaattagagtgctcaaagcaagcctacgctctggatacattactttgaagaaattagagtgctcaaagcaagcctacgctctggatacattagcatgggataacatcataggatttcgatcctattgtgttggccttcgggatcggagta

SEQ ID NO: 5189 - DNA, 3000 bp, Unknown
  misc_feature (1)..( 3000): cDNA_ID_3076123_gDNA_ID_1620770_Annot_ID_167462 3000 nt of promoter + ATG
cgattaagacagcaggacggtggtcatggaagtcgaaatccgctaaggagtgtgtaacaactcacctgccgaatcaactagccccgaaaatggatggcgcttaagcgcgcgacctatacccggccgtcggggtagggcgcgagcccgggcggagcggccgtcggtgcagatcttggtggtagtagggcgcgagcccgggcggagcggccgtcggtgcagatcttggtggtagtagcaaatattcaaatgagaactttgaaggccgaagaggggaaaggttccatgtgaacggcacttgcacatgggttagtcgatcctaagagtcgggggaaacccgtctgatagcgcttaagcgcgaacttcgaaaggggatccggttaaaattccggaaccgggacgtggcggttgacggcaacgttagggagtccggagccaccctggaaacggctcagccggaggtagggtccagcggctggaagagcccaccctggaaacggctcagccggaggtagggtccagcggctggaagagcaccgcacgtcgcgtggtgtccggtgcgcccccggcggcccttgaaaatccggaggaccgagtgccgctcacgcccggtcgtactcataaccgcatcaggtctccaaggtgaacagcctctggtcgatggaacaatgtaggcaagggaagtcggcaaaatggatccgtaacttcgggaaaaggattggctctgagggctggctgcttccgcggcgagagcgggtcgccgcgtgccggccgggggacggactctgcttccgcggcgagagcgggtcgccgcgtgccggccgggggacggactgggaacggctctctcgggagctttccccgggcgtcgaacagtcagctcagaactggtacggacaaggggaatccgactgtttaattaaaacaaagcattgcgatggtccctgcggatgctaacgcaatgtgatttctgcccagtgctctgaatgtcaaagtgaagaaattcaaccaagcgcgggtaaacggcgggagtaagcatgaatggattaacgagattcccactgtccctgtctactatccagcgagcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagcttcggcgcaagtgaaataccactacttcggcgtggcctatcgatcctttagaccttcggaatttgaagctagaggtgtcagaaaaggctttttgatccttcgatgtcggctcttcctatcattgtgaagcagaattgctttttgatccttcgatgtcggctcttcctatcattgtgaagcagaattcaccaagtgttggattgttcacccaccaatagggaacgtgagctgggtttagaccgtcgtgagacaggttagttttaccctactgatgcccgcgtcgcgatagtaattcaacctagtacgagaggaaccgttgattcgcacaattggtcatcgcgcttggttgaaaagccagtggcgcgaagctaccgtgcgctggattacgccgcccgattgccgaccctcagtaagagcttagtgtaacgaccgcgtccgccgcccgattgccgaccctcagtaagagcttagtgtaacgaccgcgtcccgcgttcataaagaggccaggttgttttaggagaaaactagaccatggtcaagaaacggactaaaatacttagtcagaagaactagaaagttcaaagctgaaccagctaggtgagccggacaagttgtactcatagacgccaaacccttactatgacgttttcccgagcacctatccatcctaggataaggcatgctctttcccgtccgaacctcttaatttttcgcgattcaacatagaattgcctttttcccgtccgaacctcttaatttttcgcgattcaacatagaattgcctttacgaggctaaattctataatcgctctcttattacacagcggaagtctttctaaccttggtttaattctaaccaactcttgtaccggtttcatcgtctttgtcccttagacttagatcgatcctttactcggtcaagacatgcatatgttcgctaaccattctaagccaaacaatcgcatattcctttatcctactttcaccttggccaatatgcggatttgattccttagcccgtttgtcgccttactcacttggccaatatgcggatttgattccttagcccgtttgtcgccttactcaattcgttcaacaactcatcatcggtcgtgaattgatgaaccaatctctatcgttacttagccatacaaccaaccaaccccactggtctaagtacaacgatagagattggggatcgtacgattcccttggttcacgatggccgaatcaagctcttggcttattggtccatttgttctccaaacgtacgcccctccggctaccggtcgtttaacactaagaccgcccacggtttactaaccgtttacccgtccggtcgtttaacactaagaccgcccacggtttactaaccgtttacccgtccggtccatggtggtcgataaagctttcgggttaatgatccatccatgcggtccgaacgacatccttatcacacccaagggtccgtggattcatccactggatcatcgtaggctagcccatgaaatctttcttccgtcggccttaggtttgctcgcgggtccaacatccgttttgtccatcggttcccaccgtggactttctttcaccatggctgaggagatagatacatgaaggcggccgcgatgttgagtttcaccatggctgaggagatagatacatgaaggcggccgcgatgttgagcctttatggtgaatcacgttccttacccattcttggtgctttctccctttatcggtaagattgcatcc

SEQ ID NO: 5190 - DNA, 3000 bp, Unknown
  misc_feature (1)..( 3000): cDNA_ID_3076083_gDNA_ID_1620770_Annot_ID_167481 3000 nt of promoter + ATG
ggcccataactagctacgaagactttcccaatcttttgtaatcttcaaaatgtggttactttcagctcaaacttaactttcttattactattttatgatatttgataatcgatcaggagaccttttttttttttcttaaagaaattttcggaactactagaattttctcttggaattgaaaatatttaaagaaattttcggaactactagaattttctcttggaattgaaaatatagctaagctagctaggctttaccatacgttaatgatactgtctttttctctttacaattccatattcgaatttgatttgtatataacatattgggaagaatcatcaatatgtattcagctcaaaagaattcaacaaaaaaaaatgcctattatcaataaaaattcactgggctttagaaggcccacaatagtataatggatcctttttgttgggcttatttcagtcagggaacaatagccttgattttgttcctttttgttgggcttatttcagtcagggaacaatagccttgattttgtaaatctagttacgtggcatttaatatttaaaactacaaaatttaccagtcttggctcaaaaaaatatttattcacttttcttcttctctgaccaaaatcaaaatttgttcgattctcattcttcttctcacagtcgtaaaccctaaaaaaaaaacagagaaatcaaatttcaatctcgaaggatctacaaagaagcatgacgaccggagatctcgttaatatccatcctactgagcttaaattcccctgtcgaccggagatctcgttaatatccatcctactgagcttaaattcccctgtttttacgttttcgattctccgaattgaaccgtcgttgtttgtttgggtaacctctgttataatttgtgttgttgttggtggtgagaagttgagttgaagaaacaaagttcgtgttcgatgcaattgaccaacaagacaactactcaatgtgtcgcttttaaggtcttttacattctcttcttacaattctgtcttattagtacacattgagagagtgttgatgttaattgagagacacacaggttaaaactacacattgagagagtgttgatgttaattgagagacacacaggttaaaacccggtgattcctgcaatgttacaggttcttaaaaccatttcttctttcattcaaaagctttggttttttttagtcaacaacacaaaagatgattgttgttttgtttcagtgacgatgcaagcccagaaagaggcaccacttgatatgcaatgcaaagacaagttccttgttcagactgttgttgtctctgatggtactacttccaaagaagtcctcgctgaaatggtttgcacactatatgcttttttaattccaaagaagtcctcgctgaaatggtttgcacactatatgcttttttaatttgttgcagttcaacaaggaggctggtagagtgattgaggatttcaaactgcgagttgtttacattcctgctaatcctccttcacctgtccctgaaggttctgaagaaggcaactctcctatggcttccctcaacgatattgcctctcaatctgcctcactctttgatgacgtgagatgatgattcattttgttatccaatgttaagaaaccgagtgtaatatgcatcttcttatttcaggtgtcaagaatgttaagaaaccgagtgtaatatgcatcttcttatttcaggtgtcaagactttgtcttttaccattctcgacatcttgatagttaagtttcaccaccaacatcctctctcattcgctcaggcatggtctatgatttccaaattgacggaggagaagacttctgctactcaacaaagtcagaagctccgtctcgaactggtacgcgttgaccccagtgcactaagtgatctacttgttatttgtgtaatcttcataaacgaatacatgtatatattgtgtattcaggaaatgctgaggaattcataaacgaatacatgtatatattgtgtattcaggaaatgctgaggaatggtgggtctgctcggttgcgtgattggctacttattgaaccggatataaacgccatggggttagcttcatcatccttttaatcatcaaatcttgcaaagttcttaagatttttgaccagattttcgtaaaatggaggtggtttttttttaaaagtttcatatttaagctgtaaaatcagtagctgtagcacaggaacaggtgtgattttgtggcaggtttcttgttattgatttaaacacactttcgaggtgtgattttgtggcaggtttcttgttattgatttaaacacactttcgagtgattaagaaaacaaacgcatcatacaaagtagaaagaaaacagttacatgttttagtcttggaagtcttctttgggcttggtctttgtctttcgatatctttcttccatctgcatgcccatggaataagctgcttgagccaccttttctatgtttggaacgttgtagctctgcgctatatatatcccccagatggttccgcagacgaatgagaagtagcttcttataaaccccattttcaacaccagatgcagacgaatgagaagtagcttcttataaaccccattttcaacaccagatctatgtttatcttttacttcttctccaaggggtttgtttacaagttcatttatttcctcaagggaaaagttaaactttttctccaagggtcaactccttaaatctcgccatctataaaagtctatcagatattatatgaatgtgtcgttttcgaacagcaacaactgtatttttgagtgatcggaaaagattttccaaagtatagaagaagacaaatacgttttacagaactagggataacacaaacaattatagaagaagacaaatacgttttacagaactagggataacacaaacaatattgttaaggcctctcttcttcctcataggtatcacatagcactagtttcaagataaacctaatg

SEQ ID NO: 5191 - DNA, 3000 bp, Unknown
  misc_feature (1)..( 3000): cDNA_ID_2052773_gDNA_ID_1620770_Annot_ID_167510 3000 nt of promoter + ATG
caaacatttccttgttcgtttgccctagacaaggcaataaatcatatcctagagaagcgtaatcgatcattcgattttctttacctaagcgtacaattgaatgttttcttatattatttcttccgttcctttgtcttattattccttaagtctatgttcttacttacgttcactctttttttcttggttactcggacagattccaagtttcttattctacaagataaatgaatcttggttaaatgaattgctggtgaaggtattatcatttcttccaacaaaagatgctgtaatgaattgctggtgaaggtattatcatttcttccaacaaaagatgctgtaagaacgagtcttttatcgatgcgatggaagtctctttggatgtggctgccgaaactggagtacgattttaggcattattcagtttcggaaggccaagggttagctagatttattactttgagtctactaggacataaagctccggccattgaaagcttgagtctcaagcttaggtatggagcaattggatcaattaaaccgtgagttaagtctcaagctttgtacttttgcggagcgtccaactaaattggtgagttaagtctcaagctttgtacttttgcggagcgtccaactaaattgcccaaaagcttatataaatgcaaatcgattgtgatcttgaaactgaaagacgagattctcgttgatgttcctcgtaaggtatgtctcccctccttgaaaacattgttccttggacgtgtgacttactcggatgaagattctcttcaccgacttctctccaactgccctgttcttgaggatctagttgtggaacgagatagtaaccctaaagatgtcttgtccttgtcatcttgatgggattatgatgaattaaccctaaagatgtcttgtccttgtcatcttgatgggattatgatgaatactccttctttgaagtatttgaaagtcactgatgaaaggcaagagagtgatagtgataatgagagtgatagtgatagtcctcgatacttctacgattttgaagatatgcctaagttggaggaggcagattttgtattgacattccaaaatatcaaaaagttctttaaatttgtcacatctattaagcgtctttcgttatgttatttttgaacaatattcttgaagttgaatcttttgtcatcttatgcagttatttttgaacaatattcttgaagttgaatcttttgtcatcttatgcagtctttatatcatgagggtcttgtcttcaaccagcttgaacaattgaagatatgttcatgtgattcagattggtcaattttactttctcggttactcgaaagttctcccaatttacgagagctcgaggcttacgtgatagaagtaagtttcttcgttagagacatattccattggttcaatttactatattgtttaagccacaaatcagtggggcaatcagctgaattgtgttcctaaatgtttgttgtcgcaaatcagtggggcaatcagctgaattgtgttcctaaatgtttgttgtcgagtctcgaaacgttcaagtggagtgagatgtatggattgctgcagaaccagatggatgtggctaaatatatcttgagaaatgctcgatgcttaaagtctgcgacaatcttttttccgacaacctatgctaaagaaacaagagatgagatgatcgaggagttgtcactttcttttcaaggtccagagacatgccaagtcttcactaccctccatattacaatggttttttatttgcagcaacttgatctaacactaccctccatattacaatggttttttatttgcagcaacttgatctaaacttaaggtgttttttttgtctttgttttttttgtatactttatctttgagcatactatttttcttgagacattggctttatctttttctgagatcttaacaaataaccgaactttgaagagacaagacatgacatgaacttttatttgcagcaacttgatcataacacaagactcaaacacaagactcaaacacaagacttagaagatcagtcaacaatatagatgttgtagaaatttgcatcctaatattagaagatcagtcaacaatatagatgttgtagaaatttgcatcctaataaagttcattacaaagaaatgacccaagtttcccacacatatccgcatcaaaaaaacaagtgccataacattgcattaagattcatattcatattaccaaacagagcacttgcacacatacatcaacacaaaaccggcaagaacatcataggaacactcatttgaaaaaacccaaggaatagattcgactatgtaaacacacttcaaagaagaacgagattttctcagcgctctcaaacccgggttctcaacttcaaagaagaacgagattttctcagcgctctcaaacccgggttctcaaacccgaaccggaccggaaccggaccattacccatttaacccgacggtttacccataagccgagccctaattttttcaaagaaaagggccctaaacttttcgtcttctcgcttcccttcctctatctcgtcttctcgcttcccttactctatcccatagaaaaaccctgaatttggtttggccaatgatgtcaaaactcttacatttggtaagtctcttcaacgattttggttttgtgagcacttacttctacatttggtaagtctcttcaacgattttggttttgtgagcacttacttcttcttacaagaattacatgtctttgttcaggttgtaactgttgatctgtttctgtcacaaaatgggttcgaaaaagaagtgttttgatggttctagagatggaatcagcggtttaccagacgcaatgatttgtcacatattatcatttcttccaactaaagtagctgcttcaactaccgttcttgccaaaagatggaagccatcctcgaatgacttgtgaagagaggagaaagggttctgaaagttttatgatcctcga

SEQ ID NO: 5192 - DNA, 3000 bp, Unknown
  misc_feature (1)..( 3000): cDNA_ID_2052834_gDNA_ID_1620770_Annot_ID_167489 3000 nt of
acatctctttggattggatatataataactgtggtcgacgacgacacaacttcccccaaacaaaacgttacgtctttgacataaaagatgagcggaagcaccaccggttgtggaggtccatgcggcgcatgtaagtttctccgacggaaatgcgttgctgactgtgtcttcgctccctactttgattcggtggaagggacgtctcatttcacggccgtgcacaaggttttcggggcgagcaacgagggacgtctcatttcacggccgtgcacaaggttttcggggcgagcaacggtcacgcttacttacgaggcattggctaggcttcgcgatcccgtctacggatgcgttggtcatatcttcgcccttcaacatcaggtattcaactatataaaacccaatattgtcacatatttatgtatatataatatatgtttgatgatctatatacattgaaagatttactatgcatgcatgcgtgtatttagttatatagaagttcattgtataataaaatcatcccataacattaggttaaagatgaagaagttcattgtataataaaatcatcccataacattaggttaaagatgagttccatttaatcgcctcttggtttcctgtttattagttttgaaaattgcatagtactaattccacaataagagtcaaagttgctaatattgaaaatagctaacgtgtgtcttcccaatggctcgtttgtcgaaaacagcgttaaagaaagtcaaatcgtcattctttgtggttacattccgacttgtttgtctttaatagtatatcggttgaataaaacagtttgaaaattttcttctaatacgaataagtatatcggttgaataaaacagtttgaaaattttcttctaatacgaataagtcccacatgtgaacaggtgatgaatctacaggcggagttagcttacgtccaaactcaactctcaacattacaaggtcttcctccgccgaattctcaaaacaattcacggacagaagcagcctcttcatctaatgtgccactcatttcttctgtcgatagcaaagacaatatgtcttcctcgtcgtcacacattccttgtatgtcacaacaacaagaacaagaacagccaaaagaagctattgaggtcccatgtcacaacaacaagaacaagaacagccaaaagaagctattgaggtcccatgaggacggtgatcttaacgctcttgcccgtgagttcttcactaagtatttgaccggaggcaaataccgaccatcttctttaatataaccatgttaacctttgcgacatttattaggaactctttattttgtactaactggattgccctgtaacttaaaaggggcgttaatagattctattggatttgcagtgcaaactcacatctcacatctcacgcttgacgtcgacatgacacccatgtccctctacacatctcacatctcacgcttgacgtcgacatgacacccatgtccctctattaaatgtgtaattcataggtaatacaggcccaaaaggttaaggcccaaaatccccaaatgggcttatgttaaaatcttgccttttgcatccaaacccacttgccttttcttcaagtgtgactaaaaacattatgtaataaagctaacgttaatcacttgtcttggaaatatacaggggtgattaatatataatagtggtgaaggtggtctcgaggcctcgaaattttaatttgaactcaaggaaagatggaaggtggtctcgaggcctcgaaattttaatttgaactcaaggaaagatgaattgagatacggataaattcttatttaacacacaatgatttaaaatcacaaatgctctattcttttcttggaagtgaaagcaatataagagaaagagtcagagtgagtcaaaaaggagacagaaggcagagaaggtcaaacaaacggcttgttaatctgaccgcttgtcactttattatctgtcacctaccaatcacattcctagtaaactcttgtgtgaaccaacataaacatattgttgcaaaataatcctagtaaactcttgtgtgaaccaacataaacatattgttgcaaaataagcaaacgggacaatttttttttttttttttttaatcaattccggacgtgaaattatttattaaccaaaattcactgtcggtcttattcttaacgacaaaaaaaaagataaattatttttggatatttcttcttgcaaaaacctaattttctctcatctttttttttttttttacgatctggttttttgttttctttctactctgttttcaactggggacactatgtttttttttcttcttcttgtttggatctgttttcaactggggacactatgtttttttttcttcttcttgtttggacgtgagctgaccaggagaaatctgttcttgtgtttagttcaattctcggctgaggaacgttgactgttgactgatagagcaacttcagtgtgttgagaccaaacataaagcttcaggtctctgtttttcttttaaacacttttgtctgagatctcattatttttgtacttttgcttctaacctccttgtgttgtttttttttcctgttcaaactattatgatgtacaatttgagaattttcagtgtaacattcctgttcaaactattatgatgtacaatttgagaattttcagtgtaacaaaaaagtagaagcctttacaaaaattaagtctcagcgttatatcattaccacatttgttgagattacttgaaattcgaaatcaagtttctatatttatgaagctatgtggttggatgatgaactctcttttaaagttttggcttgcttgtaattgcagttaaggataggatttgagaatggaaacaagcgacagaattagccctggtggtggtataggagcagaagttccatcagcgtatcatatggctcccctggtggtggtataggagcagaagttccatcagcgtatcatatggctccccatg

SEQ ID NO: 5193 - DNA, 3000 bp, Unknown
  misc_feature (1)..( 3000): cDNA_ID_3076117_gDNA_ID_1620770_Annot_ID_167464 3000 nt of promoter + ATG
acttcgatttttcaatcagtaatattggtggttcagagatgatgatgatgaatcttttaaggagatcagcgatagccatcggccgccaatgatgatgatgaatcttttaaggagatcagcgatagccatcggccgccaatatcccaaaatcggtaaggctttcgtattccatctcactctgccggcatttctatataatattggctaaaagctattggttcttctactacatagacacggattgtttaggatcttgtgaaaattgaggtcgtttttttcagtgtctctagtcctgtttgaattgaatctctctagtgtccttgatctggggaaaacttacagtgttacttttgttatatatcagtccaagagggtttttagcaactcattagtgttacttttgttatatatcagtccaagagggtttttagcaactcattacattttctttgctctttacacccttttgggcttatatgttagtctcatacctctcatcgtttttcttatgcaggactctactggagctaatggtcagcagtgataattgtgtaatcaaacttcaaatcctagtgttgatgtgtaccttgttgttctgacaattgtctgttatacaggactattgtttcgcttccgaaacccgcaagcaagtatatgtacggaagctcgtccaaagaacatcaactcatcccgcaagcaagtatatgtacggaagctcgtccaaagaacatcaactcatcagcagaataaggtgtttcttcctacaagtttctacttaatgtctacgttatgtgtttgccatttatcacaacgcaagccgtcaaaagcgacagacagcttctgtcatctaataatgatgcttgctttgccaattgttttacaggctaagaaagaggtgacgactgtggaggatccttttgattctcctacataccacatcccggagaagccggtgacctttacagaaggtgcgtcctacagtcttgttatccggagaagccggtgacctttacagaaggtgcgtcctacagtcttgttatagctcatttttcaaccaaaagagtgaggcttcagaaatctaatttgaatttatctgctcagacacttggatttgagtaatctaaagacaccattatgtattctaggtacaaggtctttgacaaagccttgaagagaattcaagatgatggtcaggtaattagaaactaactctacagattgatcatagcggaggggtggtgtatgaaacaaaagcatctgtttataaaatgaaacaatttctgtgactgtgtatgaaacaaaagcatctgtttataaaatgaaacaatttctgtgactgtctatggacaagaaactagaaaccgagctgctcgtcaacgtatacccaacagagtatttacagatgaagacggagtggagcatgttgaggtatttcattgtagaacctctattgcgcttggattcacattcttgctatataaattgtctagagttttgcaggtttaacatgatcaaaattgaatatgcttcaggtaaacttctacatccgtgggcctcaaggagcagggaaagtgtacacggagatgtttactacatccgtgggcctcaaggagcagggaaagtgtacacggagatgtttattaacaccttccccagccaaattgatgctggagtcttatttgcctgcctaaagcactcgtatttatgactcagcagatccggaaaacattcagaaacggcttagattgttttagttggggtgttggagaaaagagagagaattgtgttacacatgagctgtaggaatgacttcttatcaagcaactgtttgctaattgaaaaacaagtctaaactgtgtttatgatcctcttggggatgtctaggattttaaacaagtctaaactgtgtttatgatcctcttggggatgtctaggattttaacagagacatggagaatgcatatatcatgaagcatcaagtatacaatagaggcaatcatggatcaaacggtgtttatggtatcagtaagacagcggagaatgcaaccgggaccaactctctctctgagtttccccgagccatcaaggctacaaacatctcgactacaagggccaatcaaattacataatcacggaaaaaacaaggatagatacaagcaaacctaacactcgagcaataatttgagtaatacaaggatagatacaagcaaacctaacactcgagcaataatttgagtaatcctaattaatcttgtgtttaattaagaaaagaaaacacaaaaaagttgaaaggtttagtggtgcatccacgtagcaagacattttaggtgtacgtcgaccatattgttggccgtttatagagcatcatccactctcctcgacgagcaagatcatgccgcctctggattcttctcattcatcggtgttcctgcgatcccctccgtagcaccctccgcctcctcagcgccttccccgtgtaaattaccgttcccgtagcaccctccgcctcctcagcgccttccccgtgtaaattaccgttcatacttggctattgttgcaatgtaattttcattgaagtcagtcaccaatgaccattgaacagatgttttaaaatgtccacgtaagcaattgttgtttggaacgattttcggttagcattcgtgccttttttacctcaataaaaggccgtggcattaactcacttgtcttgagacgttatgtcgttaaaaccaagcccaaagttaatttcggcccaaatcgttttcaactttcccgccgtcttttaactttgttaatttcggcccaaatcgttttcaactttcccgccgtcttttaactttataaaatttccgcactcccgactcttggtgtggtaggcaattctgaatcgcgaggtttagttctccggctgaatcagagaacgacgagtcggaaaaattcgaaactctagaactgaataaatgtcgacgtggcaattatttcccgattccagcggcgatg

SEQ ID NO: 5194 - DNA, 3000 bp, Unknown
  misc_feature (1)..( 3000): cDNA_ID_3076125_gDNA_ID_1620770_Annot_ID_167461 3000 nt of promoter + ATG
gtgaagagacagacttgtccaaaacgcccaccacgaaggtgcatagtgagaagagtaagtcaagagatagacttgtccaaagaagagtaagtcaagagatagacttgttcaaaaagaaacagaagagaatagaagagtaagtcaagagatagacttgttcaaaaagaaacagaagagaatgcttggggttacactcacgaaggtgcatagtgagaagagtaagtcaagagacagacttgttcaaaaagaaacaaaagagaatgcttggggagatagaagtgtgagatagttctcaagctaagaaagttgtaaaagctaagaactagcatcaaatgatggatgaaacacaaggtagttgttgaaaagtcaaacacttggtgatgaaaactggtgattgttgcgaaaatcgtccaggattcctcgaccaggaatgaaaactggtgattgttgcgaaaatcgtccaggattcctcgaccaggacttgaaatcgtcgaggggaaaaaatcggttccgaggaatcgtcgatccggacttggaatcgtcgagaaaagtttaccgggtccgaggaatcgtcgagaaaagtttaccgggtccgaggatttgtcgaccaggagtggaaatcgtcgagaaaaatctatcgggtccgaggaatcgtcgaccaggacgaggaatcgtcgaccacttcatcgaccgggtccgaggagtggtcgagggtttgtcgaccaggacgacttcatcgaccgggtccgaggagtggtcgagggtttgtcgaccaggacgaggaatcgtcgaccgggtccgaggatttgtcgaccaggggttgaaatcgtcgaccacgtccgagacttcatcgaccgggtccgaggatttgtcgaccaggacgatgaatggtcgatgaaaatctatcgggttcgaggaatggtcgaccaggggttgaaatcgtcgaccaggtccgagacttcatcgaccgtgtccgaggagatttgtcgaccaggggttgaaatcgtcgaccaggtccgagacttcatcggatttgtcgaccaggggttgaaatcgtcgaccaggtccgagacttcatcgaccgggtccgaggaatcgtcgaccaggacgatgaatggtcgatgaaaatctatcgggttcgaggaatggtcgaccaggggttgaaatcgtcgaccaggtccgagacttcatcgaccgtgtccgaggagtggtcgagggtttgtcgaccaggacgaggaatcgtcgaccgggttcgaggaatggtcgaccaggggttgaaaggtttgtcgaccaggacgaggaatcgtcgaccgggtccgaggatttgtcgggtttgtcgaccaggacgaggaatcgtcgaccgggtccgaggatttgtcgaccaggggttgaaatcgtcgaccaggtccgagacttcatcgaccgggtccgaggaatcgtcgaccaggacgatgaatggtcgatgaaaatctatcgggttcgaggaatggtcgaccaggggttgaaatcgtcgaccaggtccgagacttcatcgaccgtgtccgaggagtggtcgagggtttgtcgaccaggacgaggaaatttgtcgaccaggagttgaaatcgtcgaccgggaccgagaattcgtcgaatttgtcgaccaggagttgaaatcgtcgaccgggaccgagaattcgtcgaccaggacggcggaatgctcgaccaggacgatgaatgggcgatgaaaatctatcgggttagaggaatggtcgaccagaagttggaatcgtcgaccgggtccgagaattcgtcgaccaggacgaggagtggtcgaggatttgtcgaccaggagttgaaatcgtcgaccgggtccgagaattcgtcgaccaggacggcggaactggtcgaccagaagttgaaatggtcgaccgggtccgagaattcgtcgacctggtcgaccagaagttgaaatggtcgaccgggtccgagaattcgtcgaccaggccgaggagtggtcgaggatttgtcgaccaggagttgaaatcgtcgaccgggaccgagaattcgtcgaccaggatggcggaaccctcgaccaggacgatgaatgggcgatgaaaatctatcgggttcgaggaatggtcgaccaggggttgaaatcgtcgaccaggtccgagacttcatcgaccgggtccgaggattcgttcgaaaatcattggatatgatgcaatgttttgtgatcgaatctcttaaattcgaaaatcattggatatgatgcaatgttttgtgatcgaatctcttaaaatacatcaataaagagtttaggatgtcaagtttgcatcaaatatgcccacggagccccaactagaccatgaaaatccgatgttgtatcaggtcaaatgacctagctagaggtgtcaaaaaattatgaaaatttaccagaaaataggatttagtatccttatgatgcatgccaaaaagaattttcaaattccaagtatttccaagagggaaaagggctattaagctatataggggggtgggtgttgagggacaagagggaaaagggctattaagctatataggggggtgggtgttgagggagtctgggcagtccgtggggaaccccctttttcggttcggacttgggtagcgatcgagggatggtatcggatatcggcacgaggaatgaccgaccgtccggccgccgggattttcgccggaaaacttttccggcgacttttccggcgatcggttttgttgcctttttccgagttttctcagcagttctcggacaaaaactgttcgaggcgttagggtggcggcggtataaaagtgtcggagttttttcagcttcgaggcgttagggtggcggcggtataaaagtgtcggagttttttcagcagttctcggacaaaaattgctgagtggccgagaagaatgggcgtgccatgcgtgggctgacatggattcttcgaggcctaggggtggcggtatataacttgttcgcatgatattaccgag

SEQ ID NO: 5195 - DNA, 3000 bp, Unknown
  misc_feature (1)..( 3000): cDNA_ID_3076203_gDNA_ID_1620771_Annot_ID_167526 3000 nt of promoter + ATG
tttgatcatcgtttataactctcattgtgatttcagcaaatttttgtagcatttcggaattttgatctcttgatgagttttatttacgttttctgtttgctttttttatctagtgatcaagttttgagatttatgttgttgttgttatgatgatcttgtagatgcctttaggaagatgaaagtaaatgagaccggcgtggaggaactgaatccgtatccagatcgtcccggtgaaagagattgccaattctatttaagaactggtctctgtggctatggaagcagttgccgttacaatcatcctactcatcttccacaggtcagaaactaaacttcatttattttggctgagtcttacttaagttgcaattttggcctcatgggtttactgcttttaaacatcttaataggatgttgcttattacaaggaggagctccctgagagaattggacagccggattgtgaggtgcagtttcttgtatctctcactatctcaaatcttggttgttgtttggatgagtacattgtaaacagttaaaaagaaaacgagatttttgttcagaataaagctaaagtaagagaactgattctagtttgtaacttcacataagagaggtagcaagaatatacattgaaactgcagaagatattcctcatctggtttagtctttcctccaaatgttttccacaaacaactttttcttctacatgcaattttcgctgcagtattttctgaagacaggagcttgtaagtacggcccaacttgtaaatatcatcatccaaaggacaggaacggtgcacaacctgtaatgttcaatgttatcggtttacctatgcgtctggtaatttccatcgttgtagctaaattctttttctttagtcgaatgtggaagacttatttgaatttcttctccagggtgagaagccatgtccatattacctgcgaacgggaacttgcagattcggagttgcttgcaaattccaccatcctcaacctgataatggacattctactgcatatggaatgtctagctttcctgctgcagatttacgatatgctagtggtttaacaatgatgtctacatatggaactttgcctcgtccgcaagttccccagtcctatgtgccaatcctggtttcaccctctcaaggctttttacctcctcaaggctgggccccttacatggttagtctgaattgaagctgccaataacgtaaacctgttctttactgttgatatcacattttatgttgcaggctgcatctaactccatgtacaatgtgaagaatcaaccttattactccggtagtagtgcatccatggccatggctgtggcattgaaccgtggtttgtcagaaagttctgaccaaccagaatgtcggttttttatgaacaccgggacatgtaaatacggagacgattgcaaatacagccatcccggagtaaggatttcacaaccaccaccaagtcttataaacccttttgttcttccagcgagacctgtaagtctcttactaaactgaaagaagagctttggttacaaacaaatgtggtcttacaggtcactagtaaaacttttacaaagattttgaacatctaatgagctactgttttgatttttgctgtctagggacaaccagcttgtggtaacttcaggtcttatggattctgcaagtttggaccaaactgcaaattcgaccaccctatgctgccatatccgggcctgaccatggctacttctctgcctactccttttgcttcacctgttacaacccatcagaggatctcaccaacaccaaaccgctctgattcaaagtctctttctaatggtaaacctgatgtgaagaaagaaagctcagagactgagaaaccagacaatggagaagtgcaggatttgtctgaggatgcgtcatcaccatgatcatgattcttaaaaaccccaatgatctctctctgcccttttttgtggaagaggaggggaggtgaaaagtgtttctcttttctttttttttttggcttggagatggccatggctgaaaacaatataggatgaaaccagtgatgttgtcacaggtttctcttctgtttttgactctgttaataaattttaatcagacttatcagaggaaaaatagagtttgtgttgtgacactcactaagagctctttatgaatgacaactcgaacgtaaaattacatcttttgcttttgtcaagtgtttacatcagtaatatccccaatttcaagcttatttttttttttcaattttaaaactaaaaaggttccaaattttttttatcgatgagtcatatttcatttgaacattccaaaagtaaagaaaagagttgaaaactttcctcagcctattacaattgcctttagctgttaatgagttttagagattcgattagttttaaccaacagttcctgaataattggattttactctcttgttgagtttaattattccaatatttcttcatggtgctgttttgctattgctggtgataaacagttgatctaccgacgatttgcattcgacggtggtttcttcaccagaaatcgatatctccgatggcgaaggatgacgatgggaatcttttttggctcatcttacacgtgtattattacgtgtctttggatgatctttcttgatgcaatcttcttctgtaaacggtgtattattgggctcttcttgagcttgcttttgttcgcaatctgtttatgtgtgttgggctgtaattggccttgtagcaaacggtttattgaataaagtccactattgagaaaaaaaaaaaaaaaaactgaaaagggttgtttttaggcattttttgtcggagaaaaatctgggaagaagcttcgtcctttgcgtgacagggaatctctccgttggggttttgtggctgcctacgatttctgcaagcaaaaccacagaactcaatctaattaattagccgagtcgactcaatccgagtttctacagccgcacgagggaatc

SEQ ID NO: 5196 - DNA, 3000 bp, Unknown
  misc_feature (1)..( 3000): cDNA_ID_2990596_gDNA_ID_1620771_Annot_ID_167527 3000 nt of promoter + ATG
atgaatgacaactcgaacgtaaaattacatcttttgcttttgtcaagtgtttacatcagtaatatccccaatttcaagcttatttttttttttcaattttaaaactaaaaaggttccaaattttttttatcgatgagtcatatttcatttgaacattccaaaagtaaagaaaagagttgaaaactttcctcagcctattacaattgcctttagctgttaatgagttttagagattcgattagttttaaccaacagttcctgaataattggattttactctcttgttgagtttaattattccaatatttcttcatggtgctgttttgctattgctggtgataaacagttgatctaccgacgatttgcattcgacggtggtttcttcaccagaaatcgatatctccgatggcgaaggatgacgatgggaatcttttttggctcatcttacacgtgtattattacgtgtctttggatgatctttcttgatgcaatcttcttctgtaaacggtgtattattgggctcttcttgagcttgcttttgttcgcaatctgtttatgtgtgttgggctgtaattggccttgtagcaaacggtttattgaataaagtccactattgagaaaaaaaaaaaaaaaaactgaaaagggttgtttttaggcattttttgtcggagaaaaatctgggaagaagcttcgtcctttgcgtgacagggaatctctccgttggggttttgtggctgcctacgatttctgcaagcaaaaccacagaactcaatctaattaattagccgagtcgactcaatccgagtttctacagccgcacgagggaatcatgaatcggctgagaggccgaggtacaccgattctgggttccgcactcgtgcctcagctgaagaaaaaagccctaaattcattggtcgccgtccaggattcatatctatccaccaaggtgatcgaagaatttcaattcataccggtttctgaagaattgggattagtaaatgttttttgcatcaggatttttgttaaaatgtcaatctataatctgcttataatgggtttcgtttaatctcttaggacttgttcgagaggcacagggtcgtgtttacagttggaacttctatagcatctgttgctacggcttggattggtatgttacaattccatattttttgcttactttatcttcaattagagaatctttacctcttaccacgtattttgatgtttaagtttctgaattggattgctttgaaaggcgagcaatggctattagtgaagtgattcagattttgggtgttgattggcttcaattcatgagtgtttcattgggatagctttagctctcaggcttgatctctaggggtgaaatccattctgtgataaatttgaggcctttttccggatcagactatagattacggtttagttgatttgatctgccataagtttccaagtgtttggagatcatcttggtcagaattctgtgatgatgttcaataactaatctgtccaaaacttccaataactgaagtttagtactttgagatctctacatgatattctaggtcttttgttattctgctgggacataaaacaagttagaaactgaatttcttgtgtgatactagtgaccgttggaagaggtatctcattggtcttttgtttatgtttgtactgagtcaaatgagttttatgaccgtgttctaccgaatggatgaatgattgtgcaggttactcattacgacattacaatgaaactagaattaatcagaggctggagtccattgagaatgcggttagtgtgtccctcatttgccaaagtttattgcacatagtattgcatatttgctttaaatttagctgctttgcatagttggattcatatagctgctcttcttgcaaatgacttggtgcttcctcttatgatgtctagttattgatcctctatcatgaacttacagcgtagttgtctgaatttagtcctctttccgttaataatatagatttttttgctaatacttacgtggttgactattttacactttaaaatattcagtgttttgtttttgtaccttaatgatccttagttgctctattgtctcagtctgtcacttgaaatgtttgtttttttggtcatgccagatgaaaaacacccaagagttagaacgaggagaactgaagaagctcgttgatccagtcggttccaggttcactacaacaattgccacagcgggaaccactttgatcctcgggtttgtttccggaaagactgttataggttgacaagttagatactgtgtgtcgggtttctcattaatagtttccgtctgtttttcttcaggtatgggttgggttggcgaggcgggatatggtatgcaaataggaagtttagaagggagcaaatgagattggccgggcagttaaaaccgagagaatggaagttactagggaggataaaacctcgagcttggccaacaacaaagtttctcagacgaccattcccaagacagaacaaaacaacagaaaatgctttgaaggcaccagaatgtggaggttgaaaaattgaagaacaatctaaagaagtagctgatcggaacataaaagtgcacatgggttttgtcttgaagccaaaggctcttctgtctttttattcctttatgaggaaattgagataacctaattcgaaaatcaaatagatttgtgttataaattgactctagtagtgtggactatgaaatgtgattcagctaatctttatatcgagatcaaaatttaaggattcctctgttttcgcacataaaaaagaaaaagaaaaaggattcctctgtttatgaacaagataaccaaaaaacatggccaagtagatgagaggagagtgtgctgacgtgtgacaatatcattggtgcgtacacgtaagtccacgtagacaatgtttttagttcgtgtcctaaagagtcacttttttgtgttttggtggagaagaaagagagggaagaaact

SEQ ID NO: 5197 - DNA, 3000 bp, Unknown
  misc_feature (1)..( 3000): cDNA_ID_2052970_gDNA_ID_1620771_Annot_ID_167530 3000 nt of promoter + ATG
gtatttcattttcttttgctctgtaagcttatttttctcatcgatccaacataaacaatcggaatagaaaataattcatcactctttatcactaggccaatactggactcccctcttagtgacataatttttgttgtctcttgataaccagattcgacagcttgcaaacgagatcaaagaactaactatgaccaatccagttaccatctttaatggagattcaaactccagtggtatgtacaagtcttagtttctcataaaatatttatgtactacttttgataatgtaggaaatgtttcaaatatgtttattttttatgagaaacagagaatgatataatctttgcttttgctcttgtaggctatgcatcttacctggttccagcggctgccgttggagctatggggtactgctacatgtggtggaaggtgtttatctctttaaaatctgtctatttttctctatgtttcatgtgtcttttgttatagttttgtaacatgtggtttaccggtaaactatatatcattgacttctaaggtttacccacattgcagggctggtcgttttcagatgcaatgtttgtgacaaagaaaaatatggctgatgcggttgcctctgtttcgaaacaactagacgatttgtcagacacattagcggtgaacaaataatttttttgagaccttcctctgttatatattctatttcattatgattttttgacctagtgcatttgtttacgcagtcaacaaggaaacatctttctcagaagctagcgaccttggattggaaggtggaagagcagaatgagacatctaaaatgatcttaagtgatgtaaggaacccgttttatttctcactttcttgtattgatgccttattttttccttagacttaagattaggatacttatacattcgtctgagagagatctcctcttgtacatttaacatcttagaagaatttaaaacacatttaggaattccaaaagattgtagagtatttatttattaacgtcctatctctttggccctgaactgtttttcttcacatgtacagtagagtcctttgtttctttcaaattacagcttgattctcatatctgcgatttactccatctatgcctttctttgatattcattttaatgctaatgctcacatggaatcttgcttcaattcaggttactgagatgagatcaagcatttcgcaaattgggtttgattttaagcaacttaatgaaatgatttctggaatagtaagtctcatcattgccctctaatatgcatcattgccctctaatatgcatattttaaaggggctaatatatctttactctcttatatgaaatttttacaggaagggaagattgaaagtcttgaaagcaaacaagtaatttgtctacaaccattagatactacaaaccacttcacgctatcaattttcttaaaactaattgatctcaaacagatattttttttgttaaaattttaggatgtgaccctctctggactatggcatctatgtcaagttgcaggcgttaaagacagcacaagtactaaagtatttcaggtgagtgttaacttacaaattaagtgaaacgttttcttacttatttttcacgtagttataggccttaatgaaaaaaatcttgtttctggctttgtggtttaggatgttggtgagagattacctattgatggaaaaccatccactaatacttctctctctgtaagaatgctactatacctttttccatcatataaatgtgcatttccattctgttgacgcaaaaaagttgcttatagtgaaaaaattcaacgagatggttgatcttgaatttgcatatattcaaggcaatctctcatcaagcttattcgaataaaaattggaacctgaaaatacttgtggtagtagctgttatttgatgatttcatgtcatgatgtttctttggctttctaaaactataaaactatggaaactccagggtctgcggtttctgacggaaggcaaagaggatgcaaatgtaatacacaagccggttatggcgaaagaaattatggtgatgggggaaaaaacaaaagtcactgcagcgggaagaagcagagttcatagagcgtttccaggtggaatatcttgggtacgggatgtttcaggactatcctaatattattttggttgatatacaaagaaattgcttgtattcgtcccaaattctgatactgggactggcaattattttttcatgtaaaaagaagaaaaatctacatatgttattgcatccaccaacaatttggtttgcccctaattatatttggtcttgatgtttgtaaagaaagagtgtgattaaggctttcacgtatgttgatgtcttcattgatttggacttttgtgctcctttttccttttgtgtttggatcaattttgtttgtgtagaaaatagaaagaactaccacagaagacagaactactgtcttgaaacatttgtttcgtcctttctcgtaggattaattgtctttagttggcagagaaataaaatatttcgctcttattgggccttggcccaaaatagatatagagacagcccaaatttaatttaacccgaaatagtccaaccgggtgaatttgacagcaattaaaaaacccggcccggcttcttatattaacaagaggcttggcatcggttaatcggagcttctttcctctcaagtgaagtgtctggatcttcgtcgctcaacgcaaatccctctccggttcatgtaaatttccaacttatttttgtgctcgaattttggttaacgggacaaatttcacacttttacggagtatggaagcagcctttgtcttctgggctgttgaattgcgattcattgtgtatgcccaacaatggtttaattgggaggttccaatgattttttgtgcttttttcttacttaatataaccactgttgatgtttcttctgtgtccttgtatcgccacagtggataagcagcctggggaag

SEQ ID NO: 5198 - DNA, 3000 bp, Unknown
  misc_feature (1)..( 3000): cDNA_ID_2052959_gDNA_ID_1620771_Annot_ID_167533 3000 nt of promoter + ATG
ttccggtcagacgccaaattcaagatccgtcagctgttctttacccgtttgctctaccgggtcgagggttttcagcccgacctgttcgaggattcgtcgcagatccttccgtgacggctggtaatctgagtgggtaccctcctcgcccgagttttacttacgatcctggaccatatgagcagcgtcaaatggaatccttgttgcagcagtttataagggagagaaatcctcagattcgtccattaccacgccttggattgggttctcctgttgggttgggtcccattagagcaagtcctcaatttctgcaaccgcgggtgaggtttcttagatgaagtcctcaatttctgcttgtcatgtttcatttgttaatgcttagattctagctaagtagtggaaagattagtggggaaaatgctcgagatgatccaaagtttcttgattggagtcttagtagaactgaatctgactgtaccgtgacttaagaatcatcttggttaatattggatccatttttgtcagagtgattctcattcgaactaatgcatgtagttctagaattttgatcgactagtctagttatacaacaatgtgagttgttggacgtgtctttcatggttttcttataaaccatgtgatagttagtaattggatctagttatctttctattttggttctttgtcctgctatgtgcctgctttactctggtcttgaaaattctcttttgtggaatgaggaagacttgaaaatgcttttatatcttagcaaatgttaagctgttcttctcttaatagttggtttgcacctacttacttttgattattgctcttgctccagtcacattttctcattttcgtaaattttggtacttaggttgccccgcccccaacttcaattctagacactagcaggaatagaaaggccaggtgaacatcaaatttctctactttgatattacctttcttttggtttcactgaaaatattattttaaaaaaaacttgttcaagagacttagttgccttgctgtttcttcttccttgttattagaagcaaggatggggctcttgccgttgttagagggagaaaggtaagcctactatcatatgtactgcttgtttgagaatttggaaaagacatctgttaagtttagattgtaatactattcaactgtttacaggtccgaatcactgaggggtcttcttctctttattcacttggtcgatcgtggttgaaaaatggtgctcacgttggaattcaggttcgcactttatatgctgctgttagagtaggatgttagtgtcattgacgactccgcttgataaaagattcatcggttgtattttcaagatattggtttgtggggttttgattcagaaaacctctcagaatgccaaatttactcgaatttggaaactaaattacttttgatcactcacctatttgcatccgtgctagttagaggattctttcttgatatagttatatttttagaagccaatcttagttaaatgatcttcaattgcatactcaaagcttgttatctgctttgcaatggaaatgtgcatctgcaatctcttgagcgtaaccatatatctgggactaatctaactttcagtttctctgttgacagccgcaaaggagtggtataatgaaacctttgccaaaaccgttacctgtggatttaacaacagagacaagtgtaccagatgatccagatgaagaatcagcggatgaagacaaagaggtttgtgttaagtcttcaagaaccattgattctatctgagcagaacagaagacattagtctgattctttcctgctgttgctaatttcagctcttgaatatttactacatgacgtttgattccactcttttctttgatgatctcaggacgaggaagctgtaaagcaattatctgagaaggatcttttgaaaagacacatcgagcgagctaagaaagtccgtgcacagtaagctccccactattctctctttttgctccttaggtcgtgtagtatttgaaagataaagctccccacaagattcatggattagttttcataatcatcaaagcaaatctagcagaatattttggtaacttgaaaaagcggatttctttctctttcagattacgagaagaacggtcgaggaggatcaggaggtacaaagaaagaataactcttattctggcacaatccgaagaccgatgatgcttgaagaacgactaaaaaagggtaaagttttgttaggaattagcttcatatgactgttgttgatttagcatactagtaccacgtaacaacatacgtgtagtaatagtataggtgtgttcttcttcgtcttctatagattagtaggactactcaatgaatagtgtttcattcttcctaaaactaaagaggaagataaaattgtttccttaaagtcagcttttactaatttgacaataaaaatttcttctcttacacatgtgtcaatcagcgaagtggtaataaataaactttactgtcattcgactaattgtaactttataaacaagatttgagaaaaattgagattttgtagtaaataggtggaagtctctaattggattagaggcttttcgagagagaatcgcatagggaagcggacagagaagataacaaacgctcatatttaaactctctttccgttacatttgccacgtaattacaacaaacacgtgtcatcgccgctaagaactaatttttgtcattgctccacacatgcaactactaaactaccgatgatctctctcgctcacgtttaatccgccatttctgtaaaatcctcttcccttttctgaagtaaactttttcccgcaatcaactcttgctttctatttttctcgattgtttacacttttcattttcagctctctgtttctttctttcacactaaccccaattctagtttcttactctccaagaaacaaagagcaccgatctcagttttctcgagaaacagaggacaaactcaga

SEQ ID NO: 5199 - DNA, 3000 bp, Unknown
  misc_feature (1)..( 3000): cDNA_ID_1399465_gDNA_ID_1620771_Annot_ID_167535 3000 nt of promoter + ATG
attgtcgatacaaacgaacaaaaagcaagtatgtatgatcgacgatagaaaaatacattcccaaagggtgacttgcgatccaagatttctccatagagatggctcaaaatctgtaaacacgtaactgataatcgaatcctgtatactatacatacaaacatgtatgtgtctaagtacataaaatttaaaaggcttcagccttcaagaagagtgaagatccatggaacaagatcttgtccaacttcgcttctctgacgtagccctaacctgaagaacacggcaatataaaaaaagtgtcagtgaaagctatttacgtaatatgatttttttcagcatagagttttggaaacttgttttaaacctttgatggtaaaggaggcaaagatgctcgtctcgtaagctcctctctttcctcttgaacagcctttaatctttctcttaacaattccacttcattttcaatctttaacctctcataatcaaccgcagacatcgattttctccttgaacccgaagagctcagcgacttcttgcgtggacgacataagggaggtagctttcgagcaatccccgagacaatgatactgttttcatccaacgattctttaggtttgccaacagaggattcttctagattcttcttcttactaatgttctctgtttcgtccttcaccatataaacatcacgcacacgtgagtacgcgacttctgaatctgatttatacagatctctgtttttatctctgtttccttcttctctataaggcatatcgagaaccgttccatcaagttcctgaacgagcaaagctcttctctcttgacagtctttgttttgtttgtgttccggttctggaacattcttctcttttattaaagaacattccaattcctctgtttcttcgagtagttgtctataagcttcaacttctttctccaagaaatgtttttctctctcacgccgtatcaaaatgtctttgagtatgaccatctcttcagcatcaaaagtcgatctctcttcaaccagtctctggaactgcctcgcttccatttcaattgccgccttctcatcttgcagcctatgtatcatcgccatcgcttcatccgctgctgatgctgcagcgcttctctctttgtcaagctcgacacaaaccgttgctcgagccgctctctcttctttcaataattcttctaaatccctaacagatcttttctctacatttctcacaaaagattgttctgctgatgaattggagtttacctgttgattaactgatacggttttctcaaattccggccaatgagatagattagtcccctctcctgccttaccacaatctgcaatacatccaagaagagcaaggcctaacattgattattcgaatgtagaagcaaaatctcaatccataaagaagacaagttaaggtaagaaagaaaacctttttggtcatcattggaacatgtctcatcataaggctgcatcaaattggtttttgcggtctcatcaaaggcttctgatgaagaaatagatctgagacttgcacagtttacacgacctgatctcctatggtttttaagaccgtttcttgatcttcttgtaacaaaacgtttgcctttcatgccctgaacggtcataagatcaaatctaccaagttccttattgttaatcacatttggttcgtctcttgacaaatcctctgtttcatctttaactctagcattgcttatatcaccactgttctttctcaccagctttaactcaacaaaccggttcgaatcatcgtcactagtaatcgaaccaaaagggattttgctttttatcgatcgatctacggctgagattctgtctgatgcacgatccaccagaaggtcttcatggaggcatttcctcatagtgtttgatacaccgaaacgtccattgtgaaattttggaagaggtaaacctagaaaccctagaaatctcaacaggagatgtatacaaagagatgtacatagaagcaaataagctatggagagattcagaaatgcgcctatgagaccagtgaaattccaatagtgcgtatctaaacacggcattttgataaatagattagtttctatagctctgagtcaaatctattcaccaaatccaccacctatgggaaaatcaagaaacatggatgatgtgttcgaactttgatagacccatttcagatttctataccagacataaaaattccattccgaaattttagtttcttgtaatataaaaaacaagtacgtaaagcaaacagagctgaaccacatgttgatgatgaatctcaaataggttactatttttgaacaccatgcataattggattttacctgaagttgaggtctagcattagccaagtggggattaatgcgaacgttattagggttcacaaatggatatgatgcaaaatcatgtagacaaggcacgtgaggatgtatactgtcagagatgcttcgaggaacacaacacctctgccatggcaatcttatacacatctatgcttacataagatggttttatttggtttaaaaaatgttattgcacttttgattttcttattttaaactaaatttttcgatttttcaaaaataatatttgattaaatttgatccttaagttttagtttttatatttttcaaaaaaaaaaacttttattttttttgggttttggagttgtaacaaaatttgaattattttagtaaataataatagtttatgtgatttaagtaaagtttttaatttatcaataataaagttctaacagtacaaaatgataaatcttttttaaaaaagcttaaattttaaacaaaccgaacttggtataataagaagagaaccaaggattatgaatatagaacggtcgaattaaaccggatctaaaccctaaacctctatgaaacctcctgaaccggtgagttccttctgtatctcgattctcgaatgtcgatcgagccatcgtagagatagagagagaatccatagaaatg

SEQ ID NO: 5200 - DNA, 3000 bp, Unknown
  misc_feature (1)..( 3000): cDNA_ID_3076184_gDNA_ID_1620771_Annot_ID_167542 3000 nt of promoter + ATG
acccattggtctctctgtctttcttgtggtattaatagtttgaattgttgtttctgtaatgtgatgaagactgttttagacgtgggcaccgggagtggaattcttgcaatttggtcagctcaagctggtgccaggaaggtttatgccgttgaagctactaagatggctgatcatgctcgtgcccttgtcaaagccaataaccttgaccatattgtagaagtcattgaaggatctgtcgaggatatttcattgcctgagaaaggtattattcactttcccttttcttctctttcactgcgattagaaaagagtagtaatcagggtttaacttagtggctattgattgagacattgcaatttggttgagttgaacatgtttcttttgataatttttactctactcgacattgcgctaatatctacatattcaatttaatgggcagttgatgtaattatctcggagtggatgggatacttccttctgcgggagtccatgtttgattctgtgattagtgctcgtgaccgatggttaaagccaacaggtgtcatgtaagtggattttctgttattttatttctattctttgttgtaacattaaaatttcatgatgcatgattgttacttatgagcctatggcacttgagagcttgatgctgtgtagctatactgttaatatcttgatagcataatcttttcctccagtgccagttatagaatttcttatcaaattccatgcataaattttgatatcatgtggcacatgttactaatattgaaaacaattgggtaaagatttggttgatgttggcactgtgtgtatctaagcattacaaataacctttgtatacaataggtaccctagtcatgctcgcatgtggcttgcacccatcaagtccaatatagcagatcggaagaggaatgatttcgatggggcaatggcagactggcataacttttcggatgagatcaaaagttactatggggttgatatgggagttttaacaaaaccttttgctgaagagcaagaaaagtattacatacaggtgatttcagaactctttttttctgcaatttaatttatctttagataagttcctcagctgacagttgaacaattaacaaattgacttacagaccttttgctctgacatttcatggaactcataaaattttgtcttttgtgcacagactgctatgtggaatgacttgaatccacaacaaatcataggcactcccacaattgtcaaggagatggattgtttgacagcatctgtcagtgaaatcgaggaagtcagatcaaatgtaacgtcagttatcaatatggagcatacaaggctatgtggttttggtggatggttcgatgttcagttctcggttagttcgtacagattactgtgttgcatcatgttgaagaaactcgtatacttactcgttgcttgtttgtttttgtaactaggggagaaaagaagaccccgcacagcaagaaatcgagttgaccacagctccaagtgagcagcactgcacgcactggggacaacaggtatattactccccaatctctggcctatgatggttaaggcttcgattgtttcaaacgctaatttccgcgtaatggtctgaaactggcaggttttcattatgtcgaatcctataaatgttgaggaaggtgataatctgaatcttggtttgttaatgagccggtccaaggaaaatcaccgactaatggagattgagcttaactgtgaaataaaagaagcatctggtaaccccaaagaatctttcaagaagacttacttcatagagtgattgattgattatagagaagctttccttggggcttgctggttcttgtatcccatgtatgaaccccaaatgtaatgttttattgcttcttgccttttttttctatgtaaacgagattgttataccaattttcaatagatttttatatgggtgatataatttattatttttggtatttgattaaacatccaaaaatttcttcggtattaattttgaagagattttttttctgtgaagattgtttaacttttttgaacatttttcagtggtttagaatatttgttaaagtctaaaaaaacatttttttggtttaattaatatcgaactaaatgtttaaagatttgttttggagtaattattaatatttacgaaccaaatatttggtcgatagagttgtgttgggagagcctatgtcactaacccctttgtctgcccctctttcggagcgattcttttctcattctttcgtcggactctctgtctccttttgacggcggcaccaacgacaaagcaagcaagcagtgataacatctatctatctctccgtctaaaccaattgattaggctagatcccaattcttcgagtatcgattcttcttcaatcctttttatgtgaatattctcctaaagcagcaacctcttgggttcttcttcttctgggtaaaattctctggattctgcttttgctttgatacgattgttttgagctacttgttttttttggttcctgattgcgttaagggtcaggaggcttagtagaactaagatatgaaatcttaatctgagttatttcgatgcatagactttggattctggatctttgagtactagtcattaaaaagtcggataatttctctgtagggtacttcttagaatactgatttgatttgattttatggttaattctcagttcgtgataattcttaagacttttttagtggtatgtcttagaatcatggaattgaaatgggcaggttcgatttttgaaggtggatattgattttgaatccatatatgcgttgatggatgtggattagtttcttgttgtctttatctgtgcattggtgatagttccaaagtttatctgttggtatacacttcgttgctttgctcagttgtatttgattatgtagatgcagtaacaactttagtaacccactctcctttttctggctttgaattttattatagtaactg

SEQ ID NO: 5201 - DNA, 3000 bp, Unknown
  misc_feature (1)..( 3000): cDNA_ID_2052939_gDNA_ID_1620771_Annot_ID_167541 3000 nt of promoter + ATG
aattcatggaggggcttttatagctttttccttgaagcctttcttggactttgcaatctcttattttcttgtttaagtttttcgtcatttgattctttgtggataatatttataaattgaactcctgtgtatgtatctttgagtttctttgatggaagacggttaattacactctgatctgatgtgtggagccttaaagtctctgacttttgtttcattaataagccggatagatagtaaatgctgaagaaggtttagtggttgttaaagagcgtaaatgatcttaaagtgcttacctttttgttttcttttttgtcttttggctgtgttaggaatggcatcaagctcttgtctcaagcaagggtcagtgccaatgaacaatgtttgtgttacccctgaagcaacgtatgaggctgtggttgcagaccctaggcttttcatgacttccttggaaaggctgcactctctcttgggtactaaattcatgtaagcttctttcttcccttatcatatcttacttagtagagtaagttcagttgttatctgctctgacagaaatttgtgttcagaaagtctctatctttgagatttaagctcttatgttgacgatgaatcatgctttgtttttcacctacaaaaattttaccagttacaatgcatgagattctctgtctatattatggattcctcttctgtgtgtatagtctgactaaaagtaatgttcttttttgtgtaacgcattgttccttttgcttcttgggggtaatgtattgtaacttttacatattggatatggatgcaatactttatagcttatagctttaaccattctacatattacattggtgattgtagggttccgatcataggaggaagagatttggacttgcacaagcttttcgttgaggtaacctcacgtggcggaatcaataaggtatgtgaatgccctctcaggctctcaatgataaattaattccattctatatgtattgtctgttttctatgtctcatatagttggttttgttctaaaatcttgaaatctacattgacatttttccttggatcattttccttctttgaattgcagatacttaatgaaaggagatggaaagaagtaactgctacatttgtctttcctccaactgcaacaaacgcatcatatgttctgcgcaaatactacttctcgctgctgaacaattatgagcaaatctatttcttcagatctaatggtcagattcctccaggtttgttcataaaaacctctttaactattttaccaaattttcaaatatttttcagtttcttctctgttttgtaacacacatatcttctgtagactctatgcagagtccatctgctagaccatgctttattcagggagccattagaccttcacaagaacttcaagctctaacctttaccccacagcccaagatcaatactgcagaattcctcggaggtctcaacttttttctctctttgcttctataaatgttccaactgagaaactgtgacttataaatctgagtaaaatcctttttcctttgatgttattgtttcaggatcacttgctggatcaaatgtggttggagtgatcgatggaaaattcgaaagtggttaccttgtaactgtaacaattggatcagagcagcttaaaggagttctgtatcagcttcttcctcagaacacagtttcttatcaaactccgcaacagagtcatggtgtcctcccgaacactctgaacatttctgccaatcctcagggggttgcaggaggagtaacaaaacgccgtaggagaagaaagaaatcagagatcaaaagacgtgatcctgatcatccaaaacccaacagaagtggttataacttctttttcgcagagcagcacgcgagacttaaaccgcttcatcctggtaaggatagggatatcagcaggatgattggtgagctatggaacaagctgaatgaagacgaaaaattggtatttcacacactgatctttgaattcttatcaaactctgttacgtatatcgagtttttgtctcatgatctgtttgattttcttttatttctagatttaccaagggaaggcaatggaggacaaagagcgatacagaactgaaatggaagattacagagagaaaaaaaagaatggacagctcataagcaacgctgttccgctgcaacagagacttccggagcaaaacgtagacatggctgaagctgaccttccaattgatgaagtcgaagaagatgacgaagaaggtgattcaagcggatcctcaggcgaaagcgagccacatgatgatcagagcatagaaactgatcctgaattggaagagccatctctgaatccctcaggtccaaacctaaaccctaatccgactgagatagtggtggctcctaaggagaaaaacggcgatgttgtgatggaaacatctccattgaagaaagccgatgagccaactgtggcggtgactgctgagcagaactgaagattcttctcttgtttcttactccccgttgccagtttcgtgttccataggtaaatgttagagagaggaaagggcttcagataccttgcttctggcccaagattatgtctttttggttttttttttggtttttttggatttttcttcggaaacaaggcaagtttatggttataacattttggcataagagaattttttactttcgttattaatgggatatcctgtaaattggtgattaaaatctgaaagggccttataaacttgggcttggaaagcaaatgggccgaagaagtaatccctgtaatatgattttgaaagcggaggagggagacttaaagactttgattgattgatttataaaaggaaccctaagtttccgaactttgtccgtcgccgtctgaaaactctgtagctctctcacttcagctttccaattaaagggaacaaagctttgatttttgccgcagtcagaagcattactttgcaagaacaagtgtgtaaacaaag

SEQ ID NO: 5202 - DNA, 1878 bp, Unknown
  misc_feature (1)..( 1878): cDNA_ID_2052904_gDNA_ID_1620771_Annot_ID_167553 3000 nt of promoter + ATG
gccaaaacccatgacctaggaaactatacgcaaataaagcaaccagtaaaaaccctgtctcagatcaatgttggtgttcttccacatagtatcaaccaaagctaccacggattctgtccaaatctgagtgattatacaggtaagactctacagagatttattgcgtttaataaatatagatctaaccctaaaagcttggttcatgcggttcctcagtgaaatcagactactcaggatgcacaaatccatacgaatcgataggttaggcaaataaacctagaaacaaatcgaggtaagcaccgaatggtgtaagattaaaacctatgcatagatcaaacgaaaagtgacttactgaatccatcttcgacaaggtaattgaaggtatgaccgtcgcagttgtaggtgaacttgttgttcgaagacggaagcttctggaggcactgagcagcgattgaggtgaaattacctttgaaatcagtgaactcaacgaggatcaccgtgccgcgagctacgaaactgtagatcaacgattgttgcgccattttttctttaccttaaatctccgatccaatcgaccgtctgatcagagaattttttgggcggtcgcggaaaaaaactacagatctagaagactatgaaagaacaaaacgaggactaaagtggacatgggagaagaaaaagttgaaaagcgggcaagggtaaagttgtcatttaaggtagtcagattgggtcaaaaatagtataaaaccttgaatttaaggactaaaaaaaaacaatttcaaaacggagagatcaaacaaatgtcgagaaagttggacccgcccggatccagccaaaaagctcgtggactctgccgatggcacaaattagtaattaccaactttaggacaagttcaggtcccatggtcgaagagagtctgtctctgtcttcctcaaaatatctttttttccaaattcatcattgatcagtgattccagtattagctcagttacgaacaaaaggcttaaacataaaaacaaatgttgtaattaaccaaatttcttaattcttaatggacggggggagctcatagtcatagtatcttgttacagcaacaaaattcgaacttctaccgttatctcttgtcatctacaattgctctgcattgtttagaacctgctaattaatttgtttaacgtgttcctaaagattttgatcaacaatcaaataattgaaatttaggtagttaggttgtggttagaatagaaggttagtgaattggaatgaaagaaaaggtttgcaacattattttaatttttttggtaggaaggtttgcaacattatcaattgaacgttcttttaagtaacataacatataatttatagaaaatttaacaactcaaatatcccttacacatcgcaattttctttataaaaaatcaatatataatatatatatatatatatatatttgttttttaaaatgctcattgataaacatttcacatttgaattgaaaaacgagccaccgtggtgtaaaaacatgaagatactattattaattagacgtgaattatttaccaaaataaagtttattaaggcaattttcgactatacaaatgatgaatttttctttttatttactttttatatttaaaaattcaaaatttgaacgttaccaaagggaaaataatgtctctgttactcgcgcaaatccagcgctctcatatagtttctcttctccgatctctgcgtcctgctttctccatcgctacccctcgttcccttgtgtatttttacatcgcttactaatctctctcatcaattcgatcggatttttgtggtgttcttaggtttcgtttttttatctttctctcatctggataaaaggaagaatg

SEQ ID NO: 5203 - DNA, 3000 bp, Unknown
  misc_feature (1)..( 3000): cDNA_ID_2052911_gDNA_ID_1620771_Annot_ID_167551 3000 nt of promoter + ATG
agtccattagttgcatataagcccatcccaagttcccctgtaacaccacattcattcaaattccatcagttcactgatcaagagacttgagaaatctaatcacaactaaagactagtcgtgagattattagtcttaccaagatcctagaggtttccttctcgacggtgacctgaaacttcttgccatgagatctcgcagtctttgttggtttgccattgaatgcttctccttgatatatcatccaaagcttttgcttcaataactcaacttgctcttctattctcccacatttctgttcaacaaaattcggaatcccaagtttgtcaatttcactatctaataaaacggtaaccgagagaaacaagagaatggtctcggtcagagtttagttaccttatatagatcgatgaggacattgtctaatgactcttgagcttgtcttgaacaaagatctctaaaggattgaatagcgtcaatggcttcttcagctctgttctgttgtttcattaacaaggccatgtctttaagagcactatcaactctatctctcgctttaatcgctatccaaaacaactctatcgctgcttctgcatctttctccaccaactgaaccaaacatcaaatccaaaatctcagtaaaaatcaatataaactcgattcctttggataaagtcacacatatgtatattaaatttacctgaacatgcttcgctcggacataaggactgtctccgtgaggcaacttatggacaacgttgtacgccgccgccgacgagtcttgtctctcacctcctcttctctgaatcatcatcatcatcgcaaacttcgtgtctctgtttctaaatgaagaaaccttctttatctctcctaaatccggtaacaccttcctttctctctctaggggtgtgtgaagaaagatataattatattgtggaagaagaagaaggaacctagacagattctcgtcttggttcattatcgtcaactggatctaaaataccgcgggctggtcgtttttctaacctataaaatagtgccacgtaccctatccgtccccattattctcacacgactccgacttggccagttttttttgtttttttttcaaatctagtccgtagttgttatttgtcctcataaataacgcccatccttaactatattctgctgaatgtagttaataaccatattgttttgtaaaaaaaaagaaaaagatatttcgcccattgtttctagaaagtggttattctaatgatttgtcgataattcaaaatgtatataaaaaattgtccgatgattttttccaaattaaagtctgattttatttttttgactagtaaaatctattatgcttttattatttctctaacattttcccttatatcaaatcttatgctattcaattttttttagtttgaatttttttggccctttaaaaaaaatcaacagcatatgtcacaacctacaagtaattccataattatgtgttaaacacttaactatatcaaatcatagtacctaacttctatcttttaaaatttgttgggggaaggttatatatcacaacaattatctcgttttatttaagtgtgcattttgaagcaaagtgatgggcctacgtgttaatcaggtgaccgtacgtgtcgcgtttacttttcgctcaagacgacttggttttattttaaataacatttcggtccaatacttttttagttattcaatttggcccctttatttttgtttcgctacaaatttgtgattggaccattataaatccttagatcttgtagaaacattatactcccaagctttggtggctttgtgatatgtgccattggttgcatgaaaaaaaaaacaagaacagtgtaaaatgagtatattttaaaaaggtgtaaataggctaatggaaacatcataatgataattcattccaacgccacgccttaacatactttgttagctgttattattagtaccatctatggcccaaatgcataacatacactttcatgatcttgttgtttgtgtataaactatactagatatagtaagttgtgtgtataataataatattgatattactaaacatgatcaagtgcatatactacgttcagtaaacacaatgacacatggatagatacacatggatagagacacatggatagatacatatgtatacaaaaccaaaacggctagaaattgaaatgatagacgatgataatgcaaatttagacatttattagtgatatacacatatatctagtgtattgtagacacaaatagaaagatgatgatggacgttcagtcggttggcttttgagctaattagtagctaaatgttttcttttggcagagagctaagtaggtaaagttactgacatagttggcgatgattgaattggtttatacagttcaatacaacacgttaaatatatatatatatatatatatatatatatatatatttttttttatctcaaagtcgatcgaagaaacacaaaaaaaatatatacagtatatatgtttgtttaaagatataataattcagaacgctcatctggaccaacttctcccattgtttgtttaaagatccaatacgaactcaatttctctttaatgaaacccaaataaaaaaacttgttgaaataaaaaacaaggaaaccccacaaaagcgatccatatgccagaaatgcatcattgcctaaacccacaatacattaacactaattactctctttctccttttctcatgcctttcttctttcattttctttcaaccttaatcacacaaaccccaaacacaagttttattttgaagtactttgtctagtttgtgttcgattgagtactactacgggtgactcggatcattagtttggaccacctggcgacatcaacaagagaaaagtgttcggctttagtccggtcttgttacgtaccgtcaaggactacttgttctgacgacattattaatatatccaacacgacagacgaagatg

SEQ ID NO: 5204 - DNA, 3000 bp, Unknown
  misc_feature (1)..( 3000): cDNA_ID_2991085_gDNA_ID_1620771_Annot_ID_167550 3000 nt of promoter + ATG
tctgctttttctttacctttattactgttccccggcagcacaaaggagttatgatcacctcgtaaaggagaacaaccattacttgtgcgcaactctcttatatcttcagatggttggtatctcgatgcagcaacatgaacatgtccgttacgctgattcagatttaaaaccggatttttctctacacgaggcgcacatggatcagtggagatggatttccctttatccttctcaacaacagttctcctaaacaaagcattgcctacagaagcacgagggcgatgtccactctcagttcgtgtatcagaactttcccggttgtccccaatttcagggactggtctggctcttccgtgaagatgatgattacggtattcctctctttgatatcttaatggtgctactggagaatgtggccttctcttaacctctctatggtgtaccgatctatctggagtatcaggtatgattaccatgtcaatatcagaattctccatcctgaaacaattaaacaagaaagaaactgaagcaatgcacacatgatgttatatattagcaatagatttttctgattagagagatttaaattcgtgttttgagactttcgaaaacataaaccctaaattataacttaacacaatttccccaaaggttaagatcacaaaagtggcaatcaacaacaacaacgacaaagattgacatgccttaataatcatctaaaactgaggatcagactagtgaaaattcatgggcatttcagatacaccaaaatgagaacagatattcctctccagaaacaattatcgtagaggagaaatctatcacaaatacaaatacgaaaggacagaataaattacccgattgaatttgattcaaatgtgggaatcgaaaccctagttgttcgatgagaagcaactgcatcgaacaatctatctcctcttgctcgggtgcaacgattggacctcagattattccgggtcgggtaagggattactgggtcgggttctgggtccaatattaatgatgttggcttagacaattatattgggctaagatccaataataatgggccttttaaaaacagggcctctttttatttaaattggctttcacaatttaaaactgcaatcaaatgcttagtcaaagtttaaacagagaagttagacagaatcagaaacccaaaccaacaagacaaatagttcgtgaaagttttgattatagcaaaatccaaaacgtgcatttattcactagctctttttacaaatggttcctctattttttgccaactttactaatttaaaaaatggattttcaaaaatcaaaaaccaaaaccattctagatctacaaaaaaatcaaggccttaaagtgtcttgaattttgaattaagaacacttaatagttgaaacttatcgttgtcgcagatgattacaaaacgatcatgaatttagtcgtttttttccgctcctacgatacaaaaatgacatatagtatagctatgttttccaaattttaaaagtcaaactcttctaatttttaataattctaaatttctattcactttttaataacactaaatatagttcttatttcgacgcattacgtttcctagaaatatttaaaatttcagctgaaaataaacaaatgcaaactgatgttaacaatatgattacttaatattaggttgaaacttgaaattcatggcattgtttccatttcaacgataaatatacttttctaagtctaattattttaaatttaatacctaaaatttttcgaaatcaatatagtcacatagaacgctctcatcacgtaactttgacaaataagtataggacaacgtacttgttagggatttgtttaatagcaaaactatgaaaacaaaaacatagtacaataatcatttattgggataatcaagtcaccaattgcctcaaaaccaattattttggcggtttcttaatgatttattcgagaaaatatcctctctcttttttcctacattttggctttttctgcattcaatttttttaaaaaaaacattactcttcgttgggtatataaaacaacaattcaccaaactaattactactagtacttgttttgttttaaataatgctattttttttctgtgacttttattttcaaatctgactatttaataatttcatttactacaataattatatgaattatttattgtcgtaatattttttaacggttatcgtatctaaaatagttattcccagaatccatgtaagcttctcgaccggactttgaaccttccccattggacacagccaaaaggaaccgtgtccatcttcggttcctctccctctgaaaacttattcctttcttttcaacttcctagtcttcttacttcacatatcatctctctttgtttagatctcttcttcccacgattacaaaatcctgtccggtgggttttccccgatcggggtcggatctgattcctcggaagcaacgaatctcgaggcttctttttggttttggctttcggggaaaggctggaatcatttctctttacggagattaaacataaagttccttacttcagctgattagcttcattcgtgcttggtctgctccttcttgatctgggtttacaaacaaatttccttttttggcaaattatttctgtgtttggggtttcgaatttcgatctgctctcgggtgttttagtgattgaatttcgattcgtactgtcttatatctgttcaaagttgtcggctttactctaggcatttggggattttgcttgggttttgggttttatctccaatttttcagatttgtttactctaatcatatatcggagagttgcaattaggtttttatgaattggaggaaatttgcaatcttttgtgtttcccagttgagagggttttaggttttaagatgatggaacttgagttgtgtttctccttgtgaaagattgagtctttgtaaagcttttgtttgttatatccaacttctgagat

SEQ ID NO: 5205 - DNA, 3000 bp, Unknown
  misc_feature (1)..( 3000): cDNA_ID_2052914_gDNA_ID_1620771_Annot_ID_167549 3000 nt of promoter + ATG
acagaactctcgaaatggaaagtgatctccatgtagaaatctctcattctatgcatcgtagccacaagccgaggcagcctcctgcaccatttagcccaagccagaggctgataatgcctaacgataatcatagcgatcctctcttctctaccacaaatagcttcttgtagagcgctccatccatgctcattctgcaagctccaatcagcaccagcagccataagcatctccgcggaggtctcatcaccgagctttacagctaaatgaagtgccgtgtctcgattaaccacatcacgcctgtctataacagctgcgattgaatccgcttttgtctcttcagctacagaagctgcttcgttttgaacctcagacgggtcacgcatcttcggaagagcggataatagtttcttgagaccggcataatcccttgtgacaacagcgtgatgaacaggactgtgaccatacttggtaacatcaatggtgctgcttgccatatctcagaagttggatataacaaacaaaagctttacaaagactcaatctttcacaaggagaaacacaactcaagttccatcatcttaaaacctaaaaccctctcaactgggaaacacaaaagattgcaaatttcctccaattcataaaaacctaattgcaactctccgatatatgattagagtaaacaaatctgaaaaattggagataaaacccaaaacccaagcaaaatccccaaatgcctagagtaaagccgacaactttgaacagatataagacagtacgaatcgaaattcaatcactaaaacacccgagagcagatcgaaattcgaaaccccaaacacagaaataatttgccaaaaaaggaaatttgtttgtaaacccagatcaagaaggagcagaccaagcacgaatgaagctaatcagctgaagtaaggaactttatgtttaatctccgtaaagagaaatgattccagcctttccccgaaagccaaaaccaaaaagaagcctcgagattcgttgcttccgaggaatcagatccgaccccgatcggggaaaacccaccggacaggattttgtaatcgtgggaagaagagatctaaacaaagagagatgatatgtgaagtaagaagactaggaagttgaaaagaaaggaataagttttcagagggagaggaaccgaagatggacacggttccttttggctgtgtccaatggggaaggttcaaagtccggtcgagaagcttacatggattctgggaataactattttagatacgataaccgttaaaaaatattacgacaataaataattcatataattattgtagtaaatgaaattattaaatagtcagatttgaaaataaaagtcacagaaaaaaaatagcattatttaaaacaaaacaagtactagtagtaattagtttggtgaattgttgttttatatacccaacgaagagtaatgttttttttaaaaaaattgaatgcagaaaaagccaaaatgtaggaaaaaagagagaggatattttctcgaataaatcattaagaaaccgccaaaataattggttttgaggcaattggtgacttgattatcccaataaatgattattgtactatgtttttgttttcatagttttgctattaaacaaatccctaacaagtacgttgtcctatacttatttgtcaaagttacgtgatgagagcgttctatgtgactatattgatttcgaaaaattttaggtattaaatttaaaataattagacttagaaaagtatatttatcgttgaaatggaaacaatgccatgaatttcaagtttcaacctaatattaagtaatcatattgttaacatcagtttgcatttgtttattttcagctgaaattttaaatatttctaggaaacgtaatgcgtcgaaataagaactatatttagtgttattaaaaagtgaatagaaatttagaattattaaaaattagaagagtttgacttttaaaatttggaaaacatagctatactatatgtcatttttgtatcgtaggagcggaaaaaaacgactaaattcatgatcgttttgtaatcatctgcgacaacgataagtttcaactattaagtgttcttaattcaaaattcaagacactttaaggccttgatttttttgtagatctagaatggttttggtttttgatttttgaaaatccattttttaaattagtaaagttggcaaaaaatagaggaaccatttgtaaaaagagctagtgaataaatgcacgttttggattttgctataatcaaaactttcacgaactatttgtcttgttggtttgggtttctgattctgtctaacttctctgtttaaactttgactaagcatttgattgcagttttaaattgtgaaagccaatttaaataaaaagaggccctgtttttaaaaggcccattattattggatcttagcccaatataattgtctaagccaacatcattaatattggacccagaacccgacccagtaatcccttacccgacccggaataatctgaggtccaatcgttgcacccgagcaagaggagatagattgttcgatgcagttgcttctcatcgaacaactagggtttcgattcccacatttgaatcaaattcaatcgggtaatttattctgtcctttcgtatttgtatttgtgatagatttctcctctacgataattgtttctggagaggaatatctgttctcattttggtgtatctgaaatgcccatgaattttcactagtctgatcctcagttttagatgattattaaggcatgtcaatctttgtcgttgttgttgttgattgccacttttgtgatcttaacctttggggaaattgtgttaagttataatttagggtttatgttttcgaaagtctcaaaacacgaatttaaatctctctaatcagaaaaatctattgctaatatataacatcatgtgtgcattgcttcagtttctttcttgtttaattgtttcaggatg

SEQ ID NO: 5206 - DNA, 3000 bp, Unknown
  misc_feature (1)..( 3000): cDNA_ID_2052918_gDNA_ID_1620771_Annot_ID_167547 3000 nt of promoter + ATG
ttcaatcctccacaggctcgtgctcctgttagagcaccagcacggggtcgaggttatcgtttaggcggtgcatctgcttcactacgtacagctctgaatttcagttttccaattgatatgggcttagactcggtactctttttaactccgtttatatcctgaatgttgcctaatgttgttaagtaccgtagaatcatccttaccctttttaatgtaacagagaatggatattctggaggaattagagaatgctattggacactccattaccagtagtaatcttcttcatatggatcgtgactttactgagtatggtatcttattgatagaatttcgtcattatcttactatgattcttcaatatatgaagcttgatagttcaaccatttccggtgcagagatgattacgaattgctgctagctcttgatgaaaacaaccatcgacatggcggtgcttctgctaatcgcattaacaacttgccagagtctacagttcaagtaagctaaaggttcacttgtaaaattcagctttttcatatcgaaattttgttactaaaagcttctatttgattgcttatgtgttaatttgcagactgataattttcaagaaacttgtgttatctgtctggaaactccgaagattggagacaccatacgtcatcttccttgtttgcacaaattccacaaggatgtaaggatctttactgattcaaatgaaaaccccttattaagaacagagattcgaaaagtaaccattgtttatttattgtgcagtgcattgatccatggctaggacggagtaaatcatgtccggtttgcaaatcctcagttacttgacaaggttttcaaattcatcggagaatttgaaaactaccattttacccttccaaaccggtcgatctctggaatcattttgcgggtaagtcaaacattcttggccatcaaatttgaactcattaaacggggttttactaccgtttacgcgcgagggatgattatctgtgtatctctgtgattattttctcgggtttaaatatatctagctaagaactttttgtagattaagaaagttgatactaccacttattcactttagtttaaacatataccttttaaaatcaatttaaatgcacaaggctttgtttaatcgttttattcactttacttgcacgaagaagcaagatacaatcatattcaaagagtaaaacaaactaaagagaaacgacatacatttcagttattgttacatatataacgaattagttttcttaaatgacatgcattggattttagctcctcatcaatgcacattacggttaaacaaattctcagtgacctccgccgccaattcctccaccaatttctttaccggctcctccgccgattcctccaatggctccaccgtcaactcctttacctgctccaccgtcaaatccttttccgactcctccctcaattccttttccgattcctccctcaaatcctttgccgactcctccatcaaatccttttccggctccaccgtcaactcctttgccaactcctccatcaaatcctttcccggctccaccgtcaactcctttaccggctccaccgtcaactccttttccgaagccaccgtcaactcctttaccggctccacctccgaatcctcctccaccaaatccaccgcctattcctccaccaaagcctccaacactgcctccaatccaaccgccacctgctccaaagccgcctccaccgctgataccaccaccaccacctaagtcgccgaattcttttttaaagcccttcttgtggaggagaggatgagggtgagggtgaggaaacaagggcttctcatcaccaaactctgcttctcccatagtaaaatctgtgaccaaagcaaacaccaaaacaaacacacgcactttaccggcgattagacccattgttagtggaaacttaaaatgtttgtagttaaaatattagaagctattggaagaggatgttttgatacgaaattgcttcttgcatgagcagtatatatatagacttagagagagatcgtgatagcataagcacttttcgtcaatgtgcatggattcaacctgtacaacaactaggatataattgctgttgagtaaaaacagttaaagatgtttcaccggtcactggacaagttttatgtttcattgtctgcccaactgccatattgatctcatccaacacaaagagaaaaatatgatgcaaatatagttgaaaaattgaagaacatatgacaccaattattatatacagttccttgaattatattaatcatacattcatatcaattatattaaaatttaatttgaaggttgtccaggtttcagagggcaataactaaaaatgaaaatgtttctgcatgtctattcataatttcatattaagtgaaaactcgtatggtctaagagaaaatatttactagaaaataattctgacttgataaaagatgtagtcgctttataggttggaggacaggccatgtcaatctatggaatattgaactatctatataaaccctaaaatgtgatttcatttatttgtgagctttagctttttaggtgtcatcaatcaatgatgtaaactagaaactcatatgctatacttccaaacaaaccaataaagtttttattatgggccgctagattggtccattaacactataagatatatagtctggcccatcattagacccaattttgtattccgactttatgattttgtttggatccatcatatatatttggggtgaaagtgtaatcttattaaacatttaggggtattggtaaaaattacttgacttgttgggtaagtatcttaatattcgataagtctagaatttcgattttgattagacttgtgaaaaagtgaactcagaaattgtgctcgcccaaagtagttcggttcttgtgttcctccgtctgatcaactcttcttctccacctctaggtttctaattttccgattaggataatg

SEQ ID NO: 5207 - DNA, 3000 bp, Unknown
  misc_feature (1)..( 3000): cDNA_ID_2052922_gDNA_ID_1620771_Annot_ID_167546 3000 nt of promoter + ATG
atatcgtagtaatgcaacaatgcatagaactgtgtctgagagtctgataaaccttacttggtcattgaaatatgattctctttgcagcttttgcttggttacttgccacctgaacgttcactctggtcaactgagttgaaacaaaagagatcccaatacaagcactacaaggatgagcttctgacgagtcctgtaagtgatcctggtcttttgtttcttgccttggagttattgttagtctgttagttttgcatgctatgtctgtctaagttgatttcaagtaaccggattatcacataaaagttatcaagtgtgtattatcctagctgtttttgtgaactttgtaagtcctttttctcatctagaaagtttctgtacacaattatcttttcttgaaatgtgtttgtacctctaaatgattctgtggtagttagtcagaaatcacatggaaaatggtgaggtcaaaggggttcgacaactatgacttgaagagtgaaagccgatgcatgcttgcccgatccagaattactgacgaggaccatcctttaagcctagggaaggcgagtatctggaatacatacttccaggtactatatcttacatcctgggcaggtctttcattgtcttaatcttttagagagacctcagtgcattacttaaggacaggattaaaggttatatagtatttaatttgtccactagttccatcatcactcttttgttaatgtaggatacggagaccatagaacaaatagacagagatgtcaagcgtacacatccagacataccctttttctccggtgaatcatcgtttgcgcgttctaatcaggtaacctttttgtgttctcatcagcaaattttcacctatttttgattaatcaaagctcagtgacatttcgatttacatgtctaggaatctatgaagaatatattacttgtatttgcgaagttaaaccaaggcatcagatatgttcaagggatgaacgaaattttagcacctatcttttatgtattccgtaacgaccctgatgaagatagttcagtaagtagactctttttgtttcggtgataccctttaaccaactttcaatgataacgtacacagttttaaggtaacagtgctagtctggaccctcaataatttcaagatatgcgttcctttgaagtaaaagctcaagactgttttactaaatgatgtgtcacagagttacaaataaaaaagaaccccgtaatctattagtatgaatctgacctctctgtctaattttcttagaagattggttcgtgtatgatcttttttcttcaaccttgtttttcttcttctcagcttcaatcaatttcatattaactcttttcaaaatatgcagtcccatgctgaagcagatgcattcttttgctttgttgaattgttgagtggatttcgagacttctactgtcaacaactcgacaatagtgtggtgggaatccgatctgcaattacgaggctctcacaacttgtgaggaagcatgatgaggaactgtggcgtcatctagagatcaccacgaaagtaagacattggttttttctttctctcatgtctttttgttgtgacaacaaccatatttgtcattctactactatagtcctaatgatctgctttgtgcggaagataaattccaatgatcccctcagcttactttgtattcttgttctcctatccataacataataacagtggattggatcctctgagattgagactgacattgtatagattctttgattacaggtaaatccacagttctatgcatttaggtggatcactctcctcctaacacaagagtttagtttctttgacagtcttcacatatgggatgcactcttaagcgaccctgaaggtccgctggtaagatcgtaatatcttctccttgatgcatacccgaaatcaaatcgatagatgcagaagtcacattagtttactgttccactcatttgcttgattaaagaagacccggtctgtatcgtattgttgcaggaaagcttactggggatatgttgtgcgatgctggtactggtgaggaggaggctaatcgctggggatttcacgtcgaatatgaagttacttcaacactatccaactacaaacatcagtcatctcttgtatgtagccaataaacttcgttccaaaatgttagtataaatccttttgttggttttttctagcttttgattaaaccaacttttagttgcccccattacaatatacaaagcgtttttgttttgtttttatattttactgtttaaatggcaagacatgtttgtttgttacgttatcgttttggagattttctcggaaatcatgaatgcaaacaaaatgtggttgttacttgtcctccgatttcagtcttagaagccatatgaggttcttggagaatcattctcctcctccaaaacgtacatatgccaaaactcagagccttgaccacttgcacttccaccctgtaatgatttacacaaaagagaagcttgatattaccatttcaggcaaaaaaaagtacaagaatatttatgaccaatacggtggtaccgaaatcatctccactacagctgctggagctcgaagctccgattttggttcagttcttatcatttcggtttactgttgactttggtctttagcaggttcaaatcgaattaaatttcggttaagttccacgcaattcaagggaattttgcagcttcaaaaataagagaaacggtcacaaaacgagcaaaaattcaaaattagaaaatacgcagctcacgagtatcgtgatattaacaacaacccaattacatcattacacgtgtcgttatatacagatgggtactttcgtttataaatacacatcaaacgccttactaaaaacctagaaatagaaaaatcagatctagattcagtttttttcatcaaaaaagagcgtcttcataaacgcccttcgtcttcttccctggaaatctagtttctttcttccacgaaa

SEQ ID NO: 5208 - DNA, 3000 bp, Unknown
  misc_feature (1)..( 3000): cDNA_ID_2052925_gDNA_ID_1620771_Annot_ID_167545 3000 nt of promoter + ATG
aagacaccgcaagtctccgccatgttcacgcccagatcctccgtcgcggcgtcctcagtagccgcgtcgctgctcagctcgtatcttgctcttcgcttctcaagtccccggattatagcctctcgattttcagaaattctgaagagaggaatccttttgttttaaatgctttgatccgtggtttgacggagaatgctcgtttcgagtcttcggttcgtcatttcattctcatgttaaggcttggtgtgaaacccgatcggctaacttttccgtttgtactcaagtctaattctaaattaggttttagatggttgggtagggctcttcatgccgcgactttgaagaatttcgttgactgtgactccttcgtcaggttatcattggttgatatgtacgccaaaaccggacaattaaaacatgccttccaagtgttcgaagaaagtcctgatagaatcaaaaaggagagtattttgatatggaatgttttgattaatgggtattgtcgagccaaggatatgcatatggctacaacactttttcgatccatgcctgagagaaattcaggatcttggagtactttgatcaagggttatgttgatagcggcgagttgaacagagcaaagcagctttttgaattaatgccagagaaaaatgtggtgtcttggacaacattaattaatgggttttctcaaactggcgactatgaaactgcgatttctacctatttcgagatgctagagaagggcttaaagcctaatgaatacacaattgctgctgtgctctctgcatgttcaaaatctggtgctcttggatcaggaataagaattcatggttatattttggacaatgggattaagttggatagagccatagggacagctctcgtagacatgtatgcaaaatgtggggaacttgactgtgcggctactgtgttcagtaatatgaaccataaggatattctttcttggactgctatgatacaaggttgggcggttcatggacgctttcatcaggctatccaatgttttagacaaatgatgtattccggtaaaagattttgtccagtctaagaatttagcttattctcatttttttttaattattattcatcgagtttagttctttaagttgtggtgtgcatgcaggagagaagccagatgaggttgtgtttctcgcggttctaactgcatgcttgaactcaagcgaagttgacctgggacttaatttctttgatagcatgaggcttgactatgcaattgaacccacgctgaaacattatgtgttagtcgttgatctgctaggtagagcagggaagttgaacgaagcacatgagcttgtagaaaatatgccgataaatcctgatcttacaacatgggctgcactctatcgtgcttgcaaagcgcacaagggttatagaagggctgaaagtgtgtcacaaaatcttttggagcttgatccagagctttgtggtagttacattttcttagacaaaacacatgcgtctaaagggaacattcaagatgtagagaaaagaagattatcattgcagaagagaatcaaagaaagatcattgggatggagttatatcgaattggacggtcaactgaacaaattttcagctggtgattattctcataagctaacacaggagattggtttgaagcttgatgagatcatatcgcttgccattcagaaaggatacaatccaggagctgattggtcaattcatgacattgaagaagaagagaaggaaaatgttacgggaatccatagtgagaaactggctcttacacttgggtttctaagaactgctcctgggaccacgataaggatcattaagaaccttagaatctgcggagattgtcattctttaatgaaatatgttagtaagatcagccaaagagatattctactgagagatgcaagacagtttcatcatttcaaagatggaagatgttcatgtggtgattattggtgatatagttgatcccttcaggttagtcaacaacaatgactcaaaccaaaaaggaaaaatgcgatgttctgtaacatcccagcctgagctgcttgaagtttttgtttattcatggcgctttccggtacaaatcttgtcatgttcttgtacacaagagtagggattaggacaagctcatgatttctgagaccaggccacacaccacagctatatcaggccgaagtgattcgggttaccccacaggcctagaagtgaaagagaaggggctcaagtgggttacttgtgtttttgagatggaaaattccaattcttttttatagaaaatatgagaagtttcgtttcataagctaagattttcgtaagataagattatgattaagcaaggagatgttagtatctgtaggtgtcatgtgtattattgaagacaacaacgaaacacatggcaattgtttgcgaagcacaggtatcacatgagaacaaataccagtcgccaaggtaaattgggtccatcactgttgctgattaatcaatcttgtgtttgtatatcactttatatatatggtaatacgataaaataaatcatagttattgttgctttctgttatacgattttaactcaaattattttgttgatatccaaaaattacctcaactctttagatatatgataatactaatgtacataatccatatatttattgtagtttccaaatatatccctaatcataaaaaaaatcttacaaatgactatggatttaagtatttccaaacaaaacaaacaggggaaaattgaataaagaaaaagaaagggataaatgtgtaaatagtcgacaatattgaggctatatttaatattaatttcttcgattcttctctctctttctctctctgtgagaagaagcaaaatcacgaacttccattaatcaccgactcgcagaacctttctctcattaaatcttgtggaaacctcggaaattgaatctgcgtgagtttcaatcgcttgatcgatccatcaaaccctagag

SEQ ID NO: 5209 - DNA, 3000 bp, Unknown
  misc_feature (1)..( 3000): cDNA_ID_2052929_gDNA_ID_1620771_Annot_ID_167544 3000 nt of promoter + ATG
ccttgtctcattcttatataatgtgaaggaaagcgatttgcacacgaaaagaacagggcatactgagtttgtagataagacattggagacaatcaaacccatcagcttggaagctcctaaggttgccatggagattgatgataatgctagtggtagtggagaggctgcagaaggtacattgccatgttaatgtatatgtattgcatgagtttctgaatgtgactttaacgctatttcttatggtcactctgcagagatggttgttccagacgttgacaataacattctcgaggaacttgaagcgatgggcttccctaaagctcgtgctacccgagcactccattactctggtataaatctaacttttggttgtgggctcctattataatctttggttcacgtagttttcatatctcctctaagaattatctgaagtgtaacatggtcatatgcataacagctccaaaatttatggccactgatcacaatagggaatcagggagtagcttattgattaattgttatgctttgtgaatagcgtgtaaagcttgattgtgggcaactgagctcttgttcacgtctctcctttttgaactccggattgatatataaaactgtcatctatctcattgtgtgcaattagatcttcttctccttttctcgttatctcttttttttttgttcagatgtcatctgaatctcgaaattcttttacacactttgaaattcattccttcaggtaatgccagtcttgaggctgcagttaattgggtggtggagcatgagaatgatcctgacgtagatgaaatgccaaaggtgggtgttttgtcaattattacttttcagcagaatgtctgttctggaccgttttgtttcttgataattgcattccaaatctcggtttttagttcttatctcaaagtggttttttgcttgatgcgacaatttggaggtcaaaattttctgtatatatcaccttcaacaatcttatatcttgttatatgacatgtatgtggtcttaaaattactccattgtttccttactgttatttctatgttattgactgtttgcctaggtgccttccaactccaatgttgggcctgccaaacctgctcttacgccagaagaagtgaagctaaaagcacaagaattaaggtcgatgagtattctgttttactgtccctatttgttttcttttatagcgtgcccaatggcatatcgacactacacttttatcatgcataacctagaccatgaaaatgtctacacttcaatttatattcgttgatccatgtctcagggaacgtgcacggaagaagaaagaagaggaagaaaaacggatggaacgtgaaagagagaaggttttctgtctctgatcctttttttaaatgtgttactgttatcttaaataacttaattatgtgcttgaaacatattgtgtcattgctgaaactgtaagcattactttgttatcatcttttaacacgttagtatttggttcaggagcgaattaggattggcaaggaactcttagaagcaaagcggatggaagaagtaaacgaaagaaaacggttagtcttttctggttataatgtcaggcttatcagctgtattcttatttttgtttttcttaatcgactacttattggttgtgtgtttcagtcttatgtttttgcgtaaagctgagaaagaagaagaaaaacgggctagggaaaagatccgtcaaaagcttgaagaagacaaggtatcttcaatgcagtagatttacgtacgttatgcattacatttatatttctcaacaaaaaaaccttgaagactcatacattttaacaggctgaaagaaggcgaaaactcggattgcctccggaagatcctgcaactgcagctgcaaaaccctcagtgccagttgtggaggagaagaaggtaaacaaaaaagtatcaaaagctagttatattttatcatctcttgttatatgctttttcttatagagacatcttttttttttggcaggttacattgccaattagaccggccacaaagactgaacaaatgagagaatgcttgaggtcccttaagcaagcccacaaggtaaatacatttaacatttgtcaacccacacattctaagcaacaatgagccgaacattaatcttttggaaatcggggaaaaagggttcaaggaggatcaagtaaagtttgagtataacagtaattttgcttgtttgttcaggaggatgatgctaaagtgaagagagcgttccagactctgctgacttacatgggaaatgtcgctaagaatccagatgaggaaaaattccggaaaattagactcaccaaccaaacatttcaggtaaacaatcgggcataaaaatacgcatctagatctacttgaaggatctacactgatgatgatgatgatgatgatgggtccagtttcttacttgtcatggtttttgggatgaaaatgtaaacaggaaagggttggttcgctaagagggggcatagagttcatggagctatgtggatttgagaaaattgaaggaggagagttcttgttcttacctagagacaagatcgattcagccatcataaactcagctggaacagaactcaactccgccatcaacaaccctttctttggagttctttaaatccatgcctcttcttatgaaactaaaaaaaaattcggatatctctatgaataatactggctagtgacattctttttgttttgcttaaataagtggaaaatttggagagcagaactaaaagcttccattactgtttaatccgtcttgttgtttgcattgtaacttttaaggtaaaaaaaatgacatttccatactgctttcgtctgaaccggttcgccaattaaccggtttgatatatttagagcaatacggtttaatccggttaagataagtagccactagccaaatatataagagtcttttgcaccgcgagatctgatgactgatgagcgttttgactgaggtacg

SEQ ID NO: 5210 - DNA, 3000 bp, Unknown
  misc_feature (1)..( 3000): cDNA_ID_3076196_gDNA_ID_1620771_Annot_ID_167534 3000 nt of promoter + ATG
ttccttagtaggaggaaccgagggatcttctcctaaagcggttccaactatctggtctgaagtgagttttcctaggcagcttcattaacttctttcgaggtttgtattttagattgtgtttgatgtttcgttgcgtatatttggcaggttatgaggttttttacaaatcctcacaaacctatgatcttggcattatctagaccagacccaaagaagaacataaccactcttctgaaagcctttggcgaatgtcggcctctacgggagctagctaatctcgtaactgttaaatagctgtatttattccagagcatgaaaccaagaatcctctgtttctgaaattctttttcctgtgtgtttgcagactttgattatgggaaatcgagatgatatagatgagttgtcatctggaaacgctagcgttcttacaaccgtcttgaaactcatcgacaaatatgatctttacgggtctgtcgcatatccaaagcatcataaacagtctgatgttcctgatatataccgacttgctgcaaatacaaagggtgttttcataaatccagctttggttgagccttttggccttacactcattgaggtaaagtatgcatatgtgatatatatatatatagtccttcttactcgtttccaatcctgtttaacctaaatagtatccagaaatctattcacaaaccaaactagacaagaaattaatcaatctggtttaaccaaaattaaaaatgcaggctgcagctcacggacttccgatggtagcaacaaagaatggaggaccagttgatattcatagggttagcaacgtgtcctgaaactgaaaatcatttaaattggtaatgcttatttctttctcatggtatttaacttcaggcattgcacaacggtttgcttgtggatccacacgatcaagaagcgatagcgaatgcgttgttgaagctggtatctgagaagaatttatggcatgagtgcaggattaacggttggaagaacattcacctcttctcatggcctgagcattgccggacttaccttacacgtatagccgcgtgccgtatgagacatccgcagtggcagacagatgcggacgaagtggctgctcaagacgatgaattttcactcaacgactctcttaaagacgttcaagacatgtctctgagactctctatggatggagataaaccatcgttgaacgggtctcttgaaccgaattctgctgatccggttaaacaaatcatgagccggatgaggacacctgaaatcaagagtaaaccagaattacaggggaagaaacaaagtgataacttgggtagcaagtatccggttttgaggcgacgggaacggttggtggttttagcggttgattgctatgacaatgagggagctccggatgagaaagcaatggttccgatgattcagaatatcatcaaagccgtgcgatcggatccacagatggctaaaaactctggttttgcgatttccacttctatgccgcttgatgaattaactcgcttcttgaagtctgccaagattcaggtgagtgagttcgacacattaatatgcagcagcgggagcgaagtgtattatccaggaggggaagagggaaagcttcttccggatcctgactattcctcgcatatcgattaccgatggggcatggaagggcttaagaacacggtgtggaaactgatgaacactactgctgttggtggtgaggcaagaaacaagggctctccaagtcttattcaagaggatcaggcatctagcaattcccattgcgttgcatatatgatcaaagatcgttccaaggtaaagtttgattttcaacaactgtaccaatcattaatgcagactgcagagtatctaatcagggtttctacaggtgatgagagtagatgacttacgtcagaagttacgactaagaggccttcgttgccatccaatgtattgtcggaattcaacgagaatgcagatcgttcctcttcttgcttctcgatctcaagctctcaggtacgttaactaaaccacattttgctacggaaatgctacaaaacaaaattatatttttgaacatgtttgtttccttattatcgcgatttaattgttgcggtgaaggtacttgttcgtgcggtggaggctaaatgtggcgaacatgtacgtggtggttggagatcgtggcgatacggactatgaggaattgatatccggcacacacaagactgttatcgtcaaggggctcgtcacattgggttctgatgctcttctccggtcaacagacctccgagacgacatcgttccatcagagagtccttttatcggttttctcaaggttgattcaccggttaaggagataaccgacatttttaagcagctctcgaaagccactgcttgattccactaatatccaattctcccggttcaaccatgtagattaatttgtttatttattttctacttgttttgggacttttaagttttggtattttggccgatcgaacattaggatttaacaggcttctatacataaaataaaattttcaaatagtgaagtcgaggctattatattttttttgtaaaaattatgcaacttgtgttcccatccgagaatggttggggaaaaaaagaagataagcctaattcaaaaaacaaattgtaaaatttgaaaaatcttaactgtaaaatggcgcctataatatgggaaatatggatcacataaaataattagattttaatgttcgttcttttaaatgcaggtttaataatcaaccggtcggtttgattgcaagacccgacgccggtttgttgctggtgtgactcgcgcggctgcgacggtgattcgaagcagctataattaattaccttaattaacgaaaattcagaaatctacatctcgccagtgagaaagactccaaggagagagagctcatacagagtattagaaattctcaaatcactagagaagatctcgtcttcttcctgattttaaacgcg

SEQ ID NO: 5211 - DNA, 3000 bp, Unknown
  misc_feature (1)..( 3000): cDNA_ID_2052966_gDNA_ID_1620771_Annot_ID_167531 3000 nt of promoter + ATG
gtacctcctgatcctcctcgaccgttcttctcgtaatctgaaagagaaagaaatccgctttttcaagttaccaaaatattctgctagatttgctttgatgattatgaaaactaatccatgaatcttgtggggagctttatctttcaaatactacacgacctaaggagcaaaaagagagaatagtggggagcttactgtgcacggactttcttagctcgctcgatgtgtcttttcaaaagatccttctcagataattgctttacagcttcctcgtcctgagatcatcaaagaaaagagtggaatcaaacgtcatgtagtaaatattcaagagctgaaattagcaacagcaggaaagaatcagactaatgtcttctgttctgctcagatagaatcaatggttcttgaagacttaacacaaacctctttgtcttcatccgctgattcttcatctggatcatctggtacacttgtctctgttgttaaatccacaggtaacggttttggcaaaggtttcattataccactcctttgcggctgtcaacagagaaactgaaagttagattagtcccagatatatggttacgctcaagagattgcagatgcacatttccattgcaaagcagataacaagctttgagtatgcaattgaagatcatttaactaagattggcttctaaaaatataactatatcaagaaagaatcctctaactagcacggatgcaaataggtgagtgatcaaaagtaatttagtttccaaattcgagtaaatttggcattctgagaggttttctgaatcaaaaccccacaaaccaatatcttgaaaatacaaccgatgaatcttttatcaagcggagtcgtcaatgacactaacatcctactctaacagcagcatataaagtgcgaacctgaattccaacgtgagcaccatttttcaaccacgatcgaccaagtgaataaagagaagaagacccctcagtgattcggacctgtaaacagttgaatagtattacaatctaaacttaacagatgtcttttccaaattctcaaacaagcagtacatatgatagtaggcttacctttctccctctaacaacggcaagagccccatccttgcttctaataacaaggaagaagaaacagcaaggcaactaagtctcttgaacaagttttttttaaaataatattttcagtgaaaccaaaagaaaggtaatatcaaagtagagaaatttgatgttcacctggcctttctattcctgctagtgtctagaattgaagttgggggcggggcaacctaagtaccaaaatttacgaaaatgagaaaatgtgactggagcaagagcaataatcaaaagtaagtaggtgcaaaccaactattaagagaagaacagcttaacatttgctaagatataaaagcattttcaagtcttcctcattccacaaaagagaattttcaagaccagagtaaagcaggcacatagcaggacaaagaaccaaaatagaaagataactagatccaattactaactatcacatggtttataagaaaaccatgaaagacacgtccaacaactcacattgttgtataactagactagtcgatcaaaattctagaactacatgcattagttcgaatgagaatcactctgacaaaaatggatccaatattaaccaagatgattcttaagtcacggtacagtcagattcagttctactaagactccaatcaagaaactttggatcatctcgagcattttccccactaatctttccactacttagctagaatctaagcattaacaaatgaaacatgacaagcagaaattgaggacttcatctaagaaacctcacccgcggttgcagaaattgaggacttgctctaatgggacccaacccaacaggagaacccaatccaaggcgtggtaatggacgaatctgaggatttctctcccttataaactgctgcaacaaggattccatttgacgctgctcatatggtccaggatcgtaagtaaaactcgggcgaggagggtacccactcagattaccagccgtcacggaaggatctgcgacgaatcctcgaacaggtcgggctgaaaaccctcgacccggtagagcaaacgggtaaagaacagctgacggatcttgaatttggcgtctgaccggaatcgaatgtgcgtagaggttattactataagcagattgttgttggaacggattagggtggcgaagcggagctatgggtctgtaagtcggcggcggtagtggcggcggagcaggaggtggctgagacggcggtggtctaacagtgtttactggtgttaccggagtttccgatgcggtggatagagacggagacaccgttagagatgcggaggagttgggatcgggaattgacattccgacggcggaaggaatttgtcgattcgattttcaaaagaatttttggggaaacagtaaaaagaaaaaaaaaagtttcaaatttggtcacggtttaataatgcgcgaaccctcttactcatagggaggttttcaggttttgggccgatctgggcctgagggtattagtgtcaatttaaacacgggagagaaagagagagtaatcgccatttttctttattgggggagtgaagaaggataggattcagatgatgaagtacagatgaatgctccataaaccctactcttcttcttttacctccagcttcgattataccattccttgtttgtgaaggttcgtaacttcttcttctctctaaattatctcatggatttatgaaaagaatcgattttgtttgatttatgggttctaattagtcgaagcgcttgggtaggtttgcaatgttctagctggtcttgagcaatctctggtttagggtaccgaaatatgtttatgggaattgaaatttatcggatgagattttgtttctacagtcgtctgttcaaattcgatttcccatgtttcgtttgttttggtataggcattttagttggtaaggatg

SEQ ID NO: 5212 - DNA, 3000 bp, Unknown
  misc_feature (1)..( 3000): cDNA_ID_1013364_gDNA_ID_1620771_Annot_ID_167529 3000 nt of promoter + ATG
taattcgtcgacatattatttaccatagcctattttcataccacagtaattacaaagactattttatttcagacagaaatatcattcacagattagtcaacattaagtacaaaagtattatacaaagctttgttcgttttggtcgctgagtctggtccaaatgccaaaccagtagcgacacttacaaccaccaattgtaaactacaacgagttaggtttccaagtcgtagatcgtggtagcttcaaagccattgaggctgttgggacgaatccaagtaggcgacatcgctgcaaactgtgatttcagattctgagcagatgatttccgcattctgaagtgtgaatccgtgcattatgggcaacgggaatcccttttctaggtggtcatttgcatatggcacaaacactgtttgtataacagtccacactattggctagaagatcggaacaagataaagaaacacgtgtgaatgctaagaatgaaagaaacaaacatgcgagtgctttaaacacttgacatgatggttttacctgaagaagatgcagatggagatttccaatgttgctccatttcaaagacatggagaaatcttctaaacttacgctgcctccaaggttattgcccatgactctgagagcaccagatccccggatcatctgcagccaaggaaacagtgaatcatctattggtaaaccgacatcactgcaaatttgcttatagtaagtaactaaaacaaaagatatggagcattgtcattggaggactcaccaaggagatgcaagctacaggtattacttggtttgcatctagaacattgattactaggtctgcattaacattagctccaacgtattgctctgatatctttacaagcggaggtgaggacaaactgatgttcagattcatatcctggttcgggtatttcttgtatagttgtggaatgatgaacctccacctagcagtgtttaaaagagactgctctggtattttatccacaacccattgcacaaagtctgcctgaatatggcaagagtgaacatcctcatattagaaacaacggtggaaaacagtaatattgatgtatcggaaacatatagaacagttttatcaagagcattctttctagttggaacctaaggaattaggaaattaggaacttacattatagtacaaagctgcagcagagttaaaaacagcttcgtcaactgaaattccgagcattttagaatttccagggcagataactaaagatacagactttttgaagaaggattttaagacttgatttgtttctcctttggtgaacaagccatcaatctcaaaagtgatagatgaatttctcaatataggatcactggtgaaagtgacattaaggtcagcattatcatccactgggatttcctttggaaggctttgtaggaatgaatcaaggtctgatactccttccgtgagtttcttggcaatggtactttccacacttgacccaatttggtctttaaatgcattaaccatcctgaattgcagagaagagaatgaagtttaaaatgaaaaacaaaccaacacctgtcttgcaataagagggagtggatctatcatcaataagcaaattatttcgtacccctgataaaaccatgatgctcctccttccaactcaatggtaatgtcttccacatggcatccacattccgaaagagaaagttttaagcctccttcatcacttttcaagcctagagagagcccgatttccatgccttgaaccttaccgagaaggcgagaatcagcactcatcaaattccctttgtaaaacagatataaaaatgagcagatcacagcaacaactaaaaccaacacatggaaatggtaaacagagagcaacagtcacctctgattcccatatgcaactatgttctaagacatataacaatcacgaaacataaggatacaaaacagaacagaaatttgtgattcgcaagaaaaatcttgtctttccattgattcacaagattgagatgatcaaaactaagaattagtaaaattgatcataattacctgaacagatgcaataccctgatcagatatttcaataggaggaagccaagtactgtaagaataatgccaattcatactcaaattacaagtcgtccctgaagcgacgatgacaacacctgtctcaccaagcttaacataagatgacgcaacgtcaagctcgtatatcgtgagattcgagacaacaacatcgattcctccaaggaacgggattttcatagatttctcaattctgggaatctggagaggtataatcgacgcgatagctttgttaactagaagatttttgacgaaatcgagtccgttttgagatacgagaaccgatgtgaatgaatcggtgctctgcgtttgtgaaggcaagaagaagaaacttggtaatagaagaaagagaaagcatcgtccaacatccatggcggatattcaaagctttttttgttttggtctctctatcttcttcgatgaagaaaacaggttaatacagtgaagttgcgtaatggtttggattattgagaaatgtctaaaataaccttagtcattcgatttgcattgccttctggggtaatctgattcaaaaggaagtgtttggggtgaatacataaattgttaaaatattaatgtttctggtcaatcaaagctaaagctgaggtctatagggcaataaaagtataaatacatatgtaattgtatatactgtacatattaacgtttgatatgtatataagctcaagtggtgttaaatattctaatatgtgtctaaggacaatagttcgattaaaattggaagcttcgggggtaagaacataagttttgaaaagtatttatctttgtggtaaatcaaagctaaaattgaggtctaaagggcaaaagggtgtcataattggtctctcgcggtggcttggcgacacggaacagagaattaatcgagaatctttttcagcttgtaaccggaattc

SEQ ID NO: 5213 - DNA, 3000 bp, Unknown
  misc_feature (1)..( 3000): cDNA_ID_2991244_gDNA_ID_1620773_Annot_ID_50210 3000 nt of promoter + ATG
aaccatgtttcttgtaacaagtgtcttcaacatgaccagggcgactacagtaagtacaaactggcctctcctttttctgataggtgtctccattaagaacagattgtgaagactgattggagactgcaaacactgatgaagtcattcctggagtagtagaaatccttgcagaacgttgaatttcatcctgatcaatcatgttgaatacctcagacaaagaaggcaaagttttcttcatgagaatctgacttctaacagcatcataacaatcattgagtcccataagaaaatcaatgactctattagtctctctttcaatcagaagatcttctacagtccgtggaatagcctgaagactcgtcaattcttcccaaagagtttgtttacgagtatgatacgatgacaaatccagattgccttgacgaagagagtgaatctgttgacgcagcttgtaaagtcgagggaggctagatttgtgaaatcgagtatagagatctttccagattgcagcggctgtgggaaaatacaagatgcttgtatagatctccttcgatacactattcagaagccaagacttaaccatactgttacaacgacgccagattttgcaataaggatcatcatcatcaggttttggaatagatccatccacaaatccaagcttattcttagcttcaatgctagtagtcatggctataatccaggtaccatagctgtttccatctaacagttctggagctaagactaaaccaggatgatcggagctaacaagatgataaggactgtgactattatcaggagaatccgatacctcaaagtgacgcgatgagctgtattgagctggttgatgaatcgcagcatgaatcgaggatcctggagctcttgctgatgaaccagaagactgctcatgaatcttcgatgaagcaatgacaagtagatccggtgaactactccgacgaacactctttccatttcgtttacccatggagaatcgaaacagctaacaaatgagactggatcgcaaaggaaacgaagagaaaacgtgtagaagttcaagagaagaaaaaaaatgagaagatgaacaaactccggtgagattccagtgaaatcaaatcggaaaagtttgttacgagactgagatcgagatattttgctctgataccatattagtaaaacaatctcattctcattaattagcaaaagagtacaattgggggtttatatacaaactgatattggcctaaaccataagcctctaaaccaaaattaagattggtttatagaataccaacctgtacagactctatatgaaatctatactaaccaaactaagcttatatacaacaatctaagctatatacattaatagacgaaatttttaaacaaaacccaggattcgaacatcaaataacccatccccaacgcaacaaatattatcaaccaacttttcatttcatcaatgacactgtgaatcatataaaagagatatgatgtcggtgttgaagataacttctttattgtaagattattttgatcgaataagctgcctcaaatcttctaatttcgacaactctttatctgtgaggacactatgaacacgtttgtaaaaatccatcacttggtctctagctaccaccattttctttcttcgcatagggctggggaataatgagttcttacagtgaaaacataagtggtgaccggacgcattgaacctaacatcgtagaaaacattgaggaaatttttgtaacataataaaaagagacatgtggaaagagaaaacaaaaataaaacaaaatattgagaagaaaccaagaaaggaggaatttctttagtagagagatctaccgagattataaagaaattgaggagtagaagagatgtcagcgagctaaagtgacatcagaggaaagactttgaagtggttcctcaatactagaggtatataagaaaaagaaaaagaggcagatccaaaatgttggttttgaaagttttatagatttttaagattttgtttttgttttcatttttcaagagctaattgtcataccattaccaatcaagttttaaaatgttggttttccaagaaaatacttttgctataatctttttttttgtcatcagatattatttaggattcaacgaaccaattttgaagaaaattgttaacaaaagcgaatttttcatgccaaatagttttttattcaaaattttagacttttagttatcttataagcaagcgttataatttatttatttttttaaagaaaattttgagaaaaacaattgcgaaaaaatgtcaggagatcttcaaatgttcaaaaatacaaaaaaaaaaaaaaaaaaaaaaaaattagtgtggggtaaaataatacgtttaaattttattgacttttcatttcaatagtcaacttttagtgacttcttatttcagtcgctaactttttgttgatgttgccaaaatagtcattaaattgacccgagatcacaaattgcgggtaacggaactttgttaaaatttctgttaaatccacaagtgactggattaaaaaaaaaaagtgcaactggcctaatatgagcccaataaaaaatatctcaaaagttttatgggcttattacagatgggcttagtcagagcactatcttacccaaacaattaaaaaaacaatttacaatatgttttcgttttctacttttttcggttattttgggcaaatgatatctacagctcaacaaatcaaaaaaattcaaaaatatttcaatttattatttctcgatttttttcacaactgtattttaattgtatttttagtagaaatacttatttttccaaaaatatttgtttgtgttgatgtatatataaaaaatctgcatcagtgttttgtctacattttctcttccattagtttcgttatctttttattttctctatctatctggatattattttttcacttggggatttggagaaacctctcctctctctatctatagccatg

SEQ ID NO: 5214 - DNA, 3000 bp, Unknown
  misc_feature (1)..( 3000): cDNA_ID_1830033_gDNA_ID_1620773_Annot_ID_50213 3000 nt of promoter + ATG
acaactgatcctaaatattatttaaaaagattttttgtttttcatcgcatattaacaacattatttattggcaacaaaaatgcaatgaaattagtattttgtagcaacattttcacaactattttgcagcatgtagattgtgattttctcgttatactaagttttaagtggtgtaatataagaattgaaaattatgatgttactaatttgtgttattcttataatgatcattagctcaatttgtgttaaatatccacctgactttttattcgagtgtactgttttttttttttttctgttacaatttgagtgtagtgacgattttatatatatttttgttaaagactatctctctagattaattaaaaacttatctatactcgaagttgatatattggttctaaaacgaaaacgctcgatgtattttaagaaagtgttatgaaaaaatgatagcaacttgaacacaaaacgactgcatacatagtagatgattgattgtctaaattaatttatttccattcgaatataatttgatggtgatttgtgtgtaagaaggataggtgaatcgttgggtggaaagttaaaacgtttgaatgcatatctaattactaactagtattcgtgtcttaatacaaagatttcttatcgtttcgtttgttaggtgaagattagctaaaataattaatatgtttaatttgaattggtgtatcatttttttgtcattaaccgtgatgaaggtgatgacaatgctgcttacgtcaagcttatcggcggctctagcggtggcacaagtgggaaagaagggaaacgcaaacgcaggttggcttccgatttgcgggcaagttccaaagttttgcgatcagatcactggagctttaattgccggtttcgttgcactcgtcctctatgtactcttactcttatattctctccacgccgtcgtcgacccttttctccttcaaaaatcttgaatctacctttttttttttgagtatcgatctaattttatgtctctcatacatatatagatagtagacacataaacataaatttgctcgatgtcgatttgagacgtagttcgtgtgttgtgcttgtataatttccactgaaaagaacgttttctaaaagttcatgaccataacacgtaaagaggcgaatgaaggtaatattaatgtgggacatagtgttttgcgtgatccaaattattttagtatcgcaaaccggcctgtcttaaatggacatttgtagtaacaaaaccgaccatcagcaaattaacgttaacgttgctctaatcgtgtgtatttttctaatgcttggtgaagcacatgcgaccatttgttgtgtcagaacaaaaggaagattccacatttagaatttagattataatcccacatgcctattatttaaacatatgtatactgtaataaattagtcccagaagagcatttcatcatactgtataattaatcaaatttaaaaaacatttgtgttgaagagaagatgactagattcacttgattttttttaatactgattggtcgtttgaccagtcaggatccagactgaaatattctcaaaaggtatgaactattttaatgaaatatttgagctgagaatttgcttatgggacattctatccttctaaagaaatcattagaaaatggagaaaaagttactagaaaaagagagggaaatggggcgagagtatgaagaaagggtcccatgtgaatctaataattgaaaagcaaatatgagatttattttagggttcttgttttagcgtccaaagcggtcgcagttgccgttcagcgacttttctctgtttatgaaataaaaacgctccacttgttcttttcttctttcaacccactttgttataactattaacaaatattgcttggtccaaattttattatactgaattattttagtttttttgtatcatcatcctcaatgttagttttgaaatcctaggtcagtaagtcaataacgaaaatgacaagtttaattttgtaattggaacttacatgtcacggtctttgtttacgatcattgccacgaattgtttagatacgggctttttttttctttccgtgttgatgattatcgtttcttcttacatatcttgatcaatcactaacatttacataacctacaattttgtaatataattgcaatactcgagatcttcaaatggtgatactgttaataaaattacgaacttttaatcatcatcaaaatctatagaaaaagatacataggaccaaaacaagcctaaaacaaagagttataatttacaaataaatgcatgtattttgttacttttgttaaggattttcatatcaatgcatgcataatgcattctctttttattttatttataatgcattcttttataatattcggatccaaaattatgaattaattccagattgccataaatgtctttctttgtttatgctgacttttttcttttcttaacttatatagtaagtaaaccagaaaggtggaagatacaaagcaatttcattgcattaataaacttcaaatgtattatccaataatcaaaatttatctagtaattcacaaaaaaaaaaaaatctgtctatcattcaaaatttcaccaatttggataaatatctagaaaattttaaaatacaattcaataacactattaacatatcaatcaatatataacattgcaaaagtttacttgatcattagtatattcattttaaggttaaaagatctttaagaaaaggaaattcaaattatattgttggaaaaaaatacaaatcaaagacagcaaaaaaagtaacaaaaaaaaaaggtagaagaaactgaaacgcggaaaggaggcaaaatcttctcgtcgtcgttgtcgccgtcttcagagctacaaacgaaaaaactcgcttccgtttcgatttctccattgttattgtttcttcagtgaagcttttttcttcgagaaatttctaagatctaccacatgctact

SEQ ID NO: 5215 - DNA, 3000 bp, Unknown
  misc_feature (1)..( 3000): cDNA_ID_1830037_gDNA_ID_1620773_Annot_ID_50214 3000 nt of promoter + ATG
accattatcatggtatcagaaaaccaactattcttggtgtcagggagcatatcttcacgggatcagtctcgtcactggcgtggttcatgtctgctcaggagacaagttttgtcactcttggtcagcgtgttcttgcaaacccactgaaggtcagaatgcattatggccaccctgatgtatttgacagattctggttcttgagtcgaggcggcatcagtaaggcttccagagttataaatatcagtgaggacatctttgccgggtttaactgcacgttaagggggggaaacgtcacccaccacgagtacattcaggttgggaagggtccacaatttggattatttctaactaactatactgctacaacgtttttttaacgtttttaacgtttattaattatgcaatctacttttgttataattatgtaatttaacgttttttaatcttctaaattcaaaaaatttgagtaacctttgtctttatgcatttttcaggtcgggaagggacgggatgttggattgaatcagatatcaatgtttgaggctaaggtagccagtgggaacggagagcaggttctcagccgagatgtgtaccggctcgggcacaggcttgatttcttcagaatgttatcatttttctacacaactgtagggtttttcttcaacacaatgatggtcattcttactgtttacgctttcctctggggacgggtttatctggctctcagcggggttgagaagtccgctctagcagacagtacggacaccaacgccgcgcttggggtgatcctgaaccagcagttcatcattcagctcggtctgttcactgccctgccaatgattgttgaatggtctctcgaggagggtttccttctagcgatatggaatttcattcgaatgcagattcagctttcagctgtcttctacacattctcaatggggaccagagctcactatttcggtcgaactattctccatggtggggccaagtatagagccactggacgtggatttgttgtcgagcacaagggattcactgagaactaccgactgtatgcacgcagtcactttgtgaaggccatcgagcttgggctgatcctcatagtctacgcttcgcacagtccgattgccaaagactcgttgatttacatagccatgactatcaccagctggtttcttgtgatttcatggataatggccccatttgtgtttaacccatcaggattcgactggcttaagacagtctatgactttgaagacttcatgaactggatctggtaccaaggcagaatctcaacgaaatctgaacaaagctgggaaaaatggtggtacgaggaacaggaccacctgagaaacaccgggaaggcaggattatttgtggagatcatcttggtcctccggtttttcttcttccagtatgggattgtataccagcttaaaattgcaaacggatccaccagcctttttgtctacttgttctcatggatatacatctttgctatatttgtgctcttcctagtcatccaatacgcccgtgacaagtactcggcaaaagctcacatacggtacaggcttgtccaattcctcctgatcgtgcttgctatactggtgattgttgctttgctcgagttcacgcatttcagcttcatcgatatcttcacaagccttcttgcattcatcccaactggctggggaattctgctgatcgcacagactcaaaggaagtggctgaagaattacactattttctggaatgctgttgtctctgttgctcgcatgtatgacatattgtttgggatactcataatggttccagtagcgttcttgtcatggatgcctggattccagtcaatgcaaacgaggatattattcaatgaagcttttagcagaggacttcgcatcatgcagattgtcactgggaagaaatcaaaaggcgatgtctaagtttaaaaaacggtaaagctccttgttctcaacaccttatgttatgatcgtttaaatcctggatttcacaccaatgcgggctttaaatttgtgtaggtcttaagaagtaaatggtagttcaaatcctattggtatgtggcgaaggaatcagttggaggttagttttcccgaaacaaccgaattcgaagttttgtttcgtctaaagaaaaactcagatgctgatgatttatctttgtattttaaacaggtttttggagagtttggttggatgaggaatcgggaagttggtttgattcggttagatgggtttagggagatatttgattgtcagtgtgtgtggagggaactctgattcttgtatggtttttgttctaaaggtacagcaatttgtgtagtgaggctttgtgtatttgttctccttctctcattatagagctttagagcatttttagtttatattcagattgttatctaatgtcatctcgcagagcttttgttcacatttcacatcttttcttctccttcttagtagagatcagtttcagattagatacttgtccatattccactactctcgtctattatcggtttctgcttgtcaatttctgggtccaaaattgaaataaatttatataattggaccacaacaccactttgtcggttttgacttttctacttggatgctcctgaacttcttgctcccttttctattacaaattgggaaacaatcagtgtgaattggggaataaaaaaaaacagaattgagcaattaaagccacgtggcaagaaatcgacgagggaccaacgtgtttgtctgcaagatctaatccttttattaacaaaacggcgactgatctaacgggaaacttttaaaatcgagaaattgttaataataaattcaactacttctgggccatcatcatcaatcttgttcgtcttccttttgatcttatcaaactacagtcaaatcactcagagaaagctactaggtctctcctcgacatttgctttcaattcgatccagtaattttcttctcatcggagagagaaaaaaaaa

SEQ ID NO: 5216 - DNA, 3000 bp, Unknown
  misc_feature (1)..( 3000): cDNA_ID_1828025_gDNA_ID_1620773_Annot_ID_50219 3000 nt of promoter + ATG
attttcttttcgggacattttgaaaaataactcagatttctgttgaattttgcttctttttgtaaataatcaaaataacatgtaaaagatataatatgagataaaaattaaagtttaaaaaacattaccataactaataatttgagtaatttagaaaaaaaaaaattaccacaactattcttgatataatatgagtaaaaaacttcgaaacgagaagattgaaaatttaaattttatttttcgaattctagctaattggttctatttttttggggatatttaaaggtctatttgagacaattattcatatatttaaataatattaaaaatggaaaattttgggacatacgtaacgacatacttgttacattaagttaaacatattaaaaacaagattattatttgacagaaaaaacgggtattgtatatgacaaaaactcggatgaatacgagataagatagtttctgttctttaccggacatacctaatctttttgtttgataattttcaaaaccaacgcacagaagaacataccttcgagtcttctatattggtcaagtcttgggaatcaaacaaacgcaaaacagagttggattacataccttgctcttaacgatatatagtttatagatatgatagtatttattagctttttccatgtcgggataagactgttcatcgaaggaaagttacgaatttgaagatgtataatactccaaaccttcgaagctatgcacatcccattcaggcgccattaacatatcaaaattagcctcatgcacgtttgttttggtttcttcgtcgtcactggtatcttcgctctcatcagcttccacagattcgatttcttccatcaacttgctcaacttttcttctatcatcgtcacgtttgcacactgattgaggaccatgatgatcgactaaaccctaatcctctatctgaaatcccaaaatcctaagatgtaattctctagaccgagcgatggtatttaaattaccttattatcctagaaacatgtgaaatttaacataattgtcatccaatttggtctttcaaaaaaaaattcttttttttgctcagttaaaaaaaaaagttcaacaatatatgttccaaagacaaaaagattcacgcattttcatgattttagagttcttagaattttttgttataaaaggtttgcagacattaatttttttccccaaattagagtttttagttgaggtattagaattctttttatcaagaaaggtacttataaaaataagtatcagtgtgtgaaatccactacttcaatgttggaatgttacaccttcctcaagaaggaatttgagtaagaaagaagttgtgtaacccattattatatgatcttatcttcgcaaaacatgcctcttcaactagttgatgtagttttaagctactaaaataataaccgggtaacttaaatagtgaaaactgataacaaacttaataggatatgtaaatcacttggttattggtccatgtgttgaaattgtgtggcaatgaacccacaaacggataacaaatcatgattttcaatatctcaaatgagaagttgtgggacgatccattctagatactaaatgctgtcatcaagaaaaattatctaaccacaaacaaaaaaaattgagccaatgcatcatgaacttcttcattctactactaacaattgattttctaaattaactttacatttacattcgggagtgactcaagataatctagatcaaaattccctaaataatctaaaaatcaagaaccttaatatgagtcaaaatctcttctaataagcagaaaataagctaaaacagcacaaaaagcagcaacaacattgccttctttcaaaagaaccttaaacacaaatccgacaacttctctcgtaatcttccttccttcaaccactaaaactcttcttgatttcccaaagaaggcaagcaacaccaccaccgatatccaaatcaccatcaccgccggaaccgccaccgtcatagcagccaccatcgacatagctccaaacatcgcaccgagcaccaccgacgcgtataccgccggtaatcttgaaggagaataatctgaatttgatgacgtgtattgaagcttgtaccagttaagaactgatctcaggaggttccatgaagaagatacgagaattgcgtagacagcgatgaagagacaaacccatgtccgtcttttactcatgattgtgatgaagatatgatacgatcttggagattctgtttgatctgccattagagattggaagttcttgcttatcgatcgaatctgttttgagatttgtctgcgactgagcaaaataaaatagagcagtttatgagaatccttacactcagtcgtagcgcgtgtcgtgtacgcttctttgtgaatttgtttttgagctggcaatcgcgtggttatggttcacacgcgctttaatatatttttttttgtgaaatatgaaaaacatttggtcgaatttgtgagataatgaaatggtaattggaaagattgtgactgcattgtttttaataattaagtaaatttaaattctgtggaagtatatttaatcaataaactggaaaaacaaaagaaaagatttcgttaccataacgatttaaatttaagattttgttatacagaaaaagaaatgtagaagatttttttctaatttagaggagtcaaacaatgatatataacaaaaaaaatcacaatccggtggatttgtggggtaagtcattaatcttttactattttgtttggaaaaattagtagtcaatatcattatgactacatatatcagtgtcaaagactcaaagtaatggcttagatattttatgttaataaaaggaatatatatactgtgaaaaagacaagtttgtgtaagggatcgcatataatctcaactaatacaataaacaaagatatagccgttggcattaatcagctttggctagaccaaccagaagatcagaatcttgagaag

SEQ ID NO: 5217 - DNA, 3000 bp, Unknown
  misc_feature (1)..( 3000): cDNA_ID_3076210_gDNA_ID_1620773_Annot_ID_167609 3000 nt of promoter + ATG
caaaaaaaaaagaaaaaaaaaaaaagacaaatcccgagtcgggcgtttagtcgagatctacagacgggcgaatgtcctcagcaggcagaagtgacccagactggttaacaactcccgcctagtcagcaagggtctcgaccgatttgtgaccacccggacttaaaggagcggggtcgggaacaggagccttgagttcctctttcagctcggcgacaaaattggcaaaatttacctcggcattggcgaagtctttcagccattcttcgacctggtctttctcggtcgccaactctccaccttcctcaagtgccttgatcagttgcgcattaggccgcgcctgggataagtatataaactgatcgttgatcccatcgagaagcgagactttctgctcggcggccttaagtctggcgacgaaaacctcggaggtctcacgctttgccgtttgagaagcccgagccacttcgctatcacgaagccccctcgcctcggccagcatgcctttgaggcgaacaacctcggagtccgcccttaggttcagctcggccatcttaatggcattcgccttgttcacgaaagcctccttttcgccttcctcctttgctactttcgctgcagcagcttgggagagcgcctcatctctttctcgctcggcaacttggatccgagcatccgcttcggccaacctgttggccgcctccatgttgttcctcatggccaaatcgtacgagtgcaccattcgattcatcgaagcaacaacctagaaaacataaagaaaattacatatcggagatctagacgcgatgaatgaaaaagttgaataggcacagtgggaagccgtttcagcatacttccgcgactccagaagagtatccggaggaggaagcaaaggaccgacgcaccccctgaggaggtttgcagaggctacccggtcctcaaagatggggagttcttttcccgcctcggcactcgaggccttcttcttcttgcttttcttcttggacgatgaatcattcgtccgaacacgcttacccgcggccatgtcgctcgcaggtagcacaacaaccgcctcgggcaaaggcgcaacagcagtaggatcgacctcttgagcttcagaaggcgtcgggtcaaccggggccgcaacttcgggagcaacattccggtcttgagtcgcatcgggagaggctacccgcggcaaaatcaatcctgcattcgcgaggcgtttctcttccgccaagcgtctttctttatcttcttttttcttcgcgtacacctccctcaaagtgagcttagttgactgcatatcgacgaacaattgagttcggtggtccggagattctgaactggtaggacaggaaacgccgtgaagaagacggagggctagttcgactcgatccagagagaaatgttttgaccaatcacacttctgagctgataacgcgtgataagccgagaggaaatcgtcaggaatcgactcgagaaacttgagagtgcgttctgcaacaaaggaaaactagttagaaaaagaaacaaaatatataaatcgcgtcggacgtaaacatatcgctaactaactacaactacccaaagttccccatctcgtcagaaccgtcccgagaagatcatcgtgaacaacgtctccgagagccacgtagaagaagtgttcggtatacgaatcgtccttgctcgggaacttgtcaataatcttcttacccttagtaggagatatataataccgatccacttcggattttggaacccgcctgatctcgagatgagcgagcgtaatttcagtttcggattcataactccgaatcaaaatcccgagcaaatgtctcaagtatcgcatcgtgatctgggaaagggcaatctgatatgatgtcacatactccagaaccagcctcgggattggcagccacaagaagcaaccataaaagaacccctcatacaaggtatagaaacccgcagggggattgtcggcttgctcgtcagggctcggcacacccaaggttaaagcgccaaggccaaatcgagccctaaggtccgagagagaccgctcgatgcacaatgttgagccgggaggatctggcattatcacctttttgcttttcttcctcttcttcttctcggccttttcgaaagctttttgctcattaagacgcaggatatcttctgtctcgttcgggcctaagtaaagaaaatcctcaatcttaaccgtcggcatgaagggctcaggcacttctcgccaattggatgtctcggcttcgtcagccatcggggcaaaagacctgcgaacaagaggcggctcgggatcatcgggcaaatccagttcccgagcgatatcggcattggtatcttcccgagccgcgacgggagtcgcctgctcgggggcatccgaagaagaaacagtatactcttcagaagatgtccaaactgctctccgtttgtagatcgcgggaagatcatctgggtgatttgagtcgctagaatcgacaagagaagcgctcgggatcgacggagactgtctaggactcattctcggctcgggaacgatagacgagaagggaaacaaccagaaaacaagaatttctatcccggagaaatcaaaaataacaaaatgaacgacggagcttcgccagaaaagaaaaaacgataggaatatcaagatcagagagaaggaagcaaacttgtttattttcttcgaaaacttcaaatgaaatctcgaatgagtggcttgccatatataaagagttttcaagagcgcgttgggtccgcagcaaacattcaaaacgcgttcaagcgcgtgggctcggcagaaggaaaagatccgcgtgatcctcgggaataagcgagaaacgtttccacttctcaagaatagtcggcaacacgcgacagaagtttgaccgtccgggaagatgaagcgacagaactagaagacgaacagtcggctcgggaatccattcatgaagctcatcgtctctctgctaagtcaatgagatg

SEQ ID NO: 5218 - DNA, 3000 bp, Unknown
  misc_feature (1)..( 3000): cDNA_ID_2153903_gDNA_ID_1620773_Annot_ID_167589 3000 nt of promoter + ATG
cattatgaacaatgaagattttaacgccgatgaactcctcactttcgtcgcctataggttatgttttgtacttctgtctctctagactccatatataactcgcaaatactcttttgaattttgttttgagaagttgtgttgttttaatcccacttgcttgtaacagtgtgctgattctaggtctgaattaaatttgttgtccttctcctttatgtcttagaccatgttttttgtaaactatttttcagatcaagtattctgaaacgccttggacgtatgatgtgtcatgccgttgctctcagccaaggcggctgtgtagagataaacattgaacattttggcactgattctctcctcacctacattgctgataggttctctctctacccctatcccacatgcacacaaatatttatcgttctaacgaagtttataaagttgtacgtctacataagtgggattgattttatatctaaaacggttatgctaatttctaggtctaattctagtcaggattgaagaacaaaatatctcagttggtttagtggtaaaggatatgtttgttccttagtgccttttccttatgaggattaggagaattattttggttaattcgtatttgacatcaacgtatattgagtatggacatactgtatataggttccacccgtctctcttcttatactcgcaagcattagcacacaggttttgagttcatcgctactagtacagtttcataatgatattatatttgtatcttgaattgttcttctatctcttgatttttgtttgttaactatacttgcagatcaagtaatttgagacaccttggacttgctaagtgcgatcaaataacgggcatgggactgttcacagaagccatgaaacttccattgcttgaagacctcgagctttcatactgcttaatcaaaggaaagaatttggaagctataggcttcgcttgcctgcatttgaagacattgaagctaaactgtcaaggtttcaagttccccggctttacgtatgatcatgatgccctaggcattgctaaaagaatgcccgaactgcgatgtctccagctttttgggaacagagtatcagacgtagggttgaacgcgattttcgacggttgtcctcacctggaacacctcgatttacgtcagtgtttcaacattaatcttgtaggggatctggagaagcgttgtatggagaggatcaaagatttgagacgccccaacgattcaactgctgattacccatatgatacaagtttgctcgatctaggcatttgaaatcgttttgaagtctgtttagctggtcttgactacatcaaacaattttaattatgggattaggctcgagacggctcattttattaagcccaagaacgatggaaatatatatatatatatatatatatatattttttttggttagcatttgaaagaactaatctattttaaatagtttttaacatcgaatggtaacaatgtattaatttcggaaaagacattatatgcataaatgtgtaataagcaaagaaagaaataaaataaattgctgtcacaagaaatttcttatcaacttttacacgaattatatcatacataaaactatttcatcatgtcaaattatacacaagtcactatcccgtcagtcgtgtcataacaaggagagtaaaaaaaatatgttgttaacattaacttttagaaaaattaaatgaataattggtttaaattctaagaaccagcttttatataatagccaaaaaactagattttagcattaattcttaacatttttctattttcttctttttgaagatgtccctggaatccatgataatccgaaaaaattgatctgaatccgtatccgaaaatttagatttattctattaggtcttaaactcataaatttgaatccgaatcaaaacctgaacctgaacccaaatccgaatgttttattcgaaaactcaaaattttcgcagaaatttatctcttttaacaaacccgaatatttacccaaaaataagatggttatagaaattctcatacgtatattgttttatttagtcaaattatgtatcaataaataaataaaatatgttagacactagaactcgacttcgtgatcaacgtacgcatcaataattgaaatatgatttggtcgagtatatatgaaatttttttggcagaaatcaatagtttaactaaccgttttcgtttatgtttacatcatgtttgtttaaatttttatgtcatgtctgtttcaaattttataagttgtaataattattaagatatttaaaattaaaatatttttattttaaaaagtccaagttaagaaccttttattacagtcaaaattttaatcttttaacaaaattcttaacgtcaaaattttcacaatcaattataaaaatattcctaataataatgctcttaagagcactactatcgaaggacgtctcaatttgtattggtttggagtaatccggcgtggctacacagacgaattgtagaagaagcttcactaagagcatttccattgcataaccttttattgatgtctttaagactaaccatagtaaaaatagattaaccatgattaaaactaaagacatttgcttttttgggtgtctaaaatgtcttagggaagacatatttgacatcaaaaaaggtgaatgtctttaattttaactatggttagtctttaaaacacacactagaagttatgcaatagggatggtctaagttctttgctaggttactttaattcttggatttttgaacattgctctgtttttttttttagtcaaacaacattgctctgtttccgaaacaatccgctatgatattggcctaatgtattgtatgatcctaggcccaatgcttattgggccagtaagcaattggcacaaattgtattcgtagattttttagtgcgatgaggactagatagtaaacttgtgatctcaacaattttccgattcccacagaa

SEQ ID NO: 5219 - DNA, 3000 bp, Unknown; identical to SEQ ID NO: 5215
  misc_feature (1)..( 3000): cDNA_ID_3076247_gDNA_ID_1620773_Annot_ID_167577 3000 nt of promoter + ATG

SEQ ID NO: 5220 - DNA, 3000 bp, Unknown; identical to SEQ ID NO: 5214
  misc_feature (1)..( 3000): cDNA_ID_3076251_gDNA_ID_1620773_Annot_ID_167576 3000 nt of promoter + ATG

SEQ ID NO: 5221 - DNA, 3000 bp, Unknown; identical to SEQ ID NO: 5213
  misc_feature (1)..( 3000): cDNA_ID_2991244_gDNA_ID_1620773_Annot_ID_167572 3000 nt of promoter + ATG

SEQ ID NO: 5222 - DNA, 3000 bp, Unknown
  misc_feature (1)..( 3000): cDNA_ID_1828017_gDNA_ID_1620773_Annot_ID_50221 3000 nt of promoter + ATG
gagcacgcagatgcggttcatggcttagatgaaattcgatctcttcaacctcgtggtgcaactattgttgataccgatccacttcccgtctttctatctcaatttacaatggagaggtaccatcttcgattagtgttctctatctcaactctggcttaaagcttttcaaattagcatttgatgagacttttaaggcaacaaaaaattgtgcagtattgctacaaggtttccttatttggttgaaaagaaggtaaaagaagtacctagacgagtttcacttcttgactggaaaaacatcgaagagaattgtgacgaaccattcgctgcctcgggcttatctttcacgcctcttccggttaaatttcttttcacttttgagaaatcaaaacagtctaattcttccatgagaccttatagactcaacaatgttagttatgctttaggtgatgcatggagaggactacattgctttaggtttcctcttcggcgataaaagtaaagtggcttatatatcagacgtatcacggattccaccgagtaccgagtatggtaagagctcattatgttatgccctaatcattatacctctgtagttcacttctactaaagagaaagattgatattcttatgaatctttgattaagcagctatttccaaagctggggctggacagttagatcttcttatcctggatacaaatataccgtggaaggttcacatcatctcataacttttgtttaccgctttttcgatcttgataacctttcttgctgaccatctctttgataatagagaggaccacatcccacacacatctgttttacagaggtttgtttcaatggttctcttttttttcttcccaaagaatgcttcacttctctaaacctttttgagagtaagtttcaatattcctattctttaggctcttgagatcttaaagaggctatgtccaaagagagcgcttttaacgggtatgacacacgagtttgatcaccatgaatacaatgagatacttgcagaatggtctctaaggtatgcaatgaaacaatgttataagatttctataaatcaacatcgttgaatgctaatagagactatgttgatttctagggaaggaatccatgtacagcttgctcatgacggattacggcttccaatagacctatgagcaaattactaaagacaaatcttagaattcttgttacctatcaagaatacaaatgacaaaaatttccaaaattatatgagtagaatctatattttgatacagtaatgaaaatctctgtttctttacttgttctgggaatgattcaaaatctttaaaccaagcccttgaaacaacttctctaaatttgaaatctcattctcaatattcacttcatcttctcttgtgatcttttcatgcaacttggttagtctctgagtcccaacattcactccttctgcataatctctaagcgctcgtctcattgatccattttcgtcttgaacatctttgtatttccttttcagagatcggtatccgtcaatagatttgagtagctgttcagacaactctttgtttcttccctgtagaggcacattgttgtctcctggacctggaccatcaatatcttctttcttctccttattatgctctaccgcgcaattctgcactttcttaagtaatttctcattttgagccctaaaatcacttacaagctcctccatttcgtttaattcgtgagctttcctcgaaagctccaaagccattatctctttctccttccctaaacttgaacacatcatttgaagactctttcttgcagccatactcgcgcttaactcttttctcagtttctgaatatcttcaggatcgttctgtggtggctttgttggactcttggttagatcaggactccgtttcagatcggtgtagcatcgtctaagctcttttttcccagatgatgattgttgttgagctttctggattcgtgtctttagatcatcgagaatcgtcatcatagtgttgactctctgaactttccaatcatcgtggtgcctcgatgttgcttcgttgtgatcttgaacgagtttcagcagtagcttcacgttcgtagtgattccttaaaacagaaacaagaacacgtttaacatatttcttgccatgcaagtcacaagttgttttcttgcccaaaacggaaaatgaaacatgtcttaaatcgatctttatgagatgaatgtgattgatctaccttccaaaccagaatcttcatgagattggtgctctatggttcttgttggtgatgatgtaatagatccagaatctgaagggactaaatccggcgcagaaaatgctcggagacggctcatgttttccggttcagaaacgccgcctggagagaatcaatcagacaaaaaaatgatcaacagaggaagatgttggaaatttggacaaataacagataaaggttgttgtatttttgcaacttccatgttttgtgaggcgtaattagtggacagattatgcctttttcaactaaatttgcctgtcttacctcatttcacgctctaactttttttcctattaaaaattaacattgaatgttaaccatgtaaatgtgtgagataaaaacataatgggccttcggcccaatatatcactagaacatttgttttgttatactatgaggactaaattgtaaatttgtggagaagccgaaaggtccgaaactttactacacttcttctcatttaacttgacttgacgtttgaggtactcagaaaatggattcttcctcctcttcgcctatgaagtacgaggacaaaccgagaaactgggcggagcttctgccggaactaacggcgtccatcctccaccgtcttggcgtggttgagatacttgaaaacgctcagaaagtgtgcagaccatggcatcgcgtctgcaaagacccttcaatgtggcggaaaatcgatatgtgaatcccgaagagcctcaaaatcattgagtacgacatcatt

SEQ ID NO: 5223 - DNA, 3000 bp, Unknown
  misc_feature (1)..( 3000): cDNA_ID_1827986_gDNA_ID_1620773_Annot_ID_50231 3000 nt of promoter + ATG
tcaaaattttaaaatgttatgtaatttatttttttaatgaaaatattgaagcatatattgtaatataagatttgattcactttatttctttatttttattttctaataattgaaaagatattatttgagtcaatatctataaatttgtggttttaaatttaatttttattatagtaataggttatgtatttcattaattaggaaaagaaagaatgattgttaaaaatcatagcaattgttaagaaaaatataaatcatggagtttgcatgtattagttaaattaatattattcgctaatttgtaaaccatttaacttggtttgtctaagttatacatgtccgttaattatgtaactaatttcaattttgtgatgttttatatcactttttggattattttatataaaataacacttctatatattaaatatattttgtacttgaatatatatacttgaaatttttattaataatatgaaaataaatagttaaaagcttattaagaaaaattatttcgattttaacgattgcagatatgtggtctaatcgtcaacggaacacaaatccttccacaagaacaggtttaaatcatcccgaagtttcagctcttccctcaaaaacacctcgacctcccttcacggtgagctttgccttttgctgttctccgtgtttgatgtcccttttgccgtcgtcaaccgccaccgccacatctcatccgcctcgctcgaattaggtcagatcttcactttttggaggaaagttttaacttgggcttgggcctttgttgggtcttgtggatatttgggtggccctttaagcttgttgggctgcatgattgtttggtgcatacatgttttttgggcctgccctattgtagtgtacattattccatctgccaatcgttcgccactttgccaatctttcacctcttcacgtttcatcactcatcggttcaccggaaatttctccgggttctctttgcctatgtcggatatttcttcggtaggctcaatctgctactggtttagcactacttttgctggttcgatttctgcctaaattcggtaaagtttgctcaccggatacttctccggcgtcactatgcctgtgtttaaggccagtccaagttgtttccaatctagaaccacgtttgttggtttgaatttcaacggctcgtcagtttggtgctttgtcacctctatctcgatagcctttctttggattggtttatctgccctagtggcacaatcaatctcgcgcaacattgcatttggtgtgttttgtgttgtccaaggtgccttctctcttgtttgctttaatgttatcatggtccatggacgttgcaacgacatgtatggcctaaagattaaaactactttgatctatcctttaatctgcttatctttatttattgctttgcttttgatgcatggattgtttgcttcggctcctccttatgtagccctatctgtaattgttctctcttttgaggatgattgactatgatataaaattgtgcacaaaaaaaaaaaacatcctaccttcagaatttgattaatcttcatatccatggataatttggtatatttggaaagcaagaaacgaaaaaatatttgaaaatatggataaaaaccgttagacgtattatgtttagcagaaaaagaggcacaatcgtggtagttagctcaataccaaaaatcacggttccatgggatcggaaaaacaaattcgggtcgaaaaaatataatatgataatatttattctggttttcgttgttttgtggacggatcttggaaaggaagcgataagttttctagattagggtggttctacacatcatcaaatggagactcgccaaccatgggagctgctaatatgcgtagaagtctttctctcctctatacagaagtcgaagctctactctgggcgatgaagtgtatgattggtatcgacaacaaagaagtagcattttgtacagactgttcagacctggtgaagatagtgtcttttccaaccgaatgaccagcattttcaacttatttggaggaattccacaccgacaatgaagaattcacaagtttttcctaattttttatttctcgtactgcaaatgatatggcgtacaaattggcacaaaaatttgtattgaaccgcttcatattacttttgtaaacatttttcctcagaattggctcttctaatttctaaataaaatctgatgaaaaaaaaatagtatatggttgaaaagttcaatcaagcgttcaacatgaatataacttatgttttcttcaaaaacaagcttgatgaattcaaattgttttacaagagatggaggtttcttacgcataaaactgacatcattgttgatcctcagatattaatgatatttgcatctgacatatggtagagagaacaagagtttgtaagtacacataacttttcaactcattaaatcttttataaaattttgctattaaaaatctaattgattcgaaaattttagggatgtaaattaacaaaaagtttcaactgaaagccgcctgatttttgggacgtgatgaaacgatgtctcgtattatatgatgttcagtcccaatatcagcattcatctcgccaaagaagaaaacaattaatcaacgagcaagcaattgatgaagaaagcgatgatgactcagactctgatagtggtaacgtgccagcaacacaagttcccgagacacaagaagatgaagaagcgtatcgtgttgccgttgatgatgatgaaaccttcaaaaattctgctcctagaaaccaacaacgaattaggcctaatttgtagtcaacatgttgaagtggaattagttcacaaagatctgggcgaagcgcacaagtttatgttggttcacgaggaaatcgtagacgacaatctttaaaaaaaaacatacaagacattattgctagttatagagatttccaacgacaaagttttcaaaaacttcgttcaagagaataccgcaatg

SEQ ID NO: 5224 - DNA, 3000 bp, Unknown
  misc_feature (1)..( 3000): cDNA_ID_1827982_gDNA_ID_1620773_Annot_ID_50232 3000 nt of promoter + ATG
agagtatcaaaagtaagaacgcaagatatcatgatccggacggccgcggaatacataaacacgagtttggccagacctcttacaaagctcgtgcccgcaaacatgtaagttaatcagcttttttacttaaaaaactttgtatttcaaacaactgacttatctgttttagtgttttagtgtgagatgataggagaaagtactccagattttctcctgctcttagatgagactcatagaaaacctgatgggactttcatcgatagaaagtcggaggagatctataacgacgtgtcatcaaagattcaagaggaggagtctcacctgtgttcagacgacactacggagagcacaggttcaggcgggttatctgttcaagcaaagaacaagatctatgcacgtgtaacttatcgctttcaactcaatatagtgtcggacatatggcatcaactcaatatagttacagttttttgtgttgctttgtatttgtctgttgtggcttgaattatgtcaaactgaaatgattatcttgtgtttgtggcttggataatgtcagtgtgtgtaaactgatatgattatgttgtgaatgaagtttgcattcagtcattatgtgtaaactgatatgattatgttgtgaaagaagttcgcataatgtcattgtgttttttggcctgattatgttgtgtttttggtttgcataatgtcattgtgtttttggcctgattatgttgtgtttttggtttgcataatgtcattgtattttcagcctgatatgattatgtctggagctaaaagttttgcattatatcaatgtgtttcgactttgctttgattatgttattgtcggtttggttgtgagtttctgacaggttgctcctaagaagaaaggcaggatttatggagctggttcattacaggcagaagcgtcttcagctcatgccggtccggtgcttcctcgagatgatccagttgtgctctcgtagaagctggctgttgctgaagcccttattgcaaaccaggctaagaagatcaccagttttgatgcgtattttgactaccttgccgataaggatccagaatttgctacactgtttcgagccagatcctctacaagaactgaatcggtcaactccaatctgagacccgaggagcctaatgccgcagctgctacatctgctgggatcggacatgtggctgtcggacctgaggctgtcaaacctgaggctgttatagctgaccccaacactggatcctctccatctcatactttctaatttctgtattcagtttgacaatttatcaaaacttaagacaatcttttgtggtttcttatattgtgtacttgaatctgaaaatttcagctttcaattatgagtttagtgtttttaatcagttttcaaatttaaagcttagtaatcagatcaaattaggaaaatcattaaataaagctaattacaacagtaatctctaaatataaacagtaatcacgcttacaaaaacaacaaataagtcgctgatacgtcacaagtccattgcaaatattacgaggtatttgcgactaaacgaagggagccacgcaactccatcgaaacttttgcgaggaatgagggagccaaaataaacagtaatcacgctaaaaaaaacttcaaataagtcggttgacacatcgcaagtccatcgcaaatattgctaaggatttgcgatggaacgaacggagccccgcaactccatcgcaaaatttgcgaagaatgagcgagaccataaatttgcagctactttgctaccgaatttgtccttcgcaaattgtgagtgcttcgcgagtaagttagttcgtcgcaaaatttgcgagagaaatgctaccaatttgactttgcgacacgcgtattgcgaggaactgtggttcgtcgcaattccctcgcgattgtctgcgagggattagctacggtttcttccctcgcaaaagacgtgttttcttgtagtcttcaccatctccctcaaactctctgcaactatgtaagtgaacttttctaccaatttcaattagtctaaacattgaatagatattttgcataattgggtggaatttagagatcaataaatatatatataggtactaaatcgttgttgttctttggataatcactcattgctaacaaccaatcactatcgtcagtttaagtactatcgaataattcatgaaattaatccttcgtcgtttgtttcttctttctattttaccgtgtacaaaattatctctatagtaaaaaaaaaaaagaaaaaaaaaggctccattattagcaaacgaaagtggttattggacaggtgaaatttaatgagtatttcgaatgtagttaagctaataatcatatgttttcagattgaatctgtgttcaagagatctcattctctacttctcttgttgttttttactatataaataagttcagtcttagtaggctgtccctgggtttaatctatgagacctggtttacctgaaatgatcatttgcattttcggtagaagtggacagttttcgtgtcgtacatttttttgactgagctttatagtcttgttggtctaaattctcaagtcgttagtcttgtttgctgcaatttttaatatttaggttttatattttaggtatttaataattatctaaacaaattaatagattaatttttgtatattatgataattgatattatataaaatggattttaactaaataagtggttttgattaataatttaggtgtcttttagatttttcatttaaaaataatctttacttcgatatttattttactatgatatctattaattttttgacattacgaattttaattatattaaactatgtactaataatattattttatttgttaggacttcgtgccaagattttcgtaggtctacgactcgatccaataatcagacatactagacaacaccatcaccatcgttcgttcccgagtcaaagcagtccattgctcttccatcgatg

SEQ ID NO: 5225 - DNA, 3000 bp, Unknown
  misc_feature (1)..( 3000): cDNA_ID_1828079_gDNA_ID_1620774_Annot_ID_50235 3000 nt of promoter + ATG
caaatgaaatgactgcatggtcttctcgtggttctcgaaaatgatctctacaaaggtacggaaagtgatgttgagaacattaggttgtacagtcaatgctgtgattttggctgcaggctcgtccttgatcacattgtacttgaaaaccttctctgacatttggaagtactcagcaagcttcaaaggagtctcggtgtcaacgtgtgatacaccattgaaaccaaaccggactttaccgtcaaccacacttttagagttgacaagcttgatgctacgggtaatgttgatctttccgtaatggtatgagccttgggggttaggccttgcagcgttagaggtaaggttccacctgaaagacctgaactggttcaaagaccaagcccatccaacaggagccttgggtagctcagttgaagcctgaacgttgcttccctcataccggatcacacccacggtgctcaactccttcttgaggaacctagtcgatgcaaccatgtagtaatccttagctgcttggttagcagtcacaagaactgaaaagcactggccaacatggacatcgagagagtcatagtcgttctgaataacatgggatccttccatctccacgagcttcatcttgtggttctgaatcctgaagttaagtgtagacttgaacccaacattgcagagcctgtacttgtaagtctttccaggcttcattgtgaacaaaggctcgttctttcctccaacctttccagactttccattgatcaaaacaccgttaggcaatccaagggtgcgtccactgtcaaggaagttcttgagagcagtgtggccagctgtgtaccagtcaccgagaaggacagtgtagtcatcttcaggatcagcataaggaacgggaattaggagacggctgttgacacggagaccaccaaaaccaccagcaaagcggtggagagaagtggttgggtaatagaagtaggaaccaatctggtccttaggttggaaatggtaagtaaagttctgtccagctgggatggggcatgaagttccagccacaccatcttgccagcagttcttcctatgctgaatcccactcctgcatccacaatcccttattaatactactcatatatcacataagaatgttaacttgggtttaaaaaaagtcctagctagattggcctggtcggaccctagaaagtcggtccgcggaaaaccctttgccttgaatcccgtcaaagctggaccggatgggaaaagtccgataaaagattaaccgcggaccaactatggcttgagcacaaataattgactggctcaagcttaagaatgaggatcacagaccggactaccccatgacaacaagctttttaacagatgatcataatataaataaagaatgttgattagtaccaggtcaagaggaaaggttcgtctaggtggttgaagacattgatgacgacgttgttgttagaggttgagttaaggttaggaccagggaattgaccgttgatgagaatcaccttttgaggaacaccgagaggtgaggcagttccgtaagtcacgttccatgtatggaagaagtaaggatcaccggcgttcacgatcgccaccgtagagacgaggcagaccaacaccgtcaataacctcccctccattttttttttaatctctttttctagaggaaaaagagaattgtttttgtttctgtgttacgtataattaaccctttcctacaaaaaaaaaaggaaagcaaaactagtttttgctcttaatgaatcctttgtgatttgaagtatttatttagggtaaaacataacttcttctataaggtaacgtcaccaatttttacgcttcatctctaattcattttctatataagaaaaatggtgacaacaaatagatttctacctgtatctctttatggttttaagattccagaactttgaatgaatacaactcacatcgtattctaatattggaaatgtcactaaagatgttaatatgtggtttctacgtcaaaagaatgtttcccgaaaataaatgtcatgacaaaactatgaccaaataaaaagtatctctaaactcgataaatgaatttctcacgtcataagaattagctttgacatgctaacccaatatagaaatagttgtgataattatattttgcgatggagtattctaattctgagattattctttgtctcgatagcttggtttatttgtagtaatttttagtctaaaatttccgtactttctcatgtcaaatttaataagtcactcaattgtataactattttcgagtgcatataattgaaaattgcatcatctttaaacgcttaaactttattgcatacgcaatggtatcactttaaacgtttttatctgttatttctttttattattctacatatctcatgttttcatgtttgcaaaagaagttgttataatggacgagtcagaaatatttatagaaaaactgaaacgtcattaatcttccaagcccatcattttatttttattctatcatttgactatcgtgctactataagtcatttgatgtacaagtcaattatttgatatgagatcaaatcataaccaaattggtttatataagaaaaaataaagtttagtcgttcgagttagtatcatgaatcatgtataatatatgactagactcaacaactattctccaaaattagcaaaattctcaaaaaaaacttagaaattttttttttagaaaaaaagtttcaccaaaaatagcgagaggtcaaattgaatattcctaatatggacgacaggaagagcgtgatgaaagggacctaaagaaacgagaaaaatcaggaaactgtttattcgattaagctataaaatgtcatttaacatttgaagaaaaaaatcgaaattcaaacaaaaaaaaacacataataaaacaaaaagaaaaaaaaaacattttttccaacacttgaaaagaaaaatcataaactttactaataataaagtttactattaatg

SEQ ID NO: 5226 - DNA, 3000 bp, Unknown
  misc_feature (1)..( 3000): cDNA_ID_1828065_gDNA_ID_1620774_Annot_ID_50239 3000 nt of promoter + ATG
gtgaatatcttgccaacatagtctcacccggaaagacctttcgcagattcttcctcagaattcgacacatgagaattcatcatcaccagaatctcactggtcaagatattcttactccaaaattttagagcatgtatgctttccatagtgagaatttccgtcgtatctttcttattcgatgcatgcatcaacactgcaccaataacatatgactctgatattactcgttgggctggaaacattcaccacaatcttatcagtcagttttaaccttaaaaactcgataaatcaagaacacttgaatcggaaagcaaaaaaaaaaacagaactagaagaaactttcatgtattgttgtttgttttatcaaactcaaatcataatttgaatgtcttttgaatctgaattttgtggaactaaaacgttttagactttgatgcaactagaaaatataacaatgcatgcaaaacacttttacaagtttggtccctccatttgaacaactagaacaaaacttttaaagaaactctagaacacatttgattaatactaacaagcgtgggaagtaagaaactaatttgaggcatttgtacataccatattgtaataactccttagtgttgttatttgtctcactgcctgggattgttgttggtgaggaacagtgttgataatggcccattattaatgggtcgcaacttgcaagacatatgggtcttcactattaagactctgcaacattaaatacatttctcgtggggttcatcctaatatgcatattggtgtatgtatctgtgcctgcatgatttaatgaccagcaaaaaacagtaatggtcaaagtaaataacatgatgggagaaggtgaaaaaagagtttaaacctcggaagagttaatactggtaaaactctgggtctttcttcaacgttctcaattattacaactttacaagtactacaaacattttcgataaagacaacaatacacacacttcttcaagttatgtaacaatccacatttgaaagcaaaccttacaatatgtaacacatcaacgattttcacactataaatataaaactaaacttaccttcaatgtgttaacaaggacaggatccgagttctgatttgaagaaacatctgaagacaataactgtaaacagaagagagtactaagtaaaggagcagtagaaatcacagtagccaatgttcatgacatctaaatattagcaagaaagatgctcttaacgccagttgatttagataaattgaatagtcaactcataatgatacataaactcttacctctctgccaatgaacacgagtgcaacatcaacaggttgctgaagttttttctccgagcactaaacaatggagacaataaaatagatatgagaatgaaaccattgcattgtgtaaaaatatttgcttgcggactcaacgcgaacataccagaaaattagaccaacctcctagagtgaaaacagagtctactagatcctttgcagacatgacttgataatttacatccgtttcaccattagcatacctacaatttcatcaatgtggacatcaatataagcacaattccaacaaaagttctcaaactcttacaccaaaaccagagtacaataaaatttggtaaatttactcacataagccttgaaaatggtgaaaacaaggatcaacaaaaagataaaaagaggcaggcctaactggagatgcggagaccagaggaaagcaggaactgtggaaggtgaagctaatccaaaatccacgagagacgcaaactcaagaactaccaacaactacgccagtagagcagaggtaaaacgtcaccgtttgctataatttacccacaaaaccgatgtaggagaaccggtctgcgtttaacggttggattagctaagagaaccggtctgataatctcttgttaacggtctttgtagaggatgtgaactttatctaagtgtgttcaaaggcttcatattttgagactttatattttgattttcaacttggatacactagctagatgaaaacaatgatgatcctcttctctgccttttacgtgcgctttattattctgtgctagatgcaaagaacaatatcccctagcaatgaatcttttttaggatatacataagacagtacgtattgataataattaatggcaagcttcatcaaacagcaatgaagaaggtactcatccaatgcaaatcttgtcatccttgtatcgtcctttgtaggtgaatcatcattaggctgcagaacactgttttcacagagagcgtgttcagtttgatggactaaaactgaccttatattatatatcaagctcaatctgctggtctcacgaaaaactcgtctctctattgtacttaaacccttaccactaaatcccctgaatgtcttttactatttcttaactcttgaactactggaattcaatttgagctcatttcttattaccatgttcatttggagatacgatagagttagtttatcaactaaacaagatcacacgattgatcaactaaacaagaaatataaaaccaaaaagacaaagaaaaagagttgagatcggaaagaaggagaacgacgatcaagcctcacgatatttatgttccttcgagacctttggtataagcgaatcacatcttgtgcggcagaaatattgtaaatagtctgaatttcaaaataaattactatatatatatcacaatacatgtcggtctggtttagtaaagagaaccggtcgctgaatctggttcagctaaaagaaccggtctggtgtgtcagataagggccaattgggccattaacacattacggcccatataaatttaaattaacaaaccatgaaccgtcgtcggctcatcggaccagtgtggtatcaccggcacttgtaatcagagagactcactctcgagtttcgtcctctctacttcccgctcaaaatccttcggattcagccattgaaacaaccttgagaagagtttgaaag

SEQ ID NO: 5227 - DNA, 3000 bp, Unknown
  misc_feature (1)..( 3000): cDNA_ID_1828057_gDNA_ID_1620774_Annot_ID_50242 3000 nt of promoter + ATG
tcaaactgtgaatccagtcatggaagctgagatcaaatgtcccttttgtcaaagtgggtttgttgaagaaatggaagatgacgacgatcatgattcttctgatccggctgatgttagagcaaacaactctctttgggcgcctatcttgatggaacttatgaatgatcctgtgcgtcgtaggagaaaccagagtgttgagtctgttgaagataatcaaaacgaggtacagaccgagaacaatgaagacgatggagaaaatgatttggattggcagcttcaagagattctcaggagaaggagaagacattccgctgctgttttgcagttgcttcaggggatacgagcagggttgtctgtagaatctgagagtactggtaatggaggtaataatccgggacgggtgatcttgatcaatacctccaatcagactatcacggttcaaaactctgctgatatggattctgtacctgctggttctttaggtgactatttcattggtcctggatttgaaatgttgcttcaacgtctagctgagaatgatcccaacagatatggaacacctcctgctaaaaaagaagctgtcgaggctttggctactgtgaaaatcgaagagactctgcaatgttcggtttgtttagatgattttgagattggaactgaggcaaagctgatgccctgtacgcacaagtttcatagtgactgcttgttaccatggcttgagcttcacagttcatgcccggtttgcagatatcagttacctgcagatgaagccaagactgattcagtaacaacaacgagcgataacaatggaagcagtagtgcttctgctacaaccagccatggagctgagaacagcgatggaaaccggcgccaagaagaagaagaagaagaagaagaggaggaggaggaggagaacgagaacaatgacggaagcggattctcgatcccgtggccgtttagcaccttgttctcctcgtcgcaagatagcaatgcaccaacggattctagttaagacatgttccctgagcaacataagctttttggtgtgatcatgaaatctcggttctacctaaatctgatcttttgtctgtacataagtttctcagatttggttgaatgctacatctttggaaaacaaatatctttcagtttgtgtttttttaattgtttttgagcaaatcttttgccggattctgtaagtcgcttgtgtgttttttgttgtcaaccaaagccacttttgcaacttagtttgttaaattaatgccttaatggtaaaataacaagattggtggctgtagtacgaattgtgttggtaataaattataaatttaaacataaaaagtaatttaacattcatcacctttgttgtatgaaatggaattgtataatattgtatgcctaattacttagaccgactcgtttaatatgtcgtcatccaaaacaaaatatgatgtcttttactaaacttaatgaagtgatgctttttccttgtgttaatccatgattgcattaccatgtaatcttttgtttacgcgtaaacattaattagaatttataaaagctagagttcacatgtgtaaaatgcgaccaaagttaccaactttatgcgctattaacgaaccttttgacattaacgaacttaactttgatatagtatatatactaatatattaacgtttcaccaaatctccttgtatatatataagtattgtagtatcaacttattacattatctctcagattagtcataatccaaaagaagaagtaatgaatcgtcaggttttatccctaatcactttgattattctcttggtctccgcgtacaacacgactatgggccgaactctgccgagtaagtgaccgtctttgatcatacaaatacaatcacgcataaacaaaactcatattcagttcttaatctctttttttattattattataaattaaggggaaggaaatggagcacaacaatttgataatctaaaagctggtgtcagacgaagtgaatcggcacgtactcgtcagaaaggacccggacactgatgagtgatgatctctaacaagttttagttggcaccttcatgcaataattgataatctactgctttgtaataagtccgtcgttgtggcgattcatagtctctactcgattcatatttgtgaacgtgtcttgagttatagtcttacatatagatccaacaaaaaaacgtatgctaacacattctgtaatagaacacgtggcagacaaagagtggacggttccctaaaattccagtaaagaccgtaacattaaaatctaataagctgaattcccataattaccctcatccgacaaagagaggcaagggtagtttaggaaagtatatagaggtaataacgtgtccttaagctccacagatccaaagcgcagatcacaaatctcatccccagagagagaacccagagagcgatattgaaaatcaaaactctctcctttatatataatcccaatttacaaatctctttccctctctaaaaatttcttatctttgtataaaaagccttctcctttttcaaatcattcaccttcctttcgccttttcgggggaatttcttccaatctgttgggtttacgaaaccctagatttcgaaattccggattgctaactagcgaaaggtctgattttgtttcgtaccctttgttcctaatggattcaattccacggattttatctgaattgagtttcttcgtagttgcttgttacgaattggatctcatgttctgaagttgtgtgtttcatagcttttcgttgtttgattgtgaaacaatgtttctagatttcaattatcaaaactggtttttagataaccagatttggtcaatgaaattgtaaagcttgaaaacaattttgtttcgtggatgcttgttggtttggatcgacatgagtttctgttttgccctatttaagacgagatttatagctgatgtgtgtgtgtttacgttgattcttatgttagaga

SEQ ID NO: 5228 - DNA, 3000 bp, Unknown
  misc_feature (1)..( 3000): cDNA_ID_2992626_gDNA_ID_1620774_Annot_ID_50243 3000 nt of promoter + ATG
tattttcttataagcaactcgtgtccagactatttagcctctcttttaccttttgccctacttagtcatttggtaatcactccagggagcttacggagagaatgcatctcttgtttatccgcagggatacgggtatgctgcctttccttactcaccagcaacaagccctgctccacaacttggtggtgatggacagttgtatggtgctcagcagtaccagtatccttttcctctcacagccagtagtgggcctttcgcttcgtctgttcctgcctctactcagagcaagctctctacaaacaaagcagccaactctgcatctgctggtatccctaaaggaatgaatggatcagctcctgttaaaccattgaatcagagtgcactgtatggaaacagtgctcttggaggtggtcttgctgctggttatcaggaccccaggtatagctatgatgggttttacactcctgtgtcatggcacgatggctctaacttctcagatgtgcagaggtctgtttctggcagtggagttgcatcctcatattctaaggctaacaacaatgtacctgcgactaggaatcaaaactctagctccaattcgcattacacggtatgatatggaagtcagttttgtatgataagtcttcttctctatctgaatccctgtatctgatagcctcattctattcttggcagagtatgtaccagcctgcatccatgacaggttatgcagctcagggttactacgacagagtgtctccaaacaagtcatatggtcagtatggtagcacggtgaggtctggtatgggttatggttcttctggatatggttcaagaacaaatgaaagaggatggctcaatacagacaacaaatatagaagccggggaaggggtaacagttacttctatggaaatgagaacattgatggcttgaatgaactaaacaggggccctagagccaagggcacgaaggccacagaagaggttagctcagaggaggtgaaaaagcagacgtttgatgaatcaaatactgaggagactgtaacatgcgttcttccagatagagaagagtgcaacagagacgattttccagttgagtataaagatgctaagttctttatcatcaagtcgtacagtgaagatgatgtgcataagagcatcaaatataatgtatgggctagcaccccaaatggaaacaagaagcttgatgctgcatatcaagaggctcagcagaaatctagtggctgccctgtgtttctcttcttctcggtttgtacctaattcttagtttatttcatattgtgtattcgttttgtttcccgatgctgagtatataccccaattgtctccaggtcaacgcgagtggacaatttattggccttgcggaaatgaaaggaccagttgatttcaacaaaaatattgagtactggcaacaggataaatggactggctcatttcccctcaagtggcatattctgaaggatgttcccaacagtttgcttaagcatattactctagagtacaatgagaataaacctgttactaacagtagagacacacaagaggtaagtgtttatatcttctcgatctatatgtttctgatctaccagcaatattttccacttttcaatgttcaaactctttccatgtgatcatgtatgtaggttaagttggagcagggtttgaaggttgtaaagattttcaaggagcataacagcaagacatgcattttggatgatttctcgttctacgaggctcgacaaaagactattttggagaagaaagctaagcagcaacaatcccagaagcaggcaagagaagaaaacggttaattccatagatataagcagatgcatttacatttgtcctctctactctctagtattgaaatgcacccatatatctttaacaggtctgggaaggaaaaaccaatgatgagaaaccaggaactgttgattctaccatgtaaaatgcgtataaagatccctgcatacggtgggaagatgaagaagtagtgaaagataaaatcagggttgggtttgttttcgttttagcttagacagattttcatttttctttggtttctggttcggacatgactctgttgagtcttttcttaatttcttctagattttgctttcaatctgaaaatttagtatcttctttccttctccatttctcctctgtttccaagttttcaaaacctaaaaggctgattggacaaggataacacatccaattaaaatgttatgtttttgttaatactctataaacctttgtagttagaccattaatttttgtgtgaaactcgcataaaatgagttagttgcaacttgcaagagaaagatatcgattcgtgtcggatccacagtgacaggagtatcggagcttgagtcacggagctaggagggtatggacggaaactaggaaatcgttgaatctatatgcataatttcttaaaatatgaacaatgagtttatatatgttaacaaccatattaatttatacaggttttactacatcatttaaagtatgagggtaaatgagtatattttagacaattacaatttttgtaagaatcatctgcatttaaattcatctgattttattattattttggatgagtatgagtttggcaaaccatatggctaaaacatctagatgatgtctttgcatttcaatatggatttcttttaggctttagccttttgggccctaatgtaacaccaagtctgcgacaccatccaaaaaattaccgcgaaaaaaaaaaaaacttgcgagagagatattgattcgtgtcggatttgacgtggcaggagtatctatcatctatctcgtaattacgtgattaacttagaatctgtttctttcttcacccaccaaaagtagcaaacctttgccacctaaaaatcttaccagttgggtgaaagttgccaaaatagagcttgcttttgtcgcaatcctatatttttcagattgattgttggtgggtttgtgtaaatg

SEQ ID NO: 5229 - DNA, 3000 bp, Unknown
  misc_feature (1)..( 3000): cDNA_ID_1828053_gDNA_ID_1620774_Annot_ID_50244 3000 nt of promoter + ATG
caactccaccagagagctttgcaattctctcattgagtttctccttctcgtaatcttgctccgcttgctgcacaaaccaattaccattgcaatgtaactacactatccacaaaaagtaaaagaggtcccatatatgctatactcttttactatacctcaataagatttttaatctgtgtaacacgctttttcactgcatcctgtgtgcttccatcacccactatggtcgaggtctcctttgtgaggacaacctttgaagcattaccaagaacctcttttccagctttgtcaagtgaaagaccaacttcctcacggatcacagttgctgcaagcgaagatagaaaattaggacaagataaaaactacaaatatatgcgtaaacatagggctcatcaatgcagacagaacttacctccagttagaatggcaatatcatcaaggtattggctcttgcgctctccaaaccctggagctctgagagctgctatcttcagtgtacctctaagcttgtttacaacaagagtcgctaaagcttcttgttcaatgtcttcagcaataattaatattgggtatccgcctctaattgcatcctccaaaacaccaacaagatcccttgcattggtaattttcttgtcaacgagaagtaactgcaatcataccaaaacattaaagatcgttgttatactcatatataaatatctttagtggctaaatagtctgccaacaaaattcatcttctactcagattcaagaaacatctaccttgcaattgtcgaactcgacggacattttctcgctgtctgtcacaaagtaaggagagatataaccacggtcaaattgcattccttctacgacgtagaggttgttctcggcacttttaccctcctcaagggtcaccacacctttcctgcccactttgctcattgcttcagcaatcatatttccaatttcgtcgttgttacccgcactaacagctgcaacatctgcaagttcactgtcttcaacctacatcgacatgacttacattcagaaccttttgaaaaagactcttaacatattaaaagaaagagagttctataaatttgaaacctccttagacattttcttgagctcggtaaccaaagcctttgctgtcttctcaatacctctggtgatcaaaacagggtttgcaccagcagctaccacctgaataagataatcttaaaattagtacaaaagtttttgaagtttcacatagagaaagctgaaagaagaatgttacacagaccttgacaccctcagcgataaaaccttgtgcaagaacaacagatgttgttgtaccgtcaccagccaagtcattggttttggcagccgcttgcctcacaagcttagcgccaatgttctcaaccgggtcttccaactcaacctacaggagaaagtttgaaactctaagactcagttgaatgagaacaaaaatcattatcagaggggtaataattccatacctctcttgcaacagtcacaccatcattaacaattcgtggtgatccatacttgctctcaagaacaacatttcgtcctttgggtccaagtgtaacaccaacaagatctgcgagcttgttgacaccagcctagtacaacacaaaattagaaaccacagaaaatgtaaacctttagctccggtttgggaatgaagtttccattaactttttttaaaaaagatacttacttgaagtctcctaatggtagtcccatctttgttgaaatgtaattcctttgctgcgcacacaattgcagaactggatcttctgggtctaggacacacactttgtctccttccaaatgagcttgaagacaacttgctgataagtttcttatcagatttgtgaccattcggagcaaccattgaaccaatagaagatgtggcagtgaaagttgacgccattttatccacttcaaagacagacaaaattcagcacttagataagatttcaaagatataaaaaagactcttcttttcatctatatacggttaacacaatcaatataacagaaagaaacaacaacccagtaagctaaagtaataaattttcacaacaaaccagaagaaaggcgacaccttcgaaagcagagctcaataagaacacaattgacaatctgaagaaacactaatccataaattttattacaaaacacccaaaatcatggaagtaatgaactaatacaagttttcaaaagcttacaacaaattcttatccaaacaaaacatacacacataaactgtggcactaaaaaatgcagaggataaactattccaagagtaaggattaagaaactaacagaagtagagagatgacgaaggaggttttatcaccggaagtttttggtttccggataagaaaaggggagctgaagcaaggaaaggaagtaggtttatctccttactctcgcttggaaggtgcttttaacgttcccttacctctttcaagctttgagttaatcttggccgttggattcaactcttcggatcctggatcagatttatattgggcctatttgggcctttattcttgctccttaattcctaacaatggaattggaatcagtgatatttattttaaaaattgattttttcccgattaattgcgaaattttcgaggaaataatatttatagtattattttgtgagatatttcgtagtgactagtataatattaatgtggctggaataaaggaagtattttaaaaaaaaaacgatggagaaaaaggtaaacaaaaataatagaaaaatataaaaaagggatcttggaggtatttgaatcaaatcgaggtgaacgaacaaaaccacttttgcctcttcctcttcttctctcttctcttgcggctacgattcaatctcttaaaccctagattccttctgagttcttttttgctctgatatttgtgtttgtctcaaactcttattgttcaatatccgacaaggatctattatcagtcttcgctgccaactctgttctcatg

SEQ ID NO: 5230 - DNA, 3000 bp, Unknown
  misc_feature (1)..( 3000): cDNA_ID_3076276_gDNA_ID_1620774_Annot_ID_167642 3000 nt of promoter + ATG
acgaggaatgacgtgtgggatggagaagatcttgaaggagtgcctgaagaacctgatgaagatatcgagccatttgtgaggattgatgtggagacaattcatcatttcagtcatgaacattatctgaagctccaagaaaagaaaaccatttgcgagaaagacaagtattgtgttgcatgcacgattccaattataatctctcggagattttatggttgtatggagtgtgattttgtactcgacgaagcatgtgcttctcttcctcgcaaaaaatacctcccaatacataaacacccacttaccctccaccccttcccgattggtgggatctccaggttcgattttaatacagttgctgccaaagacatattcaaatgtaaagcttgctaccgattaagttgtggtttcgtgtacaaatgcggtgaggaatattgtgagtttcaaatagacgtcagatgcgcttcccttccagatcctttaattcatggctgtcatccacatgatctcttcttcaacttgacccatggttattgcattgggtgtagaccacgaaccgacttgaccaaggcacgtatgctcagctcacatgggccgggcctttgttcatcctatgcagtagaatgtattaagtgcgacgactcctttttgggtatgacatgtgctagttttccttgtgaggcctactacaagcacgataggcatctactcacactttgctacggtgacgaaaaagatacaacaagtggtcaatattggtgtgagatatgtgaatcagaattaaatgcagatgactggttttatacatgtgactcttgtatgatcactttacatatcgattgtttacttggaaaagatatgtacatgaagcccggccatatattcgaaataggtgatgatggtgatgaagttgaaattgttcacaatgatggtaactctcggctgatttgctctgaatgtaatcttcattgtgcacaggcttgggcattcaagatgatacgtggatacaaatggtattgcactcttaattgtatgggaaaaggtcttggccttggacgtctcaattgaaggtagccaagacattgtgatcagcgcatcttatgtgtttcagggctttcgtcgaatacacgtttcttagggtttaatcttttggtgttaaattttatttttgttttcttttttttcttttgtgttgatgaaaatgaaaatgataaaattctgttctcgttttggttttggagtctatcaagatcactttgctgttattatatctttaggtgttatataagtagagtccttatagagacgttgtcattcattcttgctttttccacaccacatactttactatagtccaagtcatggcggatgtgataaagttgtgggagacatttgtgagggagagtcggatagattctcgaaattaacgggagaagttaatgtaacgtataacagttctcaactatgtgataagtacacaaaaaattattcatattggttgactattatgatcatatatcaactaaattaaacagctgtaaatgtacacaaatagccacgaagtagtgaggctaatgcagggatcaagttttgtctactttaaaaaacaataataataatccgattgtttaatcatctatatatccaaatgaatcggtttcttatacaactgtttgtcttattaaaacaatcctcattagttagcagctctgattatggtttaatgcatgctattgataaaaaaaaatataaattcacctttttttttttgtagacatttttaaaaaattcaccttatgatggcttgagtttacatttttttttctttgtcgtacttgagtttacattttacaaattaaaattttcgttaatttcctctatggtcaagaagaaaaggtaaaaaaaaaaaagactaagatatttataaattttgcatcaaggaagtgctgtagaaaataagaattccttttgtggaaaaaaattgcaaactttttttaatctatatattgtcgtttttttttcttctttggctttctatatattttttgtttttttttttgtattccaacttaaaaagttgtttatcagttaggctaattctaatattggctagtttattgtataaacataaaaaggaaagttttggtctttgttttattttagtgttagtctttgtttttctttttttgaggcgttggtctttgtctttcgtctatatatgatttactaagaaaacaacatgttcttaattaactgcacagctggacctagattgtcacattctattaagaaagtaattagaaaaaaaaagaggagagttagtcttattaaccgctagttgattaattagatatagtagctaacaaatgcttgtggttcttctggcttaacaaaatttaataataaccaatcatttataattcttaaagttcctttaattatgtaggattcataatcgtgcttaggttatggctggctcgaagcctgaactagttttttattcactacagctggactaaggtcatcatctccattggtgagatatttcaaaagtttctaaaaaaaaaaaaatgatattttattatgatttagcttctgtccaattataaacacacatatacacatagtctctcaatcattactctaaagtttttctgcagaaaaactattctcaatctctcttctatctctcacctactttattattattttatattttttagttaatgagaaactatatgagagactactgatagagatgctaagagagatagatagagagagagaacaagagacttgaatagttgactttatacattggaactggtctttaactctgggcagatgttataaaaggacatatttgggagcagacagatgtatgagctaaaacctgatttttactatctgatttgcttcttctttcattccaaagaaacccgatatggaaccacaccctctttattttgtgccacctccttatttaactagaactaaacctcc

SEQ ID NO: 5231 - DNA, 3000 bp, Unknown
  misc_feature (1)..( 3000): cDNA_ID_1807133_gDNA_ID_1620774_Annot_ID_167639 3000 nt of promoter + ATG
agtactcatcgaagcttatcaccgtttcatgcagaatttgactttttgctatgggcaatagatgcatgatctctattagcaatacttctggtacttttgcttcagattgttcagacctaatttctatcattgacaaccaagacgattagccgacattcgcagcggaattggcttcctatcgatctttagtttgtttttttcttcttttcatattagatttcttcttcgtagttttactgttcgagatgattgtttagctaaaaaagctcgggatcgaaaaagtcttttctcccatgaaagcacatcggttcctgaatggctttctctagcggagagtttattaccgattacttaaataaaatagtgtttgtgggggggaaaaaaaattagtctcctacatttattgaaatttctttacttaattagatcgccaaatttatgaacttgtttaggtcaataatttcgatggtaaaaactaaaatcataagacaaaagaaactcaaacctttttatatgatttaacttatagaataacttgttacatatgatatgtttgtatgaaagaaagaaaagagaaccgagaaaaataagagaatgaaaagatgaaagaacagagaacaatttcaaagatatcttatatagtagagaagttaatggataacttggttttattaaaatgtcgaatgcaacatttctaatattctagttaggctgcctatgtgtttaacttcatgcctttcatgacatttcatctcagtacttggagtttactattcaagcttcgtttgcaaacgcacattcaaaacatcataagatttctcgaagatactacacagtagccatacataaaacaattcgttctacaaaccagatcgaataacatgtgtgaaatagattcatctgcagtacctttttaacgcggctagctatcaggaaacagagtgcttcacttgtatataaaaaaaagaggttcaagcagaaatacaaggcatcgtaaaacccgatatggtctaaaagatataactaagcaagtttgcatatgtcctcgtactcaatggacttgatgactcttccatcatagacacctttctcgatctgcactttagcacagaacttctctgtatccacacccaacaaccttgcattcgaaccacgatatgccccattcactatcttcaccatccctccaatttgtggaagcacagtctctagctccttttgatcaactctcaacacatgtttagaatcaagcattttgatctccccaacataattatcaatcactttcttcacaacacctttttgcttataataccctttctctgccaaagccttactcatcaccttcacaatgatcccttcgaacaaccagtaatctttccgattcatcctctccttcttcttctcttcctccttcatcaactcatccaaagctgatctcctctccttctcgctcctcccggagtccccacttctcttcctcttctcccctctctcaaccttgtcattctcttcatccccaaacaaaagtttcgagctttcccctctctctttacccgtagcaacctgtttaacacctccaccaagagcaaatccaaccttgaccccactcttcaacctcaagtcttcatctttcttcctctcatcatcaccatcatccacaacttcatcattaccactggtttcaccttcaccaccaccaccattcaatttctcagcagctctctcaatctgtctctgaatctccctctcttgcttctcctcctcagctaaatcactcttaactctcttattcttcaacctctccttaaacaaagtctcagaatctctatctatataagtaataaaccaacctttaggagtttcttcaaccttacacttaccagttttcccaagatgcttgataaactccgtcaacgtcgcccactccgtcgaattcatgtgaacatgatgtctatcgttaatatactcattgtagacaacagtggcagcgatacgagagaaacggtggctccgcctcatcagatcgagaaacgtctgctcgaattcttcagagtaaccatcgacaacacgagtcggattctgcccaaaaacttgcatctgcctctggtgagattcgctcatacaatgacacttgaatccattctcgtctcggcattgtttctgacacatctgacaataccatcgaagcttttgaagtcctttggctttaattcgattcgcaatcgcctttggggttagaaaatcgttcttacccatcgaatcttcttgggtttgtcgaacaaaattaaggtgttgggaattgaaatctagggtttctcaggtaacaaccactgatcgagaatgatgaagattcaatcggcgaagattagctaatatattgattgatgataaaccgaaactcataccaaatataattgtttatcctgaataccgaatacgacccatcaattaaagcccatacaatactgggcctataagaaaagaaatgtaaattgtggggaaaaaaaaaggtaaatttacaactttataatatatgcctcaaataattttaacagcttgtttggtcttatatcttgtgatctttgactttcagtctttcacaatggaaattattgaatcttgcatttttattgaattaatttcctatttgtaacagaatactattattagagatatattgattgagaatcgtaaaagataatgtagttgtgtgacaagtgagattcaagaaaagtcaactatatacaacgagagtagcaaaaaagaaataaattcaaatgatttggaaaattgaagaggggaccaattcttgggggtaaggagtagactcgtcgccagagctgactttgaaaacttgacttggtctcattcttctcatctactgcaaaaaccacaatcagtatataacaacaacacatgagtgacttaattctcatagaccaatacagagatacaaagcaatagaacaacaagaacaagaaaacagagaaaaaaaca

SEQ ID NO: 5232 - DNA, 3000 bp, Unknown
  misc_feature (1)..( 3000): cDNA_ID_1025895_gDNA_ID_1620774_Annot_ID_167635 3000 nt of promoter + ATG
tgtatggctactgtgtagtatcttcgagaaatcttatgatgttttgaatgtgcgtttgcaaacgaagcttgaatagtaaactccaagtactgagatgaaatgtcatgaaaggcatgaagttaaacacataggcagcctaactagaatattagaaatgttgcattcgacattttaataaaaccaagttatccattaacttctctactatataagatatctttgaaattgttctctgttctttcatcttttcattctcttatttttctcggttctcttttctttctttcatacaaacatatcatatgtaacaagttattctataagttaaatcatataaaaaggtttgagtttcttttgtcttatgattttagtttttaccatcgaaattattgacctaaacaagttcataaatttggcgatctaattaagtaaagaaatttcaataaatgtaggagactaattttttttcccccccacaaacactattttatttaagtaatcggtaataaactctccgctagagaaagccattcaggaaccgatgtgctttcatgggagaaaagactttttcgatcccgagcttttttagctaaacaatcatctcgaacagtaaaactacgaagaagaaatctaatatgaaaagaagaaaaaaacaaactaaagatcgataggaagccaattccgctgcgaatgtcggctaatcgtcttggttgtcaatgatagaaattaggtctgaacaatctgaagcaaaagtaccagaagtattgctaatagagatcatgcatctattgcccatagcaaaaagtcaaattctgcatgaaacggtgataagcttcgatgagtactcttgatgccaagatggaggagtaagtcttgtccaacaaggactcatccaacatgccaagtagcatcaagttgacattcagggagctgggttagcgggatttgagaagaacttaggggaggaattgagcgtatgggtgcatcttctgctagagttgcttgtttccaaacatctgcctcttgaagagccaaagttaaagtttcaacaagaggttttctaaagttctagaagcgatttctactttttcagatataccaaagtatccatggaaagagttccaacacttcttctccgattccaaattcccggccacgccaaaaaagaaatcgaaattatagaaaagggactttctaggaaaaatattctgtgaggtaggaatatgcgataatgctcaaatctgtctcgagggtggacaatgaaactggagatggttgatagtctcttctgtttaatctgcatcgggggcaacctttatatgtacccttgtgacgatatgtcaatctttgacaagtggctaaacaaccagagatacattgccacgcgaaatgcataagtttccgcgtagttttaagcttccatacttgtgcttgaagtgctgaaacacctggtccctgaaaaggggggtcacaagtaggacgagacatgtcacgtgcggcccaatatcctgacttaacagtacaattaccggatttagtataagaccagctataaccatcactcaagtagataccgtttggacgaatctctgaaatgaggtgaaatatcaacggggtcgatcaatgcttggagacggtctagtttccacaaattttgtgttttggtcgattaaacatttacatagagtaggggatctcttatgttaagaatgctcgtcgcggaccgcacaaggatggtgggaatccatggatcttctcatacacgggtcagcattcccgaacctatggtcctccgaagtcccgagacaagaagaggtttggcagctatgatgcttctccatccaacagacggacgatttgaggctcctatatgtaatggatcactatatcgaaagtatctccccctcaagaccctactcaagagagagtttggtacccagataagacgctaccgttatttagctaaaagagctagattaaattcttctagcgttctaaagtcaagatcgccctcaaagtgtggattacaaagcttatctcatacaatccagtggataccattactattttcattagttttttaccagaaatttgcaataacactattcaactttgagcaaatagccttaaaaaatagaatgcacaacataacatatgtcggaagggcttgtgctatagattttataagaacctctttaccttctttggacaagaatttggctgaccaagtattaagtcttgaaacttatctctcacaaataagaaaatttgggtttaaaataggaaaaaacttgggttttaggtaggagaaaacttgaccaagtatcgaccactgttctcataataaatgtaggagactgcaaacaacaaaaacagtggcaactaattaattgggcaggactaggaggcaaatccacaagtctttaaaaagcaattcctttaggtaggcactgaaaaagcaaacctttttttttttcttctttccggttggtccactgttatataaagcttggttggttcttgacttggttgtcaaaatcctaaatcccaaataaacaaacagagaaaaaagggagaaatatttaacaacagtaggagtctacaagtccacggcttgatcaatttgttcttcatctatttccttattctcagggaaatccagggtttttgaattcgtactctctctctcgttgtccctctcaaatcagaaaagtatctgccttttttaaaattcattccccttcgatctttgctttttcatcgctgattgttcttaaaaggaatctctactttttcaataagcattaacattgtccgtttcctcatctttggttcttcgattctcttaaagaggattttatacttgattctgttgaagccctttttctggggttttgtctgcgtttgtttccttcttctaatccagaattaaaactagctctctgcgctcaaagttttaagttttattcaaagaggtgtaagcaaattctccaattgatg

SEQ ID NO: 5233 - DNA, 3000 bp, Unknown
  misc_feature (1)..( 3000): cDNA_ID_2993779_gDNA_ID_1620774_Annot_ID_167632 3000 nt of promoter + ATG
catttggggtgctagcccatacattatatttgatgctcttatgcacatcatcttcactgtacgacttgatgataaagaacttagcatctttatactcaactggaaaatcgtctctgttgcactcttctctatctggaagaacgcatgttacagtctcctcagtatttgattcatcaaacgtctgctttttcacctcctctgagctaacctcttctgtggccttcgtgcccttggctctagggcccctgtttagttcattcaagccatcaatgttctcatttccatagaagtaactgttaccccttccccggcttctatatttgttgtctgtattgagccatcctctttcatttgttcttgaaccatatccagaagaaccataacccataccagacctcaccgtgctaccatactgaccatatgacttgtttggagacactctgtcgtagtaaccctgagctgcataacctgtcatggatgcaggctggtacatactctgccaagaatagaatgaggctatcagatacagggattcagatagagaagaagacttatcatacaaaactgacttccatatcataccgtgtaatgcgaattggagctagagttttgattcctagtcgcaggtacattgttgttagccttagaatatgaggatgcaactccactgccagaaacagacctctgcacatctgagaagttagagccatcgtgccatgacacaggagtgtaaaacccatcatagctatacctggggtcctgataaccagcagcaagaccacctccaagagcactgtttccatacagtgcactctgattcaatggtttaacaggagctgatccattcattcctttagggataccagcagatgcagagttggctgctttgtttgtagagagcttgctctgagtagaggcaggaacagacgaagcgaaaggcccactactggctgtgagaggaaaaggatactggtactgctgagcaccatacaactgtccatcaccaccaagttgtggagcagggcttgttgctggtgagtaaggaaaggcagcatacccgtatccctgcggataaacaagagatgcattctctccgtaagctccctggagtgattaccaaatgactaagtagggcaaaaggtaaaagagaggctaaatagtctggacacgagttgcttataagaaaatattaacgcacgtactgatgtcatatcaacactctcggaattggtataacctgtgtagtcactcccataacctgaaagattatacaaacggttgtgttatagatattacaataattctagacagtagaaggctgaagatatataaatgaaacttaattatcaccataatagtagggctgctgatacacattaggaacatagaaaacagaaggatccaaggcatcactgggtagcataggtgacaaagatcgatcaaaagaaggaacttgaccattcgaatccatagctccatactggtaaacacccgtctgcaaagataatgatgctatgagaactctgcttggagtaacaaaatgtgcagagacattaaaagatgtaactttaccttcttagtaggctcagggatctccaaagtcctagactttgaatctaaagacagtttcttcaatacatcagcagcttctgaaaaaacaatgtaagtgaaggaaacaaataggtttctatcttcagcaagactaaaaaattgatttttctaatcaatttattcactttgctagctacaggaacagtcaaattcatcgagctaaaacaaacagaacaaatggaaatgacatcatttcactatatgaatcgaattacgatgaagcaactagattcatgaacgtagatcacaaaagaaatgaaggagaaaagaaacaaaggcaaaggatacgatcagcaggaggagcaacagtagacatgagaacagagttggcagcgaagactgataatagatccttgtcggatattgaacaataagagtttgagacaaacacaaatatcagagcaaaaaagaactcagaaggaatctagggtttaagagattgaatcgtagccgcaagagaagagagaagaagaggaagaggcaaaagtggttttgttcgttcacctcgatttgattcaaatacctccaagatcccttttttatatttttctattatttttgtttacctttttctccatcgttttttttttaaaatacttcctttattccagccacattaatattatactagtcactacgaaatatctcacaaaataatactataaatattatttcctcgaaaatttcgcaattaatcgggaaaaaatcaatttttaaaataaatatcactgattccaattccattgttaggaattaaggagcaagaataaaggcccaaataggcccaatataaatctgatccaggatccgaagagttgaatccaacggccaagattaactcaaagcttgaaagaggtaagggaacgttaaaagcaccttccaagcgagagtaaggagataaacctacttcctttccttgcttcagctccccttttcttatccggaaaccaaaaacttccggtgataaaacctccttcgtcatctctctacttctgttagtttcttaatccttactcttggaatagtttatcctctgcattttttagtgccacagtttatgtgtgtatgttttgtttggataagaatttgttgtaagcttttgaaaacttgtattagttcattacttccatgattttgggtgttttgtaataaaatttatggattagtgtttcttcagattgtcaattgtgttcttattgagctctgctttcgaaggtgtcgcctttcttctggtttgttgtgaaaatttattactttagcttactgggttgttgtttctttctgttatattgattgtgttaaccgtatatagatgaaaagaagagtcttttttatatctttgaaatcttatctaagtgctgaattttgtctgtctttgaagtggataaa

SEQ ID NO: 5234 - DNA, 3000 bp, Unknown; identical to SEQ ID NO: 5228
  misc_feature (1)..( 3000): cDNA_ID_2992626_gDNA_ID_1620774_Annot_ID_167630 3000 nt of promoter + ATG

SEQ ID NO: 5235 - DNA, 3000 bp, Unknown; identical to SEQ ID NO: 5227
  misc_feature (1)..( 3000): cDNA_ID_1828057_gDNA_ID_1620774_Annot_ID_167629 3000 nt of promoter + ATG

SEQ ID NO: 5236 - DNA, 3000 bp, Unknown; identical to SEQ ID NO: 5225
  misc_feature (1)..( 3000): cDNA_ID_1828079_gDNA_ID_1620774_Annot_ID_167617 3000 nt of promoter + ATG

SEQ ID NO: 5237 - DNA, 3000 bp, Unknown; identical to SEQ ID NO: 5233
  misc_feature (1)..( 3000): cDNA_ID_2993779_gDNA_ID_1620774_Annot_ID_50245 3000 nt of promoter + ATG

SEQ ID NO: 5238 - DNA, 3000 bp, Unknown; identical to SEQ ID NO: 5231
  misc_feature (1)..( 3000): cDNA_ID_1807133_gDNA_ID_1620774_Annot_ID_50248 3000 nt of promoter + ATG

SEQ ID NO: 5239 - DNA, 3000 bp, Unknown
  misc_feature (1)..( 3000): cDNA_ID_1828046_gDNA_ID_1620774_Annot_ID_50249 3000 nt of promoter + ATG
tagttgtgtgacaagtgagattcaagaaaagtcaactatatacaacgagagtagcaaaaaagaaataaattcaaatgatttggaaaattgaagaggggaccaattcttgggggtaaggagtagactcgtcgccagagctgactttgaaaacttgacttggtctcattcttctcatctactgcaaaaaccacaatcagtatataacaacaacacatgagtgacttaattctcatagaccaatacagagatacaaagcaatagaacaacaagaacaagaaaacagagaaaaaaacaatggctgccttgtcggataagttagcggatgcttaccagaacgcaaggccgagatatccgatcgattggttcacgaaacttgctgctcgaaccggtcagcacaaatcagcttgggatgttggtactggcaacggtcaagcagctattggtgtaagcttcttccatcttgttccaaaagtttccactttcttatgtactctgcttcacttagatctctcaaacgatgtcgttttaatccctctagaagaacacaattatggatttattagctttagttgagaggagagaagaagatgaatggcttctttctaatgagtttatgatttaattagagcatagatttatctcaatcgatactattaacgtctaatgttagtgatgattatgaatgaagtaccaattattaacattttcacattttgagaacatgatttctcttgttttattttgagaaaataaaagttactaatctacctcatttataattattaaacaaaaaatttgtttggttcaaatttgtaatggtatttgtcattgtactattcacctaaaatgttaatcaacatttaccatggtttaatttaattgcagcttgcagagtatttcgagaaagttacagcaaccgacataaacgaagcacagttaaaacgagcggtaaaacacgaaagaatcagttaccatcacactcccacaacaatgtccgaagaccaaatggttgctctagtcggcggagataactccgttgatctaatcgtggcagcacaagccgttcactacttcgatctcgcaccattctacaacgtagcaaaacgtgttcttcgcaaagaaggaggattaatcgcagtttttgtctacaacgacataatcatctctcctgaagttgattccatcatgaaacgtcttgtggactccacgttcccgtttagaactcctgtaatgaatcttgctttcgacggttataaaacgttgccgtttccgtttgaaagtatagggatgggatcagaagggaagcctataatgcttgacattcctcataagctatcgcttaaagggtttatcggtttcttgagatcgtggcagcccgcaatgaaagctaaagaacgtggagttgagcttgtgactgaagatttgatctccaaatttgaagatgcttggggtgatgatgatgatgttaaagatattttctacaaagctcatatgattgttggaaaactttcggtaaataattcatttacttaattaatatctatatagttttggtataaatgaatcattcgttatttatatataatgcaggcttcagatatagagcggcatcgaaagagatttgatacgaactgcgtagttacaacactaaaggatcataacaactcggctgttattgcttcaggtttgttttctgaaatcttttcattgtttttatctccaatttaaacaatgtcaatcgaattaaccaaattgggttgtgttgtgttgttaaattatagtgactgctgctgcatttgctggagtggcggcttactgtgcttactctgcaaggaagaacagttagatcctttgaaggacaaagaaacggttttctgaatctagtgaatgaaatcttttttattttacatgttgacatgttgtcatgtatttatttatgtcattgatatgagatggttaagtaatatctaaagatttaagagtcacccaacactcttacattcatgactcaaggggataaaataaaagtacaagcatccacataataaagaaaatagattctcacaagtgttcttttgtttttcgctgagtacgcgcataaatagatgctcacacgttcttgggttttaagaaattatatattaagcccaacttgtacggctcaaaactctgtaatatagtcaaggacatgatcaatttcttataattagcatatgggcaacttacatctgggccatttgttgatacgtttcgcctaataccaaaacaactctaaactcaaattaaaagtcaaacctatgattagaatttagaagccttttgaaatttgatctaacgagtgaccaaaatttttagtgcttctaaattaaatctaggatttatgttacagagacttgattattggaggtaagttcaacggagatctccaaacattggtaaaattgtttgtcgtggtctcgtatattagggaatatagtaccttttatgaatggcatagatttttgtattgcgccattttatggaatatacgtacttttaaaatatactagatgagtacccgcactacgtgcgggtttatgtattactatttacaaattattttatataatgtctgttcatataaaataaagttgaatgcatcggttttaaaacataaatatgatttgtaattgtttttgaaaagtccaactatattagttcatctgaaaaacgaatgtgcttgagttgttttttattgttatcctagattctcagtttttttttaaaatttatatatccctatttttttgttatatgtttagattgtgagacggtgaaattttagaaaatatatttcttaaactaaaaatataacatgactttattaaccatgtctctgtatcttcaatctaatcatgtaggtgaattttaaaaaattattacaaatttgagttaaatagataacaaaatgtgaagttggaaagattggcgagtaagattccgaaaaagaagacgaagggg

SEQ ID NO: 5240 - DNA, 3000 bp, Unknown
  misc_feature (1)..( 3000): cDNA_ID_1829979_gDNA_ID_1620775_Annot_ID_50254 3000 nt of promoter + ATG
atatttgcaagaccattataactacttaactgacagtgtttgaaattggaaataacttttttttttcttttaaaaaacaaaattggaaataacaaaattggagaaggaaatattaaaccatataatatttgctatgtacaaatattatttataaaatattttatgtttttattatctcaatgatggtgaacatatgtcagatttttacattctgtcatatataattgtttttacaaaaccataggttaaaaaaaaccaatttttttcaacttcatgcttcttaggttaggctattaggttcttccttcaaaaatatttgcgggaagttgctctcaaatataggattgaagcatttttcatattcatgagtggatgaatccaaaaggtttcgagcctctagaggttttctgcatgttttcgttgggttgtcccatccgatgttcccattggtttattatactgtttttcttaaagttttgttaaattttattatgttctctccttgatttcttatattattagtgtaagtatcttccatatttagtatcgaggaatatattatctattttttttttggaaaaatttaaactgttttgtagatgaatatatcaaactatgttaaattttatgtattttccatatatgctaaaaaaaaattctcgtgcaaactgaattttatttaagaatttaagtctttacaaaaaaaggttttttagccacattagctgattttctgaatttgcttgaaactacgtgaacattgaagaagctacgtgatgtgctacactattacaattacggtttgtgaatataaagataattgattcaaattttgaaacccaaaaatctatatttagaagtaaactggcaatgttcgaacagaatagtcatgccgttgaccgctataaaaaaattttaaacagaatataattacatgtatattaagaagttcaaaaagaagctatttgattcatcttttttttaatatatttttaaaccaaaatattgatagaacaatagggaaaagctcgagtttaaatatgacctcgtgaatttgttttttgttgtgtttttgaattattgttaaattatattcaaaaaaagaaaaaaatgttttacagcttaatgaatacgatttcaaaaacaaattctaacaacacaattggaacttaagctcgtcttgtagcaaaccaaacttgaagatcctcttcatacttatggattcccctataccccgaattgtacttaaacgatttctcacatttttgtcgatcatcttgatctggtggttatggttgttcaccgtgtcttcttgcattcctctctctccaaattgagtgtaccgtattttgaaagatatataggagaatgtaaacttttgttttctcatgtacattatgttaaacttaaatatatattccatttatttttagtataaagtttttcaacaaaatcttgatgtaacaacatgagtactttagaatagatgaaaataaaactagcttataaaatacaaaatgtaaaaataatctaaaaatgatgtaaaacacaaaatataaaatacaaaacgtaaaaatgagacatcaatatattgttctgtgaactttatatatagattagttacaaataatctattgtaaatattttaagatagacaataaattaatactttttagtaaaacatacaactagttaataatctaacgaccaatataaatcaactgccaaaacaaaatatatgaaattatattttctcaaaagttaattggttgtcttaaaatgaagatgttgactctgagtctatgatattagtcaaaatgcattttaacttttatgtacattccttgtatactaaaatgtctaaaaacacggtattgaatttcatttattccgtattataaaaaattacaaaaaagcccttcaaaatatatggaaacaaaattgtaaaataactgtaaaaagtaaaattatggttttgagataccaatatatttttgtatgaaattttatccaaacaataaataaatattgtatttatttgttttaaaattatatatgatggaaaatgaatcaatatttgttgaaagttggcaaatggtagaaacctaacggctaagagaatacgacgacgcaaatgaactgttttgactaattttaggaaaaagataaaacggttctctttaacaaatttgtcgcgtttgaatacgacatcgttaaaaactatgttaaacattatatatatatactaaaaagttcaaaaaactataaaattttagttttctcatcctttttatctttaaattatcaatgatttgttgttgatagaccaataatagctcacactaaagtaatttaaattttgaacacacttaacctattatctgcacctaaactattttattctataagtagaatgctcgttccaacacctcatattgttcaaaatgctcgttcatttttagatcgtaattgtctaattattaatttataaaaattgacagctttccttttaaaaacaaaacaatacaggtttgactacaaatacacattttcgaacagatagatagagagagaaaaagaaacacaataaaacgcgcgtaaaaaggaaggctaatttagtctttttcgtcgtaactcccataacgagacaaaacaatcttaagtgttccctctcatcgtaaaagcttttctccttccttctatgtacagctgtaatggcaatatcgtaaataactcgtaacagaaagggcaattattgtcaacatttataatttaatttctcccaacttctcaaattccaccatttttcttcatcctctcctccataattgattttccttttttttgtttttccttcttgcaactaaaataaataaatttttagaaaccaaaaaaaaaattgtagagagagaaaaaaaaaactcagaggagagaaagagaagacgacgaagacgaccattttttttttttttgtcaagagagaagacggagacaacaatg

SEQ ID NO: 5241 - DNA, 3000 bp, Unknown
  misc_feature (1)..( 3000): cDNA_ID_1828151_gDNA_ID_1620775_Annot_ID_50256 3000 nt of promoter + ATG
gcagggaaatctaacgtctttacagttgtgaatcctccatctaccaccagattatgcccatttacatactttgaatcatcggaagcgagatacaccgctgcattagctacatcggttggttcacaaacctctccatttaacactcctgtactctgcactatctggatcagccttgagtcatcaacaccggggtaaatctgtcgcatctcatccatcacgaatgatgttgtgatcgcaaaaggagaaatgcagttgacccggatcctgtgcttgcatagttctgaagctgttgatcttacaattccgataacagcggattttgagacgctgtaagtatgttgggctaaaccgcccatcatccccgtgacactccctgcacaaatgatggatccagagttacgcgggatcatcacacgagcagcatgtttgattcctgccatgactccacggacatttgtgttgattacctgcagaacataagaaaaataagatcagataaaaccaaatgctccacacatttgttctttcacatgttcttatggatcattaccttgtcgaaaacattgagatcaagatcaacgatactaggaggcgttttgcagggaataccagcattgttgtacataatgtcgagctttgtatggagcgagacagcgaagtcaactgcgttagcaatgtctgattctttggtcacatcgcatgggaagtaagcacaactgggaccgagttcttgctcggtttctcgcccaatctgcggttggatatcggcaatgataactttggctccatgactgatgaattttccggctgttgctttgccaatcccacttgctcctccagtgatgagtgctactttaccttctagcttcctataacataacaactatagattaggtattagtatttggtaagactctcatatttgacatttcttagctggtggaaagagtaaaagctttctaacttcaagataagatttgtggaagaagacaaatcagagaaaccaacttgtaatagcaaattactttgtatatccctgtcattcacatataaacagaatacatatggcctttatcccaacttacaatgaatatttttattcagattttgagattaagatggtacttgccttgaagttgaatgagatgatgaggatgaggatattcccttgataaggaagttcttgctcacattcttgaataatgcgttttttctatttcatacatagaaaagaaaagttagaacaaaagagaggtcattgttaaatctgcagaaatggatcagaagtatatatagagaaggagcttgacccaatctgaaacatgtttgtgctagctatattgctccgagatatatatatagatcggtctttgtcgtttcctaacttataatttctcgtctttgaagagaatggtccctgtgtttgcgtcttatatagatatagagggaacataaaggtgtggtctttagagagggagagagaatctaatggggcggtgattgaacctgaagcatactagcatgcaagtgtttgtaaaaaaggcttgatccctttatcttttgctaatgaagacaaaaaaaggaacataaaagttcataagcatgtgttgatttcttcccaaaacaagattgtataatagccatataggctgaggttattgttgaactacatattttaattaatatattttttcttttggggtcataaatcattaatataaatctaaaatatgttatatcatggtattttattgcaatattaatatcattgaaaatttgaaatcaaagaaaggcctttcttttgttaaaagaagaaaaccttttaaaaaacctctattgcttgtggcatgcatgtgtgggtgtgcttattatgagctgtctactaatgaataatatttacgttttcaattcttatgttatacaacgtacctaccaataccatcttcataacccgacagaaagctaacaattaacattatgatatatattattcagtagacaaatgatatattatacagaaacattgcatacgaccaatttgatatctaatggtgttgattccaccaactaagatctatccttttgttggcatattaactttttatacaacatattacatattttcaaattggattagattatgacacgcatcaaatctagccaagaaaataaaacaaagattttcaacttagaatttcaaaatccaaagtaatgaaatgtgttcttagaacaagtgactcatatatcaacaattacaaaggtacacaatcctaataccatgtgttgctggtaaatctaaattaattaatatcgtaaagtaatgttataaaattacagttaaatattttaagtaagcaagttcacattcatgggatggaaaagaaaaccaaagtgttaccaatctttgacatgtcgataaattgtaacattcttaaatgttcatttgaccaaattctcaaagattcttcaccaaatcgcacacaaagagtagaaaaatagcaaagcatttatgaggtgtcgaataagtagtttggtttccttctagaagacataatatataatctttttttttcctgcaacataggtgaagaagattaaagggataagaacatagtggaaatactgagaagaaaatgaggtaagaattttcaagtcccaaaaaacaaaagataatagaggggcattccgagaattgaactcgggacctctcgcaccctaagcgagaatcataccactagaccaaatgccctatttgatgtatcgtttgacataattaaatatatatagtaactaaaatatcgtttcacggaactgagcttttcaaaaccattcgacacagctctgtactcgtctctctcccgccaatcacctcgactaaagcaccaatggaacctctagggtttcttctctgattccaaccgtatacgaatcgggagcttctagcgattccatttcttcttggacagcattgaaattcgagtttcgatggtcaatcttatg

SEQ ID NO: 5242 - DNA, 3000 bp, Unknown
  misc_feature (1)..( 3000): cDNA_ID_1828147_gDNA_ID_1620775_Annot_ID_50257 3000 nt of promoter + ATG
atatacttacactgttaaaattgataaaaaggaggctagaactataaccttcttctgctgcttgactgtttcatcatccagattctggctgaataagactcgaacatgtgccaagtttcttcgtttccttaagtctttccacacgaagtcacctattttaccaggtcctccaaggctcgtagtaagctccttctgaaggaataacctggggaaatctttattgcaagggctttcatgacttccgtcatatattttccttggagaagcatgatatgcaacattcaagtcaatgactcctgattggcaagaagaggcttgtcttgtcccacttaacgatcctcgtaagctgcttgacaaagtgttggtttcacttctgtctttaactaaactagcaccccaagatctcctaggtgggacgtgatgtctttgcataagacgtgatcttttggctctgggatgcctccattcacataagttgagaagacatgttttaacagagacgttagctctggttctctcttcattggtgaattttctcttcttcttagagtttctttccctgtgtggagcagcactaaacagaccattcaatttgtctctttcaggttcaccctcaatggtatcattgttccttctagaaagattactaacttgatccctcatttctgatacactcccaggaattgggtctgattcacaagcttcttctgtagtacagggagcatacactaaagcactcattgcttcagcagcaatttgagtgttaataccaatgtcaataaagtcttcctcgggttccaagggctcctttggcgccttatcctccaactgagcatccttctgtgagataaacataatgccctcactcaaacccgatgcttgttccatcttgagatgctttgcagaactgttcttcataactctttgtgtgggatgacttgagacttttctaatatcacacggatccctagatcgtttcttcactccaaaatcatcacctgcaacctgatcttctcttatcttggagcatgtaatacttgcacgagtgactggagaggttttagggtcactcacatcacactgatcactactccaatcaaagacactcattttcctggttggacttctgctcataattcttttggccagagattgacatccttttgcacctgatacaggagatgacttccttctgcaactattaaccgggagatcaactggagacaaatttagatctttgtccatcaaaaagtggtcaacaaaaccaagggcatctgcttgtgttgactctcctggttcttgagaatccaaaaaatcaagccctggaccatggctactagcagtaatccgcaatgaaccttggaaaccggtcactgtatcacaatttgattcttgcttgccttgaagaaagagatgtagtaagatttatctgagttaatacaaagaagaagatagaggcaacataacaacacaaggatatgtttacctgtttgacattcgtgatcatttgatccatcagactccaaaagtatatctccagctttcgggcttagctccggcaaacacatcggctcaccagcagcgacacttccatcttcatcatcactatcatccaccaccacttggtcgagaccgtaacattcctggttcagtgattcctcgtcaccacaatttccgttatctactagctccgtatcgtcgtagagcacttgaaatggggtttcaagtaacgagctattaagtactaatgcttcatcaatcgcctctgtatcttcaatttccccacatcccaaaatccgattaacctcaaaccctaagagaatccagaaatgaaattggtactacgaatctatcacctcaaaaatctacaattatcagcaagaaaaagaaaatgtaaatgaatcgtaatctcaaaactcactatgatccgaagaagctgaaggagactgcaaatcggaggcgaaatcttcggtttccataagattgaccatcgaaactcgaatttcaatgctgtccaagaagaaatggaatcgctagaagctcccgattcgtatacggttggaatcagagaagaaaccctagaggttccattggtgctttagtcgaggtgattggcgggagagagacgagtacagagctgtgtcgaatggttttgaaaagctcagttccgtgaaacgatattttagttactatatatatttaattatgtcaaacgatacatcaaatagggcatttggtctagtggtatgattctcgcttagggtgcgagaggtcccgagttcaattctcggaatgcccctctattatcttttgttttttgggacttgaaaattcttacctcattttcttctcagtatttccactatgttcttatccctttaatcttcttcacctatgttgcaggaaaaaaaaagattatatattatgtcttctagaaggaaaccaaactacttattcgacacctcataaatgctttgctatttttctactctttgtgtgcgatttggtgaagaatctttgagaatttggtcaaatgaacatttaagaatgttacaatttatcgacatgtcaaagattggtaacactttggttttcttttccatcccatgaatgtgaacttgcttacttaaaatatttaactgtaattttataacattactttacgatattaattaatttagatttaccagcaacacatggtattaggattgtgtacctttgtaattgttgatatatgagtcacttgttctaagaacacatttcattactttggattttgaaattctaagttgaaaatctttgttttattttcttggctagatttgatgcgtgtcataatctaatccaatttgaaaatatgtaatatgttgtataaaaagttaatatgccaacaaaaggatagatcttagttggtggaatcaacaccattagatatcaaattggtcgtatgcaatgtttctgtataatatatcatttgtctactgaataatatatatcata

SEQ ID NO: 5243 - DNA, 3000 bp, Unknown
  misc_feature (1)..( 3000): cDNA_ID_1828143_gDNA_ID_1620775_Annot_ID_50258 3000 nt of promoter + ATG
gtcctaaggtgaaaagtgactgtaaatctgtttatgaaactgatcaagacaaaagaatatcatttcttctaattgaattcacagcaggtgaaatcataagtcacaggagaacaaaggttcaagaggctgttgttttcagttttgcagaagaaacacaagtagtaaacaggatgagaaagctgtttgcagaagatggttttcaacaagccattgttgaagtttattgtgattctaagagtgagtctactctggtcaagatcatagtatgcttaagaagattaaagggggttgataccagcaggcaagtcataggagaaatgattgcagagttggtattcaaggttgttaggagtgaaaaagcttatcaagctgagaatatcactaaagtgacaacagggagaatgcttcaagcagataaggagcttttcaaagtatcacaatcctgagaagatctcagggaccaagatggaactcaaggaatctagaaaggtgaagtaaaggattcgacactacggcaaggtggagttttgtgaggttttgcctaaagtgtctaagagtatctaacccaagtagaaggtttcagccaaaaggaacaaaatcatgtctttatttaatttccagatgtaactcttctgaagaaagtggtgtcatggatcttcggctgttgattctaaggcactcttaatgtttgtttatatgtccataaatgttagtgagatcatattcttataaatgttattgcttccatcattttgtaggatggtttggtttttgatgatgatgatgatgatcaagaatttgacattatcaaggattttggttgttgataacaatgatgatgtttgtttggtattgaatctctggttgaatcataatgcagaggtttagaaaaactctcaagtggaaggtgttaactagggtctatgtaatgtggaagtcttatgttatctttgtttcccttttatgagtcatgagtaaatacagttttccttctaccaattctcatattatccgtctttctcctaaacagcaggatgtattggatagacaaactaaagagaaaaaattaacaacaaaactcaatccaaaatgtttagaaattttcaagaataatgaaccaagatgttttgagactcaaaaccaaagttaattacttgccgtaacacgaatcgtgttaaatatggatcatgaaattttctaaacttagattggtggacttacataatctgtttcttagattgcctgagttctaagctttaagtagtttccggaaagcctgtgactctgtgagtacaattccgtttatagtgctatttttatttgtttacaaaactatataatcgatttcatgtttgtaaaacctgaaaactccctttattaatataaagaaaatgagatgctcctagtctaagaactaatctaagaaacaaccaataatgatgttcttaaagagatacaaaagaaaaggaaaaaccctgaaaacactcacatgcacatgaaagtatgaaatgaaaccctattatggattcttgaagacttcctgcaagatccttttactcagcgtaccctttacaggaaacctagtggaatcaatagcgaagcaaatctcccgagtctttttgtgcctaaacatccaaatagtgagaaaatcaacatgtttctcgagcttataactcttcacgaaattcttccatcccgacgtcaaaacaggtgtgcccttaatccatatcttcaacaccatcttatgattctctccgtttggtccatacaccgaaacattaagccctttagtcccaagtttctctgtttttcccagagcatccatcatctttttcaccggctccttccctaacatgagcctgtattggttgtccttcacgtcgctatccatcaactgctttcacattggtttgctgcaagctcccatagcatctggatcacggacaatacttctcggaggattacttttcggcctagtgtctcccaaccgcgcatgcactctagggtttcttcggaattgtctacctcagcgacttttctcttcttacccttattttcatttgtttgcatacacgattttacttccaaatcatcctcacatacggattcttcatcatattcttcttcttcgtcttcttcttcttcttcttgatcaaagaaaacagggtttggtagtcgtaacaatactgacacagcctcaagttcgtctggagttacatcatccatctcctcaatctcttgttcgttagatcatgtacataggtgatatttatagaatatcacaagtccaaaaattatttttatattgataaaataattagaatgaccttgatcaatatcagtccagtgatgtttttgatataagtatcatctgacgtgacatcctcagattggtcgcatttgcgaaaagaaagaaaaatatatatatatatatatatattaaacaaacattataaataatattaaaattttcttaatgacttttatgaatatcacctatgaaagaagaaactgtttattttccttgatatagtttagtttttccattcttcaaacggttgcatagtttagttttttcattttatttttttcatcaatagtttagtttttccatgtatatctcaattatgaattaattcaatatatagtccaagtactaagactatgtccatcagtgtttctaatgggcttcttatctgaaatcctaaagaataaaagcccaaaattaaagaaaaacccaacaaaattattaggatcgatcctaattttaggttttttagaagtgtttagaaactcaaacgtggttgcttctaaggatgaaaatttaggcaaaacaaaaaaaaatcatgctccgcgtgtttttctttcctcttctcctatctcttttctttggttactctaacgacgaaatcaggcgatttgaatcgatttgataagaaactatggtgtatcgatcatgaaattgggagacagtctctttgctccaatctctttctcatg

SEQ ID NO: 5244 - DNA, 3000 bp, Unknown
  misc_feature (1)..( 3000): cDNA_ID_3076311_gDNA_ID_1620775_Annot_ID_167680 3000 nt of promoter + ATG
gtgaaccttgtattggtatacaaagatgtgaagagaggaggcacagaggcattgtgaacagtaacagtctctgtgaaattggaaagaaagtaagaaatcgcataaggcatctcgtcggatcctatgaatttacccgaaattccggatttccagtatctcattgatcttttccaaatgatgaactgtttgtcttcttcttgatccatctgaaaggtgaaatttccatgtgatggatcgttgaagcttctccatgatgataaagtcatattctcatccatcctcatccctgggagaaatgtatcagtaggattctgaaaactctgccaaaccacatttgcttcatttccatcactaatcaacacaagattaccattatccatcagctttaccattctctccgcagatactgaggaaggtttaacaccggtgtcccaatacactcttccctttgaatcaataacttcaagattcccatctttagagatggtgaaaatgcaggaacggtcaagaaccggagattcacgatttgcaacccagacaacagtcagtggatgtaaattgtaaaaccaaatccctaagtaccttctttcgtcggagcttccattaggagtgaagaagccaagctcaaatctctgaccagctgaaacaagagtctctccatggctgtcattgatcaatgttgaacctttgaacaatgttttggagtcttgaactgcaacaaaacaatctaatcgacgaatatgcagcaaaaacatatagaagaagacagaaagaatcattctctgaccagtactagcttttttttactcatctgatatctccattatttctgcttaagaactcaactcaaaacgtgtctaacgaaaaaagaaaaagtttgcctcaacgtcaacgaaagacccacctgaaaagtaaatatgtggaacgcagctaatcatgtgttttaagatgtttccaagaaaaagcagaacaagtctcacttgagcatctgaaccaaaagccatgaaagtagtagatactatttacactctcttagccactgtatgtagatacacatgtgaccaattcacgcactttgtgtcaactttttccgcgatggatctctaaatagttcaaaaagatccaacattttttgaataatacgtacttttagagtattttttgacaatgagagagacataggggtacctaaacgtgaattactggaaaaaggggacaatgatgttgaagaagtcaatcttttgtccttattggtgctttcgaagaagtggagattgaccctgcaaacattgttaaccaacttttttccgaaattattgtgagattcgaggagttttgacaaatgtaggacttttgtcgttcaaaagaaatgttttcatctaaaacgcgtaaacctgtaaaaggcagcttcagctctgattaaacaaagagacttgcaacaatgtcactatgagacattactgtttaaaaatagattcagaaacactaatcagttttcacactaaaacaactttgtcttctgccttgtttgtttattcctctggatgtttcatagatatacctttaacagggtatagcagtttcaagttcatagatgaaaccctttcgctcacaaatattgttttaaagccttctttatgagagttggattggttcaccacatagattctctaactcctcttccaggagtttatgcaactttgcttcagttcgccgatatatccacgcattagcatcacggtcccagtcaaatctagaagggccactgcaccgagacaaaaggaagaatgaagattacattaatgtgaatctaagatgtggaagcacaaagtcaagagcaacaacactatacagtcataaacagtttcatttctccaaatatcatgagtacaaaaatcagaagagagagcagaacatgataatccagatgcgaaattcaatctaggcgcctaaagttagcaactttcaaaaggcaagaaagaatctttacctcacaggtgaagacatccagatttgtcgatttggagtttgcttattcagtacataagtgcctaaagatccaagcttaagggtaagaacttcattctgttggaaacagccaaaaggactgactataataagtacacatagatttccagaaatatgaacaagatcttaaattgcttaaaagagtttaatccttaccccataatctatgtcgaaaccatcaatctgaacattatcaccataatcctgaacatgaatcatgcaagtagaacatagtgtaagctattgcaatctcaagtaaaacgaagaaccctagagagaaaaaggttccagcttcaaatacctcaattttctcaagaaggtgattaattgtgaagttggctaatttgtgaaactcttcctcctgcaaaaccgaactgtttttttcttccactttgttcatattctcatgaaattaacgattcagatacaataaaggagatcaaaatggagaatattaaagtacctgtaatcgacagaagcaggaccttgagaagagaagcttctggtagtcaaagaatcatggcggattcgagatcctattctccagaaggaatccaacggttctatggaatcttgaatcagattgcttgaaactcttacgccattgctacggagaagagttggagacagcttgagaaacctcggcaatttccgtagaagaaaccttgaagctgtagccatggcggttctgtcacaagaaacattcgacgcctctcttcttcttattccttcgttgtccaatttaggcccacaataaggcccaaatttagatttacccggttcacgtatttcccatgttccggtttactgaaaccggtatggttctcaagagatttgtcatttgtgtgcgaagaagagttttcttctcctctcataagaaaaaaccagaattttgaagaaggagaaagaaaaaaatctgggtttttgggagctgattaggttttgttccttcaatctctgggaattttcgct

SEQ ID NO: 5245 - DNA, 3000 bp, Unknown
  misc_feature (1)..( 3000): cDNA_ID_1387356_gDNA_ID_1620775_Annot_ID_167676 3000 nt of promoter + ATG
acggcgatcaaactcaatcttcttcttattcggttagggctcgtttcgagaaaatgataagaactgctcaagataaagtctgtgaagccattgaagcagtcgaagaaggtcctaaattcaaggaagatgtttggtctcgacccggtggaggtggtggaatcagtcgtattttgcaagacggaaatgtatgggagaaagctggagttaatgtctctgtgatttatggtgttatgcctcctgaagcttatagagctgctaaagctgccacgtctgagcaaaaacctggtccgattccgttctttgccgctggaaccagctcggtgagttctctctctctctctctatcagtcgacattgctgttgatatggtctctgagttctttgattgagcttgatcctacattctaggttttgcatcctcagaacccttttgctccgactctgcatttcaattaccgctatttcgagaccgatgctccaaagggtaagaccttaatcctctttgagaagtgtaaagttccaattttttggttggatgaagcatttgatttcatcacttgtagatgttcctggagctccgaggcaatggtggttcggtggtgggactgacttcacacctgcttacatctttgaagaagacgtcaagcactttcattcggtcgttaaacctgatccattgttctgaaagtttgaagctttgtgattatggagatgctgattgaaatatctttctttgtgtaggtttaaaagcaagcctgcgataaatttgatccgtcgttctacccttggtttaagaaatggtgtgatgactacttttacattaaggtctgcagttcctttaacgctattctgattgtttggtgagatcttagcactttgtggaactaaaagaccttagttttagagtcatgtatgtgcaagaatagatttagagcctcaaggttttgtttaggttgatacagtgataagttgtcgcctaggatttgaaaacactaaaaactttacggtcttgcctgcagcaccgtgatgagaggcgagggcttggagggatattttttgatgatttgaatgactatgatcaagagatgcttctgtcattcgccactggtagtgaccaagatataacttgtgacattttgttttaagaaacttcctagttgacttatttgaatactgagatgaattttgcagaatgtgcaagctcagtgataccagcttctatacccatagtagagaaacgtaaagacacaccatttaacgagcaacacaaggcatggcaacagctgcgaaggggcagatatgttgaattcaacttcgtaattggatactactagctttgtttttctttctgtataaatatctcttgaaacctcgtctcatgttttgttgctgatggtaaaaataaaggtgtatgaccgcggaacaacatttggtctgaagactggaggacgaatagagagtatccttgtctctcttccgctatctgcgagatgagaatatgaccatgtaaagtttcttgattcaagaaactaaatcttgtttcatcttagctaatgaaacttaactactgatggtgtttgtctcttgttgcggatgcagaaacctgaagaaggaactgaggaatggaaactattagatgcttgtatcaatccaaaagagtggctttagttaattaattgtggttatttccccaattagctcttttattagttttgtctttaaaagccttaaaagagtaaagagtctaatgaaaagtgagtgagataaagaaattgtaatttggcgtcatctcatcatgagtcactgacaaacaaagatcatgatggttgatgatggagtatatagtaccaatcgtgatgatgatgataaaagtaattaacttttaattttttttactgacacagtaaaaataagagccgttggctcaaatagccgagcctctcggtgcacgcacgcatgccacttgctcggtaactgttcactagacagaacacaacaacactcaaatagagtgataacattgaatctgatgatttggtttagtataaaaatcgtttccaagtttcaacgagtgggacttgtgttaggttaaacaatttcggattaagtaaacgtcactgtctcatttgtcttgatacaagaaacgcccgtgatattttttcttcgatgtcgtccaatggggacaaagaaacaatttagtccccggatatacacacacacacacaaataatacatgggtgttgttattatggcttaccttacacaacacaacttgccaatgtttttaaatttactaaaaaccaaagccagaagatattttattgccacaaattgacgtcacacctgcccatatctaatccatgtctgcaacacaaaaaacaaaaaattgaattcccccaaaaagtgaggagagagatgtaaagactgtgtaccaattcaatatctttttgagcagagtaaaaaaaaaagtttaaaaatttgagcttctgacacaaaaggagccaaatgtaatagctggatccaatccaatgcaatgaaaacatcttagctgtaaaatggtccaatctctctcttttctttctacattattacttccacagaatcaatttatctctcgaaaagcaataaagtctctatatttgtgctcaaagatagacagagaagcataaatacttgtcctctgtgtagtacaaaagtggagccccactgagtgatgccctcacagtaacggctacatttttcttttatctctctgtctctctcttcttttgagtgattttttatgaagatgggttcttttgtccacttattactgtcctgaatcacacgtcgaatcctacgtggcatctctctccattgtatgccagctcactctcactcactcactcacctcccgcctttataaagccttacctctctctcttgtctccttcattgagtcaagtgctcgagactgtagagtgaagtttgatttatttagagagataagttaaaaaaaaa

SEQ ID NO: 5246 - DNA, 3000 bp, Unknown
  misc_feature (1)..( 3000): cDNA_ID_2053079_gDNA_ID_1620775_Annot_ID_167675 3000 nt of promoter + ATG
tttaggtttatatgtcgttcgtccaggctctgtatggtggaggagggtggccactgtcggtattcctttcacctgatttaaagccgttgatgggtggaacctactttcctccaaatgacaattatggacgaccaggattcaaaactctccttaagtaagtaaaccctttttctcttattgtacaaaagcattctaggcttgtaatggtgcaataaaaaatagagtatgtatgtagaaacaaacgctcttggcgaagactatagttgattcgtttatgttctccatgttttctttgggtttggttcaggaaggtgaaagatgcgtggaacagtaagagggatactctagtgaagagtggtacatatgctatcgaagaactctctaaagctttatctgcaagtactggagccgataaattgtcagatgggatttctcgggaggctgtgagtacatgtgcaaaacaagtatgattcgactcgcggactctagaaaaatatatatgattgatacatcaacatgaaaaggtcttctaacagtgagtgtttgtgttaaagctttctcggagctatgattcggaattcggtgggtttggatctgcaccaaagttcccgaggcctgtcgagatccagctgatgctttatcattacaaaaagttgaaggaatcggggaaaactagtgaggctgatgaagagaaaagtatggttttattcagcttgcaaggcatggcaaatggagggatgcatgatcacattggaggcgggtttcatagatacagtgtcgatgaatgttggcatggtaaaacttcaaacagtatcctgtagtatcaaggtgatgaaaaatattttgagattgacgcattttttgctatttgtctggtgcagttccacattttgagaaaatgctgtatgatcaagggcaactagctaatgtgtacctcgacggttttagcattaccaaggacgttatgtattcttatgtggcaagagacatccttgattatcttagaagagacatgattgcacctgaaggtggaatattctcagctgaagatgccgatagctttgagttcgagggggcaaagagaaagaaagaaggagctttctatatatggacaagcgatgaggttcttttctctgatatatgatatattcatgagctgactctggtttccctctgcatactgacatttgttttgcgtgtgtgtttggtttcaagattgatgaagtcctcggggagaatgctgatcttttcaaggagcattattatgttaagaaatcaggtaactgcgatctttcgagcaggagtgacccgcacaatgaatttgctgggaagaacgtgctgatcgaaagaaatgagacgtctgctatggcatcaaagtttagcctctctgttgagaagtatcaggagatattaggtgaatgccgaagaaagcttttcgatgtcagattgaagcgacctaagccgcatctagatgataaggtaatactcttcttggaattctcatgttgtcttctctactgtttcttcagatttgttaaccatttaagatttctttcatagataatcgtgtcttggaacggtcttgttatctcgtctttcgcaagagcttccaagattcttaaggctgagcctgaaagcaccaaatattatttccctgtggtgaatagtcaggtaatgaatgctacaccctttcctttaatttcttctttgaccgttttgtaattagaagactcatttttcagccagaggattacatagaggttgcagagaaagcagctttgtttatcagaggaaatctctatgatgagcagtctcgcagattacaacacagttacagacaggggccatccaaagctcctgccttcttagacgattatgctttcttgatctctggtttactcgatctttacgagaatggaggtgggatcgaatggcttaagtgggcgattaaacttcaagaaacacaggcaagtgagatctttactagctcgatttgttaaagttcttgattttggctaaaaaagttaaaaacattttaggatgagttatatctggaccgagaaggaggagcatacttcaatactgaaggacaagacccatcggttcttcttcgtgtaaaagaagatcatgatggtgcagaaccttcagggaactctgtttctgctatcaatcttgtgaggttagcttccatagtcgccggagaaaaagctgaatcctacctcaacacggcacatcgtctcctggtaaacaaacaaacaactaatcccatttgctattcatagaaagagattattgagtctctttgttgttgtttttgcaggcagtctttgagttgaggttaagagaactggcggtggctgtgccattaatgtgctgctccgcagatatgatctctgttccgtcgaggaaacaagttgtattggttggttctaagtcttccccagagcttaccaacatgctttctgcagcacattcagtctatgatcctaataaaacggtaagagcttaaaaaattatccaaatttctagattcaagatttgtgacttttggtggttttactgagcaggtgattcacatagatccctctagttctgatgaaatcgagttttgggaagagcataacagtaatgtagctgagatggctaagaagaacagaaactcagagaaagtggtggctcttgtttgtcaacacttcacttgcagtcctcctgtctttgactcttcttctctcactcgcttgctttccaagtaaacaaagatcattccatgtttaatagttgcttgtactgtaaggaacagatcaacgttgttctctctgttacagtcttacagagtagataaataaagaagagaactaaaccgagtatgaggttttttggttgaactaaaccggaaataaccgggtttggtttggttaaaaaaacagagctttgacgattccttatcatcttctatcttcagcaaaaaggtgaaaacttggattcgatcgatcgctgaaa

SEQ ID NO: 5247 - DNA, 3000 bp, Unknown
  misc_feature (1)..( 3000): cDNA_ID_3076323_gDNA_ID_1620775_Annot_ID_167674 3000 nt of promoter + ATG
cttcaagtttggagatctgctcacaagacgctctaaatccgagattttaacctcagaatctaaacaagagaagtcaagagagaccaaagaagttgaactctctggaaaatagctaagccaatctcctcctaaatcttcaacaatacactctcgtagttccaacactctcaagttcctatattgaaaatcagacaacaacaaaaaacaaaccaaagctacttactactatgagatataacttgcagccaaagaaaagattgtttttgtatttggttggaaccgaacctgcaagtagctgcaatagcagcgataccatcagtagagaaaccttcacaagaagtcaacacaaggactttaaaatccttaaacgaagcagcaattttctctaagcactcatcagtcaccaccatcctcttcattctgatctcttcaagagacgaacttttcgccgccatagcttcaatccacggccaagcataaccaccccaaccatcaggaacgagattatagtcagcgaagtgtggcttccccttcaaagtcaaagatctcatctccgggaaccgtcgtgtaaccgcagcaggactgaccgcgtaacagtttccgacaaagactcgcttcctagtcttccgttctgtctcaaaccatgacttgcagaccagagaaacagagttccggtcctcgttggaatcaatgaaggagaggatatgttccaacaccttaggtgggaatcggagacccatcagaaacagagtgagagagagagaggggggaagaaatgaagaaaaaggtttgagattttgattcgatatgagtgtgatctaaatcgaaagattgaagcttttgatatatataaacagagcaagtggaagacaagaaagagtatgacaagacaagagaatcgaaggagacagtgtccatgtgagaccattaataaagttgagcttgcacccatgtgagcctactgtgtatagctcactaatataattagtttccttaatcataattagtttactctgtgatccatcacatgtaagtctgtgtgagaactcgtggatctaatcatttatggtattacccagttcacacatgatgtcagattcgttaattagtattttacttatgcttcagtttcaaagtaaaaatatattttatctttggtaccaaatatcaattcatattgttaccaatcaaatgttacaactgaatctcttcaaacaatcaacgtttttggacgtgaaaaacatttttatgattaaagcttcgaatggcaactcattatcaaaacggtacagtttatacagttttgacaattatcatttacaaaaagaatttcaaaaacgttacaatttttttttattttcaatttttttatacagtttttttttacagttttgcattattctataacagtttaccgcgtcagttaacaacttatcgctctagctaacagctaaagttttgttaccaatcagactcttaaatcttaagaaatggagtaatccatctcagtgcataagtgtcacaaaatgatcgagactcgttggttacaaactctttatcacatttgaagaagcttaacttaagttgttttgattttcgagaaaccgatagagtaacaaagaagttaacatcccaattaattatgttcctaagctttattttcttagtgtcggattggttagattttctcatagacgctattccgctaaaaaactatgactctacacaattacacaagatgtgggttagtaaaaatttgaagtctgaaaaaaaaacagaaaattcagattcaagagccatcttcttgtcttatctacacgtgtcacatactgaactcctccaacaagagaaagatgtgtccgaagctccctcgctcgaatggcgaatcctctacaccttgagttcgtttagccaatctcaacaaacgctaaagaacgacgtcgttttgttgatcgtaattctaaaaaatcaatcagcaatgctgatgaaaagtcttcacttgttgtcttcctcaatcctcctccaccgctttgcttctcgcagcattgcatctttgtctactctacccagaagaagaaatatcgtccgtatacataacccttcgttttctagccctttcccgccgattctctctagacccatttcctcaggcaaggtcttagccatggcggaagagtcttcttcttcttcgacctcgtcaacatctcagaaacataccaaccgtttagccgctgaacacagtccttatcttcttcaacacgcgcataatccggtgattactctcttttataaaagtattcgtctttagataaaattgataagagaagaacacctctcgtttcaattagggagctttcttgcaatttgctaagtcacaactggtttagattgtagctaaccggttcttagtctaaaagtttggaactttttttattttttagattgatttcatggtttatgtcaaaaaggttgattggtacccatggggagaagaagcttttgaagaagcaaggaagagagacgtgcccatcttcttatcaagttgtttactttatcctcttttgatcgttttaattactgcttgattagattccattaatgacttttagtttgtgaaactaatttggttccttttgttttcaaaatctcttttatatggaatcttgaagttggatacagtacctgtcactggtgagactttcaattgttttcttggatttgagtttgacttcttctttttactgaattggaggattaagagaatgaatgacagattcaaagactctggatctgttagtatcattactcttctctcctcataggtgtaactctaatgaaggatttaaggattttataaattgaaagtggaaagaagtcttatagcctaagaactaagtgttattgtttgaaatgttaggagtagagaagcagataatcttatattcctattttgaaatgtatgtttaagtaacagttaactcttttgtcaggtgccatgtc

SEQ ID NO: 5248 - DNA, 3000 bp, Unknown
  misc_feature (1)..( 3000): cDNA_ID_1808799_gDNA_ID_1620775_Annot_ID_167671 3000 nt of promoter + ATG
ttgtttctacatacatactctattttttattgcaccattacaagcctagaatgcttttgtacaataagagaaaaagggtttacttacttaaggagagttttgaatcctggtcgtccataattgtcatttggaggaaagtaggttccacccatcaacggctttaaatcaggtgaaaggaataccgacagtggccaccctcctccaccatacagagcctggacgaacgacatataaacctaaaagtgccagtaaaaagaatcgtaagtccatgaatatagtcaaggctactttctctagtagacactgatccagctagaacaaattctacacaagtctactatggtttctaaggttttgcatctcttactagagttaccgaagacacaaatattcgccaacaaagtaaaagaagctattaatatgacccacaacatgattgagccaaaaagaaaagatatttctgaaactaagcattcagagaaataaatgaaaatttgagttttgagcaatttattcaagacatcaaagagtgcagaaagtagtttaccttgtcgacatcaggccgctcttctcgatcaacctgttgcatagacatgttactaacatgtttcaacagtaaccagttcaaagacagtgctttaaaatgtttttccgtgttaaacgctaaccttgatactaacgaatgaattgttcaagagttttgccacttcttcatcttcaaatgactcaacttccatgacatggcacctgacaaaagagttaactgttacttaaacatacatttcaaaataggaatataagattatctgcttctctactcctaacatttcaaacaataacacttagttcttaggctataagacttctttccactttcaatttataaaatccttaaatccttcattagagttacacctatgaggagagaagagtaatgatactaacagatccagagtctttgaatctgtcattcattctcttaatcctccaattcagtaaaaagaagaagtcaaactcaaatccaagaaaacaattgaaagtctcaccagtgacaggtactgtatccaacttcaagattccatataaaagagattttgaaaacaaaaggaaccaaattagtttcacaaactaaaagtcattaatggaatctaatcaagcagtaattaaaacgatcaaaagaggataaagtaaacaacttgataagaagatgggcacgtctctcttccttgcttcttcaaaagcttcttctccccatgggtaccaatcaacctttttgacataaaccatgaaatcaatctaaaaaataaaaaaagttccaaacttttagactaagaaccggttagctacaatctaaaccagttgtgacttagcaaattgcaagaaagctccctaattgaaacgagaggtgttcttctcttatcaattttatctaaagacgaatacttttataaaagagagtaatcaccggattatgcgcgtgttgaagaagataaggactgtgttcagcggctaaacggttggtatgtttctgagatgttgacgaggtcgaagaagaagaagactcttccgccatggctaagaccttgcctgaggaaatgggtctagagagaatcggcgggaaagggctagaaaacgaagggttatgtatacggacgatatttcttcttctgggtagagtagacaaagatgcaatgctgcgagaagcaaagcggtggaggaggattgaggaagacaacaagtgaagacttttcatcagcattgctgattgattttttagaattacgatcaacaaaacgacgtcgttctttagcgtttgttgagattggctaaacgaactcaaggtgtagaggattcgccattcgagcgagggagcttcggacacatctttctcttgttggaggagttcagtatgtgacacgtgtagataagacaagaagatggctcttgaatctgaattttctgtttttttttcagacttcaaatttttactaacccacatcttgtgtaattgtgtagagtcatagttttttagcggaatagcgtctatgagaaaatctaaccaatccgacactaagaaaataaagcttaggaacataattaattgggatgttaacttctttgttactctatcggtttctcgaaaatcaaaacaacttaagttaagcttcttcaaatgtgataaagagtttgtaaccaacgagtctcgatcattttgtgacacttatgcactgagatggattactccatttcttaagatttaagagtctgattggtaacaaaactttagctgttagctagagcgataagttgttaactgacgcggtaaactgttatagaataatgcaaaactgtaaaaaaaaactgtataaaaaaattgaaaataaaaaaaaattgtaacgtttttgaaattctttttgtaaatgataattgtcaaaactgtataaactgtaccgttttgataatgagttgccattcgaagctttaatcataaaaatgtttttcacgtccaaaaacgttgattgtttgaagagattcagttgtaacatttgattggtaacaatatgaattgatatttggtaccaaagataaaatatatttttactttgaaactgaagcataagtaaaatactaattaacgaatctgacatcatgtgtgaactgggtaataccataaatgattagatccacgagttctcacacagacttacatgtgatggatcacagagtaaactaattatgattaaggaaactaattatattagtgagctatacacagtaggctcacatgggtgcaagctcaactttattaatggtctcacatggacactgtctccttcgattctcttgtcttgtcatactctttcttgtcttccacttgctctgtttatatatatcaaaagcttcaatctttcgatttagatcacactcatatcgaatcaaaatctcaaacctttttcttcatttcttcccccctctctctctctcactctgtttctgatg

SEQ ID NO: 5249 - DNA, 3000 bp, Unknown
  misc_feature (1)..( 3000): cDNA_ID_1009489_gDNA_ID_1620775_Annot_ID_167670 3000 nt of promoter + ATG
catgaagcttcttataacacctgcagggcacgaatttgcaggtctgattcttatcatgatgttcttttcagcttttcatcatgtttgagatgcacttctcagcttgtaagaacctctcttgtctattcttactttttacctctgacacacactggtttctcttctactttgaagcttagactgttctgctgtcaagacttgacttcttctgcatactccacaactttcagtccagattctttgtgagtattgatttgtcagttgtcactgacctcggatcaaaacttggcatatacatgtatgatataggaattatttctagtcattaacgttttcgaaaatacacacataaaacaaagcagtatttttacagacttaaaataattattttatcgattaaaaagttgattttttttttaataatataaatggaaaacctaagtataaaaggaattgatttgctagaaagaaggaaaaaaacaaaccctaaaaatatatagattcttcagcaaggtaagatagagagaacgtgagagatcgatcatggcgaattcaacaggtaaaccgacaagttcaacacaagaagatgaagaagctacctcggctacagaaatattagcacaattgatgcaagatattatagatcgtgaagaggatatagatgatgaagacgatatagatgacgaggttatagatgatgaagactatgaggttgcgtcccttccattattacaagaaagccaagctaatcaaaagcagtctagggagagggaagaagaaactgaaaaaaatcaacctaagaggtttaagaaacagaacatgatgaaaataaatatccatgacttttcagaagaaactctgaggttaattgaggtatggtacgaagctgaactcgatccacaagatatattcggcgataatgaggtgacgaggctattcagcagaccgataaagaagcagttgatgtcgagcgatgtcgataaagatcaatgcatgctcatgttatcgaaggagcaagtgaaggagaagatgcttccttttctagaagattcagagaatccggtaaaggggattgatgtttcggtgtatggaccagacgggaaagttcaacagatggagttcaagatgtggaatggggataaaacacctgtgttaacttcagggtggaagcagtttgtggaagattatggtctttcgatgacttgtgattttgtcactgtttggatgtttaggcacataaagactcgaaagctttgctttgctattcactacgttaaattttctttaagagattaatttatcgagtgggatgatcttgaagactgctttcttgaatccaaattaggatttttgaggtttttgtttctttctttttctgtgttaactagtggaactaccagggtattaactagggtttgcttccctattcggtctacaaggatcttgaagactgctttcttgaatccaaattagggtttttgaggtttttgcttctttctttttcctgcgtttttgttaccaggatattaattaggatttgcttcgctattcggtctacaatgatcttaaacatagataattgatatttgataaggtaccaaaatgatggatcatatatggtcgtcactggtcagagaatatatgcacattatatggtcgtagctccaacgtttaatttgatctaaactatgtatgtatcaaggttataaaatattgcaccacacaagctttttacttacaatgtgaaatcaatgtaaaaaccgttctatacacatattaatctcacaattacagcgactaaacaatacaaaaatcacaagcaagattccaagagggaaaaaaactggagaaacaaagaataagacaaaaccaaacaaccaacacaagaagaagcaaaatcagttgtaagaagaagaagagagccaagggtggttaagtgcctcgagagctgttggacgtctcaaaggattgatctcaagtagagtccttacaaaatctaagaacaattcatcactaacttgtagttgttcttccaagcttgattcttctgtgattatgtattcaatctcattgctctcctaaatcaagaataatgcgtcacattcaagcaataactctcaagtatttttggttatattaagaaaaattacctcgtttaagtggtagagatcatactctttggtgaagtatttatgtgtctcttgacctttctttagcatctctgtttcgataggacctaaaactgcaacaatcctagccaatatcatcgctactgcttcgtttggaaacagaacctgatacacacatacatatatacacattgatacatttgtgttactagtttctttgatatgtgggataaaacatacagataagacttttgatggaatctagacagtacctcaccagagcagagttctgctacaatacacccaagagaccacaaatcgatcttttcgtcatatggaagcccgagaatcacttcaggagctctataagaccgtgattgtacatacaagcacaagttatcagagcggaaacaactacttccaagatcgatgatttttaccgcgcatcttttgtaactctttatcagtatattgcttgattaaaaaaaatgccctttttccaacttaaaactgcatcgttcgttaaaacttaaaacttaggaatgggattttagtaaccaaacatcatgcaatagccacaaaaagatgtccgtgggcttattgggcaagcccaatatcatgaattctgatatgcagatcctaaaactattgcggtgcttttcataatgtatctaactctacggtggttctctgtgaaaaagatgaaactataagggtataataacaatttaaaataaggtcggcgattcccacttcagacttcagagtgtcgcctccaatttcaattagggttcctactttcttctcctttctcgtaacttgatcaaatctgcttactgtggagttatacaccttgaagagtctcgcgata

SEQ ID NO: 5250 - DNA, 3000 bp, Unknown
  misc_feature (1)..( 3000): cDNA_ID_2053094_gDNA_ID_1620775_Annot_ID_167669 3000 nt of promoter + ATG
actgcgagaactgagggtgtttccatctgagccagatcttgatgcaaccaacatacctctgacggaacaaggcctggtctttgtgtctaaaggctgtcgaaagcttgagtctgttctctacttctgtgtccagttcacaaacgcagctttgtttaccatagcaagaaaacgtccgaatctcaagtgcttccgtctctgtgtgatagagccatttgctcctgattacaaaacaaatgagccacttgataaaggattcaaagccatagctgagggatgcagggatcttcgacggctctccgtctctggtcttctctctgacaaggccttcaaatacattgggaaacatgccaagaaggttaggatgctatcaatagcatttgctggggacagtgatttgatgcttcatcacttgttgtcgggctgtgagagtttaaagaagcttgagatacgagactgcccttttggagacactgcactactggagcacgctgccaagctagagaccatgcgatccctttggatgtcatcttgctttgtaagttttggtgcttgcaagcttctaagtcagaaaatgccaaggctcaatgtcgaagtcattgatgaacatcctccagagtcaagacctgagagctctccagttgagaggatatacatatacagaacagtcgcaggaccgagaatggatacgcctgaatttgtgtggacgatacacaagaatcctgagaatggagtttcacatctagccataaagtaaacttgctgcttcagtcatattttcctttccatcttcagtttttgcagacattgttgtgggagagattcaccttccatttgttccctttcatattgtttttactaagatattagaatatcagtgatagaagcatttcatagcttgtactctgttaaacaaacaaaaccttgtgtttggaataaaattatcattttataagatttatagtaaaagaagtttgtaaagaaacatctaaaatcatgagctaaacggtaaggcctagcaaaaaactacatatgttgccgcaaagcatctctcaaagtataagcagtagtgtaacataatatctccgggaagaaaaaggtcagtatctgagtgacaacaaggtttctgctttgagcctccgcaacaccagcaacttctcctcactgggttcttcatctgcactgtatcaacccgcacaagttaggcgatttcgttgattccggcagatttcttgatggattcaagaagatgctcaattctgtatttcattacaggctgaccatgtcgagtcttcctcaacattttcccctttgcttctttcctcctagattcagcctcttctttcgcttccttcttcgcctgaaacattgcctctctctccttccttactctctccatctcttctcttgtctgcttgtacaaatcctctacaccaattctcttattagatttacccttccgcttatcatcatcatcatcatcacctaccttactagtctctccagtctcattcttatcaggaatgttctgctgcttcaacgacttcctaaacttgctcacatactttgcattcttgtagaactctttttgcttttctgaaagtgagcacaaaagaacactcattcaatcttacttcaagcctaatctgattagaaaacacaaactgtgaaactatacaccattaaaggaactccaaatagttctcttctgatgcctaacaccaaaggaaacataatcaataaccacatcgtagcattcttaacatcagcctgatcttaaatcttaatatagttcctcctaatcatcgagtactagcttaagtttgaagcaagaggatgagaagttacaatcaaaaaggaaactttttttcaagttgggtggagagaagcagggtaacatagtcaataaccacatcgtagcatcctcaacatcagcctaatcttattatagttcctcctaatcctcgagtactagcttaagcctaatctgattagaaaacacaaactgtgaaactatacaccattaaaggaactccaaatagttctcttctgatgcctaacaccaaaggaaacataatcaataaccacatcgaagcattcttattcttaacatcagcctaatcttaaatcttaatatagttcctcctaatcatcgagtactagcttacgttcgaagcaagaggatgagaagttacaatcaaaaaggaaactttttttcaagttgggtagagagaagcagggtaaacatagtcaataatcacatcgtagcattcttaacatcagcctaatcttaaatcttgatatagttcctcctaatcctcgagtactagcttaagttcgaagcaagaggatgacaagttacaatcaaaaaggaaactttttttcaagttgggtagagagaagaatctcttactgatcaaagaagggttatagcgattattttccgatttcatgttggcaaaagtttggagagaaagaccaccgcctcctaatctcctcatgttcttcctcttcttcgtctccgccgatttggatttatcagtctcatgatcagcattttgatagaatttcttcattatcgcgagactcttcaaggtgtataactccacagtaagcagatttgatcaagttacgagaaaggagaagaaagtaggaaccctaattgaaattggaggcgacactctgaagtctgaagtgggaatcgccgaccttattttaaattgttattatacccttatagtttcatctttttcacagagaaccaccgtagagttagatacattatgaaaagcaccgcaatagttttaggatctgcatatcagaattcatgatattgggcttgcccaataagcccacggacatctttttgtggctattgcatgatgtttggttactaaaatcccattcctaagttttaagttttaacgaacgatgcagttttaagttggaaaaagggcattttttttaatcaagcaatatactgataaagagttacaaaagatg

SEQ ID NO: 5251 - DNA, 3000 bp, Unknown
  misc_feature (1)..( 3000): cDNA_ID_1411691_gDNA_ID_1620775_Annot_ID_167663 3000 nt of promoter + ATG
ttggtgaattttctcttcttcttagagtttctttccctgtgtggagcagcactaaacagaccattcaatttgtctctttcaggttcaccctcaatggtatcattgttccttctagaaagattactaacttgatccctcatttctgatacactcccaggaattgggtctgattcacaagcttcttctgtagtacagggagcatacactaaagcactcattgcttcagcagcaatttgagtgttaataccaatgtcaataaagtcttcctcgggttccaagggctcctttggcgccttatcctccaactgagcatccttctgtgagataaacataatgccctcactcaaacccgatgcttgttccatcttgagatgctttgcagaactgttcttcataactctttgtgtgggatgacttgagacttttctaatatcacacggatccctagatcgtttcttcactccaaaatcatcacctgcaacctgatcttctcttatcttggagcatgtaatacttgcacgagtgactggagaggttttagggtcactcacatcacactgatcactactccaatcaaagacactcattttcctggttggacttctgctcataattcttttggccagagattgacatccttttgcacctgatacaggagatgacttccttctgcaactattaaccgggagatcaactggagacaaatttagatctttgtccatcaaaaagtggtcaacaaaaccaagggcatctgcttgtgttgactctcctggttcttgagaatccaaaaaatcaagccctggaccatggctactagcagtaatccgcaatgaaccttggaaaccggtcactgtatcacaatttgattcttgcttgccttgaagaaagagatgtagtaagatttatctgagttaatacaaagaagaagatagaggcaacataacaacacaaggatatgtttacctgtttgacattcgtgatcatttgatccatcagactccaaaagtatatctccagctttcgggcttagctccggcaaacacatcggctcaccagcagcgacacttccatcttcatcatcactatcatccaccaccacttggtcgagaccgtaacattcctggttcagtgattcctcgtcaccacaatttccgttatctactagctccgtatcgtcgtagagcacttgaaatggggtttcaagtaacgagctattaagtactaatgcttcatcaatcgcctctgtatcttcaatttccccacatcccaaaatccgattaacctcaaaccctaagagaatccagaaatgaaattggtactacgaatctatcacctcaaaaatctacaattatcagcaagaaaaagaaaatgtaaatgaatcgtaatctcaaaactcactatgatccgaagaagctgaaggagactgcaaatcggaggcgaaatcttcggtttccataagattgaccatcgaaactcgaatttcaatgctgtccaagaagaaatggaatcgctagaagctcccgattcgtatacggttggaatcagagaagaaaccctagaggttccattggtgctttagtcgaggtgattggcgggagagagacgagtacagagctgtgtcgaatggttttgaaaagctcagttccgtgaaacgatattttagttactatatatatttaattatgtcaaacgatacatcaaatagggcatttggtctagtggtatgattctcgcttagggtgcgagaggtcccgagttcaattctcggaatgcccctctattatcttttgttttttgggacttgaaaattcttacctcattttcttctcagtatttccactatgttcttatccctttaatcttcttcacctatgttgcaggaaaaaaaaagattatatattatgtcttctagaaggaaaccaaactacttattcgacacctcataaatgctttgctatttttctactctttgtgtgcgatttggtgaagaatctttgagaatttggtcaaatgaacatttaagaatgttacaatttatcgacatgtcaaagattggtaacactttggttttcttttccatcccatgaatgtgaacttgcttacttaaaatatttaactgtaattttataacattactttacgatattaattaatttagatttaccagcaacacatggtattaggattgtgtacctttgtaattgttgatatatgagtcacttgttctaagaacacatttcattactttggattttgaaattctaagttgaaaatctttgttttattttcttggctagatttgatgcgtgtcataatctaatccaatttgaaaatatgtaatatgttgtataaaaagttaatatgccaacaaaaggatagatcttagttggtggaatcaacaccattagatatcaaattggtcgtatgcaatgtttctgtataatatatcatttgtctactgaataatatatatcataatgttaattgttagctttctgtcgggttatgaagatggtattggtaggtacgttgtataacataagaattgaaaacgtaaatattattcattagtagacagctcataataagcacacccacacatgcatgccacaagcaatagaggttttttaaaaggttttcttcttttaacaaaagaaaggcctttctttgatttcaaattttcaatgatattaatattgcaataaaataccatgatataacatattttagatttatattaatgatttatgaccccaaaagaaaaaatatattaattaaaatatgtagttcaacaataacctcagcctatatggctattatacaatcttgttttgggaagaaatcaacacatgcttatgaacttttatgttcctttttttgtcttcattagcaaaagataaagggatcaagccttttttacaaacacttgcatgctagtatgcttcaggttcaatcaccgccccattagattctctctccctctctaaagaccacaccttt

SEQ ID NO: 5252 - DNA, 3000 bp, Unknown; identical to SEQ ID NO: 5249
  misc_feature (1)..( 3000): cDNA_ID_1009489_gDNA_ID_1620775_Annot_ID_50261 3000 nt of promoter + ATG

SEQ ID NO: 5253 - DNA, 3000 bp, Unknown; identical to SEQ ID NO: 5248
  misc_feature (1)..( 3000): cDNA_ID_1808799_gDNA_ID_1620775_Annot_ID_50262 3000 nt of promoter + ATG

SEQ ID NO: 5254 - DNA, 3000 bp, Unknown
  misc_feature (1)..( 3000): cDNA_ID_1828131_gDNA_ID_1620775_Annot_ID_50263 3000 nt of promoter + ATG
aatgtctgcaaaaactgaagatggaaaggaaaatatgactgaagcagcaagtttactttatggctagatgtgaaactccattctcaggattcttgtgtatcgtccacacaaattcaggcgtatccattctcggtcctgcgactgttctgtatatgtatatcctctcaactggagagctctcaggtcttgactctggaggatgttcatcaatgacttcgacattgagccttggcattttctgacttagaagcttgcaagcaccaaaacttacaaagcaagatgacatccaaagggatcgcatggtctctagcttggcagcgtgctccagtagtgcagtgtctccaaaagggcagtctcgtatctcaagcttctttaaactctcacagcccgacaacaagtgatgaagcatcaaatcactgtccccagcaaatgctattgatagcatcctaaccttcttggcatgtttcccaatgtatttgaaggccttgtcagagagaagaccagagacggagagccgtcgaagatccctgcatccctcagctatggctttgaatcctttatcaagtggctcatttgttttgtaatcaggagcaaatggctctatcacacagagacggaagcacttgagattcggacgttttcttgctatggtaaacaaagctgcgtttgtgaactggacacagaagtagagaacagactcaagctttcgacagcctttagacacaaagaccaggccttgttccgtcagaggtatgttggttgcatcaagatctggctcagatggaaacaccctcagttctcgcagttccttgcaatatgaggcaacagcttcaagacctttgtcctcaatcaagtccatcacctaccaaaaaatgtctcactagtaagaaccaacataaatgggatactcactcaaagagtcttgaaaaatgtaaaatactcacccatagcttctgcagtttcgagcatcgcctaagaagctcaacaagatcaggcattcggacagtagcgtagctcaagttcaacgaggtaagaccaggacagacagaataaagagctggaagatattcagggaggacatcccagagaccagataagctctgaagttgcttacagtttgaaaaagcttctgataactttgaaaacgcttcaggtttcaattgagctgcgaaagaacctgtgccgagctcagtcagttgtggagcacaacgaagtaagctaacgagtccatctagagtcacagctggattcaacttcaaagacttcaagtttggagatctgctcacaagacgctctaaatccgagattttaacctcagaatctaaacaagagaagtcaagagagaccaaagaagttgaactctctggaaaatagctaagccaatctcctcctaaatcttcaacaatacactctcgtagttccaacactctcaagttcctatattgaaaatcagacaacaacaaaaaacaaaccaaagctacttactactatgagatataacttgcagccaaagaaaagattgtttttgtatttggttggaaccgaacctgcaagtagctgcaatagcagcgataccatcagtagagaaaccttcacaagaagtcaacacaaggactttaaaatccttaaacgaagcagcaattttctctaagcactcatcagtcaccaccatcctcttcattctgatctcttcaagagacgaacttttcgccgccatagcttcaatccacggccaagcataaccaccccaaccatcaggaacgagattatagtcagcgaagtgtggcttccccttcaaagtcaaagatctcatctccgggaaccgtcgtgtaaccgcagcaggactgaccgcgtaacagtttccgacaaagactcgcttcctagtcttccgttctgtctcaaaccatgacttgcagaccagagaaacagagttccggtcctcgttggaatcaatgaaggagaggatatgttccaacaccttaggtgggaatcggagacccatcagaaacagagtgagagagagagaggggggaagaaatgaagaaaaaggtttgagattttgattcgatatgagtgtgatctaaatcgaaagattgaagcttttgatatatataaacagagcaagtggaagacaagaaagagtatgacaagacaagagaatcgaaggagacagtgtccatgtgagaccattaataaagttgagcttgcacccatgtgagcctactgtgtatagctcactaatataattagtttccttaatcataattagtttactctgtgatccatcacatgtaagtctgtgtgagaactcgtggatctaatcatttatggtattacccagttcacacatgatgtcagattcgttaattagtattttacttatgcttcagtttcaaagtaaaaatatattttatctttggtaccaaatatcaattcatattgttaccaatcaaatgttacaactgaatctcttcaaacaatcaacgtttttggacgtgaaaaacatttttatgattaaagcttcgaatggcaactcattatcaaaacggtacagtttatacagttttgacaattatcatttacaaaaagaatttcaaaaacgttacaatttttttttattttcaatttttttatacagtttttttttacagttttgcattattctataacagtttaccgcgtcagttaacaacttatcgctctagctaacagctaaagttttgttaccaatcagactcttaaatcttaagaaatggagtaatccatctcagtgcataagtgtcacaaaatgatcgagactcgttggttacaaactctttatcacatttgaagaagcttaacttaagttgttttgattttcgagaaaccgatagagtaacaaagaagttaacatcccaattaattatgttcctaagctttattttcttagtgtcggattggttagattttctcatagacgctattccgctaaaaaactatgactctacacaattacacaag

SEQ ID NO: 5255 - DNA, 3000 bp, Unknown; identical to SEQ ID NO: 5245
  misc_feature (1)..( 3000): cDNA_ID_1387356_gDNA_ID_1620775_Annot_ID_50264 3000 nt of promoter + ATG

SEQ ID NO: 5256 - DNA, 3000 bp, Unknown
  misc_feature (1)..( 3000): cDNA_ID_1828129_gDNA_ID_1620775_Annot_ID_50265 3000 nt of promoter + ATG
tagagagtatccttgtctctcttccgctatctgcgagatgagaatatgaccatgtaaagtttcttgattcaagaaactaaatcttgtttcatcttagctaatgaaacttaactactgatggtgtttgtctcttgttgcggatgcagaaacctgaagaaggaactgaggaatggaaactattagatgcttgtatcaatccaaaagagtggctttagttaattaattgtggttatttccccaattagctcttttattagttttgtctttaaaagccttaaaagagtaaagagtctaatgaaaagtgagtgagataaagaaattgtaatttggcgtcatctcatcatgagtcactgacaaacaaagatcatgatggttgatgatggagtatatagtaccaatcgtgatgatgatgataaaagtaattaacttttaattttttttactgacacagtaaaaataagagccgttggctcaaatagccgagcctctcggtgcacgcacgcatgccacttgctcggtaactgttcactagacagaacacaacaacactcaaatagagtgataacattgaatctgatgatttggtttagtataaaaatcgtttccaagtttcaacgagtgggacttgtgttaggttaaacaatttcggattaagtaaacgtcactgtctcatttgtcttgatacaagaaacgcccgtgatattttttcttcgatgtcgtccaatggggacaaagaaacaatttagtccccggatatacacacacacacacaaataatacatgggtgttgttattatggcttaccttacacaacacaacttgccaatgtttttaaatttactaaaaaccaaagccagaagatattttattgccacaaattgacgtcacacctgcccatatctaatccatgtctgcaacacaaaaaacaaaaaattgaattcccccaaaaagtgaggagagagatgtaaagactgtgtaccaattcaatatctttttgagcagagtaaaaaaaaaagtttaaaaatttgagcttctgacacaaaaggagccaaatgtaatagctggatccaatccaatgcaatgaaaacatcttagctgtaaaatggtccaatctctctcttttctttctacattattacttccacagaatcaatttatctctcgaaaagcaataaagtctctatatttgtgctcaaagatagacagagaagcataaatacttgtcctctgtgtagtacaaaagtggagccccactgagtgatgccctcacagtaacggctacatttttcttttatctctctgtctctctcttcttttgagtgattttttatgaagatgggttcttttgtccacttattactgtcctgaatcacacgtcgaatcctacgtggcatctctctccattgtatgccagctcactctcactcactcactcacctcccgcctttataaagccttacctctctctcttgtctccttcattgagtcaagtgctcgagactgtagagtgaagtttgatttatttagagagataagttaaaaaaaaaatggtcggtatggatttgttcaaatgtgtaatgatgataatggtgttggttgtctcttgtggtgaagctgtttctggagctaagttcgatgagctttatcggtcaagctgggctatggatcattgtgtcaacgaaggcgaagtcacaaaactcaagcttgacaattactctggtaagtagatgaagacaaacccatctctgtttagtttcctctgtttttggtgccatctctgttttgtttcctctgtttttgtgggttcattataattgaatatgtttttattgaatttttcaggagctgggtttgaatcaagaagcaaatacttgtttggtaaagtctctatccagattaagcttgttgagggtgattcagcaggaacagtcactgctttctacgtacggaacaaaacccatctcttcttgttctgtttttaatcccctatttgattattatgtctcaaatattgaaatgtgacaatgtttgttctaatacagatgtcttcagatggtccgaaccacaacgaattcgattttgagttcttagggaacactaccggcgagccttacatagtccagaccaatatctacgtgaacggagttggaaacagagaacaaagactcaacctttggttcgatcccaccactgagtttcacacttactcaatcctctggagtaaacgcagtgttgtgtaagctctcttatacaaacaaagtctcttcctttatttgattattgaagacccattttaatgatgtcttcattgcaaatacagattcatggtagacgaaacaccgattcgagttcagaagaatcttgaagagaaaggtatcccatttgctaaagatcaagcaatgggtgtttacagctccatttggaatgcagatgattgggctacacaaggaggtcttgttaaaactgattggagtcacgctcctttcgttgcttcttacaaagaattccaaatcgatgcatgtgagattccaacaactactgatctaagcaagtgtaatggagaccagaagttttggtgggatgaaccaactgtctctgagcttagccttcatcagaatcatcagcttatttgggttcgagctaatcatatgatttatgattattgttttgatgctactaggtttcctgttactcctcttgagtgccaacatcatcgtcatttgtagtttagagattagtcaagaataaaaatggatcaagagaacacatgtggttactctttgatgattctgttttaatgtataaataatcaatcttctattgattttggtgaagtttttaagttcggattttaactgaatatgcgaaatttatggaaacaaactcaacgcacttatcgttaatgacttttaagggtttgttttgattgaatgtttcaaaccctaattacgaaccttaggaaacaaaatagcaaaaaactcgattaagatacttttaaca

SEQ ID NO: 5257 - DNA, 3000 bp, Unknown
  misc_feature (1)..( 3000): cDNA_ID_1828125_gDNA_ID_1620775_Annot_ID_50266 3000 nt of promoter + ATG
accttctatggcagaaccaacctgaaacttgcttctcagttaatccaacttcctctgctaacttgcccttcatttcttcagtcggatacttatgctctgtagaaaaaccaaatcacacctgtaaagcatatacaacttggtataaaggaacatatgcaaacaacaaagccataatttaccattgtagaaattctcaagcgccataacttgcataggagtcttaagcttccgttttttgctgttttctgtagaagctttatcgccatcagcggtcgcttcgcctgaatctatcgaaaatagcacataaaaatcaaaaacataagaagataatagtgaaacacggacaccattcaataaccaagagatgcaaagccctgaccaaaatcaatttcattttacaatcatgctttgtgtatttagaaatgttgctagtaattccgaaattcaggtaaaacatctacacaagcttcacataaaagggtttaatttcagaattatggctctttctctcatcagccaaatacttctaaacccaatcaaaacgaacgaaaactttggaattccttagcttgaataattagtagtaccataaaacaaaccaaaaaaggcttaaaatttccaatgccattgatgaatttcgctaattaaaactacaaaaactgggagttgcattgtaattcgacgaactcgggatcattaaaaactattctctcacgtaaactcgcaggaagacagagattgaaatagaggaaaaaacgaatttcacctgagtgcatagcgaaaattcccagagattgaaggaacaaaacctaatcagctcccaaaaacccagatttttttctttctccttcttcaaaattctggttttttcttatgagaggagaagaaaactcttcttcgcacacaaatgacaaatctcttgagaaccataccggtttcagtaaaccggaacatgggaaatacgtgaaccgggtaaatctaaatttgggccttattgtgggcctaaattggacaacgaaggaataagaagaagagaggcgtcgaatgtttcttgtgacagaaccgccatggctacagcttcaaggtttcttctacggaaattgccgaggtttctcaagctgtctccaactcttctccgtagcaatggcgtaagagtttcaagcaatctgattcaagattccatagaaccgttggattccttctggagaataggatctcgaatccgccatgattctttgactaccagaagcttctcttctcaaggtcctgcttctgtcgattacaggtactttaatattctccattttgatctcctttattgtatctgaatcgttaatttcatgagaatatgaacaaagtggaagaaaaaaacagttcggttttgcaggaggaagagtttcacaaattagccaacttcacaattaatcaccttcttgagaaaattgaggtatttgaagctggaacctttttctctctagggttcttcgttttacttgagattgcaatagcttacactatgttctacttgcatgattcatgttcaggattatggtgataatgttcagattgatggtttcgacatagattatggggtaaggattaaactcttttaagcaatttaagatcttgttcatatttctggaaatctatgtgtacttattatagtcagtccttttggctgtttccaacagaatgaagttcttacccttaagcttggatctttaggcacttatgtactgaataagcaaactccaaatcgacaaatctggatgtcttcacctgtgaggtaaagattctttcttgccttttgaaagttgctaactttaggcgcctagattgaatttcgcatctggattatcatgttctgctctctcttctgatttttgtactcatgatatttggagaaatgaaactgtttatgactgtatagtgttgttgctcttgactttgtgcttccacatcttagattcacattaatgtaatcttcattcttccttttgtctcggtgcagtggcccttctagatttgactgggaccgtgatgctaatgcgtggatatatcggcgaactgaagcaaagttgcataaactcctggaagaggagttagagaatctatgtggtgaaccaatccaactctcataaagaaggctttaaaacaatatttgtgagcgaaagggtttcatctatgaacttgaaactgctataccctgttaaaggtatatctatgaaacatccagaggaataaacaaacaaggcagaagacaaagttgttttagtgtgaaaactgattagtgtttctgaatctatttttaaacagtaatgtctcatagtgacattgttgcaagtctctttgtttaatcagagctgaagctgccttttacaggtttacgcgttttagatgaaaacatttcttttgaacgacaaaagtcctacatttgtcaaaactcctcgaatctcacaataatttcggaaaaaagttggttaacaatgtttgcagggtcaatctccacttcttcgaaagcaccaataaggacaaaagattgacttcttcaacatcattgtcccctttttccagtaattcacgtttaggtacccctatgtctctctcattgtcaaaaaatactctaaaagtacgtattattcaaaaaatgttggatctttttgaactatttagagatccatcgcggaaaaagttgacacaaagtgcgtgaattggtcacatgtgtatctacatacagtggctaagagagtgtaaatagtatctactactttcatggcttttggttcagatgctcaagtgagacttgttctgctttttcttggaaacatcttaaaacacatgattagctgcgttccacatatttacttttcaggtgggtctttcgttgacgttgaggcaaactttttcttttttcgttagacacgttttgagttgagttcttaagcagaaataatggagatatcagatgagtaaaaaaaagctagtactggtcagagaatg

SEQ ID NO: 5258 - DNA, 3000 bp, Unknown
  misc_feature (1)..( 3000): cDNA_ID_2993386_gDNA_ID_1620775_Annot_ID_50268 3000 nt of promoter + ATG
ccctaagtaccttctttcgtcggagcttccattaggagtgaagaagccaagctcaaatctctgaccagctgaaacaagagtctctccatggctgtcattgatcaatgttgaacctttgaacaatgttttggagtcttgaactgcaacaaaacaatctaatcgacgaatatgcagcaaaaacatatagaagaagacagaaagaatcattctctgaccagtactagcttttttttactcatctgatatctccattatttctgcttaagaactcaactcaaaacgtgtctaacgaaaaaagaaaaagtttgcctcaacgtcaacgaaagacccacctgaaaagtaaatatgtggaacgcagctaatcatgtgttttaagatgtttccaagaaaaagcagaacaagtctcacttgagcatctgaaccaaaagccatgaaagtagtagatactatttacactctcttagccactgtatgtagatacacatgtgaccaattcacgcactttgtgtcaactttttccgcgatggatctctaaatagttcaaaaagatccaacattttttgaataatacgtacttttagagtattttttgacaatgagagagacataggggtacctaaacgtgaattactggaaaaaggggacaatgatgttgaagaagtcaatcttttgtccttattggtgctttcgaagaagtggagattgaccctgcaaacattgttaaccaacttttttccgaaattattgtgagattcgaggagttttgacaaatgtaggacttttgtcgttcaaaagaaatgttttcatctaaaacgcgtaaacctgtaaaaggcagcttcagctctgattaaacaaagagacttgcaacaatgtcactatgagacattactgtttaaaaatagattcagaaacactaatcagttttcacactaaaacaactttgtcttctgccttgtttgtttattcctctggatgtttcatagatatacctttaacagggtatagcagtttcaagttcatagatgaaaccctttcgctcacaaatattgttttaaagccttctttatgagagttggattggttcaccacatagattctctaactcctcttccaggagtttatgcaactttgcttcagttcgccgatatatccacgcattagcatcacggtcccagtcaaatctagaagggccactgcaccgagacaaaaggaagaatgaagattacattaatgtgaatctaagatgtggaagcacaaagtcaagagcaacaacactatacagtcataaacagtttcatttctccaaatatcatgagtacaaaaatcagaagagagagcagaacatgataatccagatgcgaaattcaatctaggcgcctaaagttagcaactttcaaaaggcaagaaagaatctttacctcacaggtgaagacatccagatttgtcgatttggagtttgcttattcagtacataagtgcctaaagatccaagcttaagggtaagaacttcattctgttggaaacagccaaaaggactgactataataagtacacatagatttccagaaatatgaacaagatcttaaattgcttaaaagagtttaatccttaccccataatctatgtcgaaaccatcaatctgaacattatcaccataatcctgaacatgaatcatgcaagtagaacatagtgtaagctattgcaatctcaagtaaaacgaagaaccctagagagaaaaaggttccagcttcaaatacctcaattttctcaagaaggtgattaattgtgaagttggctaatttgtgaaactcttcctcctgcaaaaccgaactgtttttttcttccactttgttcatattctcatgaaattaacgattcagatacaataaaggagatcaaaatggagaatattaaagtacctgtaatcgacagaagcaggaccttgagaagagaagcttctggtagtcaaagaatcatggcggattcgagatcctattctccagaaggaatccaacggttctatggaatcttgaatcagattgcttgaaactcttacgccattgctacggagaagagttggagacagcttgagaaacctcggcaatttccgtagaagaaaccttgaagctgtagccatggcggttctgtcacaagaaacattcgacgcctctcttcttcttattccttcgttgtccaatttaggcccacaataaggcccaaatttagatttacccggttcacgtatttcccatgttccggtttactgaaaccggtatggttctcaagagatttgtcatttgtgtgcgaagaagagttttcttctcctctcataagaaaaaaccagaattttgaagaaggagaaagaaaaaaatctgggtttttgggagctgattaggttttgttccttcaatctctgggaattttcgctatgcactcaggtgaaattcgttttttcctctatttcaatctctgtcttcctgcgagtttacgtgagagaatagtttttaatgatcccgagttcgtcgaattacaatgcaactcccagtttttgtagttttaattagcgaaattcatcaatggcattggaaattttaagccttttttggtttgttttatggtactactaattattcaagctaaggaattccaaagttttcgttcgttttgattgggtttagaagtatttggctgatgagagaaagagccataattctgaaattaaacccttttatgtgaagcttgtgtagatgttttacctgaatttcggaattactagcaacatttctaaatacacaaagcatgattgtaaaatgaaattgattttggtcagggctttgcatctcttggttattgaatggtgtccgtgtttcactattatcttcttatgtttttgatttttatgtgctattttcgatagattcaggcgaagcgaccgctgatggcgataaagcttctacagaaaacagcaaaaaacggaagcttaagactcctatgcaagtt

SEQ ID NO: 5259 - DNA, 3000 bp, Unknown
  misc_feature (1)..( 3000): cDNA_ID_2053058_gDNA_ID_1620775_Annot_ID_50269 3000 nt of promoter + ATG
atggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggtaaagatttgtctaatacttccatgtctacatgttcctttcttgcccttttatggaaatatgacttgtgttttgtgtgatatcttcttttaaaggcaggaatatatcacggggagaggaatcaaatgaaaatgcagagagagaaattgcattcgactgatgaaccaccggtgagtttgatggttaactatcttaaaaatatagatattgatgtatattttaacaaagtttagaggctctatcaagttcgtgttctgacctttaacgaatgttaataggttgccaaacgagtgaaacatgggtatattcagcaagtatatgcaccaaaatcatcatcatacagcgagattcttgaacgaaaaagccagataaatcggttagtaaccaaccattgtgtaatgcatttattgtcccaaagagatatcaaatcggcttattggatcatactgttatgtttgtaggtctggtgtggaactgccttctagtttaagcggggacgatgagactgacgaatctagctcgtcaatggattaagtaaagaaaggtacaaaggaagattaggaaattccggtttgtatagatatatgatgaaaccggtttaggatgtgaaaatgttgcatcgtgtaattggtaaaagttagagctctcttcattttggtaactaaacggtccccaaagagatacagtgagccagtaatgagcctttttttgtttaaatttgctcctaaaccgttaccggtttgaccgaattgagtatgtaaatcccagtgattacaaaataaccaaagtaaggcccatttattaataaagctcaaattaggcccaaaatattatgatagtccggtttagtcgtaaaaggcggttcggaaatgtgtgactaggagatttcgtcacatgagaaaaaatcagagccgttgactagttttcgtagaaagtatgtggtacaattttgattcggccaaaaaaggtttttttctttttcttttagggttagcgttgctttgcctcaaactcaaattttgaagataatttttttggtttctctgctactgatttcgaatctttacgcttaatcaattattcatctggattttcaaatccaatccttttcctccctggtaagaatctctcttcttcttcttcttctctctcacgacgattccactgttctccgattctgtgttagttcctgcgatattttccatcacttgttcgtgtttcgttattacgggtttgtgttttgtgaacttgttgacctttgtgtctccgtaatttcgtccaacggttgatgtttttgattgctgattagatttttgtcggtaggtattgaaaaagatgatctttatggattttgttttctgtttcttctttcctttttgtaatctgacttgcaagctttttgctttttttgtcggtcggtgttaaaaattgttccttttctcttgttcaattgtttcctcaggtgaccaagtaattggggattaacaaagggactggggctttattaagctcgaaacaattgttcttcactctggccgcttctgcaaagtcgtgtgcttctcgcacctctgcgcaggtgtggggtggccttgaagtggtgacttcactctgtcttccaaggatttctctagcttctatcatttggaggctccgtcgtgtttctgagggtcttacccttgattacggctaacatttactacgcccactataccacctcttaagcttttataagaactttttattcgtgcaaaaacttaacttggatcttaattgtttctagtttagttgtggttgtaaagtaaagaaccgtttttttgtggtttggttttgcttttttagtttccgttggtgatgtagttcgatgttattaagtttgacacaatggtcaggttttcatgcttcaacgctcacatccaccgccatagacctaaggtaacttgaaccatcattgcctcttgtgtctttagaacgatagttttacattctctgtccaagactcctttgtccaataagagaatgctaatttgtttctatgttctggtgatgcagaaatctgttgaaggattttcagaacgagtgatcaaagaagatgggtctaaatcaaaaggattgagctcaattatatttgggagaaacattgcttctgttagtgaaaacagcaagccagccgctgttgagcgtgtctggaaatctgaggaaattaagcccagtggcattcttgagcatggtattgggacgcaccaggtactgcatctcaagaaaagtcaatctcatggaaatgaactatacttggatgggcgggatgccacagagaatggaacagacgatgcatcagatcggattacttctccgaattctcttgaacaacagagtggtattcacgaggcaggcagcagcaagcgtgtagatgaaagtcctaatctgtatcagcaaggtcctcgagcttctgtttctgcttaccagggttcaaatcaagcactctgtgggtctattttctcggttggagatcttcatcatactgataaagacagccgtcaactcgatgatacctccttatatggtgaacagatggacaactcaaacagtcaaacacctcatgattcacctttg

SEQ ID NO: 5260 - DNA, 2251 bp, Unknown
  misc_feature (1)..( 2251): cDNA_ID_2992383_gDNA_ID_1620775_Annot_ID_167707 3000 nt of promoter + ATG
tatatgtgcttgtgttcttcatccacctcctgttagagtctatagaatctagaatctacatgctgatatcacctaatcctgtcaagtatttgcaggcacaaattagcttagatgaacactctgaacaaacattcaaacgctcaagactaatttttgaagagagattcttggaaaaaaggaacacttggcaaacctcgcttgagtgagaactggagttcgtttcctctgatgcttgcgcctcagctttttcgttcgagtaacttccagaattcgaaatgaaaatcaggcaaccgatattagcaacacaaaacttctcttcatgatagccacaaagctaatatgtgcaacactttcaaatacattggataaaaaagattgaagttgaagaaggctcacgttgataatatagtgacccatatgagttcaatacaatctacccaaagaagcctttggtctacagggattacaccgtatgtaaccaagtgtgccaatggccagagtttccagcctgcctgcatagacaaaatcatgacataacctttagataaaatcaacagactaactttaagctttatatatgatcacgaagacacagggcaaggagagttaattacagtgagcattggcaaaaatgttgtcttgatttcgctgaaaatgtcagctggagattggaaacgcaagagccctaaaactgtaaagtagatactgttccaaattgcagaccatacggtttgatcaaatgcgacttttgcagggactacccaccattcttgaaaaggaaagagagccttgtacaaagaaaagattttagctttcagcccgttgttaatacaacatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatg

SEQ ID NO: 5261 - DNA, 3000 bp, Unknown
  misc_feature (1)..( 3000): cDNA_ID_1015303_gDNA_ID_1620775_Annot_ID_167696 3000 nt of promoter + ATG
aaaaaaaaaaaaagaaaaaagcaaataaagaattaagagaaaacatattttgaaatttgaacagcttaatcaaagagaaaaaaaaaaagagaatttataggaagagaaggcataaattattttgagatgttgattagcctcttcgtcgtcggttattctaaactggtttaattaaagaatagtgtaatatttatgattttctgattttctccttcgagaaactatatttgttgtatctgttttgccctaaaaaggctatataagcctactataatgccatatcgtcaaagtttttgttttgttttttgttttcttgttttttacgtgcaagtaacaaatcaccatatcgtcaaagttacttgcacgtaaagatacgagaaccaatagaggaaattatgcagggtttggcggcgaccacagaccgtggctctctgagctatctaatggtgatttggtttatcttcctttgtgttcttcttgagtgcttacgatgcgcaatggctggaagctatcctcagattccaattattagcgatgctgcttacattcataggcgattcagtttggcagattattggcccacggctttgagatttcccaagcctaaaccaagtatttgagatttgagaaaccaaaaaaacactaattatacaaatttggcagattatggatttatcattcatataatgattcttgtttgatgacaaaaaaaaataaataatgattcttgttattaacttattagtattagtttttcattagcaaaaaccggcctaatttgtgataattgggcttttactaacaaaggcccaataaggtggagtgctttcactaaaaccgacctaaataaaatatagccacctcgtcaaaatcaggtagcttcatatttcttgcacgtaaagtttactctgtctcaccgattttgtttttttctttgttttttttttgattttttaatatcgaaaccctaaagcctcgaaggttctctcgccggagaagaaattatgcagggtttggcggcgaccaccaccaaccgtggctctctcaccttcctcgctccgaggtaacataatcaactcatgatttcgtttctccttttcgatctctctctctctggtcttttcgttctccttcttcgattctggagttcctcgttattttgatgatttgtgtcgcatcggttgattcttactagtcttcgatttgctatgatatgttttaatctttcgctctgtactgtttgaatcgtcaatttcaatgaaactcgaatcaatttgcctacaatttctgaaattgaaattgggttagaaatggtgtctcttttgctttaagatttggttactgcgtttctccataggcttttaaaatagatttgatgttgtgtttaccgtttttgataaaccaggaaccatagtccaatttcaaagaaatttgtgaatccaagagtgttctttcccaacgttgattcatccgcaaaattaagattatcagctagctcaatttcacggagatgtccacgagagattgctcctctttcaggtaattatttggtttcaagttttattctttgcttgttctgtaaccatggctttgaggcttgacagctaaatcatgtgctctttgtgattctgcagcaactgcatctgtggactttgcagcagcagcaacatcatccaaccagctctttgctaatggcttgccaccattagctcctggtttgagaagacaccggagaccgatagagcctgcaagagtggctaaagatgacttctttaaaatcaaactgcctaaaatcgcagagagacctgaatggtggtggaggacgttagcttgtgttccttatttgatatccctccaaatatctgatgttggtttctatgtccaaccttttctcgaaaagcacgacgctattggggacatgatatatttcatcccgggagcgataaacagatggccgacatggttcttcatggtgtactgctacttgggttatatgtgggtggtgaagaacaaagagctgcctcattacttgaggtttcacatgatgatgggtatgcttcttgaaacagctcttcaggtcatatggtgcactagcaatttcttcccgctgattcatttcaaaggacggttcggaatgtattattggatggccatcggattcacctacatatgtctgcttctcgaatgcatacggtgcgctcttgctggagtctatgctcagattcctttcatgacagatgctgcttccattcacaccctcttcaacttgggaggttttcagagaccactcaggtgaaaggtgaaaaactggccctttcgggtgttacatactttggaataggaacaagtctcttatcgagtctacacttatatgaatttagtctttttagtgtcagtgtcttatctcatgtgtaacacagaactctctatgagagtagcttataccaatgattttaaagctgaataatccggtcggatttgtccatgatttgaaagtacgcagatcaattcagctctatattgaacgtatctcacatgttgttggattgctttgcgaatttaaatacttcaaacatgcttttgtaatttaattttagtctattggtagactttgtacataactcataaccgccttaaggtccactggtttaattacattgaattttttttcggttaagtgggctccatgattccccacaggacataaaaaagtgatcattattggagaccacgtctctgcaacatggtaccaaccaaatcacaatgtcagtaattttacattccatcttctttacaaagtcttccttggtcttgaaactcttgactggttctaaacacagctcattatatgtctatttagtattttacacattggtttcagacggctcttaaaggtctctctagcttcatgtcaaccatctaaaccaaccaccattaatgttcctctgcccattttcaagaaattagaaatcatttttctctaagttcttgatcgtcgcc

SEQ ID NO: 5262 - DNA, 3000 bp, Unknown
  misc_feature (1)..( 3000): cDNA_ID_3076379_gDNA_ID_1620775_Annot_ID_167691 3000 nt of promoter + ATG
ttagttgcatatggtgccttgttgacagcttggtgttcgtaatggcagggatctatcgtctgattcatgtaatctgtgccacattcaattggccggttttgagatccttgttttactactctttcgttgttttgaaagaattatttcttttttattgtaagctaagaatttgcgaattttgcttgggcatgtgtagttttgtcataatggtttcttcgtttaaataatagttttttttttaatatgtatttatttcttgttagagcatctccaatgcagggctctcttgataatttgagagagttttgttgattttattgattaaaaaataatcaaaactagtcaaatttgagagaaacgactctctaaagagaggttttgggagctgagagagccggacacgtggcactacgtgataggttgattgtttttaacaaaaaggaaaaaaagatcctttttttctttgctcaggacatctcgttcccgatttcgacaaaaagctctatctctcctgaatttttccggtttcgttcagtgtggtgagttaaatcgtctgaaatgtggtgtatgtgattgtaaacgaatttttttaaagattgattgatttatggttgatagtttcggaaattttgttgaatctagtgaatcgatctatttactgtgatgtttgtttctgatgagatcgtttgctgtacttgggaatacagattacagaggaagaaattctcaaggtttctttgatatggagatgaacacttacatgtgctatgatctcttgtacaatgccacttgactgatttgctttgtttggctgattactttgcttggtcttgtatagttgatgtttatgggctatttcagcacttcttagtttatcttgtctcagattttgtgatttttttaatgtcataaattaagaaactttaatggctaatttatttcagattaggagatttcatccataaatggaaaaaccaatttcagtgtttatgttttgagctctcgaatgatcataatcttttgctgcatcagataatgtgattcttgagatgttactggcctttgactgtttgttttcatgaaaactgttttcttttccttgtgtgtgttgtttatgagacttccttgatggtgttttaggctactggtagctcggttgatcacatgacttgctttggagatgcagtggtggagagggatttttatccggagatgattcagtgagaatgtcggtgttgatgccggaattatgattttctccagaggatgctgataggcttgtggcttcgtttagtggtggatggcaaatgagaatgtcacttggaaagaaattgcttcaggtatatgagtaatctgattccttaaagttttatcttttcattgattttgaactgaaagctaatgtgaattgtgtatggctcttatctaggagtacatggcagtgacaacttgaaagatgatcaattattcttcatgtctctcattctttctcaatttatggtaacttatctttgatcattcaatttacaacatctatgtttgattctataattctatttcttccacttttgcctgtaagtcttttttttttttttggtaagccaagggagacaatgtctcccaagattaattaatgaaaaataaaattacattcgcacttaacgtgaaaccgtagctccactagtgtaatccaacaaaataaagcgtaaagaatctggaaccaaactaagcaaatgaaaacctaatggtaacgaaaaggcatagttggctaacccgtcagcaagacggttagcttccctataaacgtgtgaaatacggactctccagtcccttgatatgaagccatggcacaatcgtaccaggaaagacagcggatgtacctcgtttatccctgtcttcaacaaacccacaacaatctctgagtccacctcaatctctagccgtgtgactcgtcgctcccaagcaatgtagaggccatagtacactccccatagctctgccaaaggtgctgaacaaactccaatgttcagagcaaaacctcctctccaagctccttcctcatctcgtagcacaccaccagcagacgctaaacccggattacctctggaagccccatccgtattaagtttccaccaaccttcctcgggtttcgacctgtaagtcttttaatcaaagacacaaacaacatttattcttgttttacaaagatacaaacacacttctaatttttattttttttccaaagaaccccatttgagagaaactaccattgtactatcattttcttctaaaaataaatacaagctctcttcttacaaattttcacaatttatattaaacaatgggagagagccccatgagggactctcaccattggagatgctctaagagagtcattggtgcatagagttaactctacaactatttccatcttattttggtttttgtaaatctattttcatcttgttatcggtttaatgtgaaacccgaatgttgtacgatttaggctttgtgtaaaaagaaattttcacggaagtggacgaaaaaaattttgctctcaccgtttgtcaaagtgagaactggttttcacggtttgtcttttcattcaattttggaccaaattaccctgagaaaacttaataatggcacaaaccaaaccgtgcagcagttcgtatcggttaagttgatggcataaaccaaaccctacagcagttcgtttcggtttagtttatgcggttcagttttgaaaaagacaaaaaaaaaactgaaacgaagaaaccgaagaaaaagaaaaagagaagagagtaacagagagattcgagagagaattagaaagcgaaacgaaattcagtatccattgcttcaaaattcgacataacttcgaattgttgggtagttgaattgagccactgaactcccacaaccggggaaagttactgtttctcccggcgaagccaagagaaagttactgtttattccggcgagatagcaactttagct

SEQ ID NO: 5263 - DNA, 3000 bp, Unknown
  misc_feature (1)..( 3000): cDNA_ID_1808137_gDNA_ID_1620775_Annot_ID_167685 3000 nt of promoter + ATG
ataaattccaatggattaattataatcgggattttataaacaccttgacgtgatccaacatatgtctattctctctcttgctgcattaagattattgaaacacatgcggaccaaattaaaagtattatagaataaatactatgaatacaaggcatatatactaatcaaacatgcagaaccatgatagtgtagcagaaataagactttaatgcagtatttacttatcgaaattatatggaccataaaaagtgtcaatgtgtgaataaaatccagttaagactctaaaatctaaattatgattttaaataacgaattttcaaggttttgaatatgatgcattaattgttgcaaaaagaggacaagaaagataggatgcattggatggagggaaagcctgaaagcactccgcaattaaatttattttcatttctttaaagttttagttatgtttttttttttttttttttatctttataaacattactgtatccttctttcgtaaaaaaaatctatttaaaaaagaacattcgcatgttatgctttttagccattaccaaaatagagccgaccagaaaagtattataagtttataacacaatatacagagtatttataaatcattttcgttggtataaaatgtattttcaacaattttgctttacaaattgatattctgcttgtttgttttatatcaatcatattgatcattttaaaaacactagtcagtactcagtagtcatgtatatttttgtatgtattaaacccatgcactagatcagtagtagatttttttatttttttttcacaccaatcatagttagttttagggtgaatctgctgtataaccaaaatccaatctaaaattaataatataacatcatattcaaaaatattaaaaaattaacaaattagagtagtgaaaagacaaaattattcaacggtgaaagatacgcgctaaagaggacgtgatgagatatgtggaagaagagagagaataatctaatgttataaaaattaatattaccccaaatgattttaattgttgaattagtgatataaaaataactgattaaattttgcaataggtttataaaaacatagatttttttttgagtataacatgattaaaaattttaaaatctaatataaattatttaaaatagtggataatgtttgtataaaacagacaaataaaatagtatagaataaaactaaatagtatagaacaaaacgtagacaatccaaataaccgaattaaaccgctttgatcaaaaaacactataccctaagatacaacattgacaacccaaataaccaaggtaaaccgtagcggtgacgttgacgatggtaagattctgacaattttttttacccattcgttaatcaatagtttaaatagacaaacaaatcgaaatcgaatgaattggtttgtttgtttgtaggataagttaatagaattacataaacattttctgggcaaatcaaagaaattggaatctttaatagactaaacattgatgtcaaggatatgagtgattgtccgttggagattctattgccttggtgatgcaaacggatttaggagagagagagaaagagagagagaggaattgtgacagttcgattgtgaacagtgaggggaagaagaaaagtggagaaaaaatatcgagaaagagagggggagagagaaaatgagaggagaggcaaaggggcaaaattgaaaatagtatatcaaatatagaatatatcatccatcttttttgttgatgtgattttcttaattataatatttttgtgcgttagttctgcaaattctccttagttttaggcaagtttgcaacacttaaactctaataccatctccattggagttttttataagagtttctcacaataaaaaaaaaaaataatgaaaatgacggaaataaagtgtagaaagttaattctgagatactctttacaacccatcatgacatttctcttctcactattggttcaaatttttaacaatttttttttttaaatcaaataattaaattataatataatattattattttttgtctaaaaaactttgtgggtttctcatagatggagatgccgtaaaacatatgagaaaacaaaagataacctctgacaaaaaaaaaattgaaaacagaagataatgttatcaagatgcattattatattggacctaaaacgagattatcaaacaaaatagattggtgcataaagcttgtgcatgttaataataggctacaatcttaaattcttataaggaatataactttttaaaatatgatttttggtaaaaactttaatttaatatttttctttggaaaataacattgggctattaaatttaatagtggtgaaagattcaatgcaagaatggcaccggatatgaggagattttcatatttacgtgcctaattaataatgtgaaactgattagccaattaagaaataaaatttgtattggggattttttttttgtttaaataattaagaataaacaaaaagagagaaagcaaagagacacacatgcaagcacgtgatgagtgcatgtctcgcagagtctcacgccatgcacatttcatcatatcaacttcgttgactccttctcagtatgtctttacctttttcctcttatcaattcaaattattcaatacatgttgatgttttaatttaaatgggctataatgaagtttatcagcccaataaggcccacttatagattggtttattttttaaaatttacaattgttatattggcccgttttaagcccattaagaatcacatcatcaagaaatccaaaatctgaaaagtatgtggctatgtggaagcagaggctggcgcgtgccttatctgcttctctctctccagtggtctcaaatctctctgtgtgatcccacttgtcatcctcctccacaacataaagcttgagaccataaccctttagcgttttcggctaaagctttcgctgactactacaaca

SEQ ID NO: 5264 - DNA, 3000 bp, Unknown
  misc_feature (1)..( 3000): cDNA_ID_2053058_gDNA_ID_1620775_Annot_ID_167681 3000 nt of promoter + ATG
gtggaaagttctagatatgttgcacataaagacgttattcagcatcctcagttcatgagaagctatgggtataataagccttcgggatacttgaaagtgaagggagagagtgagaattttgctatcactgccgtaaagagacaattaggaagacaataccaagaggatggtccacctctgggggttgaatttgatcctcttcctcccggtgcatttgagcctcagactaatcctatagttcacggtgagtcatgataaaatgtttcaactttacctttaattttctggtttatgatgttatgagtattgagtaagtggctcagagaagctaaaaccatcttcttcgtgtgtcagattgtgaatgcctttacccatgtccagtcggatttgattgctttttctatcaactgttttgtcagagccaatatatgttgggaatcagagacggcctcaccttccacatttacttggaacgaggaagagctttaatcctggtcctgtaagtgaacattttctgtatactacatacccatgaagataatataaactagaatcttagtctgccatcacattctttggctaaattatcttactttctttgaagtattattaatattttcgttttctgtcttaatgtctttatagagctatgaattagctcgtaaatcaaagttgcattcgccagatccagattcagaggatgatgagcatgatgatgatgacaacataatggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggtaaagatttgtctaatacttccatgtctacatgttcctttcttgcccttttatggaaatatgacttgtgttttgtgtgatatcttcttttaaaggcaggaatatatcacggggagaggaatcaaatgaaaatgcagagagagaaattgcattcgactgatgaaccaccggtgagtttgatggttaactatcttaaaaatatagatattgatgtatattttaacaaagtttagaggctctatcaagttcgtgttctgacctttaacgaatgttaataggttgccaaacgagtgaaacatgggtatattcagcaagtatatgcaccaaaatcatcatcatacagcgagattcttgaacgaaaaagccagataaatcggttagtaaccaaccattgtgtaatgcatttattgtcccaaagagatatcaaatcggcttattggatcatactgttatgtttgtaggtctggtgtggaactgccttctagtttaagcggggacgatgagactgacgaatctagctcgtcaatggattaagtaaagaaaggtacaaaggaagattaggaaattccggtttgtatagatatatgatgaaaccggtttaggatgtgaaaatgttgcatcgtgtaattggtaaaagttagagctctcttcattttggtaactaaacggtccccaaagagatacagtgagccagtaatgagcctttttttgtttaaatttgctcctaaaccgttaccggtttgaccgaattgagtatgtaaatcccagtgattacaaaataaccaaagtaaggcccatttattaataaagctcaaattaggcccaaaatattatgatagtccggtttagtcgtaaaaggcggttcggaaatgtgtgactaggagatttcgtcacatgagaaaaaatcagagccgttgactagttttcgtagaaagtatgtggtacaattttgattcggccaaaaaaggtttttttctttttcttttagggttagcgttgctttgcctcaaactcaaattttgaagataatttttttggtttctctgctactgatttcgaatctttacgcttaatcaattattcatctggattttcaaatccaatccttttcctccctggtaagaatctctcttcttcttcttcttctctctcacgacgattccactgttctccgattctgtgttagttcctgcgatattttccatcacttgttcgtgtttcgttattacgggtttgtgttttgtgaacttgttgacctttgtgtctccgtaatttcgtccaacggttgatgtttttgattgctgattagatttttgtcggtaggtattgaaaaagatgatctttatggattttgttttctgtttcttctttcctttttgtaatctgacttgcaagctttttgctttttttgtcggtcggtgttaaaaattgttccttttctcttgttcaattgtttcctcaggtgaccaagtaattggggattaacaaagggactggggctttattaagctcgaaacaattgttcttcactctggccgcttctgcaaagtcgtgtgcttctcgcacctctgcgcaggtgtggggtggccttgaagtggtgacttcactctgtcttccaaggatttctctagcttctatcatttggaggctccgtcgtgtttctgagggtcttacccttgattacggctaacatttactacgcccactataccacctcttaagcttttataagaactttttattcgtgcaaaaacttaacttggatcttaattgtttctagtttagttgtggttgtaaagtaaagaaccgtttttttgtggtttggttttgcttttttagtttccgttggtgatgtagttcgatgttattaagtttgacaca

SEQ ID NO: 5265 - DNA, 3000 bp, Unknown; identical to SEQ ID NO: 5240
  misc_feature (1)..( 3000): cDNA_ID_2025218_gDNA_ID_1620775_Annot_ID_167657 3000 nt of promoter + ATG

SEQ ID NO: 5266 - DNA, 3000 bp, Unknown; identical to SEQ ID NO: 5263
  misc_feature (1)..( 3000): cDNA_ID_1808137_gDNA_ID_1620775_Annot_ID_50271 3000 nt of promoter + ATG

SEQ ID NO: 5267 - DNA, 3000 bp, Unknown
  misc_feature (1)..( 3000): cDNA_ID_1828107_gDNA_ID_1620775_Annot_ID_50273 3000 nt of promoter + ATG
atagccctcttagtaaacgccattctccaatatgcatcatataaattaacgcaaacaatgaatctggacgtctaatgtcactttcgtcagagtaaatgggtcgcagtattagaggaatttgaaaaacaattgtgttaagcgtcaccatcacccatacaacaatttaggcatgccatcataaaatttggacagatattgggcttttggttaaattaaatgggctgaggtactgaactaaagtttattaacctaaacttgtacaaatattgggcctttggtttgtttaaatgggtctaaggttcagaaccaaatttggggctttatcattctgattaacaagacaccggcgtgtagtgagcttgtatcagctgcagagtttctctcccgattgacaaagtcgattgagcagtagggtagctttagcatccaataacgtatatcgcaaagaagaggtccaagcaagcgatgatcctcgtcattgttgagtaacgttacaaggtctctgttatcggtttcgaaccaaacataacgcaatccgtgaatccatatcacttgtaaggcatggagaaacccgagaacctccgcgtgtagtgagcttgttgatggatgtagtttcgcacttccacataggattgtatggccgttactctctcgtattatccaaccggaacgtgtataaggacttccttgcataaacccactatcgaagttacatttgcataaacccatatcgaagttacatttaacccagccaacagggggaggttccaactgactgcttcgatttcgtattgagggttgtatatcacttggtgcagcattctcatttgtattttcctagggctcattcacgttaagccactcctctgcttcttgaatacctttcttcgcttcacagtctggagatcgacttttttgttgaaataaaaactcatttcttgatttccagagtcgccacatgatccaaaacggaagatatttatcaagaggattgtttattaacacaccggcgtttgtatcaaaatttgctttttaacaaaacagtaccagtccgttcaaagataaattgttcgtagagaacaaataattagtctttcaacatgttttaatgaaatctcatattatagtcatgttcgtctgataatttgttaacccattctctagataacacaatcaccagagaccaaactgatgcgttaagacatccaatttttgaggtactcaaaaatagttttaataatttttgatgtattatctatcgtagatttctagtatcgacatattggattcacaattgaataagaaaacgtattcaaacaagtaaaaccaaaaaccaaagtgtaagatagtaataaaaagcctcagtcaaaatccatataacttcatagaaattacagtttctgccaaggggttctccctgtaaaacagggtctcagctccactgcacctcgaaattggattatatcatcatcagccaacaaaaagaaatatcactaaaaaaaaaaggctcagaagttttttggtatacagtttcttcgatcaggaattatctgaagcagaactggttttaatcatcactgccctcaatacaaacaaacaaaacaacaaagaagaaactttaagaggctcatattaagaaattcaaccattgattatcgtatatacttcatagaactaagtctcagaagcgcggataattttgtaatcatagcccaaaaacacaaattcatcacagagaataacaaaatctagacattgctttgacacagttaagccggattataaaaagagacagaactgcaacacgaatggcatcaatctagcaggagctttggggcttaattcttcatgaattattatcagactagcccgggaggctcctgcggaaatctatgtaaccagagaccctaaatctatatatcaaaaacaaaactgaagaaccctaaattaaaagctatcgtgaggttgagaatgatttgtatatatgattcaacgcggctattatatagagagtaccctagccctaaaacaccgtctctgaaatgtcgtatctaccctcgttcattgactttcctttccgttgttgtcggtttaatgtaaccgaatgttgtagtatttgggctttgtacaaaagcccatcttcaaatttgacaatacgaaagcccagtgtcaaaactatccccacgtctaattgatttgccttttcgtaatcggtattattgtaaaccggcttggttttcatgatactactattattttttactcgctaattttgtttattccgaaaccctaaaacctgtcgccgtcgaggaaattatggtgacaaccaccgatcgtatctctcttacattcctggcctcaaggttttttctcctctcatcattcattttgcactatttgatttttgtttttatcaccgttttactcatctgcttcttcgttttttctgtgaaatgtgtttttttttcttcgctcgtagaatagagaaagctttaaaagtttaaatccttaattttgttaaaattatatacatgtatgaatttttactagtgtataactagccctgcatagcctttaatgtgttttcgtaaacaaataaagcaggaaccaaagtccatcatatctaaagaaatacttgaaaccaacaagcttatgttgtttctccaactttggttcaccattcccaaaatcaagattgacaataatctcgagtttgcaaagaaagattgttcctcttctaggtaataactactaagttattgtcaatattgaaaacttgtcttgtaatggatgactcttttaattaatttactatactgaatatctgcagatgtggacgttgcatcaccatcacctttcaaccaaatatttgttcatgaccggaggctaacaaagcctgtgagtacactgagagcatctaaagatggaaactcgatcccatcaatagcagcaaacgtattgctaaagagacttttcttgacttttaacataatcattgga

SEQ ID NO: 5268 - DNA, 3000 bp, Unknown; identical to SEQ ID NO: 5261
  misc_feature (1)..( 3000): cDNA_ID_1015303_gDNA_ID_1620775_Annot_ID_50276 3000 nt of promoter + ATG

SEQ ID NO: 5269 - DNA, 3000 bp, Unknown
  misc_feature (1)..( 3000): cDNA_ID_1828099_gDNA_ID_1620775_Annot_ID_50277 3000 nt of promoter + ATG
tacttgagaacatcagagattgaacatttatttactttctggtaacaacattcatgtaaaatccttgccaatttaccagcatctacgtagtgtcacaaaacctcaactataattttacgtactatctaaaggttgtgcttggttttgacctcaaactttgctttaaagctcatctttttgcgattcttgaacgcgttgctttgctcatcccaatagttagggaacttcaacctcgcaacagcgtgtggcataaatcagtcagtcatcgtattcgtaggtaaagctgttgaagaattaaaacgcttccgtatgattagtaaaaggcacactcactgactcacatcttatatctgaaagcaatatttttttcccccaaaacgatcacaaagtctgatgaatgaaaccctatatttcaatatttttttgtagctactgctttgatgttcattgtccaatggattttctcccattttctggtaagattttgaactcttatgcgttttaattttgattccttactatctctgcagcattggtcgtttttgaaggacttgtcctcttacgttttctaaaaggataaaagagcatgtcttcgttctcagttaggttcttcaactagatttaagtcatcatatttgattcaatttagaactaaacaaggtttttctgtgataaaattccaaagttaacttcttttatttagcaattggagtttgtaattttcgttgaatttgcctcagttctgctacaaaacctctattgggtccattttgttttcgggttttgaagactcttgagtttctgaaattctggtaatcttgtaaaccttgaaatgattttggtcaatttcttcactatgtcatgtgtttatgtgtacaaatgagcaagactttaatgttggtttgatcagtaaatgaattgctgatgatgattgtttagtattcaaaaagtctagaacaagcaagagttatcttcattatgatactaaaggtattattattactagtccgaagaaaggttctctttttttgaatgcccattttgtgcaacttcttaaagattattatagatcaactgtttagttcaaagaagtctaaaaaaaatcacaatgaaaattgaagatgaagaaagattttcactttctcaacagagtagtatagcaaatcgtttttcatcaaattcaattcttttgagtgaaagatcaatatagtaatcataaagattctgtttttacaatgcccatttctctatgacatcgaatgagactgagagaaatatcaaaggtttgacattagaacagtaacactcatcactcagaaacacaagaagaaaacgtagctgaaagaaccgcgagagggacagagctaaaagatgaagatagagaggaagatcgattatgttctaagcttcataactagtaccatttctccttgtaaagaagcagaaaacaaacaatggagctgagagatgagggagattcagggtttggtcgaaagaacaatggagtataggtttggttgatttagggatgccacgtgtacttcatcagtttctctcgtctgttggtttcacctttccagtcttcttttttagttattataatacaattatcaaaaaaactactagcttcttatgagtctgagaatgtggtttagccttatgagtcaggttaactggaggaagtcaagatacctgctgacctgggaccaataagcagaacgaagaagtgccaagtctagctctaatgatgcactacccggagctaattgagcagatgttgactacaacaccaagttggccatgacctgttgttgtaaatcagagctatttcaaccagcaaacaccacttaggcttccccataaatatgtggttaaagcttaatcaacgacaattgatgcaacttcagtctcagggggttaatgctggactatcttctgaccaatgtccaagagtagcagagcagttgagatgattttcgactttggtttttactctcacaaaacataattttgatatatgtaaatggatatgctgatgactgtttattcaagatctagttcaagtttggaagaacgaaaagttatattctaaacagttattgattagcaaacttttcttcacagttcattatttctcttgatcgttgtccactttcgtgtaatacacattcgtcatgcgcgcgtgagatatggtcgattcaacaacggtcacgcgcctttttgcgtgtcagagactttcagcttcaacgtttttcgttaaagagactattcaacgttaagctaatcccattattaaagaaaaaaaaaccatatgataaaataattaatcagattgattttgccaacaatttaagttaaaaccctgaattttaaaaactaatcactttttggattctcaacgcttctgtttctcatttcttctctcttcagagtccactccgaatctaatccatttatgttttgttcttcgaagaaattgacatctttctctctttgtgtctccctcattaactttgtttttgtccaaggacaactctgccctaattttacgctcctgccgtaatttcattcagcagcatctgtcttagtccaaggacttgtcttgttatgtttttttgaaagacacaaagacttaaactttaagcatctgttgattgttcggttcttgaaactccgatttaagtcattagatctgacttagcttaagactaatcaagcttttttagctgacatgccaaaagcaataaacagtagcaaaaaaaaactgttccttttattcggttggtgcattggttgttggtgttcttatcaactttcttcttctattaattagcttttggtttgggtttttgtcatttttgttctagttgcctctattctgaaaactctgcagcaacaatctctatctggtaatttatctttatttgtacaaaagattaagattttgattagctggttaggtgttcaagagaaagttttgatctttttttgggggggatg

SEQ ID NO: 5270 - DNA, 3000 bp, Unknown
  misc_feature (1)..( 3000): cDNA_ID_1828083_gDNA_ID_1620775_Annot_ID_50282 3000 nt of promoter + ATG
aaacaatggagttactaaattttggtatttcgaaaattagaaaatcgtttctttttcagtttatatgattatgagacatcgacaacaccagcttaaaccaaggatacaaatcccgatagtctttacaagttgttataaaggtaagtggaaaagaatgtttgttagtaagtactaagtagttaagaacttaagattactatatagtgcatgcataagtcattcacaacttcataaaattgcattgatttagcatacaaactagattttttcttcgcattgttttttttttcttttctttgcattgttccactataagcttaaggtgaaataaccatacaatagtcaatactcaatagtgtggggtggcataaagttgttggtcgagagatcatgtcacaagtataactatacataattttgataagggccatataacacgattgaaaaatgaagaatgcatgataaaaggaaaaagaagtggcataattttgataaaaatcaaacaataaaaacatttattagatgtctcaaagaagcattaaaaggcaaaggcagagagagagacaagtgggctaaattgaattgatagaatacaaaatggaaaagaaaacatttattagatgttgaataatgttgaattgatgttgagggagtgatggcgcatactgttactgttaactaagagtgtgtggcacacatttttcttgcttttacattctaaccagatgaattcttgtcaacagtatcattcatgtttacatgtactattagtgcatgcattacatttaaatatataaatgcacatacatgcatactcgtaaatttacctatgactcgtctaattggagaaaaggctccgtttgggcttttaccctgtccaacgtaggctaggcctaaaaaatgacccaatctttagaactcggtgagatttctcttagtattttttttttgaaatctcgttataaattccgaaactttattagagcaaaaagtaggtatcagagcgttgagtatatttccaaccaaattaaaaacagaacaaacacgtttcttaatttgaaaatctgaggctaattttatcaaacatgcatggcaggtatagagaaagtatacacacaaatactgaaatgctcaaatgcatgtatacgaaccaaaaaaatcatttttttttttgtaatatcatacacactatgatcactaatactcatgagccatttagcaaccaaaaaacttacatgaaaaaagttagaatctcgtgatcgtatttttctacccatgcaagcgacaaaacattattcaaacgtgtgaagtgtaatattcgtaaatgctttaaaatttaccaaccaagatccaaaaatatgtctaattctgaaaaaaaaaattagaccaatcaagaatatttttgatcatcttgtttaataccgcacaccgtctaaaaacgaacacattttgcatgtaaaggtgagaggtcaaaaatatgtttgtcgaatatccccaaattagaaacatctagatatttgttaacatataacttctttaacgattgaacagaactataccatctcactaatcgatgtatctgaatattctttttaattttttccccagcaaaactccaagattggttattttttttccacacacatcacattccaacggtccataatcaaccaagcaaaaaatatcagaggatttgtttgttggcccatccatcatccatctctccatgtgggtaacaacaatgtaagcgaaattattataaagttttcatcaatagagttagaaaaggaaaaaaatgtggagaaagatcaaaaactaaaacacataacaaccttataagaagatcactataatcatacaaagattgcaatgttatcaacaatacattgttttcttaacctatgattaaagttagtcagactaatgagaagtggatgaggagctgacgtggaagtgagtgacgtcatctgacagtgaagaacacgtgacactcgccagcaagaaaacagtaatgggaatccaattccaactaatctttttccttgcggctaattttgtcttttaccgttaccatttcaacgtcttttcaccgtctctcctccacgcgcgtaccattcaaccttttatcttaaccagcggtttagacccggttaacaccgattaaactgagacatcgtccggtataactaacatccaattattctcgttatcgtccttaaaattgacaactattattgaaacaagtctttggtcggattagaatcttgacgcaacttgtcctcaaacataatatagggatacagttgtacacatccattaagttaaatcattgattaattaagtagactttatcattaattatgactttttagtactgatctcaagcaaatagaagcatcagtcaaatttttgtttctaaataaacaaatctataaacacagtttcagtaatgaagaacttaaactctgtcttaaacccaaataatttctgaatttctccagttctttcttcttaatttgcaggttttggtcccaccgcttaaattaggaaaaagtttcctttttcgttctgggttttcttctctgattattatgattcattcctcgagtgtcgagctttattctcaagtgtcaaattattgagggtaaaatttacttcaacgacgaaagttcattgaaccttagctcttacgttgcgtcttaaatctcattctcacccacaaaaaaagaaaagtttgcattttttttatctctcaggattgggtttttgggaatttaaaggaaaagactttacccttttattcgttttaatttcaccaacccattaaagctcgttgatgacgattcctctgcttttccagtaagttttttgtaatctttcctcttctcaagattgctacttgtttaattcctcccttatggatcttgtcgctttcagattcgtggacatcgttttgttcgattgatgtttcgttttactctactctgacttggaacaatg

SEQ ID NO: 5271 - DNA, 3000 bp, Unknown
  misc_feature (1)..( 3000): cDNA_ID_2992383_gDNA_ID_1620775_Annot_ID_50283 3000 nt of promoter + ATG
aacatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatggttggaatggtagaggagggtttaggcgtaaggtaagagaaaatgggattgaacccaatttgcatacttcaaattctctggtgagcttgatgtttcattgatttgacaaagcatgtatttgagattgtgggcagttgcaggatcagactacatgttacttacaacaggcatgatcaaggagtattgtaaggtagggtagagaaatgatatgacaatgatgcaggttttgagtattgcctagctttgtatcaagatttggatgagaagtgactttcaggcttgtagtttagtgattggagattctgcaagaagggaaaattacatgaaggttatgtggtttttctgcaatatgattcgttaaggaggccaagccaaatgtagtcaaatacaccacgttaatgattcatccgtatggggacagcttagatttttctgtgtgttgcatccaaagatgtactgtgtacccaaattccgagttcaccaaccagggatgaatgatactgtgtacctaaattccaaagatgtactgtgtaccctaacagttttcgtctggttaggagataatcacttcttgaaagcagtttgaatgtttctcaaagaatggtcatgtactacccacgttttttgtttggttatcttggaggtaagatgagctggtgacaattctgtttttggcttatactaagattaacgtggagctagtcctttgctttacggagctttgataagatgttttaggatttaattacccatcaagaagataatgagggagaaaaaggctaaagagattcattcgacttgcaaaaccatggttggaattttgtgcacatagtgattgaggagagagatagaaagtgaagggactttaaatgttagacccgttgaaactagtggtgggcctgtgaaggttgaggttgagggaagagccagcctgcccaaaagaaaaaatatcttgtgcaacttgtgatgcttggtagctttggtcctacatgcttatccagatatttgcagagaaagaaacatcaaaaggttagccacattataggaagaactaaaattttctaatgctattttgctcaaataggtgtttgagagctctgttcatttaataatgtccatatttgtggctatgttcactgaattattaacagggaaagcagttgaaagatagctaacatgatgtaggggttttggtttttaggaggcaaagaggctttcatgggaccacactggatgatagttgcaaaatacattgtggttaaggtttgtctcttgagcacatgttgagactgggatactcttctgtgagaacgcattaatagctgtattaagtgttgatagaatttgtggacggtaattcccgtgacatttatggaggtatctgtgatgtttttcctattaaaaagacaaataaggagacccaaaaaaggtgagaacaactatacacacaaagaaatttcttttgtctgaagacaaagggagtggtcaatgaccagtactcccctatatgttgggttaggacttctactcattttgcatcgttgagatactatactgccttgaaagacttggtattggatg

SEQ ID NO: 5272 - DNA, 3000 bp, Unknown
  misc_feature (1)..( 3000): cDNA_ID_1977521_gDNA_ID_1620776_Annot_ID_50291 3000 nt of promoter + ATG
agcttttttggcttttgagttttaaaaaaaaaagtgtttaaatttcatttgtaactgatcgattttgtcacttctgtgtagattagaggttaaacgattttgattgtaaaggcaacaatgtaatctttttctttttgttgataaaaagtttgtgcattgcatttgcagataatttttttgtagaatttaatctatttttctaatacattaaaaaaaaagcagtgtgagactctttctaaacgaattatatttaacgatcgagattagtttttagtcctgagatcagtgatcaatttaggagagttgactacaatttcaattttacttttgtaattagtgggccttattgttagcccattatatgcttataatgtggttttctgaatacgggggaaattaaagttgactttaactctagacctggtttaggccctctaagaacttgtaacggcccaattagattgctatatattcacgattgtgcagttggaaatattaaaaccaaaaaaaaaaaatagaaaggcgggaaagagagttagttacatcgtcttctccggcgagacaagacgactgcgattggatttctctgaagcgcaggtatataagtgatagatcaccattgatactcttcaagaagatcccattcaattcaagctttatcgagtaagatctttattttattccatggaaaccgatttgagatttacacgaatgatccaaatacgtctcatatcatgcgatttcaagacgaaaatggcgtagttttattcaatcgaaggcaattttgaagatatcaaaaagatcgatgcttcaattgcttgatctctaacgtgtcagtttctttctttttgttcagcgacgatccttcttcagtggccatggtttctggagatacaaaatcggatgcgaacaacgttacttatgggttcgtgaacttttgtatttcccaaagccaattttgtggaaatgagagagatcgatcgatgcttaaagctctgcttcaactaataatgtcaatttctttctctttttttcagagaccttccttcttctccagcggctacggattcttcagaaccttcttcctatgcgttagtgaattttattgtattctttagaaccaatcttttagaattgatctttgcttttctggttatgttttgattgatttgttatctcattttcagtgaacagcttgaaaggctcatgatgatagattcagaagaagaccggggtccctctgggtttgtgaccttctcgattctttaaccaccaatctttgttttctctggtctatctatgttttgatattactctttttttgttggttttgtttcaggtttacgactgatgaattgatctttcaggctttagaaacagtctacgagaatcataatggtcttgatgtcgatgcgattttcacttttatcaaggttaggaggatctctctgtctctataagtatctgtgtttcatggtcatatctcatgagtagtgtatattggttctgaaatgtgagtcaatagcgggattacacaatggaacattaggatctgaaaatttgacttcatgttccatcccctaaaagtcttccttttaaagtcttggttttgttgattcctccgttgttcttgatcaactaaccatcatgttcttgtggttaatataaattgcaggaaaggaacgagttacaggaagattttagggagcggttggaaaaccagctgagatatctagtttctgaaggccaagtatacaaggtaactagtttttcagagttgcctcacactaatgttaagattcagtagttttgtttgatcagttcagaaaaacggaaaaaaaaacttgtaaatgcaggtaggaaacctctacaagatcccccgtggtgtatttgatactccagttgtgtcagtaggagattcaaatcaaagagaaaccatggatccagaagattccacgggcacaaaggcacaagacacaccaagtacttgtgcttctttcgcaccaccaacaacagaagtagatcctcggataatcgcattagcaaaagaagtcgcagaggcagaacacttggagttggaagcaaaagaggcatacgaacttgcagataaacacgcccagttgctaaaattagaaagcaacataaccttgcagttagccgtagaaatccttaatcgatgtaagtaatgtccacctcttaaccttttatcatcatcatcatcactgactttttcatttgatttggtccttgcaggtgctaacggtgaaaagattttcctgctgtaaaagctttgaccttctggtccggttcaaggtggatatattcgatcaccggtttctttttagtgtttttggttttgagtaaaaaaaagagtgtagatatgaaatgtgatttcatttgactaactagtcatagtttgttactttgtggttaaatgattttggttgtgaaggcaacagactattctgttagtttttgttaatacaagtttttacagataatgccaatcttaagaattgaataggtttttctaatacataacataagaaagaaaaaaagaaagtgtgtcatggtgtctttagcaagtatttttaacggtcgagattaatttcaaatactgatcaagaaagaaaaaaattagttatgagaattacaattttataatgggcctcattgtaagcccattataagcttacataggacttttatgagtttttgttctcagtctgtccctttaattgttttttggctcttctatcgcccatcgcttgggagattaaagtctgaactttttgatctcaagcttctccatctctccctcaactcaagctcctggttcggaactatttactttcctatgcgattggttgtttataagttgatttcagagttcggattcttgtactcattagatgtccatataggtcttgtttactggtttaattggggttttatcaaggaaataaagagtgtttagggtttgaatttccgtgtttgcag

SEQ ID NO: 5273 - DNA, 3000 bp, Unknown
  misc_feature (1)..( 3000): cDNA_ID_2161790_gDNA_ID_1620776_Annot_ID_167753 3000 nt of promoter + ATG
cccttcctttctggttgttggcaaacaatccggaacttaaagtattacagttgcaggataatttatttaccatcttccagatgcctgctacaatagtgcatgagttgcagttcttggatttttcagtgaatgatattagtggactgctccctgataatatcggttatgcgcttccgaatctgttacgaatgaacggctcaagaaatgggtttcaagggcatttaccatcttctatgggtgagatggtaaacattacatcccttgatctatcttataataacttctccgggaagctacctagacgctttgtcactggttgtttttcactaaaacacttgaagctctcccacaacaattttagtggccattttcttccaagagaaacaagctttacttccctggaagagttgagagttgatagcaactcattcactgggaagatcggagttggtttgcttagctccaacactacgttatcagttcttgacatgtccaacaattttctaacgggtgatattccaagctggatgtctaacttatctggtttaactatcttgtcgatatcaaacaattttttagaaggtacgataccaccatctttgctagccattggctttctttctctcatcgacctatcgggaaacttattatctggatccttaccgtcacgtgttggtggggagtttgggataaaattgttcctacacgacaacatgctcacggggccgattccagacacgttgttggaaaaggtccaaatacttgatttacggtacaatcaactttctgggagtattccacaatttgtcaataccgagagcatatatattcttttaatgaagggaaacaacttaacaggatctatgtcaaggcagctctgtgatttgagaaatatcagacttttagatctttcagataacaagctcaatggcttcataccttcatgtctatataatttatcatttggaccagaggatacaaattcatatgtaggtacagccataacgaagattactccgttcaagttttacgaatccacatttgtggtagaggattttgtggtaatatcctctagttttcaagaaattgaaatcaaattttcaatgaagcgaaggtatgattcttattttggagcaactgaattcaacaatgacgtacttgattatatgtatggaatggacctatcaagcaatgagttaagtggggttatcccagcagagcttggaagtctctcaaagctacgagtcatgaatttatcttgcaacttcttgtccagttcaataccatctagcttctccaatctcaaggatattgagagccttgacctttcgcataacatgttacaaggaagtattcctcaacaactaaccaacctttcttctcttgttgtctttgatgtgtcttacaataatttatccggaatcattccccaaggaaggcagtttaatacctttgacgagaaaagctacttgggaaatcctcttctttgtggaccaccgaccaatagaagttgtgatgctaagaagacctcagatgaatcagaaaatggaggagaagaagaagatgatgaagctcctgttgatatgttggccttctattttagtagtgcttcgacttatgtaactacattgataggcatttttatacttatgtgctttgattgtcctttgcgtcgagcatggctccgcattgtcgatgcttccatcgcctcagtcaaaagtatgttgccttaaaatcatttcacttcagtttttacgtaccattgtgtttctataactatattgctttggattttacctgacatggttaataataatgtgtgctttggattttaccatacacggtaatgagtcgtatggaagaattattgtgtacgatcgatagttttttttgacagatttattcttttagtgatagagaaaaaagtaagtaacaatttttttttaagagatatatatttggtaacgacagagctgtttctttcaatggatttatttttcatagcgacatagttaatgtaacaaattaatgactaaagtagcacaacattgactctagacttattctacgtcctagtaaatttgttaattaatggaatcaacttttagaaatagttgtgacatagtaagtccgtattggctgtgatagacttgagtctgattgaaatgggaaaacgttgatatgaaagtggtgacaaacttaatatcaccaaactaaattactaactctctcataactatgaatataactgtcacaattacaagtataactctatcataactcataactatatatggttaaatgagtatgtaactaactatagttcacaagggtaatatatatagtaaattcttgattgctagatgcaggagggtaaacttgaactttgttgtggtatctagatactttcggacaaataacgtataggtgatgaaacaaagtgcatatcttattgtacagttttagactttaatttggataaccctactcattgccaaggttattatcgtttagggatatgattttgcaaagataattctcccaatagaaacttaggaacttgccgagttctaaatttctaatgaagaaaaccatatctcataaaatttaagaatttgtggcttattgtgttaagttactaaatcctagagatgaatgcttagtttggtaataaaaaccaagaaaatctcattacgtcactttgagaccacaactaaacccgtttgaacaaagtgggtaaagtaaatccggcccaataaagcccatttatttccaagagaataataattagaaaccggagagacttcacggatagggtaaaaaagaactcagaggttaatcggaaaaataaatatttggggtgaagagaagcttcttctgctcaatcatgtctaacaactttggtgacagctaaagaaaaactaagttagaagaatatttagataaccttcaagctcgagaccactcggatctctctctaatcgccgatcggaatccgcc

SEQ ID NO: 5274 - DNA, 3000 bp, Unknown
  misc_feature (1)..( 3000): cDNA_ID_2161757_gDNA_ID_1620776_Annot_ID_167743 3000 nt of promoter + ATG
aagacaggagaaccgtgcatctatctttgtttgttatgtttctgttttcttgtcatgaaaattatgctcatgtatcttatctaaatcaaaaataataatttgatgaatcataacttgtaagacttgttatttaattttaacttgggatctatgtttctttagaagatcaaaacttttatctgttgaaaaaaagtgagaagatcaaaacttgttgataaacatatatagatgataggtttcacgtatactaaaagagtaaaaaaaattttttttaacaatacatacaccattcagtaaatgaacttaaatgattgtcaaatgataatagatgtttgagaagaaaaaaacaattaaaaaaagtttgatgtttgaccaaagcgaaattattttttttctttagaaagaaaacttgttttcatgacaatggccttctacaagaaaaagtatttgttagtgtttgctctcaataatgttttccgaaacattaatcagttttctgaaaactaaaagtttatcatcaaaagaaaaagtaaaaagtaaaaataaaaccaaaagtttatatattccttttttgttgttgtcaaataatagaatccaatgccaaaaacataagcaaaccgacatgagtttttttttctcaatctctgattcaaaacctaacgttgcttctttcacagtggttggaattgattatttcaaccaccaaaaataagattctaccattttcaataaatgaattgtcaactagtttgaggctttgagcggttcgtttacagacgagcttttataaatgaaaccaatcatacattcatagcaattatctaaatcgcttatcctattagtcgatatttcaattcaaaaaagaaattctatttgtaattcttaacacacaaatattgaaccaattacgaaaagactatttaaaaaatatatatcattagtttttttttttcgtcaaatatatatatcattagttaaatttaacttttttaactactatcttaaatatatatttttttttacttccgtcacaattatataataataactcaagaaggacaatttatacttatttagttttaatgaagaaataacttatgtaaagtgaaacataatgaatatatgtatacatcataccaataatgcaaatacatggtcttattaaaacttgatcacacaggtgatgccataaaatattggtacgctttaacaactcctaaaactgcagcagccacaaccaccacagcggccacaccctcaactactgtcttcctccatagtctttgcttcaatgagccaaacttactataaaattcgcttgaacagtttgcaacatttctcataccctcatctgttttaggggtttgatgttgtggcgtggctcccttcaaagaaactgagagaccagctgctatagggattgtctttggcatcgtcacatacaaaactcccttagagaactttgcacgaatctcatttcttttacaatcttttgcaacttttgtttctttcatgaacctgattgttttggtttggtccactggacagcctcctgttattgttagtacaccactgttgttgatctgtattttaagatgctctttcttcaaacctacaccaattccacttttcattgataaataactatactctttagttctttcttttttttctacaaccacacattgaattaaacaaccggtctagctagagatccatacggggaaaatattctttacatattactcatctaaattcgtagacctagcactactggccaaaaggtccgtttggacatttaaacaacgtggagccaaagagagtttgagaagcaaaagtagcaatgtggaatcaaagtatactttacaatggttggagaaatagagaaacaaagtagcaatgtggaagcaaagtataatcaaagcttttaacaattctctcgtgctgtgctatatttcggttggaaaagatatatatatatatatatatatatatatatatatatatatatcaaacaaagtgcaatgcagacttacaatgctatatatatatatatatatatatatatatatatgtatatatagtaaactaagaaaagaactactatgtattattttttattttttttgttataaatttattgtaggaaataattgttgtacctgaaggaagatgtagctcaagaatgtcgatgtcttccgttcttctccatcgacaaaagggttcgatttcatcgtaaaagtgtgtctgtgaaccttccatatttactgccatttcgttaaaaatttcaatgaacacgaaaaataaacaaaaatatattactgaaaatctctctcttgttttcaatttgttggaaatcaatattgcctggtgattgtgatgatgacccatctaattgcttctatttatataatttgttctgtgcatgcagtttcttcttggatctcctatgtactgaatgattcgtttattacccttaaagatttgctttaaaaattaatttatttcactctttcgagtttatatagtttgttgtatcttgtgaaattggtgtttcatcacatgcacatatcttcgtctatgtggttccaaatattcttttgttctttttattttaccatgcattgctttattacttacacataatgacaattttgctggtcattgattagaacatcgttttaatatcgaatgggatgtcgagttgaatattttgacaacgttcgttggctgggtcatgaatgaagtcagaataccatttctttttcattaaacaatgctatttttttcccgcaaaacaatgctattgggctcattttgggcttaaaatgttttgcgtaatctcaatgtttgtggggcttttagtttttagcccatgtatggtttgataactttagtaactcgtgagaaaaaaaaaagcttcgttctcaatcccaattcgaaatcctagctgaagtctatgctccataatcaaatccagttcatcagagatcaaagatg

SEQ ID NO: 5275 - DNA, 3000 bp, Unknown
  misc_feature (1)..( 3000): cDNA_ID_3076415_gDNA_ID_1620776_Annot_ID_167742 3000 nt of promoter + ATG
gttttgttaatatgtgtgtcaaaattgatcgattgaggttattaagttcgtaattgattgagcatgtatccttacggcaagagtcaatctcttgtgtggaatccttgtatacgtcttgttttatcaataaaagggtcacatgtgcttataactcttttaaacttcctcttgaacaaccccttaagggttggtaaaaacatgcgtttcacctgcataaactttagtcagtgcacatcgattagtgtcaagcttcagagacacataaaatgtttatcttcagtcttgtcaaatcattagtggcattactttcatttttctatcgtggtcatatgataaacttttcaatgatgcattgatgaagtagttaaacgttttcagtattggcgttctctgtatttatcatgtttgttcttctctatcagagggaaaaattccaccagacgagccctctgttcttcctccactacctatagttcctaaagcggaaaagcgtaagtccttctatggcacacctcagcccaagaagattgattatagagatagagactgggatcgtgacagggattttgagctcatgcctcctccaggaagcaatcggaaagaccttatgccaattgaagagcagccaatcgatccaaacgaaccaacttactgtgtctgccatcaggtcctgaatacataaattttgcaaaatctgtaagttgcctgatcctgttgtgatctttggttaacattttcgttatttgtttcaggtgtcctttggagacatgattgcctgtgacaatgagaatgtgagcctgctctcccagcatcttattatttattttttaatgtatagctgttatgatgaaaccttttgttcctgtttcgacagtgccaaggaggtgaatggtttcactatacatgcgttggcctcacacctgagaccagattcaaagggaaatggtactgccccacctgcagactcctcccacagtcacactaatatcatttgtacctgtgagaaggtattgctttactatcatcagaactaagctctcctcctgcaatttccatgcattctgtagctaatataatacgtatggagatttgcacgtacttatgatattaattctcataggtgccactggcatcttctttggcaccttcccttcatgaccaatgccaccaaactcatctttcttgttacccaacatctagcaagtgcaagtagaagcaaactttagatggagaaatcatcatgttttgtaaacctcgggttaattcgtggagcatatattttgtatatcaattgtatttgggtattggtgggcattttccgttttattctactagtatcgatatttacatctgcttctttctttcttttttcccctcaaaccatgagcctttgtattgatcaaatgacatgtacaaaggttttgttcatcagaaggaatttcactaaaataaaaaattgcttgatattttattcttgctgtttatatatgaaaaaagagaatccattgtgagcagctggtttgatgtgtctagatcgatagagggtgtacatatatcagtgctagataagttagttactcccttagtttgagaagtactacttgttttgactctattaaggaatactgatattattgtagtttagagaggagagatgcttcacagaacagacccacttctgcttcagaggcaatgctgtgtttgggactagtaaactaaacttctacaaggccaaatcgattcctaaacatatgtcaaaatggatccattagattagtcctttttagccttaaaaccattagtacagtataaaatttgtggtcgatctgtaatcatcctcttagtataataatctcaaactcaaatataataacaccacagtagcatttatttgttcacggatattcacacaccgtctcaactaaaataatttgaaaatgcagatcactagatctagagacttgagaatgggacccaatgcaacaatatagagcggtgagatttcgaatagagagatttgaatttaaaaatctccgatctattttttgttaaacacgagaaaatataattatttaataaataaaaaaagacaaaaagattcatattacaacagatggcgacaactgacattgaaaaagacaaaacagcttcaaacaaaataaagaagaagcagacacatacatacacaaacaaaaaaaaactaaaccccaaacattttttgaaaaatgtgttatctgttgaaccgcgggatttttcatttgtaaggtttccgccacacactttttgattttctcattccaaggtttcactttgctacttcacatcgatttcatttgcttttgaattctccaaaggtttcatctttgtacggtcaaaccaaataattagctgagagctcccagtataagaagcaggtacggatctgttctgagattcatggttctgtaatttttgctattatctcgtgaagttgtctgggtctcagttttctcgtattggatgtctttatttctggtctgaatcgagtctgcaagaatgagatttgaaaatgtagcttaaagtattttgactttaagcagaaatcttacgattttagtgtgatatttccttctgttgtgcagttggaataattgttttgtcttgaaatttttgctattttctcgtgtagttgtctgatttggagttagttgtctggttctcattttcctcgtatatgagtctttatttctggtctgaatcaaacttgcaaacatgaaatttgaaaatgtaggttaaagtttatgactttaagaataaactctatgctgttggtgttatttgtcttgtgtgttgcagttgaaaattagctgtctggttcccaattatctcgtatacggtgtttattggtttcaatcgagtttgcaaggctgagatttgaaatatagctaaagtttatgactttaagaagtagccttatgttgttggtgtgattttttcttgtgtggtgcaggttgagtaatg

SEQ ID NO: 5276 - DNA, 3000 bp, Unknown
  misc_feature (1)..( 3000): cDNA_ID_3076419_gDNA_ID_1620776_Annot_ID_167741 3000 nt of promoter + ATG
ataactttaggtgtatcaaatttagatagataggtctaagaaataggagtaaatatgttgcacttttccgggttttgtggtgttttctttctcaaatgggtcatcacatacaaatccagtctgctttagtatcagtgagtttcggcagtggtttttcctattaaacaacttcaatggtttcttgttgctaagcatctttttcatggtttggatgtctgtctgttttcctgctcgagagctcttttcgtgtttcttgatctgttcttcatttttaattcttccgtcagttcgagtacataacttgtcgttttgataggggcctcttattttcttttccacaggtcccatatctgctgtaccaagacgtaactgtgtgaatatatttgtacattgagctgtcagctgaagagatttgtcaaagtccatttttcaccaattttctcgtttcttagacacaatacaagtccctttttttctttcttttttctatgagctaacagcctaatacctcatacattcattctgtatatagattgttttgttcaggttataaaggacataggagtttcttttggttcaaattatatagggccattagtctttggctaaagttgtacatgttcatacattttcaataaaaatagtgcattcacactcagaaccttaaagttattatgtattttgatggacttatttcttctctgtttctatgcacgctcatttctgttgtgtttagaaatccttttgtttgttcctgttacttaccttgtatgattatttcttcagaagaaaatttggggactgaagaaggaacggaggaccctgaagactacactgacgataatgatgattacaatagcattttgagacctgcgtttgaagtagatggagaacctgattttagtactggaccaccagaagatgggcttgaatatttaagacgagtcaggtatattatctctctgtttccatctttctgtgtctttacacttttaaacttttggtattatggttaagttgttttgtttcctcaatttaggtgggaggctaagggaattccgaatgtaagagtagccaagatagatgaaagcacgtacataaagaaagagcaaagtgtttatatgccactaattcctgaaatccccaaatgtccagagtacctgttacccatgaaggaatgggaggactcgttgcttttggactttgtacaccttcgccaggtattttttcctgatatttcatctgacttacatggttggttaatagcagtctctctcttaatagacgaaaatgaaagtaagtgttgttatttttacagactctaacacaaagtgccaacagctgtgaggatgagataatatcaagtcagtgtgtagaagatttgcttgtggagatgttcaataagcatctccacacagaggaggatgagtcttttggtgaggtggtaacagacatacaaggaatggactcggtgacgcgggtatcaaagctgaaaaagcgtatatgtttggttgagaaggagagcggtttacagagtagcgattgcaaatgggtagtagcgttgtgtgcatcattggagactcctttggatgccgatacttgtgcttgtctaaggggtcttctgaggaagtgtgctagtgttcgtgcagagacatcattagaggttggagatgaagaagttatcaccatggcaaatatgctcatcaccatcgccggcagatactttggccaaatgggacagtaataagtgaagaagagagtggacatgacatgcccttacttttctctcatatgtgcttttgaatcttacatgagctttaatgccattttttgtagtgtcccctttgttatgtcatctgtgatgttcggaatcatcgtatttgtgcgaagtaagctctttttttttgggatcttgttgaggttattgagatcttcacaacttccgtggatcggctagatagagtcttcttatcataccgagttctatcattgtcattgttgaaggaaattacaagaactacgttgctgtagtggtttcaatttgttacaattcagtttaagtgctctttgtttcttcttcgtttggatattgcaccaaatagtagtcagatactacgtttggatgcaatctttgatattattgttacaaagaaaaaaagaataaagaaaaacatgtaatacatatgtaatatacttcgaaacatatgtaattttgcagttcccaaaacaatgttctttttgtttttgacatggtaatatgaaattacttttataaacagatgtttcaaataatatttgcgaattttaatatttttggttacagaattagtttgtacgagtatgttagttctatcttaattattaataatttaatagataatcatattttatcataacagaaatattttgttttataatttagatgataaccaatttgaattactgatgacagaaaaaatagcagtttgaattactcatccaagaaaatactagtacttaaaagacatgtaattattagattaatttagtttaacgcattcagaccaataagtagataatcttactacatactgcagccggcctgaagaacctatgcattatttaagctattgcttataagaaaaattaactgtgattatgttattatctactggtctaataatgttgtataatgctcagtttggtggacattggtttcactctcgtctattgatttcaagatgttacattgtatgttggttgtcctgtgattcatatccgtgtaccagtaaaaactcaaaaatcctcttaaacacacagagagacatggtgacgataaaacgacggcgtatttgcggtttgactcttgttccccaaagtctcaactctcaaggtcgttgggtggtccaatctcaaatctgaatggaggaagtgatgatttctccggtggagcacgaccctcagggccaggttaagcagcagcaagcggccggcgttggtatactgcttcagattatgatg

SEQ ID NO: 5277 - DNA, 3000 bp, Unknown
  misc_feature (1)..( 3000): cDNA_ID_3076433_gDNA_ID_1620776_Annot_ID_167737 3000 nt of promoter + ATG
ttcttatcccttgtgctgtaaaagtaccattccatgtcgtttcccggcaaaaatgacttttctgttccgcgtattatccaaataaataactcataaaacctccaatatcatatgtatgaatgcatcatgaccaatatatgtaatctataacgtcagattgacataaacaagctgaaccatatatagagagagatataaagagttggatcgtaccaggcaagtcccatggctcgcatttataaagatcaacttctgggatgatctcgagctcaatggcttggccgttgaccttcctatcaagatagtaagccaccagttcttcatcagtgggatgaaacctgaatcctggaggcaaactcatgggcgccattcaaagtgtatgcgttagaaaacgagagagaaagagatgagagagattaattaaagtgattaggatgttcgtacgacatatgaaggtgactatatataattaaaaagatgagactctgaagaagatatgatatgggaatgtgtaaaagtatgccatgggattggcatcttctgagattaatattttgtcttactttgggttgctttttggtcagtgtttgtcatgatactcatcacacatattttctaaaaccaatatatatattttaaataaaaacctaactctggcttttgaagattctgcaagtgtgaaaaccctagtaggaggagagacggaaaaagctttagcaagaaggccccatctcacaaatactcacatatatgaatgtatatgcttataattccggttagaccttaacgtgggtcatgaatcattatagagggatttttataacgtttgctttaaaccaaaaatgaaggctttttatgattcaacagtttaggggacccatctcttcttctcaaaccaaatctacctggcgacacctaaacactcggctttttcttttctttttttttcggtttgacagttttgttatattgttttatgttgttatggtcttataataagaatacttataaattgaattcatatatatgattaaaaaatgggagaataaaaaagcaggaggcatccaagtcgactttggctttagtgttgggaggcttctttagtcccttttacatatggattaaagacgttgttcggctcttttacatcattactcccacacaatctttgactctctttctctcggcccttcaattttactaacttccggtcaaatctcttttgcctcgactctcggcctcgatccaaaagataaattaaaaaaataaggacatcttcattcttcacatgtatgatatatataactcatgtcatatattagatgtctcgtttacatggttttttttcgtttgctaatatatataattcacatgtagacgaagaacattgtaaacggaatttaacagaatgaagtaatcaaacgttttatgtaaggaaatgatcaaatactgagggagtccacaagttgcgacatatataaaactcctccattcttataaagtataatattcaaacttcaagtaagtaactctcccttttccgtgagaaagaaataacaataacattttagggaagctttaagatgtggtcaccaataacttagggagagagagagagagtgacagatacaaaaaacaaaagatagcaactgaaaaatattttggcgaaagatgctttaacagtttaacttatcaaacgacaacaacaagacatgccccaattgtttcaccactttgtttttcttggtcacaaatcgagtctaagtctatatgaacaagtaattaatgtgagtactatatataaaaaaaaatgtgactatatatataaatgttgtatcacaaatgcaaaaggaatgtggattaattaattaataaagacaacgaggaagctaacatgcaagcctaactaaagacatgcaacctttgatacgatctaaggggaagcgaataaagctaattaagatctaagcatcttatcttatcaacccttttatatttccatttcacatgtatcaagtacctatactctttctcaagcttatagtattgatatctagagtatcaaataaacattaattaattagacgtaacacaatagtgacattattaaatgaatagtaaacaaactttacgtgtatatatatccatgacgaaattggcaaaggcgggactctatgggggaatcatgataatacatacatacgatatacatgttgacatgtatcatgtatcatgataatacatacatcatcccttttttgttggtttgttaataaaatgatcatacatcatcttaaacatcaacatcaatcacaattcttctaaaagagaagaagagtcttgttcagaaaaagtagcatctgattccctacatgtcggtttccaaaacatattttttttccatctcatattagtttgtgctaaacaaactgatccaaggaaaaaagaaaagcctttaaataatacaagttggaatccctgtgtctctagagattcttgctttcatgttttttcacgcatctcaattatagcagaagaacaatgtcactgtccaaaaacatttgcgttatttgccttttgcttttctccatgcattaaatctcatttctacccttgttaaagtggtcacactcattactctttttaatatactaatcctacaggaccacctcgtgattgttatctcaaattttgattaattattcaatcaattagccaaagcagatcttcttcaattttaagattttgatgattactgttaaagctgactatcactgcggggaattcaaagatgatgctagtatacaaaaagagaagcatggtttcaaattgcagaatcaggcccatatataagtgggcttgattatttgggcttttggaagagtgtggcccaacatagagatatagagctgttatcgtctgtctttcatggcggagcagaggtgatcgtttcactattcaatttcactcgtcgatcattaccaacctctgcgggcaaag

SEQ ID NO: 5278 - DNA, 3000 bp, Unknown
  misc_feature (1)..( 3000): cDNA_ID_2161741_gDNA_ID_1620776_Annot_ID_167736 3000 nt of promoter + ATG
gcaaaattctcaagattttaatcacaaaaagaattcaatctgtgattaaagatttaaaaaaaagttaagatttttaccttgtctttgatgaatttccagataactcgagtcatttcgtctcctgcttgtgcacagagaataaataaagagtcaagtttctgaatttatttcataaaactataacatatagaagaaaagaaaaacccggaacagagccgatcacatatactccaatataagcaaatcaatcaatcagagtaacgagaaacccataatcgtaatcatagatttgagctaattgactgttcgaacacttaccatccatttcaacaacgggattgatcaccttgatcttctcgaattccatctttgcccgcagaggttggtaatgatcgacgagtgaaattgaatagtgaaacgatcacctctgctccgccatgaaagacagacgataacagctctatatctctatgttgggccacactcttccaaaagcccaaataatcaagcccacttatatatgggcctgattctgcaatttgaaaccatgcttctctttttgtatactagcatcatctttgaattccccgcagtgatagtcagctttaacagtaatcatcaaaatcttaaaattgaagaagatctgctttggctaattgattgaataattaatcaaaatttgagataacaatcacgaggtggtcctgtaggattagtatattaaaaagagtaatgagtgtgaccactttaacaagggtagaaatgagatttaatgcatggagaaaagcaaaaggcaaataacgcaaatgtttttggacagtgacattgttcttctgctataattgagatgcgtgaaaaaacatgaaagcaagaatctctagagacacagggattccaacttgtattatttaaaggcttttcttttttccttggatcagtttgtttagcacaaactaatatgagatggaaaaaaaatatgttttggaaaccgacatgtagggaatcagatgctactttttctgaacaagactcttcttctcttttagaagaattgtgattgatgttgatgtttaagatgatgtatgatcattttattaacaaaccaacaaaaaagggatgatgtatgtattatcatgatacatgatacatgtcaacatgtatatcgtatgtatgtattatcatgattcccccatagagtcccgcctttgccaatttcgtcatggatatatatacacgtaaagtttgtttactattcatttaataatgtcactattgtgttacgtctaattaattaatgtttatttgatactctagatatcaatactataagcttgagaaagagtataggtacttgatacatgtgaaatggaaatataaaagggttgataagataagatgcttagatcttaattagctttattcgcttccccttagatcgtatcaaaggttgcatgtctttagttaggcttgcatgttagcttcctcgttgtctttattaattaattaatccacattccttttgcatttgtgatacaacatttatatatatagtcacatttttttttatatatagtactcacattaattacttgttcatatagacttagactcgatttgtgaccaagaaaaacaaagtggtgaaacaattggggcatgtcttgttgttgtcgtttgataagttaaactgttaaagcatctttcgccaaaatatttttcagttgctatcttttgttttttgtatctgtcactctctctctctctccctaagttattggtgaccacatcttaaagcttccctaaaatgttattgttatttctttctcacggaaaagggagagttacttacttgaagtttgaatattatactttataagaatggaggagttttatatatgtcgcaacttgtggactccctcagtatttgatcatttccttacataaaacgtttgattacttcattctgttaaattccgtttacaatgttcttcgtctacatgtgaattatatatattagcaaacgaaaaaaaaccatgtaaacgagacatctaatatatgacatgagttatatatatcatacatgtgaagaatgaagatgtccttatttttttaatttatcttttggatcgaggccgagagtcgaggcaaaagagatttgaccggaagttagtaaaattgaagggccgagagaaagagagtcaaagattgtgtgggagtaatgatgtaaaagagccgaacaacgtctttaatccatatgtaaaagggactaaagaagcctcccaacactaaagccaaagtcgacttggatgcctcctgcttttttattctcccattttttaatcatatatatgaattcaatttataagtattcttattataagaccataacaacataaaacaatataacaaaactgtcaaaccgaaaaaaaaagaaaagaaaaagccgagtgtttaggtgtcgccaggtagatttggtttgagaagaagagatgggtcccctaaactgttgaatcataaaaagccttcatttttggtttaaagcaaacgttataaaaatccctctataatgattcatgacccacgttaaggtctaaccggaattataagcatatacattcatatatgtgagtatttgtgagatggggccttcttgctaaagctttttccgtctctcctcctactagggttttcacacttgcagaatcttcaaaagccagagttaggtttttatttaaaatatatatattggttttagaaaatatgtgtgatgagtatcatgacaaacactgaccaaaaagcaacccaaagtaagacaaaatattaatctcagaagatgccaatcccatggcatacttttacacattcccatatcatatcttcttcagagtctcatctttttaattatatatagtcaccttcatatgtcgtacgaacatcctaatcactttaattaatctctctcatctctttctctctcgttttctaacgcatacactttgaatg

SEQ ID NO: 5279 - DNA, 3000 bp, Unknown
  misc_feature (1)..( 3000): cDNA_ID_3593869_gDNA_ID_1620776_Annot_ID_167735 3000 nt of promoter + ATG
gagctcgagatcatcccagaagttgatctttataaatgcgagccatgggacttgcctggtacgatccaactctttatatctctctctatatatggttcagcttgtttatgtcaatctgacgttatagattacatatattggtcatgatgcattcatacatatgatattggaggttttatgagttatttatttggataatacgcggaacagaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggtaaattatttcccatgcacaaacttctattaacatatatatctatattcatttctgatctaatttttttttttttgataaaccatatcgactaatattaatgttgatctaaaacaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttgataaatccatatctcatactatcatctagtacttcttttctcaacttatttaaatatactcgggtacttcatatatagtatttttttttttacttgttttttgcttatgaattagtttgactggtgaaaaagggtgaggaggtttgtggaattattttttctaccacaaaaagaaattgcattattttattttaatttttatcattaggtgtgtatggtacttaatcactagagttggttggttttgtcatatataggagggaaaacggaagtaaaaattgtgtaatcgatcgacattacttattggtttgcatacttgtagacttaaaatctggcatgggcgtcatggcaacgcaaatttggaaaacttttcggattatatatgtccgactgcggatcaatatcttatttaactatatatatgtgttatgaatatgaaacaaaagttttaaaatctgaatgaataaagaaaaaattctcaagaaaagaagctgaaaacaaagaagagagaaaaatcgagacaaatttcactacaaacaaaataaattctttattaaaaaagatgagaattacaagacaatgattaaagacatctcgagtttatgatactatatatagtttgtgattgatttggaagatacaaacaacattatcatgaagaaatctctagtttatgatacttttaatttaatttaaccaagtgatagtggtctaatagttttcacttgaagacgaatcatcgtttttgtctaggtcatacattgatctctctcaaatgcaagattatttaatcattcttattatactatccctaaaacaatcttactataaatgaatctttaaaatatatatatatatatatatatatatattgcagtttcaaatccaaacatataataagataataatttgttcgtttgaaattcaacatgatcgtatatgcataaacttgcaataaaacatactaaactttttaaattttgtattcatcaattaacactgatcataatcccatcctctaaagtataaactctagtaaaacctctataaattaatactcgataaattaataatctctataaattaagaaatgtttttggttccgagttgggatcagtataaaaagtgacacaaatcgataaattaataagataataatttttttgaaaatcctatataaatatatggtctcatcaatatcataaattaataattatttaaatgtatcaattatatatatacattatatgtaagaaatttctttgaaatataattctaatatttgtttgcttaaatttgtatttatccttatttgaaatatagttttagtattttactatatcaaaaacttttggtgttattttctaaatatgatattattttttacttgtaattgattcttgaaagatattttctataatgaaaaaaaatcttatacaaatttttgaaaagttactaaattaggaaaaattttctattaattaataaatattaaattatcgataaattaaaacccctctaaattaataaaattttgcagtccgaacattattaatttatagaggttttactgtatccaatatttgaaggaaaaacgttccaaatcaaaaaatttgtagaacttaaaaacattttatgatgcatgggagattttgggcttcaactcaacaaaatagagtaaagcccattataaagcccacaaagtgggcctttcattttgacgtcaatatgggaataataccggttctttctgttaacgacgacgaatcttcgtcttccccttgttcttcttcttcctcttcattttactttctcttcccgatttctctctgtccgattcaccttttcctccgatctcggtctccttagattccggaataatcccctcaaggcttggcttagtaatcgtcgttttctccgccatg

SEQ ID NO: 5280 - DNA, 3000 bp, Unknown
  misc_feature (1)..( 3000): cDNA_ID_3076437_gDNA_ID_1620776_Annot_ID_167734 3000 nt of promoter + ATG
tgttaccaaagctggttgacaatatagtgaaaaaaattaagaacttacttgttacatttcttttagatgtaattttacatctaaatagtaaatgttgcaaaaagttaccaagctaaatcattcgcctgactgatggatgatgatatattgactaattttaattcattgtaatcaacattaagataacaaataaactttattctttatgctaaaaatcaacaccaagtatgtagcatatgagtacatgtgaatagcatacttctatatctctgttttgttatatttttgaatagaaatgtgaatagcatactatatctctgggatattccgtaccatcgacaatgatttcttgccgccaataaaagaacacgagcaaatctacaaatctgcaaatggttcataaaccggtttgatttatgcatcagaccataaaacttcgctcatgtccggtttagctctcggttctcgctttgtattgtcatggaaggtcatcatcattcaattcacaaagcaaattttattgataaactcacactacaagtacaaatgcataccaaaagttgatacatttatatatacgctcataagcaaactattagattatttttttgacacaatacataataaaagcattaatacatttaagtaatggtttataaattccttttgggactggctgatcccgtaaatacaagctgaacaaggagtatctctagaattgctcaaaaaccatggatttttatgttatccttcttcacaagcccagcctgatgattcaaaacatttctaagatcaggatagatacaatgcttccatcttttcactacaaaaccaacttcaaaaccaataaccgatagaacgaaaaaatgatgattacctgaacaaggaacgtagatacgttcttcctctgatcaccttgaagctgaataacctacaccaaagatattaagtcatttagcaactaaaagcaatccaaaatgtatcttgagagctatggtagctttcttgatacctgtcctaattcagagtcctggacgacggtgccattgcagcagaattctttcttaaggtctttaagtatcttgctatagctatactctttcttaagcccctggacagttgtcaagctttttctaccattacgctgctgaacacgaatgtgcacgtattcctttgttcccgccccagagtcctcagcatttgcatcagcgaacggatctttttatcaccaaaaaaaacacaaagcataagaagatcatataacagaagaagatactccattccaaaaacaagaatgctgtggaatcatctaataatcatcatattctcaacaaatttaaccgccaaatttcagaacaatccttaccaaaggcagtggggacttgaacttcaagatcagacatgaaccttaagttgatacaagggacagtaaatcgacaaggcctgagaacaaaaacagaatgttagaattacgagtccaaaaatgatttcaagttacataacgtaaaaaaaagtgacactggttatcctagcaatgtcttattcagataatcaaagattcatataacaaataataaagaaaccattttctgcaaaagtctccattgcgtaaacatatcacaagattccaaaatcaaaaatcaaaacaaaaaatatagtatctgtatctaaaattcgataccattttctacagaataaataacatatctagttttggagtcaatttcttctgaaagaaaaaacaatcaaacattatcattttgcgaagaaacaaaacccagagtatatattttgaaccaaaaagagctgcattcagatcagaaaataaaatgacctacaaatctctaaataaaaactttttcgaacaagcaaatcaacaggaaacaatcattcagcagaaagagagaaagtatcacctgatcaagaagagattagggtttcgagtatttgattgaaggaagaacggaaagaaaaatggaaaccctaaattcggacaaaggcaagcttctgtctgaaagaagaagaagaggaaattacgagaggaagagctacaaaatcgaacaagttttaattcgaaccaatattcttctttttttatattttaaatcggcaaataatagtcggcgagtcggcacggcatcgattccctcccactcatctagttgcgtctttatctggaaatacgtattgggccttaacaaagcccaaatatttgttacggcgtaacaaagcccaactaaatggagccgatggggagatgctgaaatcgccaagcagagaagcccaaattacaatcagttgttcccgcccgatcacctctttttcagttgttcccgcccgatcaactctctggaattacttagcctcaaaatcctcacaacaactcttctcttgtagctacatctactttgctcttccctctctgttgtctcgcgtttcctctgctgtctcgtgctctctttttcgttctgttttgttctttctttagtaattttttcagatagttttaagtctcttctgaagaagaattagggttttagggtttagaaaaaattctctaaatatatttggttttagatctaatttaagattcattcacaaaatagaaaacgtttgtttcttcgtcatcttcttcttcaacgttggatctgttagttatgttttttcagggaccacatctaaacttgtctctaacaaaaagtccggaacttatcaacaagattgaatcttacctcaacggacactgcacatgtcctcatcaacaaacagagaactcatcaaagagatcaactcttcctaagagccctgagaaactaaaagctatgaatttcccaatctccacgatcaggattggcggatgggtcgtcgttgccaaaaaccctgatgacattgtggccaaattctattttgcaaagaagaaacttatatgggagtttctcttcggagaaccagagactaacacgctgaggctgaaacgtaagatcgagattcaatggaatg

SEQ ID NO: 5281 - DNA, 3000 bp, Unknown
  misc_feature (1)..( 3000): cDNA_ID_1396182_gDNA_ID_1620776_Annot_ID_167730 3000 nt of promoter + ATG
agagattctcagatttatcgaggtgaagaggatatatacattgaagtcctttgtgtttttcatggtttatatttgacattcattagtcagtttatctcaatttcttgtcatagttatttccttgggtttcattatactctcttctctgaatacagaatgctaagttttcacctgaaatgagtcgatagattgtgtagtctgaagtgagtcaatagtaactgatcacaatggacagaacataaggatttttaggatagttatctgacaattagttggtaacttctgaggttgtagatatatgtagtgagtattctaacacaaccatgatgactgcaaacactctgataccattggaatagcattactaactgctgttggaacctctttgttgcgccgcccaggttactgaaattcatacccaggaaacttgtggtttcatttttcctccttataacatttgactccaagcatgaatcctttttatcaccaatgctgctgcattacattctcttattactgtttctctattgtatcctggttcaagctttgaaaaatatcatttggataaactcttatatttacgttcaaccttaacatcaagaatatgaattacattgaatccagttggaagttaatctttgtggtttatcaattgcagggacaacatgaggttccacaaaactttaagaaactgttgagttatagcctgggaatccttgtttctcaagacaaactcaaaaaggtaactagtgttgtttttcttaatgcgcggtttgtcacaagcctatctacttttctccatacccccaatatctatatgacaagatgtagtaataataaacctgagttatattatatgataaactcaaaaattactttataaatgcaggtacgaaatcgttacaaaatctcagttacgaaagcaattaagccaacactcaccctgcgtccaaaagattccacgaagccaccagagttaccaagtacttctgtgatattaacatcaaaagaaacacatgagatagacccagcagcaaatagagaagcagaaggaatgaatgagttggcaaaagaaaacaacgtaatcttactccttttaattacatgttgctcatccaatttacagtatcatagcaacaaaagatatgatcccttgtggttgatcaatttcaagactggtacgaggagcaacaagactttaggatgtttttgagtgagtgcctgataattctcgtttctcaaggcaaactggaaaaggtatatttttcttaattgctcagctatttattgatgcatcatcatctatctataacaagatcatttgtaattcttatgattgattaaaatcagaaaatctcccaaattgcaggtattggatcgctacaagatatcagaattagaaaacaaagtgttggaagtagcaccagaagttgtagcaatgaaactagcagagtcagataacaaaaggttgatagcagcagaggcagtcgaagaagaagaacgaatgcacaagttagtagaagaaagccacacgatgcttcaattatgcttagagatccaccaacaatgtaatctcaacaaaactcacatggtacatcaatccatcatcatcaccatgatcatcactgtcttttgctttgtttcttgcaggtgctcttggccaagaggttgttctactgtaaaagaaaaccaagtatctatctagtttgcttcaatctatattttacttaactaaccacttgagttttgtttttgtagttcttaaacacaggtttatatggttgtaatggtgaactaatgttcactgttttgttcataaaaagatagctttttttttttttgctaaaaaacaatgacgtgtctatggagtcttgtgaatgctttgctacgtcataaagcatcaaaaggtgctggaaagaataagcttttccaaaagaaaatttggtctttttttctaattaaaaagtttggtattggcgtatggaagtacaacactactactcatatttccacttgaaaacaacattttgtgattgtgatttgatattttctggtgtgtgttagtatgcaattgcgattcattattcatagtctcttttgacattggtgtaaaataacttgattggtaacaatattttccctactagtttaggaaaagtataaagaggtgagaaaaatctcaaatcgaaaaggaagaggaaagtgggggtaaagttggaaatataaaaattttggaaaagtagaacaattagaaagaggaaaaccctaaaaaaaaaaagagggggactatataactggctaacacgtattgggttgagtctctctctacctcaatttatattatttgcttcaatcttctctttatcgctccaccagatccaagttcgcgagatttcaagctctctaacaaagttcttcacttttactctcaaagctttcatctttcattcaactacttaagctccaaggttcggaaatattttttttacttttctctgcgatttgttccttttcttatgaacgattggatctcgagtctgatttactctctttgcgatggaatttgttctgggtcgttttcaaaattgacgcttgttaatctataattcgtcatcggattcaattagtccgtgaaacccttcaattcgtttatctcaaatcgatttgggttaggttttgatttcgacacttatgttaaaatcatccaaagcttttatcttcgattttggacaactttgtgtatattatatgctttcatggagagatagatgtttttgaatggtatctgttatgataattggatgaaccatatttcctatatctctcctgacatcgaataattcagatattaatgcttgtgttcctctctatatggaacttcaagtttggctattctgttacattcttacttttgcacaactctctctggctataagatttaagaatcatctctagctatctgggttctaaactattgtttcttttgtgtattgttgtagt

SEQ ID NO: 5282 - DNA, 3000 bp, Unknown; identical to SEQ ID NO: 5281
  misc_feature (1)..( 3000): cDNA_ID_1396182_gDNA_ID_1620776_Annot_ID_50293 3000 nt of promoter + ATG

SEQ ID NO: 5283 - DNA, 3000 bp, Unknown; identical to SEQ ID NO: 5279
  misc_feature (1)..( 3000): cDNA_ID_3593869_gDNA_ID_1620776_Annot_ID_50298 3000 nt of promoter + ATG

SEQ ID NO: 5284 - DNA, 3000 bp, Unknown
  misc_feature (1)..( 3000): cDNA_ID_2161741_gDNA_ID_1620776_Annot_ID_50299 3000 nt of promoter + ATG
tcaagattttaatcacaaaaagaattcaatctgtgattaaagatttaaaaaaaagttaagatttttaccttgtctttgatgaatttccagataactcgagtcatttcgtctcctgcttgtgcacagagaataaataaagagtcaagtttctgaatttatttcataaaactataacatatagaagaaaagaaaaacccggaacagagccgatcacatatactccaatataagcaaatcaatcaatcagagtaacgagaaacccataatcgtaatcatagatttgagctaattgactgttcgaacacttaccatccatttcaacaacgggattgatcaccttgatcttctcgaattccatctttgcccgcagaggttggtaatgatcgacgagtgaaattgaatagtgaaacgatcacctctgctccgccatgaaagacagacgataacagctctatatctctatgttgggccacactcttccaaaagcccaaataatcaagcccacttatatatgggcctgattctgcaatttgaaaccatgcttctctttttgtatactagcatcatctttgaattccccgcagtgatagtcagctttaacagtaatcatcaaaatcttaaaattgaagaagatctgctttggctaattgattgaataattaatcaaaatttgagataacaatcacgaggtggtcctgtaggattagtatattaaaaagagtaatgagtgtgaccactttaacaagggtagaaatgagatttaatgcatggagaaaagcaaaaggcaaataacgcaaatgtttttggacagtgacattgttcttctgctataattgagatgcgtgaaaaaacatgaaagcaagaatctctagagacacagggattccaacttgtattatttaaaggcttttcttttttccttggatcagtttgtttagcacaaactaatatgagatggaaaaaaaatatgttttggaaaccgacatgtagggaatcagatgctactttttctgaacaagactcttcttctcttttagaagaattgtgattgatgttgatgtttaagatgatgtatgatcattttattaacaaaccaacaaaaaagggatgatgtatgtattatcatgatacatgatacatgtcaacatgtatatcgtatgtatgtattatcatgattcccccatagagtcccgcctttgccaatttcgtcatggatatatatacacgtaaagtttgtttactattcatttaataatgtcactattgtgttacgtctaattaattaatgtttatttgatactctagatatcaatactataagcttgagaaagagtataggtacttgatacatgtgaaatggaaatataaaagggttgataagataagatgcttagatcttaattagctttattcgcttccccttagatcgtatcaaaggttgcatgtctttagttaggcttgcatgttagcttcctcgttgtctttattaattaattaatccacattccttttgcatttgtgatacaacatttatatatatagtcacatttttttttatatatagtactcacattaattacttgttcatatagacttagactcgatttgtgaccaagaaaaacaaagtggtgaaacaattggggcatgtcttgttgttgtcgtttgataagttaaactgttaaagcatctttcgccaaaatatttttcagttgctatcttttgttttttgtatctgtcactctctctctctctccctaagttattggtgaccacatcttaaagcttccctaaaatgttattgttatttctttctcacggaaaagggagagttacttacttgaagtttgaatattatactttataagaatggaggagttttatatatgtcgcaacttgtggactccctcagtatttgatcatttccttacataaaacgtttgattacttcattctgttaaattccgtttacaatgttcttcgtctacatgtgaattatatatattagcaaacgaaaaaaaaccatgtaaacgagacatctaatatatgacatgagttatatatatcatacatgtgaagaatgaagatgtccttatttttttaatttatcttttggatcgaggccgagagtcgaggcaaaagagatttgaccggaagttagtaaaattgaagggccgagagaaagagagtcaaagattgtgtgggagtaatgatgtaaaagagccgaacaacgtctttaatccatatgtaaaagggactaaagaagcctcccaacactaaagccaaagtcgacttggatgcctcctgcttttttattctcccattttttaatcatatatatgaattcaatttataagtattcttattataagaccataacaacataaaacaatataacaaaactgtcaaaccgaaaaaaaaagaaaagaaaaagccgagtgtttaggtgtcgccaggtagatttggtttgagaagaagagatgggtcccctaaactgttgaatcataaaaagccttcatttttggtttaaagcaaacgttataaaaatccctctataatgattcatgacccacgttaaggtctaaccggaattataagcatatacattcatatatgtgagtatttgtgagatggggccttcttgctaaagctttttccgtctctcctcctactagggttttcacacttgcagaatcttcaaaagccagagttaggtttttatttaaaatatatatattggttttagaaaatatgtgtgatgagtatcatgacaaacactgaccaaaaagcaacccaaagtaagacaaaatattaatctcagaagatgccaatcccatggcatacttttacacattcccatatcatatcttcttcagagtctcatctttttaattatatatagtcaccttcatatgtcgtacgaacatcctaatcactttaattaatctctctcatctctttctctctcgttttctaacgcatacactttgaatggcgcccatg

SEQ ID NO: 5285 - DNA, 3000 bp, Unknown
  misc_feature (1)..( 3000): cDNA_ID_1828195_gDNA_ID_1620776_Annot_ID_50301 3000 nt of promoter + ATG
aacaaatccctctgatttcatttcctcaggatggacgaagccaatctgtattggaaggcatgcttttggtgatcagtatagagccactgatctcattgtcaatgaaccaggaaaactgaaactagtttttggtaatctcctcctcccgttctggatctgtctaacccttcaattaaattgttcattatagagaataatgggggatcattgtcattgaattcacctacctgtggaagtttatttatacacgttaaaaatcatatcttacatatgcagagccaagtggatcttctcagaaaacagaattcgaagtcttcaatttcaccggtggaggtgttgctttagccatgtataacactgatgaggtagatattattgaaatagtcctctccttcatgtctgcactatctgaatacacttacagagtatctattgatatggtggtccgatttcatttttgaacagtctattcgtgcatttgctgagtcctcgatgtacacagcttaccagaaaaagtggccactttacctctccacaaaaaacaccatcctcaaaatatatgatggaaggtgtgaattcactggcctttatactttcttgttagagtctcaccgaaatcatttcaccatctagtcatactgccctgatattaccttttcatcttgttttcagattcaaggatatattccaagaagtttatgaagctaactggagatccaagtatgaagcagcagggatatggtgagatgtgcatgttattagcgacattctattacagtacaccatgcaaacttgtaaacaaagttaatgaaatccaggtatgagcatcgtttgatagatgatatggttgcatatgccatgaaaagtgaagggggttacgtctgggcatgcaagaattacgatggagatgtacagagcgatttcttagcccaaggtttttcctcttaaatttgagatctgtctagggactgaaaccttaattctgccaaatgcattttggtcttgtatcatggttctttgttctttacttgtgatctaaatggggacagaaacttcaattttatttctccttatgaaacaaagtttctgctctccgctgcaggatatggatctctgggaatgatgacttcggtgttggtatgaaatgacgcgggcctcagccaaagtttttggtctttatcatgataacatgtttcctgcgcatcattatattttatgtattaaatttgagatatattacaggtttgtccagatggaaagaccattgaagcagaagcagctcatggcacagttacacgccactacagagttcaccagaaaggtggtgaaacaagcaccaacagcatagcctctatttttgcttggtccagaggccttgcccacaggtaacgcatttccactgtctttaaacattttcatacttggtaattcgtgttgctactctggagaaaatccagtcccttgcttcaataatgagttagtctatcagggattgtttgtggtaagatttgtcattacttgtctctttataattgatcactgaactatgtgaaccgttttacctttggcataaattgagtttaaagtctctgaaaactggttgagttcatcttaacaagatgtttggtatgtgatggtaccagggcaaagctggacagcaatgccgcactcttgagctatactgagaaactagaagcagcttgcatggggacggtggagtctggcaaaatgaccaaggatctagctcttctgatccacggagccaagtaagactaaaacttgagagaaagttgatgaggttgatgcacttaataaaaaatgtttaaagataagtttttgtctactatttgaacagggttaggagggatcagtatgtgaatacggaagagttcattgatgcggtggcatgggagttaaaaagaagattgttaggcaacaactccaggttgtgagaagaaagaatggaaatctgaaaagcaaagagtctcagcagcgtgatgtttgatttgatgctctttcataggtgtagaacttaaagcctgaaaaggggctattgcatgaataaaaggagatagactaattgggtaatttattgaggaactcagatttcccaaagccgagactcactcctcattgattcgttaaaaattgaatctttttagcccttctttctctgtataatctctgttgtaaaagctaccaatcaacagaaatggctacgttctcgttgtcattatcttctctttccctttgtattatttatctggcaaagaaatgaatggttgagctttagttataagtgttccctcttgctccctcaagttgctatggctatgtgggattagtaagaagacgacggaggatgattttgatgataacagctcccgtttgtcctcctcaccttctcctacgccattcttctttgcttcgccatgaatcatcgatcggaaactttcatcggaagaaaaatccacgtttcagaaccgtatcatgttcttctttgttgccgcaaccgtcggttcgtccggataaggcatcggagttgaagactctgtggaagaaattctacaaagtcgcgtcgccttattggttttccgaggacaaagaccaagccaggcttcgtctcgccgccgtcttcgcccttactctcgccaccaccggcattagcgtcggcttcaatttcctcggccgtgatttctacaattctctcgccagtacgaattcttcaactctctctctcatttctcacttttcaaaaacaacttgctctgttgatcctcttttctctgtgttcaatagacaaagaccaagagcaattcaccaagcagttgttctattacctctgtgctttcgccggcggcattccggtgagttttcctcacgctcctccctctgtatccaatctcaatgaatgatgttgttcactttccctggattttgcagttctttgtgctacgagattatacaaaagagactttatcactgagatggagatcatgg

SEQ ID NO: 5286 - DNA, 3000 bp, Unknown
  misc_feature (1)..( 3000): cDNA_ID_1828187_gDNA_ID_1620776_Annot_ID_50303 3000 nt of promoter + ATG
cgataacctcgcagatgctttgtttgtctcttattccttgcattcttcacctgactgttttgtttttcttgttgttggttgagaataactttaggtgtatcaaatttagatagataggtctaagaaataggagtaaatatgttgcacttttccgggttttgtggtgttttctttctcaaatgggtcatcacatacaaatccagtctgctttagtatcagtgagtttcggcagtggtttttcctattaaacaacttcaatggtttcttgttgctaagcatctttttcatggtttggatgtctgtctgttttcctgctcgagagctcttttcgtgtttcttgatctgttcttcatttttaattcttccgtcagttcgagtacataacttgtcgttttgataggggcctcttattttcttttccacaggtcccatatctgctgtaccaagacgtaactgtgtgaatatatttgtacattgagctgtcagctgaagagatttgtcaaagtccatttttcaccaattttctcgtttcttagacacaatacaagtccctttttttctttcttttttctatgagctaacagcctaatacctcatacattcattctgtatatagattgttttgttcaggttataaaggacataggagtttcttttggttcaaattatatagggccattagtctttggctaaagttgtacatgttcatacattttcaataaaaatagtgcattcacactcagaaccttaaagttattatgtattttgatggacttatttcttctctgtttctatgcacgctcatttctgttgtgtttagaaatccttttgtttgttcctgttacttaccttgtatgattatttcttcagaagaaaatttggggactgaagaaggaacggaggaccctgaagactacactgacgataatgatgattacaatagcattttgagacctgcgtttgaagtagatggagaacctgattttagtactggaccaccagaagatgggcttgaatatttaagacgagtcaggtatattatctctctgtttccatctttctgtgtctttacacttttaaacttttggtattatggttaagttgttttgtttcctcaatttaggtgggaggctaagggaattccgaatgtaagagtagccaagatagatgaaagcacgtacataaagaaagagcaaagtgtttatatgccactaattcctgaaatccccaaatgtccagagtacctgttacccatgaaggaatgggaggactcgttgcttttggactttgtacaccttcgccaggtattttttcctgatatttcatctgacttacatggttggttaatagcagtctctctcttaatagacgaaaatgaaagtaagtgttgttatttttacagactctaacacaaagtgccaacagctgtgaggatgagataatatcaagtcagtgtgtagaagatttgcttgtggagatgttcaataagcatctccacacagaggaggatgagtcttttggtgaggtggtaacagacatacaaggaatggactcggtgacgcgggtatcaaagctgaaaaagcgtatatgtttggttgagaaggagagcggtttacagagtagcgattgcaaatgggtagtagcgttgtgtgcatcattggagactcctttggatgccgatacttgtgcttgtctaaggggtcttctgaggaagtgtgctagtgttcgtgcagagacatcattagaggttggagatgaagaagttatcaccatggcaaatatgctcatcaccatcgccggcagatactttggccaaatgggacagtaataagtgaagaagagagtggacatgacatgcccttacttttctctcatatgtgcttttgaatcttacatgagctttaatgccattttttgtagtgtcccctttgttatgtcatctgtgatgttcggaatcatcgtatttgtgcgaagtaagctctttttttttgggatcttgttgaggttattgagatcttcacaacttccgtggatcggctagatagagtcttcttatcataccgagttctatcattgtcattgttgaaggaaattacaagaactacgttgctgtagtggtttcaatttgttacaattcagtttaagtgctctttgtttcttcttcgtttggatattgcaccaaatagtagtcagatactacgtttggatgcaatctttgatattattgttacaaagaaaaaaagaataaagaaaaacatgtaatacatatgtaatatacttcgaaacatatgtaattttgcagttcccaaaacaatgttctttttgtttttgacatggtaatatgaaattacttttataaacagatgtttcaaataatatttgcgaattttaatatttttggttacagaattagtttgtacgagtatgttagttctatcttaattattaataatttaatagataatcatattttatcataacagaaatattttgttttataatttagatgataaccaatttgaattactgatgacagaaaaaatagcagtttgaattactcatccaagaaaatactagtacttaaaagacatgtaattattagattaatttagtttaacgcattcagaccaataagtagataatcttactacatactgcagccggcctgaagaacctatgcattatttaagctattgcttataagaaaaattaactgtgattatgttattatctactggtctaataatgttgtataatgctcagtttggtggacattggtttcactctcgtctattgatttcaagatgttacattgtatgttggttgtcctgtgattcatatccgtgtaccagtaaaaactcaaaaatcctcttaaacacacagagagacatggtgacgataaaacgacggcgtatttgcggtttgactcttgttccccaaagtctcaactctcaaggtcgttgggtggtccaatctcaaatctgaatggaggaagtgatg

SEQ ID NO: 5287 - DNA, 3000 bp, Unknown
  misc_feature (1)..( 3000): cDNA_ID_1828183_gDNA_ID_1620776_Annot_ID_50304 3000 nt of promoter + ATG
aaaagaaatggagaggtgtcaatctgaccaaatggcttatgttagaggagctgcttatgaagcaatgatgacttcaaaaagaatagcggcagagctcgagtcgaagatggagaaaggttgtcgttctgttactggttcgaatttcagtcgaagaaactgttcgtccattgttcctgattactccttatcacctgaatcacagactctaggctcttttagcgggtatgattctccggttgagtcctcgcctatttctcatacttcttgtaactctgaatttgatcggaggagtgtgaaccgcaaactttggagacgtgatgagaatggaggagtggttgatatctctttaaaggatggtcttttctcccgtgtaactaaaggaagcaccactgtctctgattcacctcttgtaccgtatgatacttgtgaaaatggagatgaatttgaagggtttctaatggaaagtttgagaaacaccactcctagtcctcaggtgaacatcaatccatctttgttgtatgtttgttagtttcatttatgttaaacatttctgacttttctgatacacagagacagcgttcacgtcgcatcaatgctgaagatttcaacatcttcagcactccacggaagctaatcagctctcttcaatatcctgatgatgttgatttagatcattcagacatccaaagtccaatactgagaggcgagagagagaaaaccataggatctcgcaagaatcctaaactcagaaagcaatttccaaccatggtggaaacaatgtcatcaactatcacagttagtgaagacacagctcaaacacagatgataaccggtaagaagaagaagaagaagatgagctatgccaaactcgttattgcgatatcttttgttgtggtggctctcttcgcaactgtgatattgatggtgaatcaagatgatgatgttggttactacactgtccctacatgattcacctcttattggtgttaagtttaatcgtagtgtagcagagagagtagtttagctatttaattacgtgttagttgtttgtaatgaacttgatacaagatgtagtagaatcttcttctacttgttgttctcattttgttttgtatggaaatgttaagaatataaacgatgttagtacaaaaggcttcaaaagagaatggtgtgtggaattagcagatatgcggatccggtataatccgggatgagaacacattggctatatttatacatagaaccggttcaaggttgataattttttccggtttaatcaaaccggttcgagcaatttattagcttcgagaaaaggaacaatttattcactcgttaagggttttgcgcacatccgcctcatgatgacaaactccgattccgaccactgtactccggcgaaaacctcaatttctggggatggattagaaaaagagagcgactttaagaagcaactgaactctgagatagatccacaagcttcttcctcgcaaaacgatgcaataactatggaagatggagccgtctctgtaaacaatagggatctgcaagagataaaggaatcatccttctctaaaggaagtgagcaatatcgagttgatggagcccttgaagaaagtttgaattttgaggagaaggaacaagaatctgaagctcagagactattggaagcagagaagagaagattgctggctgaaatcgaacttgggtcaatctttaggaagagtgttgatgtggatacgttgcctaagatcgaagagacgatggataatgatgttgataagattgaattggttgatcatactgcgttggttgatgttgttcatcatcctaagagaccagggactgctcaaaatgagaaggatacacctagaaagcttaagaaaattggagataagagaaatgttattgaggggagtggagtagaaaacaatgggaagcagtttaggagattgtacactaggaaacaattggagtcaatgaggtttgcccacattgtgaatcagaagaacctgtggagtgagatgtattctaggattctacctgaggtggtgactgagtatgaaagtttagtttatgtgaagaattacaagagttcaaagtctaatcgtgttcgtgggcgaacggagagtggcaatggtaatctcgataacctcgcagatgctttgtttgtctcttattccttgcattcttcacctgactgttttgtttttcttgttgttggttgagaataactttaggtgtatcaaatttagatagataggtctaagaaataggagtaaatatgttgcacttttccgggttttgtggtgttttctttctcaaatgggtcatcacatacaaatccagtctgctttagtatcagtgagtttcggcagtggtttttcctattaaacaacttcaatggtttcttgttgctaagcatctttttcatggtttggatgtctgtctgttttcctgctcgagagctcttttcgtgtttcttgatctgttcttcatttttaattcttccgtcagttcgagtacataacttgtcgttttgataggggcctcttattttcttttccacaggtcccatatctgctgtaccaagacgtaactgtgtgaatatatttgtacattgagctgtcagctgaagagatttgtcaaagtccatttttcaccaattttctcgtttcttagacacaatacaagtccctttttttctttcttttttctatgagctaacagcctaatacctcatacattcattctgtatatagattgttttgttcaggttataaaggacataggagtttcttttggttcaaattatatagggccattagtctttggctaaagttgtacatgttcatacattttcaataaaaatagtgcattcacactcagaaccttaaagttattatgtattttgatggacttatttcttctctgtttctatgcacgctcatttctgttgtgtttagaaatccttttgtttgttcctgttacttaccttgtatg

SEQ ID NO: 5288 - DNA, 3000 bp, Unknown
  misc_feature (1)..( 3000): cDNA_ID_1828176_gDNA_ID_1620776_Annot_ID_50306 3000 nt of promoter + ATG
catacaccattcagtaaatgaacttaaatgattgtcaaatgataatagatgtttgagaagaaaaaaacaattaaaaaaagtttgatgtttgaccaaagcgaaattattttttttctttagaaagaaaacttgttttcatgacaatggccttctacaagaaaaagtatttgttagtgtttgctctcaataatgttttccgaaacattaatcagttttctgaaaactaaaagtttatcatcaaaagaaaaagtaaaaagtaaaaataaaaccaaaagtttatatattccttttttgttgttgtcaaataatagaatccaatgccaaaaacataagcaaaccgacatgagtttttttttctcaatctctgattcaaaacctaacgttgcttctttcacagtggttggaattgattatttcaaccaccaaaaataagattctaccattttcaataaatgaattgtcaactagtttgaggctttgagcggttcgtttacagacgagcttttataaatgaaaccaatcatacattcatagcaattatctaaatcgcttatcctattagtcgatatttcaattcaaaaaagaaattctatttgtaattcttaacacacaaatattgaaccaattacgaaaagactatttaaaaaatatatatcattagtttttttttttcgtcaaatatatatatcattagttaaatttaacttttttaactactatcttaaatatatatttttttttacttccgtcacaattatataataataactcaagaaggacaatttatacttatttagttttaatgaagaaataacttatgtaaagtgaaacataatgaatatatgtatacatcataccaataatgcaaatacatggtcttattaaaacttgatcacacaggtgatgccataaaatattggtacgctttaacaactcctaaaactgcagcagccacaaccaccacagcggccacaccctcaactactgtcttcctccatagtctttgcttcaatgagccaaacttactataaaattcgcttgaacagtttgcaacatttctcataccctcatctgttttaggggtttgatgttgtggcgtggctcccttcaaagaaactgagagaccagctgctatagggattgtctttggcatcgtcacatacaaaactcccttagagaactttgcacgaatctcatttcttttacaatcttttgcaacttttgtttctttcatgaacctgattgttttggtttggtccactggacagcctcctgttattgttagtacaccactgttgttgatctgtattttaagatgctctttcttcaaacctacaccaattccacttttcattgataaataactatactctttagttctttcttttttttctacaaccacacattgaattaaacaaccggtctagctagagatccatacggggaaaatattctttacatattactcatctaaattcgtagacctagcactactggccaaaaggtccgtttggacatttaaacaacgtggagccaaagagagtttgagaagcaaaagtagcaatgtggaatcaaagtatactttacaatggttggagaaatagagaaacaaagtagcaatgtggaagcaaagtataatcaaagcttttaacaattctctcgtgctgtgctatatttcggttggaaaagatatatatatatatatatatatatatatatatatatatatatcaaacaaagtgcaatgcagacttacaatgctatatatatatatatatatatatatatatatatgtatatatagtaaactaagaaaagaactactatgtattattttttattttttttgttataaatttattgtaggaaataattgttgtacctgaaggaagatgtagctcaagaatgtcgatgtcttccgttcttctccatcgacaaaagggttcgatttcatcgtaaaagtgtgtctgtgaaccttccatatttactgccatttcgttaaaaatttcaatgaacacgaaaaataaacaaaaatatattactgaaaatctctctcttgttttcaatttgttggaaatcaatattgcctggtgattgtgatgatgacccatctaattgcttctatttatataatttgttctgtgcatgcagtttcttcttggatctcctatgtactgaatgattcgtttattacccttaaagatttgctttaaaaattaatttatttcactctttcgagtttatatagtttgttgtatcttgtgaaattggtgtttcatcacatgcacatatcttcgtctatgtggttccaaatattcttttgttctttttattttaccatgcattgctttattacttacacataatgacaattttgctggtcattgattagaacatcgttttaatatcgaatgggatgtcgagttgaatattttgacaacgttcgttggctgggtcatgaatgaagtcagaataccatttctttttcattaaacaatgctatttttttcccgcaaaacaatgctattgggctcattttgggcttaaaatgttttgcgtaatctcaatgtttgtggggcttttagtttttagcccatgtatggtttgataactttagtaactcgtgagaaaaaaaaaagcttcgttctcaatcccaattcgaaatcctagctgaagtctatgctccataatcaaatccagttcatcagagatcaaagatggctattgcacgaactggagtttatgttgatgattaccttgagtgtaagatccataatttctctctttatttgataaattttctctaattagttcgaattttagggttttaattgtacaattcggaaattcaatttcatgtagatgcaagcactttccctgcagagctacaaagattactaaacacagttcgcgaactagacgagagatctcaatgtaaatttttgttattacattgttctcttgcgtatgtttctttgtgtgtttcgtgaattgattatg

SEQ ID NO: 5289 - DNA, 3000 bp, Unknown
  misc_feature (1)..( 3000): cDNA_ID_1828168_gDNA_ID_1620776_Annot_ID_50309 3000 nt of promoter + ATG
atagtgttgttgttgggcagtttttgttagtctcctccaccagaaatttttgaccaaataaatctaaatttggtctgattttacttcttttatactaaatccatgttgttttcactcgacaaattgatcatggatcctttagacggtttatctttgtctctttcgaagctccgtcaaaccaattcatgaaatatatattattagttttgaagtctaactatcatcaacggaggacaaaagatttgaagactacattttgaagattctatagtgatatcaatttttcaaatctttgaaaaatattgatgcatgaaagttgttataaatttaaaaattatataatcgtagctttcaattttttttttgctatttctcatatctgatttgtgtaactggttaaatttcttgggtttatgtttataatgttgttgatgttgtgtaaaatcctctctttctaataaatattaataaaaatagtacaatttaatatatatatatatatacatatatactaagacgaatgaagatatataattcaactacagataaaatatattgcagttcaaataataatcatatatataatagcagagttttctctcctctaaaagtgtccacgtcactacatctttttaatgtggagcccacatgtttttactctgtcttcacatttttttctatgcgtgagatagatttagtgatgtttatggggcacgatttagtgatgtttatggggcacgatttggtcaaaaagcccatgagccaaagaaccaaatagacttagtgaggtgtatcgggccaagatttagtcaaaagaaccaaataaaccagtatactccttctgtgtagtcaatggacgaactggcagctaggcgaggagatagatgagttgtgcacttgagggacgagctgacgagtaggtgaggaattggacgagctgactagctgacagctaggcgaggagatggtcgttgagtgatgtggagcttgaagacgagctgaagaacttaaagacgagctggagtatggggcacgatttggtcaaaaagcccatgagccaaagaaccaaatagacttagtgaggtgtatcgggccaagatttagtcaaaagaaccaaataaaccagtatactccttctgtgtagtcaatggacaaactggcagctaggcgaggagatagatgagttgtgcacttgagggacgagctgacgagtaggtgaggaattggacgagctgactagctgacagctaggcgaggagatggtcgttgagtgatgtggagcttgaagacgagctgaagaacttaaagacgagctggagctttccgtatttttcttccccagaagctcaaacatcaacagttattcactaaaaggtacttaaatacatggcttaattcctacaaaattccactacttgcaatttaattcatacttttaatatctcaaatcgaaactgtaactggagaaaagcaaaaacctcctatacatcttcctttaaactactataaaatcatcatctcccatcacccccaaacacaattatcactttccaccagaaaatattacacactctgaaaatggctgaagttgatgttgttgcaattccttctaaagcaaactatgtagcttttgatgctttacgtcttggtcgctctactcaacaggttgttggtcgcctacttcgtttttgggatgctcgcaacatcaagaaagatggccaattcatgggcatagtcctcctgttacttgatgaaaaagtaaatcatcttagatgtttaatgcttttttgtttcatatgtaattgatggctaactaacacttaatttgtttcattaatagtgctccgtaatccatgcttttatcccagcagctcttgcttcacatttccgccaagttttgcgtgaaggcataatcttcaatgttagtgggtttgaagtgggacgttgcacgaaaatctacaagatcactgacaatccttttctcctccgttttctccctgccacaacgattattgaagtttcagatgttggccctacaattgagagtgaaaaatttatgctacgtaactttgacaaccttcaagctcttgctaacaccaatattgaacttcctggtaatatttttcatgattcttacattttttaaacatgaactatgattataacacctttgaaatgatctagatgttgtaggccaaatcactttcgtccaagggtcaaacttgaatgatccaacttctactcaacgtttggttttgcgataccggattgattcgtaagctagcacttccaaaccaaaaataaataatgaacaaaactttaaaattgaactgatacttccgtctttttattttaaggtctgttattgtctacttatcactatgggatgatgtcgccgcaacctttcgtgcccatcttagctctggtgatacaatttactcggtcatgctaataactaccgtcaacccaaagatgtttggaggttagataaaactgatttatttccaaattttactctcaaattttaagataaaagataacatatggtcattcttactgtttaaggtaacctttatctcaactccacacccgcaacaaggttttttttttacagcagcattcaaccaatccaagagtttatcaaaaggttaggttcttatcaataaatctctcataactcacttctataaacacatacgcttaaaatctttctattgcttaattattaatggatgcaggatgggtataaaaagtggagagtctattgcacgtgctgatacagcagctggaatacgtaaaaaagaaatggtatcgattcatcagcttcacaaattcatatctaaaactgatgaacaggtattacaaatatattcaacataattaagttccaaaattaactccaaagaatcactactaatgttttgtttacaatgttccataagtcacaggatgctgatttcctttgcaatgctaaggtgttagatgtactgcaaaagaatg

SEQ ID NO: 5290 - DNA, 3000 bp, Unknown; identical to SEQ ID NO: 5272
  misc_feature (1)..( 3000): cDNA_ID_3076443_gDNA_ID_1620776_Annot_ID_167729 3000 nt of promoter + ATG

SEQ ID NO: 5291 - DNA, 3000 bp, Unknown
  misc_feature (1)..( 3000): cDNA_ID_1828161_gDNA_ID_1620776_Annot_ID_50311 3000 nt of promoter + ATG
ctacacagaaggagtatactggtttatttggttcttttgactaaatcttggcccgatacacctcactaagtctatttggttctttggctcatgggctttttgaccaaatcgtgccccataaacatcactaaatcgtgccccataaacatcactaaatctatctcacgcatagaaaaaaatgtgaagacagagtaaaaacatgtgggctccacattaaaaagatgtagtgacgtggacacttttagaggagagaaaactctgctattatatatatgattattatttgaactgcaatatattttatctgtagttgaattatatatcttcattcgtcttagtatatatgtatatatatatatatattaaattgtactatttttattaatatttattagaaagagaggattttacacaacatcaacaacattataaacataaacccaagaaatttaaccagttacacaaatcagatatgagaaatagcaaaaaaaaaattgaaagctacgattatataatttttaaatttataacaactttcatgcatcaatatttttcaaagatttgaaaaattgatatcactatagaatcttcaaaatgtagtcttcaaatcttttgtcctccgttgatgatagttagacttcaaaactaataatatatatttcatgaattggtttgacggagcttcgaaagagacaaagataaaccgtctaaaggatccatgatcaatttgtcgagtgaaaacaacatggatttagtataaaagaagtaaaatcagaccaaatttagatttatttggtcaaaaatttctggtggaggagactaacaaaaactgcccaacaacaacactatagccaaactttaaggaatcaacagatcgaaccgaaaaaggtcaagaaaaacattgacgaggataattttttttgaaatacataatccaaagcaaacatgcataccatattagataatactattattcactttttaaactaactggtcacacagattgaagatattttaccgtaataaaatggaaagtaaaaatgttattataaaatagaaatcatttcgccgatatttttatcctttgacaatccttgctaaaatttatctacttttcgtctctaaacttgtttcaccaattgaaaaaacgattatcccgatttgtggctcttgcctctcgtctaccggcttatatttgcaatctgcaacatatcgtcgtctccctattccatacgtatcaagcgagatatgttcagtctctgacttggccttctaatattttgaaaattttggaatgctttcttcaagtgtatgaaccatattgtatacttcgaactcgactctgatactgaccttatgggtccccatcttgcaactctttccgttgtgaagagcatactgctgcaaccctcctcctttacaaagagaacaatttgctccttaccctccttcatgaagaaaactgttacaatgtggtctccggtctggaaccgtccattcttccagttgttactatcttttggagaagaagtaatacgtctcatgccggtgagaattgaggtcttggattccttttcaaagtcaaattgtcaatcgactatgattatttacgacttgcttgtggatgtagtatcgacttacgattttctcgcttttgtctatgtgccttatcgctcatgtctccgaaagttggatttatcgtcaaggtatctattcagtttatattatgctctaatcagtgtattaaattttgttgtcttaagtcttggttgtgatgaacccttattctctctaattcctcttatcgtatgaatggaaaaatcagtctttgcacaaagaaaggatatgtaatagtgaaaattttcttttctaatatgtaaactgaataaatcaaagaaataaaaaattcggtccatcttcagatcataaattcatatgtataaacaaacaggacaatttaatttaagatgttagacaaacatgtttaggtgtcgaacatgacactttagttttctctctaataaaaatttctacatatttttatttaattgtgtgtttattttcataaatacatgtcttactactcacatctacaacaatcacatgtcattaatatagtatatatatacaataagagtgacaatttataatagctttcaacattatgaacttaactgattgtgctttttattgctagaattttattatagatatgtcaattatatttagaatcgaaatttattttctttcatatctccacagcttgtgtcctttatgaccgttaatctttaccgctaatttttgatttattcataatggtaagattatttttttgctttttatttgataataaagcagatgatatggtatgatgacaatttttatataccttctattaaatgtattttttttaaaaaaattggtgtgatgataatttttttaaaaaggttttactgtatttaaattttctaaaaaatacatgtaaacatgaaaatacattaagataaaatgataaaccgttaatttatttttctgataagtattctaaaatctacttatatatctaaacttataaaacttaaaaacaaataaataggatttaaaaaataaaaataatcatcatgtacatatttggtatggaatccaaaacaaatacaaaattttgacaaatgtcacacaacattgattaggtgcttatcaagaagattagctccttatcatgattaagctttaatacgaagactcatttcttgactaagacttgacttcaatggcgattctaaaaccctaagcgagaatccaaaaatgagtgaagaagatcacattgcttaggtgaagaagtctccgaagaatctctcaaaactatcttcgtcttctcttacaattccgacgaacagagatttccattctctctccaagtccgacgagttcaagcgtccgatcgatgagttagcttggagctcgcagtctgttcttgagacgattggtggtaagaaatcg

SEQ ID NO: 5292 - DNA, 3000 bp, Unknown
  misc_feature (1)..( 3000): cDNA_ID_1828157_gDNA_ID_1620776_Annot_ID_50312 3000 nt of promoter + ATG
cacacggtgttatgtaacctgttttttttttttgcattgtgacgtgttgaagaaatgaatcttgtagcacacttcttgttttctttgatttagttctgaagggattttctggtgattgttaaatgagactgaattagttttttcctctttgtgttcagctaaactctcctttaccaactaggaggataccagatcataagatgcaccatgatgaagaagatagtttttctgttgcttcctcgtatcctttatgtgatagttaaacgaaaacagaaacattgatttttaatatctaaccactaaaggacttttatccttagccatatatagatcagctacatccataagaagttttaaacccaagataacgattggagttgctccaacatttagtagcacatcgcgactggagagacgaagagaggtaatttttttgggtagcttataaggaaacgttttaaggaagcatggcattgctttgtttctctcattagagatgtcctatttattgttccttgttcgtgtatctatcactctgctaattgtcagcatattctggtttcagttttaccagaagttagaggaaaaacagaaagcacttgaagcagagaaaagagaaaacgagaaaaggcttaaggtaaatgttatatcctcatgcattacacttgcattcgtcaatagataatgtaggaatcttctatatattgtttccgtgttagttatgacaacagaaaaagttctgcatacaattcttgaaacgaaaatatattcaatataatgtatattgagcagtctcaaaaatatttggatatgtaatttatttggataggaagagcaagaagcagtcactaagcaacttaggaagaacatggcttacaaagctaatccggtaccaagtttctaccaagagggtcctccaccgaaacaaccattgaaaaaggtatggaacgaaacctcactgtcttcacttaccttttttacgcccactttgattcattttattgcttgtccaagactgaaaacatattgaatgatgagattcaacatttagttttcttttcttgtgatcgggtaagataggcttatcctcaccacaaacagcttatcctactcaactacgtctatggtcactttagctttgtttttattttaattttaagcagtaactcactaccacaattgtgaattcactttattcatggtaacagaagttgctgaatttctgtattcagatgttggattttggttatatgggctctagtagtctacggtaggaatgattccaaacgcggagattttaactttctatgattgtttgatttgcagtttccattgactcggcctaagtcaccaaaccttaaccgtagaaagagctgcagcgacacagttaacgcatcatatcaggaagtgaaggggaagcattgtgctcgacatcgtcacagtgtaggtggttgcaaggatgaagtcaaaacgaacagtgtcccaaggacaccaaatagcagcagcaaagatcagatgagaaagtccaaaaagggaacaccaaagtctgaagaagtacatgaaatgtttaatagtggccatgatggagagactggtgagaatggcgttggtgttgtggaggagtgaagcttcgcgtagttgtagtttcgttttgactaactttggtgaatgagaaaaacaagaaaaatggtgagaagcaactgcaaggagaagaacaggttttagagtgaaagaacaagtttaaagtttgtttgtttgtttgttgtctaatgttctgcagattgattgttctaaatttgattgctaaaatcagctgctctattttcgtatgatcttttcttatctgtttgacaattaatgtgaaatgtatattaaagttgttgttgtatggatcccaaattcccaattattataactagattaatggttaagctgagcgacatctatttatataatttcattgtgtttgtatgttttatttttctaagtacaatagatataaaagtttatgagagatgtagagattttgtagttttgaattcgttattcttgaaccaattgtatatattttattatttaaacataaatataaataaaaaagattgcttaaccatcgggttagagaatatttatgtaagtatatataaagaaaaatacaaatataaagatttattaatataagattaacaaacaatgtatgtttttttttaattatcaaaaatatatttttgatatgaaataaaaaaaactctcgtgattatttgttacattgttaaaaaattaactctaaaaaaatatttcttcttataatctttcctcctaatttagcctttcttattagtcacacccaattcaaaaaaaaagctaaaatatttggtaaatgggaaattctactatgatgcatagaatctcgtctgccttgcgttaaaaaaaacgttatttggttattatgatgtctataaaattgatgcttagcttaggctagcactagtttaaaaagaaagttgataatgtcatggagactcaaaattttaattgcaaatgtaagaagcttgtgatctgtatttgttgctcgacgtgccaactagttaattagtagtatagactacactaatattaataaccaagtcaacagtacaattttttagtaaagttcatcttttcaacattttactaattatagtttattgacttttgactgaagaaaaaacgttaattaataatgagtgtgttacccttttcctctctctctccatcgacccttaaatttctgcaactttcaaagctaatcctcctccagcatctcacggatctactataccttttcttccctttttctgaattgaatcatatttttttttaatattatacgatcaatacaaacactgctacaaatgtatcataaatactctctcactttctcttatcaagcaatcttgttgaagaaataggattttgagaatttgatcacagttttgaaggaagaaagatcaaacaatg

SEQ ID NO: 5293 - DNA, 3000 bp, Unknown; identical to SEQ ID NO: 5273
  misc_feature (1)..( 3000): cDNA_ID_1828261_gDNA_ID_1620776_Annot_ID_50315 3000 nt of promoter + ATG

SEQ ID NO: 5294 - DNA, 3000 bp, Unknown
  misc_feature (1)..( 3000): cDNA_ID_1828257_gDNA_ID_1620776_Annot_ID_50317 3000 nt of promoter + ATG
ctttttatgtaaataaaaactctgaaattgaaagaggcactccaaggctagtaattaattacaaaccattagatactgctttaggccatcttcattggtaagatactttaaaagttaatgtagtttctgttcaattataaacacacacatatacagatagtttctcgattattactttctttgcagagaaactattctcaatctctctcatatctctcttctatttttattattattttatactttttagttaatgagaaactatgtaagagactactgatggagatgctcttaaaatgtattagatatccaattccaaagataccaacttcaagaacttagacttctttttttgtaataaacttagttaaaaaagatatatatatatatatatatatgtttattttcataaatatcttaatacagaacatattaaaatctaaaaatgttaatttatgtgataaaaaaaaatgttaattaataagatgtttatttgtaattggttgcttaaaatccgatgtaaactgtctcaaaagcttataacatattacatattctaatgattaaaatctatataaatatatataaacaatatagaatttatagatattattaaagtgatggaatatataagagttttgtgacatcacaaagccaccattaatggatctaaatttctttcacttgtccactatctctctaccaaatttgtcatcttcgtccccactaatcactctcgcaagtatctttcttctttccttaaactcttaaactctcgccatcagatctttttctctgatttcttgggtcagtattcttcttcatagattgtttcattgtttgctctgtcttgttgcgttctaggttttgtttgttctgtctacctctgtaatttctctgttttgctctctagggtctttttaatttgatgctaattacattatttttgcttctaagtggatgcaattagattattattttcatagaatgtaatgatttcttcggagtaacagcttgtttagttgaacaaatggttttgtggaataagtatttgattctttggccttaaagttaatctcttttctaatgtaacttaaagtcatatcttgttattttcatttgcttaatcaaaaatagaaacttgacttggggtttacattcttgcgtctttctaatgttatcatgatgtatcacactgttatttgtattttccaggtgagaaaataacaaagctagctagaaatggaacagtatgagtttcttgagcaaattggaaaaggatcttttgggtcagctcttttagtgagacataagcatgagaagaaaaagtgagacatgctatcttcttttgctgcctcttattgttttacttcaagaaagttttaaatttttgatgtcatgtattggttttcattagatatgtattgaaaaagatccgtcttgcccggcaaactcaaaggaccagacgatctgcacatcaagaggttggtgttcttctatatactctctgtatgataagcttttttctatggtttgatcttagtttcatttctttgagtagatggagcttatctcgaaaatgcgtcatccatttatcgtggaatacaaagactcttgggtggaaaaggtaaggcataccttatgacttgaacaaaagtatatatcattccacaccttttgagctaataaggattttgtattctttctcttaggcttgctatgtgtgcattgtcataggttattgtgaaggaggagacatgttagttttctgtggttcagcttttttttttacgtagattctgtcattttggcttcactatatagatggtgacgcagcctcatattcttcttatgttacagggcacaagctatcaagaaatccaatggtgtgcattttcaggaagaggtgtgcatttcttttctcagtgcttttttcatgaactttgatttggtatagttatcatcctattttgtgcctttttctttcagaaactgtgcaagtggcttgttcagctcctgatgggccttgagtacttacattctaaccatattcttcatcgtgatgtcaaggtatcaatcatgttgctgactagacaatccaaagcttaaagatgatacttcctatatgctaatgttttgtatttttgtccagtgttctaacatattcttgaccaaagagcaagatatacgccttggtgagcttatctttctgttttcttgtcgactcttcttctgaaagaatagaatatcaacctgattatttgccgttacaggtgattttgggttagccaagattctaacatccgacgatctcacatcctctgtgagttttatagttactctatcatatgagtgcatatctaccatgcaccgtgtttcctttaagtcttttctaagattatttgtcctatgaatgtcaggttgtcgggactcccagctatatgtgccctgagcttttagctgatataccttatggttccaaatctgacatttggtctttaggtacgtttttattgcatgtagtagtggattgttaagttcccttatttgctacataaggaagcagtaatctatctcttgaattactaaagtttcaagcataagcctgaaaagattactgcaatttagttttcatgaggtttctaagaagtcttcataaaccataaggaagactgaagagagttctcaagtcttgtgttctttttgttactagatcattctaagttgtctagtgtgaattggatcgtagcgtgagggccagctgtgttatctgattaaatttgtcaattagcttgatggtctttttataaatacgagatgcagagagattgtgaggggtgttaagtgatctgggctggtttgggggtatggtggcttggtagagtaagctactctctcgatctaaactcttgttggttctttgattcagtttctgatgtgagaaataaagaaaatcattctaaaatcttaacaaaaatattgcatgtgtcacaaattatg

SEQ ID NO: 5295 - DNA, 3000 bp, Unknown
  misc_feature (1)..( 3000): cDNA_ID_1826633_gDNA_ID_1620777_Annot_ID_167780 3000 nt of promoter + ATG
tgtagaaaattaggatgcaaagactttagatatttcaatcttattggtaaaaataaattctaataattatttttattattattaaatatagtttataaatattatttatgataagtatgaatttatttgaaaaatagtgactacaattgatttattaataattatttttttgaaaattaaataattcataaataaatgaataaataaaaaactcattttacaaattcactatttaaaatcttcaaatatgatttcaaaagaacagaaaagtaaaactacatttaatcaatcaaaattatttgataataaaatataaatatttttttaaatagttttgaaattatatggaaaaagaaaaaagtattttattttcttttattattctctcttaaagtgaaagtctcgtttatgagactttagaaagaaaaaaaaataaacgaaaagaaaaagagtttacaaacttttaaaattaataaaatcttgaaagggagattggttaaaaaataacttgaagaatttaaaatattttcaaaactaaaaatattaacaaagtcttctttgtcaccgttaatgtcctcttgttcttctatttcaattcgagtttggttatagaaggaattgagtcgggtctctttatcgtttcttggaaaaattcctttatggtggtgtttatattgatctttttcggcggtggcgacaagtgacgactcctctggattcatgtgaatgctctgtaaaagatcgaacacaacttcttttgtaagttcttttaatccctctaatactttctctatagtttctttcgttggcttcaatttttcggccactgaaactatcttcgtgccggcttttctcatcgttgaaaaaaaagctctaaaataacagaaagaaaatggttaaactggagaagaagacggacccaattcaattggaagagatatgtgtatacgttcatttatgagtctaaaagaaaatatccatacatttataactctacatccctaaggaaataatatcccatatctctactcatacacattagtcataaaatcttacttggtacttgtcaaattccctaattgatcataaactcctactaaatatctcataaatgatgtttatacacataatatataccataaccatcgatatttacgtcgtatcaatctcacgtcttaatcaatgcccatatcaaaacttcatgcataccttatatagctagcatctctcccatgttcgaacaacttcacatctcgaattaaatcaaatctttagacgatcaaaactattatacaattttatccaattatattagtattaattaaataaattatattgttataaattttagtggcctgttaaattagttattatccatactgaatgtttgttaaaatatataacatatgctaagtttaattcaccaataacacatataacaaaaagttgttaaaaaaattgggagatttgcaaaactaccatttttttactacctttttgcaacaatacttttttatgttgtccatttttaaaaataccctttcccttgaacaaaatgaccaaattaccctcatctaatagaaacatgtaattggaaactgaacttttcccaccaattttttggcgccaaaatttttttttcccgccaaaaaaaaagtttccgccaaacttttttcccgcaaaaaaaaaaattctgccaaaagaaaaattttccgtcaaatttttttttcgtaacaaatttttcctcagccaaaaaattgattttaaaaatccttataaatattttctggcggcaaatagatttacaaggaattttaaaagggttttaaaagatttacaagagatttaaaaatgttttaaaagatttacaagagattttaaaagagttttaaaagatttacaagggattttaaaagggttttaaaaaatttacaagtaattttaaaaggttttaaaatctcttgtaaatctttcaaaacacttttaaaccctttaaaaatctttacaaatcatttgtaaatcttttaaagccctttaaagttccttgtaaatattgtaaaccccttttaaaatccattgtaaatattttaaaatccttttaaaacaattttaaaccctttaaaaatctttataagacatttgtaaatcttttcaatccctttaaaatatcttgtaaatcttttaaaacccttttaaaatcccttgtaaatcttttaaaaaccttttaaaatcccttgtaaatcacccttttaaaatcccttgtacatcacccttttaaaattccttgtaaatcttataaaacccctttaaaatcccttgtaaatcttttaaaactcttttaaaatcccttgtaaatctatttcccgcaaaaaaaaaaattggcgggaaaaatatttttgaaaacaaaatttggcgggaaattttttttcgaaattttttggcgggaaatttattttggaatattttaggcaaaaaatattaatatttcattttgtaaacctaaaacaatttccaaataagagtaaaatggtcgttaaaaatttaaagagggtagaaataaaaatggataaaataaaagagtatagttgaaaaggggcatcataaaaaaggcattagaaataatttttcatgttttaaatgacaataatttaaaagttaactaaaagagtctataatgggtaataacaaacgtataacactagtgaaaataggacttgtcaatccatgaattaaatattttcatggatacggtcgtagggaaataaatctttccgtcagtcctaaaaagcctaaattattggatagacaaaaatctgaaaatcttaaatcacacgtaaatcaaacgtatttacccccacatggaacttaatccaatctattaaattcaggtggcgaccgttcattggttcttgtctctagaatcccaaaggactcgtttccgagtataaaaatacgttcctcaattcaaagtacaaaccaaaaacagaaccgaaacagaaa

SEQ ID NO: 5296 - DNA, 3000 bp, Unknown
  misc_feature (1)..( 3000): cDNA_ID_2161251_gDNA_ID_1620777_Annot_ID_167793 3000 nt of promoter + ATG
ctaagtttaaattcatactaaatattatttcattccttgtatatttagattctgattgcattggtagggcgtaaataaggcctttaactcgagttttgagtactcaagtgtctaccaaataattattgcacgtcatattttatttaatagaattgtctcctaacaatttaaacccaattaatttagcactaatttagtgtctcccgtgtaaggcttatccatcatattcatatgacttacacggtcaatacagctcactcaacttttatatgtgtttatatgaatttcatctttgataatgtagaattattccaatacgtaacacaacaaactaatcaaaatcccacgtgtaggacccaaagcatggacattggtggctccaattcgggtcgggtacactagtcggatattggcccgtatctctgttcacacacctgagggagcatggaaacatggtccagtttggtggcgagatcgtgaacacacgacctggtggttcacatacttcgactcaaatgggcagtggccattttgccggtgaaggttttggaaaagcgtcttactttaggaatcttcaaatggtagattgggacaatactcttattccgatatctaatcttaaagttcttgcagatcatcctaattgttatgatataagaggaggggtaaaccgtgtttggggtaactttttttattacggaggaccgggtaaaaactcgaaatgtccatagagaaaaaaaagaagtggatagtgttgttttgagcttaagtaaatgagattttttgggatttagagctcaggacaatgatgaaagatccatagtttttttttttgtttgtaagaaaagaaatgtatcgattgattgatatgttatcaaatgtgtaaatgtagaatatggtgttaagtggaagtaggcgtttatattttttttcctatgtctttctttgtttgtaatgcatgcctgaaagaaattataacacataatttatatactaacaattggctaatttctcacagtccatccatattttcatttttgcacttcccaagactcaggaaagctaatggttctcacaatacaaaaccaagactcgaattatgattacagttccatttaacataagtgcagtttctgaacacgattttatggtttttaatcaaaattaaggagattaattgaatttggttcattcgaaagaattttatagaatggacggaattagaaagaaaaagaagaatacaaggtgaatggacataggctaaaaagaacaagatgatatgatccttgaacgaccattatacatgtgtagtccgacatgcagccttttttatcaacataatttttttagatatactagagtatttcacaacttaactttctatcattcttctttatttttgatcaatcaattaacataaatttctttacgttatcataatacgtgtcgcgtataatgtagatggcaagaaagccaactcctataggacaaacaacatcttaccactttgtgtcttgacaagattggaagaactagaggcttaattactgccaacattaaaacaattgttacgaagttttcctatctgatgttcgttgagagtgtgcaacctcctatgcactaggaaacctcgttgttggtagtctgttcaagttaaacagagttatcgtctcattcagtcaccaaaggaggtgttagttagtcatgatgtagcgtgcttcaacaattctattgtggttcaaatacttgtttcactactgaagtgttgtgaaaggaaggacaaatgtgtaaggagttctattgctgaatgcttggccaaattggctctgatggaacctgagacaatggttccaaaatttgcatcaaggttgacaatccaaaacccagagactaagcaaacacttattacggttcaagaagaccacaacattgatgaaatgatcaaaccaataattccatgatttattagactactcaaaaacaatgatcatgtattttatacaattattgtaataagtttaagggtccctaaatttatatatatataaactattcttcaatgtattatacagaagtgtggtattgacgtcgataactcttagtgaacgcaaatcaaatcttttgaaaggatgcatcaatgaaaaagtgtttcatgatgtttatgagcttgtttatttacatcatgatgtttaacactttgctcaaatataattgtttgcagaaatatggtctagagataagtatagcagtttgggagggtgtcattacactttttaagaattccggagacaaagtaaatccagcaactgtgtagaaatatcattcataaagttttaagcgtggacgtgtgtacgacgttgattaatgtggaccacgaatacttaattagaaatttcacgaaacatgaagaagaaggattctccggaaacttgtatgtattattatttttaacagttcagcaactgctcctacttataccaaccaaacgttactttttaataaaacagttcaccatatctctcaaatctcaatggaacccacttttattttcccaaactatacacgtttcatctacacacaagaaagcatcaatcacaatacactgttaaatagagaaaataaaaaataaaagtgtgcgtctttcattggtccttggaaaacagagctcgtttcatgcgtgagggcaaatgaaaaacgaacgagaaagttgtgtgtttctgtggataaaccatttttcgtagaaagaaattattcaatcaacaaagcagtgattcatacaatttgtcttgtttagggtttttcatctttgattcaatgtcgacacagagcaacctctgttgactcgtttgcttctttctttcttagatacagaattggaatttggttcatcttctttgtgaaaaatcagattttgattactgggttttagacaagtctgcgttttttttattgaagagacgaaagatttaagttttggggttttggttaaggaggaggatg

SEQ ID NO: 5297 - DNA, 3000 bp, Unknown
  misc_feature (1)..( 3000): cDNA_ID_3076488_gDNA_ID_1620777_Annot_ID_167799 3000 nt of promoter + ATG
gggtgaggatcaacggtcgggatccaagggaatgggatggagggaccaaagctgtgtttgttttttatatggattcatacgaaaccgtaactttgtgtcagataattttcgaacaaacatggcccgaaaatggatgggtcaatcaacctgtccatcaacgaaaagacccttttaacacttttttttaatagagaaaatagaggaacatatttgataaaatattggtttataaatcttgttattgtttttccgttgatgatttacattatggaaacaaggtttcgaagcactaaactcattaaatatggttgcaaatctataaatattggctaaaaaatcatggctggtcactatgaacgttggagattagtttggaaaaattccatagttattaaaaaatggttgagaggcttagtaaatttcctcaataatttatttgttggatcctaggtcacaattagaatggaccacgagccgaattataaattcagtactttagctgcatgtataatacgtagacgaactttataattgggttacatatatttatgtcgtcttacattatttggtgatagattattgcaattatatagataggtagggagataggtacagaaaaatgaaaagaatctatcaaatcacaaagcctagatatgttgatggaaaatgaatataacatcgcacgtagtttcctgagctcaatactcaacatcagcatccaagtggcgcatcgcatggataaccagagaaagaaaatattgaacattttgattgtgtctccagaaaaaatttgtattgttttttctcaccaagaatatgcatatgtgaacaaataatatgttaaataaataaataacatattttcgtctgatctttgccaataataagaaggcaaactcgtttgtgatatatatattgttttcgcttttgtgacttcatatttatctaatttcaagtctcctttctttaacttaatttccccttgattatttatgatacgttaggtgatttagagcaaccaatagtttgcaagtacctttaagatgaaaatgactttctctagtctttgagaaaaaaaataaaaacagaaacaaagtttatattaaagtagtatgaaagaacatgccactttcttgattgaaaattatatgatagacgtaaaaagctgtcgacaaaactaaaagaatagttccattcgaaatattatagatgctctcgttctattttctttttggttaaagtgctcgtttttttcttgatactctctttaaattacggccaatttcataatttcaaacttaatacatatgtaaaatcattaaatataccaaattatgcttatgtctatttttgtgaataaattacatagttcattttcataagctaaagtcatcatgaatatcagcatcatcaattttggcataaatttcataaatcataaattagctaagaccattgattttgcagctcctatacgcctagaccagcgtttattttattcttagttttatccacaaacttgctttatacagaactattctaaagtaaacactagctgatactatatactaatttaatcttaattagacgattttccattagggccttcttatctactatctaggaacggaccttcgcttctcgaaacccatttcatcccgtacaatcgaagtgtccaacatccgagttggtaaaaaatttcttactacgtagtaggtactaagaatcacttatcatatccatatattcttcacatttgatttatttcataccatcatttgaatatatatgtgttgattatcattttgttagtagtcgtgttcgataattttgttctgtatctagcaacaaatttacagtgacaagtattaaaataataccgctctttaactatatatatgtatgtatcagctcactagttgtttgtaaccagttcttgtttttccagtttgatatattcgattcaacatacccaaaacatctctcatatactgaactaatatctatttctaattgactcgattcaatatcattagtactatattatcttctgatatgcgacttcatttgttttctttcttctgttcggttttccacttgttgtttaacattttcaccttgtttcactatttgcaatcaaataaacgatttatgtaggtgtatctatatatgttcttaggatcataataaaaatatattttctacaaagtttttcgaaaatatatatacattggggattatttttttaactgtctacagctcacacatgcatattatcatatttgaatgaagataacgatacaatgccgatactgatacaaatcattatgttagatgctcaatttgtttctataggtcctataatatatacatcaagtcatcaactatactttttgaaaagaaaattacacagagctttcaaataagttgcgtgtagtttagtggttatatgtactagtagttatgttaccatctaagtgtattgtcgatgagaaaaaaaagagttcaaataaactgacatagtatgctggtaaataatcacactttttccgttttttccatttcgttttcaataatatataattttgtttctcgccatgtttcattgatattaaaaatctcatgatcatgcaaattctatcataacacagccttggacctttcttagatatatatgttaggaaggccttatctcgacctatgaagcctgaagctccattgagccttttagcatatgtcctttttcgtaattatcattttatttttcttctccgttaactttcatatcttttttcttccaaaagaaaataaattaagatccctcgagcctctctctctctctacacactcccatagaaataaatattttcaagaaccaaaaagtttgttataagcggtttcatattattcttcttcatcgattcttgattttgcaagaagacaattcaagaaagcgatttagaagacggaggagttcttaccggagatcttatacttatg

SEQ ID NO: 5298 - DNA, 3000 bp, Unknown
  misc_feature (1)..( 3000): cDNA_ID_2161264_gDNA_ID_1620777_Annot_ID_167797 3000 nt of promoter + ATG
ataattttaaaatttgttcaaagtacaacttgcctttttgaatgatctcatctgttttttttttctttggttgtgtgctttatttaaccatctttttctttcacctgaatgaaatcataaactaataaagaaaaaagaagcttacaattgttagacaatattcacatgggatgcgatgttatctactagtttctcagttcaatcacatgcttggtttctttcatgttgatctgatttagtaatacaagttgatcacatagacttttgatttctcacttcttggttgttgtgatacggtaatgcaacttagcgaaagcccttctttggactagctaaaaaagcaacacattcttttcttctaatgcgtggttatcttgctacttagagtggatggtctcttattgacttttatagtcaacatttgtcttgttgcatgcaatatcatcaatgttacatgtttgcatatttgatctagaagataagaatactgcaacgagaagaataggaacatagtgcatgattagcttgaattagaggttcttttggtttttgttataaagtaaaaggtggaaaagtcacatggactcccgtggattccgctaatgaccccaccaactttctctcctaagattttatttttgatttggttattaaaaaaaaaaggagacatagggttctctacacaccacaatcaaatcatctataagactgcgactatgcttcttctctatctttctcaactcttttgccatgccctctggttgcgttgttcccttggtgggtcgtattatgtctctctgaggcacgctactagcacgtgtctacttgcatgttaccttcttcagtgaaccctattttcaaagcagtcaatgcattgctgaaaatgtaaataataatcccaaccatacaaactatcgttttttgccattaaactgttaccctaactactcatatgtgtgtaatgtgaacgtaatggtctctataatatatgatcagttcatgttttatgcattttagtatatttttattggcctatttaacatctctatttccttcataattactgtggctgctgtagaaatcttttaacttttataatatgtttataaaactgactgaattgcgtgaattataaattgactgaaattaccttggctgttgtagaaatcttttaactttttttaatatatgtttataaactgactgaaattgcgtgtatatattatgtagtccagtattttgtgtgactgactaaatattttgactaagcacggttgcttggtccgactatatattctgtcacataggcaaaactattgtaaaatcaggtaatgttcttgaatcgtctttgggttgagttttggtgtcagagaagctgggtaagtgggtcagtagagtcgttggggcatatatataaatgtccaaatacattaaagaaagagagagagaaaaggaaattgagttttggggtatcgtggagaacataaatgagaggtgtagcgttatttccgggggttcacacaacctctaaatggtatttacacgtgtcatattgagattgggtaattagtaggcctaaggggggatgtctcctcatggggacaagactattagtcctctcctgacaaatgacaatggaggtaactattcactgcggcggttttttgactgctgcactcaatcgtgtgcgtcctcgatattctctaccccttaccactctttcttctttcccttttttgccctctttagccacttagccgttttagccgagaaagcccatttaaactttttcatggtagtgaatagtgataattctgttacatttacttgctataacctataaccattctctgtctttgatgtctttgtatagtgataattcttgtgaatttggtgtaacagaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgtaagcaaaagcaacacttgcatgttttccgacataactaaccactacacttatatataaatgggtggtatgaatgtgtgtgtacacaggaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatgaatttatttatggtacttatttaacgttgattaaaagatggatgtataattctgccttgctttgccgacaaaggaaaaaaagaaagaaagagtgaagcatggacgacacatgaaatggatcttacactcactcacatgtagtagaaggaacaagtcaaaatgctttgtaactattattatcggtgaataaaaataacctcttttgtcttctccggacctctcgtgatatagcttttaccctcttattggcaaaacgttgaacaaacaaaatacttagataggttagatttgtttattaactatgtgtttttcaaaaataattataaaatatcttgttatttgtgtaaatcacactaaattaaacacattcttttattgacagtttaatcatcatgtacattttgctaattgtagccaaaagtttagctatctagcaattggaaccttgtgcccataatccaaccatctctgtttaaattttggggtgggtttcaaattatccttattgggcctaaaatcggcccaatattaaactgaaaccagacttttatccaatccgagtaatcggaacaaaacaacatgatcgtgtgaaccaacggccaaaaaatg

SEQ ID NO: 5299 - DNA, 3000 bp, Unknown
  misc_feature (1)..( 3000): cDNA_ID_3076484_gDNA_ID_1620777_Annot_ID_167804 3000 nt of promoter + ATG
tgcccacatctcacagtcaccaccattgacaagcttgtaaacggtacactcacctgcaacacatttacactcattaaactcatgatcatatatataaagagaggaagggagaaaggaagggagagaataagagaagaagttaaggtataccagcaaaatagtggtgcaaaaaccacactggacatggcaaatctgccccggcagatcaaatagatggttgagtgttgtcgtcatgttggggagctttgtcatagagagtgtgtgtgtacgatgaatgataggagatatatgtgtgtgtgtgtgtgtgtatatatagacagagagataggttttgttaatattcattaatgcaaatatgtaattatatttatatctttcatgtggaatgctttggttatatgctaaaatgcacaatacaattcaacttatgtacgtctctatctcacttgtaataattggaatcttcatagtctctatgagctgtaagcagtaaatgattctcattctttctattaatcacattcctaactccttaatattcaaactacattttcttctctaaaataaaataaaataaaatgatgtatataatacttttgttgatgatggagtttaattaagaattttcgttatacaaaagcattgttataagatttttatgttatgtcacactcacaaaatatatatgacaaatgatacataacgtttgagcgtttaccattagaggagacattttttgttgtcaaaacaatttaaaacacttaataacctataaacagaaaatatataagctcccttcaaaaaccatttcaggatttttctgataaataagcatacaagataatatgtgttattgtaagataacactaggttaaacaaaaaaataacaagagataaaaatcgatggtaaagagtatgagtattaaaaatgaacatgtgaaaatggaaaggcacgttgcacaagaggagatagatagacatcgaagagagctggggttaataaatgatgtgatgtggtggtgtggtttggtttgcaagttagaaagaaagaaaaaaacaagtgaggttgagaaagaaatgcctctttgtctcatgtgtagttgtctctttaaatgggatttaatgaatctctcacaaaactcaacagtcttttggagttttggttgaagtgagactgaaaatgaaagtgcagtgagttgagactagtgcgggtgtttctaggagactcatcacttttagtaactcggaatcttaggattttgtctttcttctctcacatttttgctaactgtttcttgaccattttacccaaactcttctctctctctctctctctatttcttcaagtttcagtgctttctctctgtgtcatgttatttctactgtccctctctttattgctttctctctctctcacttactctcatctcctattttgtgttcaaccacaagaaaaagactaaacataatactaatatttactcaatttcctacacatttgtaatttttgtgtgggtggaatccaatgcaatgacccaaccccggagtgaacaagtttcgacccattttgagagatcacataatttaccgacccattaataagtttcgatccattttcataagcctattgatgagtaattgagtaggaggtacacatttgtgatttgagagattagaggttaaaattatacattgtaatcatagttatggcttctggtttaacagtcttttactccatatatactgatatacatctcatttctagtctcaaacttttacatgacagcttatagattggtcaaatctcactgttaacataaatagaagctgtgaaatgacgataaaatgtgcaaagacaaacgcacgttaatgtcaaacacataatcaatatctgagagaatttaaacttatcttagcaaacaagttatcagagccaacaacaacaaaacttcaagacattggtgtaagaatatgatcagaatcaacataatggctaaattttgccttgcactaatccaggttaaaactaaaacaatgtcgcaaagaattgttccaacacaacgtcctaattctacagccacaattcaacatttccacatcagtcaaagcataatgaaacaaaaaaaaaattgatcaaatttctaatcaaagataatataatgtattatgcaacaattaaaccatccctcaatagtataaaaccatctcaaaatatctgaattaaaaaaaaaacaatctaaattccaaaagcaaaaagacataacctactcttcatcagccttcttgaacacgtaagtagttccacatttcccacaataatgcctatcgaaatgactcgccatgaaagttccaggaccacaactaacagaaggacactctttcttcaacctctgaactttcccacttccatcaaccttgtaaaactgcagaactgctagcttcactttcttgtgcgtatgcttaatcttcttaggtttcgtgtacgtcttcttcttcctcttcttcgcacctcctctcagacgtagaaccaaatgaagcgtcgactctttctggatgttgtaatcagctagtgttcttccatcttccaattgttttccggcgaagatcaaccgttgctgatccggtgggattccttccttgtcttggatcttcgctttcacattgtcgattgtgtctgatgattctacctctaaggttattgtcttccccgttagggttttcacgaagatctgcattttcttgtttgagaaaaaacgcagagagtgaaaacaatagcttttatatcaaggaaattagggttacaagtccatagattatgggcctggccttagggcccaatttaataagtaaagcccgtaatgattaaacgatgtcgtctacaggataaagtttgaaaactactaaaactctcatcttcttcttctctgagtatcaatggcgattgtagcatcactaagagatattaatctcttctcttcacttccttcaacgcctccaatg

SEQ ID NO: 5300 - DNA, 3000 bp, Unknown
  misc_feature (1)..( 3000): cDNA_ID_2161236_gDNA_ID_1620777_Annot_ID_167789 3000 nt of promoter + ATG
actcccatcactcgccgtcaagaccatgaccttatgctcttcaccttctccaaaatcaccggccacgctgggtcacgcattgggtgaggctaactaaacacttaaacaacgttgctgccttgtttgttttgtagacaacaactaaatcatgctcgttttgcaacaactaaatcatgctcgtttcatatatgttgcaactactaaatcatgtttgttttgacacggctatagttttaagcaaatgataactaaattaaaatttacttatccttcaacttctgtaagttttctctttagattttgttatagaattgtaaagtgtatatgtttcgttttgtgggtgaaggtgggcgttagtgaaggacatagaggtggctaagaagatggtgcactacttaacaataaactccattggtgtgtcgaaggagtcacaaactcgagccaccacaattctaaacgaactgacaaaaacatgtaggacacaatcggagagcttcttcgagtatggctacgagaagatgaagtcacggtgggagaggctacgtgaggtagtcgaatccggtgacgcattcactctccctaattaccctcaagacttctgcaacttctttggcaaaaccctctccacttctcctggtacgtactaaacaccacgaacgcaattttgtgttgaactttgttaacggttctggttgttgttgcagcgtttgcgtggttggggtataaagaggaaagagatctcggaagtctcttgaaggagaagaaggttttgacgagaggaggagaccgatgtggttgtaacaagaggtacgtccgtgtcagcatgcttagccgcgacgatgactttgacgtctctctccaaagactcgctaccatcaaggatctcaaatgcgtcgagccttgattttttttatttgctattttcgttatgtttttaaagcattattcagtagtatgtgaaataatatgttttaatatatcatataagagatttaatgtttgttcgaatcgttaattatacacaaagtacttgaaattctatgggagaatgagtaatgtaatcccaaacagtattcattcttccaaacaaagggaagacataaacaaatgaacacaacctgggcttttccaataacaatgcaaagttaagattcggatcctgtcttaggtttttttgcatgatttcaaggtggttctctcaaactaatatctcagcttctaagaattcatttttaactagataaattttccacataaaataaattctaaagcggctgagaacttgcatgaaataacctattggattggcagtttaatttaatttcgtttggcttctaagcttttctattttttgtcttttaaatgtgagtttccgcgctacgcaatgattttctccctcttagttaaattgattaatgttatatgtgtctatatgcatattttagataacataagaatttctttgaccaaatagggtatataacttttgcaaaaataattttcttattttaagatagataatatccgttgtaaattaaatgtataaaagaaaactaacttatatgtatattagggtggtttaggtttacaattattcaatgcacgtacatcaaaatgtaattatagatgtggcaaaataaggctttgaatggatgcagtggacatagcggtctaatttgtctgcggtttagttcatcttatttttggggcggacaataaatcgctacagaccagttttatttgtatgtaaaaatggtccgcaaatggtccgctgcggttttcttctatttcttttggtccggaccactgcaaactataattgatgaatggtaaataaaaagcggtctgatccgttgacggttttgtccgttccaaccgccgtaaccagtcacaccctaagccttacatttttagtccttaaataaaatccaattcgggatatgaaacttaacaaggtgatatttttcgtatcgattcttaatacaaaagaaattattgatagaaagtgtttaagaaaaaataaacaactcatattgattcacttatgaagtcttgagttctatcattcacttgtcaattctcaaaattgaagtggcaaaacaactcttgcccatatagcttaagccttttgagagtatgaggagccaataggcccaaagattactagtaaacacaaagctgctggctgctgcgtcttaaagaggacgaaacaaaaacgacggacacgtggatcgaccctattggtcatgttccaaacgcataatttactcagaaaaacagtccataacatgacaaaactaacaatctcttcgtctggaatctccaccacatttttattctcttcaaaaattatctgcttctatttttataattaagcaagaacggtcttcgtagcataaaaacgagacacggatatagagatatcgtgaattgacttttgtctgacaaatcctcttcgtcaatttcagtggctctgctgcttcctttgttgtgaagccacatagattagattgaggaatgatccaaactcatgtcatacacacatttgtaatctgctacacaaaatacttttaaaatcacacacactaatattttaactctccccactctttgccttgcccttggctctagaaccgaacgtgactctccagatagacttttggagtcacaacattgagtttgaaggtttgtgatttggtttttctttctctttggatcgatcattgatcaaattcttcttcttttgaatgattctgaaatacccttttgaaaaggcgtctcctttacactgtgtgattacgaatttgttctggaaattgagctacagaaacccagaaattagtggccttttggtgttcttagagtcgaattagttttgatcttgattcgtttatccaaattctggttttctggttccaattgctgatgatgaattgttttcttccaattgtagaggagggaagaagtgagctagggattggttcagagtgaacataaatg

SEQ ID NO: 5301 - DNA, 3000 bp, Unknown
  misc_feature (1)..( 3000): cDNA_ID_2161213_gDNA_ID_1620777_Annot_ID_167782 3000 nt of promoter + ATG
tttaagcaaaacgctgatgagtttatctgttctttattgcctggaatttctcaccctcaagtccaatactcacaaggaggattattagtgaagagtggaggaagtaatatgcaacatgtaacatctttgtcttttttgttactaacatactctaattacctaagccacgcaaataaggtggtgccatgtggcgaatttacagcttctcctgctcttctccgtcaagtcgccaagcgtcaggtaactaaactaaccaacattcctctgttttagcataatagagagattcattaacgtaagtgtttggtggcgtacgttaacataggtggactacatactaggagataatccaatgaaaatgtcgtacatggttgggtatggttcgaggtttccacagaagattcatcatcgtggcagctcggttccttcagttgtggaccatcctgatcgtatagggtgcaaagacggatctcgttatttcttcagcaataatcctaatcctaatttgctaattggcgccgtcgttggtgggcctaatatcaccgacgattttcctgattcgagaccttactttcagctgactgagcccactacttatatcaacgcacctcttttgggcctacttggttatttctcggcccattattgatttcacacctcgaactcgaacgaagcatgaaagtctatttttgttgtgaaacatttttagttgattgttaccgattagtagattcactagattctctaaatctacgaacaaataattgtataaattaatcgagtacacaataatcaatttttaatcatatgggagttaggaaaaacaaagagtaataatgagagaaagggggagacaagagtaattaatattttgatgaccaaactaatcaaaaatcaggaatttgtcttttggactttggtcggctgctttacgcttaacacaaaagaacgctattttgtctcctccacgcaattacctcttctcactctcagacattttgtcaaacagatggtgctcgtttctgaatcagcttaagaactaacaaggagacagacactaagcttggtttttctctccgattagacggaggaaaaagtgaaaacgaggggcttagacgagtgatgtgatagagatggaaggagttgagctagaattagaaagaagaagcaagttcttgaacagtttgatacagaagaagaaggctaaagaacagcaagatcagaaagatgagttcaatgttcgtgttagggcttcagatatgcctttgcctcaacagaacagagcctttagtttgtcgcgtgagattttgaatgctactccagggaaggctgataacaaaagactcgctcatgccctaaaaaaggttagatcttttgtatctctctcatgatttttctgtatttgggttgaattggagtcattgaagtctagtacttggattgagttttgaattttgacacagaatctaaaagtattgagctgcttttgggttctagggctacgtctcaaagtcgcatgctttttgtagaatgtggttatggtcttctctttcttgattggtttgaagatgtgatgaatcttgaatttggattttcgtttgtgtacttgcatattgttgaacttcatggatggtcccatatttgttaggttgcatttgactttgttccattgttgttgtcttttctatttgtagcttcggttagtctacttgactaggttgtttttgtattgcgaggataactgtagtaggagtctcgttgtgaaatgtcttgaaactggatgttcttgttgtttattgagatgattttggagctgtcttaggccataactaatgaggcatagcatgcaccatctgctaagcttctgtatctttgctgttagaaattagttgctacctaatgataactctgaagcatgcttgctttaggaagtgagccttgcctgaatacaaccttttacaaaggacttggttcgacaccccatatatagagttgtccatttatgcagttgtttctcgtgaggatattgttccttcttaaagcggctttgataattagcttttgattttaacttatggagcgaaatggagcagttccctcaatttatgcgactaggtagaggcattgattgatccatacattgattttatgaagtggttgagtaaaacaatttagtgttcacttatctgtgtgcagcttacttgtttgtctcagtgttcatcaatctcttaataatggctacctccctttggcttttaggattgacatacgagtcaatttctgctgttgtcttgttttatcttcttgttctggtaatatagatctcttatctcgaaatagatcttcatatgtttcttgtctctatgttttctcctaaatccagcttctatgttatccactgaagtgaatcttagactcccatctgtctaatgacatgttgcagctgatttaaaactatatattcacgaaacagttttccatctgtcttccatttcaggacttcgattcagcctacggcccggcatggcactgcattgttggaacaagctttggttcatacgtgactcattccacaggaggattcctatattttcagatcgacaaagtttacgttcttctcttcaagactgccgtggagccgttagatcaaaaatgagataaaacgttgatgatcagagcatcttcaatttaatccttttcttttagaattctctgtcttgtatcccacaatgtaattctgcctaagacaaaatctttgtggctcctattgtgtaattagaagtcatcttctctactgtgaatcgtttcaacttcacaatgcaaaatattgttcttctctttctcaaattctaattttgtttttttcgttgttgtgttgttgttgttgttgacattttcttctcttcaaaagagctttaaacccaaaacctctaataccaattttgctcctccgttttataagcatcaaagaaaaaaagaatcagtgaagaagaaaaaaaa

SEQ ID NO: 5302 - DNA, 3000 bp, Unknown
  misc_feature (1)..( 3000): cDNA_ID_2161225_gDNA_ID_1620777_Annot_ID_167785 3000 nt of promoter + ATG
tttaagcttgggatgggaagtgcactagcgacgctttgtgggcaagcgtacggagcagggcaactagagatgatgggaatatatcttcagaggtcttggatcatccttaactcttgtgcccttcttctttgtcttttttacgtgtttgccactccactgttgagtctcctcggacagtctccggagatctctaaagcagccgggaaattctccctctggatgattcctcagctctttgcttacgctgttaacttcgccaccgccaagttcttgcaggtaacaacatcaaaatcagtttacttgaggtaaattcaagttgtttggttatgagattgattaattattataggcacaaagcaaagtgattgcgatggcggttatagcagcgactgtgctgttacagcacactctattgagttggttgctgatgctgaaacttagatggggaatggccggaggagccgttgtattgaatatgtcgtggtggttaatagatgttactcaaatagtttatatttgtggtggttcttctggcagagcttggtcagggctctcttggatggcgttcaagaatctcagaggctttgcaagattgtctcttgcctctgcagtcatggtttggtgagatatcggaacactttggagtcagatcgatacataaatggttcattgatgggtacacctagtgacttgctgtttgttggtttcagcctagaggtttggtatttcatggcgttgattctgtttgcgggttacctcaagaaccctcaagtctctgtagctgctctttcgatatggtgagttctaagtccctgtgaaagcttctgttttggttaggaacggaattaacggtttggttatagcatgaacatattgggatggccgatcatggtggcctttggcttcaatgcggctgtgaggtatatcacaaagtctcttaacagaaaagaaaaaaaaaagcttaatgattggaaaaaatgatgtgttatatgtgcagtgtaagagagtcgaatgagctaggagctgaacacccaagaagagcaaagttcttattgatagtggctatgataacttctgtatcgatcggaattgtgatatcagtgactctcattgtgttgcgagacaagtatccagcaatgttctcagatgatgaagaagtgagagtactcgtgaagcagctgactccgttgctggctctcaccatcgtcatcaacaacattcagcctgttctttctggtagtttctctaacaacactcaaaaaccctaggctgcttaaatttagcatgattgtgtataagacaaaatgtgttttggtttttgatattggtacaaaaggtgtagctgttggagctggatggcaaggcattgttgcatatgtgaacattgggtgttactatctatgtggtataccaatcggtcttgtgctcggctacaagatggaacttggagtgaaggtaagtaaaatctcgaaatctaaccttaataaagaacttgcatacatgataagcttcaagttgatataaacacacacacaactacaggggatatggacaggaatgctaacgggaacagtagttcaaacatctgttctacttttcattatctatagaaccaactggaagaaagaggtaaagaagcaattgtcaaattctagtatcagtttcagtgtttgtgtattaaagtttatgcaaaatgtccaggcttcattagcagaagctagaataaaaaaatggggagaccaatcaaacaaaagagaagagatcgatctctgtgaagaagatgaaaacaattcaaatggtgaaaacaatcacaggaaatgatcattaaacaagtcattgcagattcgtaataaacaaaacaaccatcccagaagaagaatcagttattcccaaattgatcaagctaagctaagactttgttgtaagaatctaaacactattgtgacattgagtttgaggtttacccagacataatctttgaaaccagtgaacataacacgcaatgatcttgaagaacatgacaacattgcaaatgcagagatgaatcagatcacacaaataatcccaaaatttccaaataatacgaagcaaattatataatccaataccatagattaaaagatctctgattccaaaatccaacaaagctgagttcaataacatgaaataaattaaaaagagactgaattgaaaaaaaaaactaagcagtgagaacaacagcaccaccagcttccttaatcttcttctcagcagtcttagagataagcttagccttcacaacgaaaggtttgttctcaggcaaatgacctttccccaaaaccttgaagaaaccatgctgcgtcacatcgatcaacggaacattatccttgctcgatttcgccttcacgtcttcaggaacaagtgaccatagcttgtccaggttcacgattgggcaaaagaacttgttacgaagcttgtggaaatacctcataccaactttcccgaagtaacctggatggtacttgtcgaagaggatcctgtggtgatgcatacctcctgcgtttccacgacctccgggatgcttacggtgcttaccgatacgtccatgtccggcgctgacgtgacctctcttctttctgttcttcttcaacgccgtcgccattttagtatcagatctagggttttgaaccagaaatgatcttaaagggtttttatatagagaggatttagcagctagggttttcggagaaacagagatagtgtattgtcttttgggctttttaataatttggcccaattataccacaggttatttatgttattaaattgggctatgaggcccattatatgaatccctaatatcaggtttagttaaccacttcacttttgagtttttcgacgacagttgatcggcgccgtccttgacagcttctccttcttctttttcttcactcataaaccctaaagtctcgcccgaaagctaaaccctttagctattttcaagcttcaccgggaaagatg

SEQ ID NO: 5303 - DNA, 3000 bp, Unknown
  misc_feature (1)..( 3000): cDNA_ID_2161229_gDNA_ID_1620777_Annot_ID_167787 3000 nt of promoter + ATG
ctctccaagctgcaaaacaagctggaaaagtgccagacgttttctactgtctcaagctcttagaagccacaggaatctccacagtacctggctctggatttggacagaaagaagggtaaagaatctgctactactgtttctttcttgctcatctgatctcttcttatgaactcattccacttgtggattttgacagtgtgttccatctgaggacaacaatcctgccagcagaagatgagatgccggagatcatggatagcttcaagaagttcaacgacgagttcatgactcagtatgataataactttggttattcgaaaatgtgattacttcttcttctgaacgactattgtgttctgctacactctttaaagctaaatctctgtagtacactctttctctttgccctattctataaaccatatctctctctttgtgtctcttttttttgggtgtaaactctctcttgtgtctctatttctattttcaattggaaactgattaagatcttttctcaatgaaatgaagtttaggccatagattattttttttaatcaacggtgatagcctttttttagtgtggcaatgtgaaatttgtaattatgctaattatattaaagaaaataataataatccatgtcctagtttgtttttgattatgaaaaaaaaatcgtctttaatataattttattaatgtgataaatccaaagatatatgtatttattccctgtctattcttcttgatactttgaatttctgttttctatatttcgtgtaagttatgaattttgcgggaaaagaggtgcagagtaataacaagggtaaggaagaaaacatagaatgagcaaagacggagaagaagacaatctgtaatggagagaaactgatcaagattctctcgccggttaagtgtcaggtgacgatggttgagaagaagccagagaaagaagatgaggaataagaataagaagagtgcgcaatgcctaaagcagaggagtttaggatttcgcagccgcttgaatgtccaccggctcccaaacctaaacgcagaagaagcagagattattcttctctgtaaactagcagtttttcttaatagataaataattagttaaataataattggttaattgttttgagagacacatgtctacatttgtcgcttattgattggttgatgttttcttaatagataaataattaattaaataataaaactatatagaaaaattaatatttttatttgctagattctcaaatgtgtgtgtcaccgatgaaggtgctctgatggatttaggtattgattaattaggacatatcttactttgttttcattcttaaaattattgtttatgtacaaacaaatcaaaaaattatctttagatttagtgactaactagcgcgatgcaattcaagttaaagataatctgattaaaaacgaaaaattatatgttagtatttatctaacatcgacattcttcagaaaaataacataaaattatgtggtgagttaaggtttcaaataggggtgtcaaaatgggtcaaaattcatgggccaactcaactcaactcaacccatgaaccctaatgagttaaattttttgactcaaatgagttgatgagtcaaatgagttattggatcaatttgtttgatgagtcaaatgagttgggttgtaatggttaatggtttcaattgtttacccaattaacccatcaatttttgtaaaattgaattaaaccaactaaaatctctaaaccaatatcaatttaagcttaaccaacacatctaaaccaatttaataaaatcaatatttttccaaatttcttaaatatacaagcgatgaaattgagaaaaaataaactcgtaatttttccaccaaaaaacataaatccgtgattttctcgccaacaaagtaaacccgtgattttcccgccaaaaacgtaaaaccgtgattttcccgccaaaaacgtaaatccgtaattttctcgccaaaaaacaaaacctgtgattttcccgccaaaaacgtaaacccgtaattttcccgccaacaacgtaaacccgtgattttcccgacaaaaatgtaaaaccgtgattttcccgccaaaaacgtaaatccgtaattttcccgccaaaaaccaaaacctgtgatattcccgccaaaaaccaaaacctgtgatattcccgccaaaaacgtaaacccgtgattttcccgccaaaaaacgtaaacccgtgattttcccgccaaaaacgtaaacccgtgattttcccgccaaaaacgtaaacccgtaatttttccgccaaaaacgtaaactcgtgattttcccgcataaacgtaaacccatgattttcccgccaaaaaacgtaaacccgtgatttcctcgaaaaactatatgttagtatttatctaacatcgacattcttcggaaaaataacataaaattatgtggtgagttaaggtttcaactttcaaataaggatgattttcttttgttgtgaaaattattcaaacataaaatagtatttaaataatatattttaagaaactataattagcctttgattaatgaatgtaaattttgtacagtttttggctcaattaatgtgctttgcaatttgcacaacccaattctaagcaaactactattagaaaagattaattttataataatgctcaattgctcattgttgaatgatagataccaaatgacttgagttcagtcagctaatttcagaaactaaaattgggtgataaagttcactacaagtttggagactacgtaagaatagttagaccactttgtcctcgtacaatccactgcatctctaaattgtggtacgatactagaattttgaaaagctaaaaattatagtacctaacataaatttgtgaaaaaaacaaaaaaaacctaacataaatattgcatacaaataaaactctatatatgcgttatgcatgcatgtctaagaaattactatctctcttttgctagtaagacatg

SEQ ID NO: 5304 - DNA, 3000 bp, Unknown
  misc_feature (1)..( 3000): cDNA_ID_2106101_gDNA_ID_1620778_Annot_ID_167821 3000 nt of promoter + ATG
agtaccgccggtcaagtcagcgggcagacatttcgaaacataacttatcccgccaaacaatttcgccatccaactcaagggtacgctcatcatttcccggccttataagtacctactctcacaagcccaccgaaatgtgtcttaccattagtttttgggctgaattgtaccctcccgtacaaaagcccctataattcaagctttttgaggactttgtgatatgttttctcctgtcacaatatttaaaatataagcaaaaatacattaaaataaaataataagcttactaaaaaaagattaaataacatgattcagaaacacttccataaatttagttatagatgaaactactgcgtgatatttttaagaaaataaatgcctccataaaattactaaaaacatactctaaatactttatttcatgtatcaaaggaaaataattagaacaatataactctacaattgttttcttcccatatgttaggtttaaacatttgtgatatacatgaatgtctagcaaatcattagacgtaaagtgtaaacactagtaaatcaatatttataaaatataagaatctactaaaataaataccataattttatgataaaacggattcgagttctactctgtattgtaaaattatcacatctaggctccgaatgatgacgtgcgattcaactacggataaagtgcggtgtggttttaatagtaacaaaaatatatacatatacatacatggctggtcccgactattcggagaccaaagcaacaagttatatattttgggattattataaaatattttaaattttggaggcctttttcttagaactgaatatttttggaggcctatttgcaaataagttttggtgtaaatttttgaaagaaaaatggggtcatattcaaatgtttcatgtggctcccttaaagactagtcttgtatgtatatatgtagatatttttgttactattagaagtatacgatactgtgtggtctgttctctattcggaaccctagtctgaccctttgttcaaaaaatcggccgcctagccgggcgcctaggcgctaatcagatgggatccacgacaatttttttcaaatcgagaagattaatcgttgatccgatttttatccgtatagacccgcctaaatccgtctagagggcgcctatcccaaattttttttttctaaaaagaaaatttaaaatttaaaatatccaacttatgttcgtaatttgtatgaaaaatcatatatttgaacctacaatcttattttcatatgtttaatataattttaaaaacaatattatataaatttcttaattataatgaattaatatgttttaaaaatattaaacaaccctaaaactaatccctgattaatttttgtataatctctgatttttttgttaggcgctaggtccactcttactgcccgactagcgcctaacgattttttgaacaaaagtttgaccagataatataaaatgatgaaatctagcttgacgagataataataaacttttcgcatggatctgcatttttttgagtaaaatagaaaagtggaaaaatgaaaaaataaaataataatatattaactgtttttattatataaattttacttttacgcaaaattatatattaaacgtcacataattaaaatcccttaaatctttatcctactgtatgttctgaatcgggcttttgtattttgattcgtgaaaagtctttcacttcaccggaccgaagatgattcgtgaaaagtccacatttcacatttctcaattcacacttgtgctttcgaaatgggcttttaactttggtcctaaagactttctctcatctatatgtctctgaattctaggacacagtcaacaagtcaacgtcggtaagagatcccacaacaacatctacacagacacgtgtacactatctctcactttttcaccgacacgtgtcggttctttcacctacaagtaaaactctctccattatcttcaataatgtcaaaaatgtcacacacacacttagtcatagtaatacccaatttccacggcacctatttgccatcgaacaaacaataaaaaactttattagttttcacaattaatacttttaactctttcccgagagtcgtaagaagagaaaaaacaaaacttttttctttttcgttgaagaatttttacataaaagttttgtagattctctgatcagaattgtgtaaaaggtattctctttttttttacttgttgaagaattaaagtaagtaaataattgatttcttattggagggacccttttgttgtcatagaatttactctgctgcgtttttttttactgttgttgctttgttcttgttgtttggttgtatattgttgatgctctctctctctcgttaggtgaagtagatctctcttttctctttctctttctcctctctctctctttccttactcagcttttgtggtgaatattgaagaaagtttctctggtgaataagagtttgttcttatttttatgaatttgttctgttttcttgttgatagtttttgggtttgataaagttgtttcctttttacttcttttagtatctatctttccaattctagtaacttcactggttcttgagctctttcaactttttgtttcagatctctctgtgtttttttctgatctttctccagtggtagcttctgagttagtgattgtactttacttccatacttcttgttcttgctcatagattttagctgtggttttgtggagttttagctctcagtgattgttttagttttagttccttaaacatgttttgttcatatgggtttgttagatctttgagttttcttcatttctttattatctctcttggatcttgatacaaaagtatgaatctttagattgcttcaagaaaaaaagttttaaagactttaagagattcttagatacatagaatttgaagatcttgtattggtttttgtgaaacagatatttgttag

SEQ ID NO: 5305 - DNA, 3000 bp, Unknown
  misc_feature (1)..( 3000): cDNA_ID_2106758_gDNA_ID_1620778_Annot_ID_167833 3000 nt of promoter + ATG
gaccttttcgacatagcttcttgccatatctccaagaactcctccatcaatttttttgccattcccattgatgatataggaagatactccacctaaatagtacacacacataattataggtttcaaatgaaagtagtgcataatagcataatggcataagttgatagcactaaaaattcgtataatgaaaacttgttgcatggaaaaccgtagattatgcaaattttcttaattgacaaattttctgcctaatcacattagaaaccgtcattatgtgtgttaccaatcatagctaataacctttagttactgagttacattacaaactccaaattatgaattaactagagtgttagataatcattaacattgattattaatatatctcaacgtactcaaaagatataaaatttgttacctccatgactacgcctctaatggtctcagcatgagtaggaacaactttaccaactctcaaacgaaaatccccaagttgatactcaagcccttcaaagtaaaacgagagtttgcatttgtaagactgaaggctctccatgatcatttgaattgaagaatctgcttccacgacgatcctttgcgacctgatgacgaaatagtacttatctggctcctccggaagcgaaattcctacaaattcacgcgggaactcagcttgattcgcctgatcttgcaacatgggtttgtaatagttgagagtggctttccatgttccctctttgacgccattgagactctctatgctttgtgttacttcgtttaggatttggctgctaaatgttgatccctgatttggttgccaatgcaaaagcctggaaaagtattcccccaaagaaatttgaaaaaaggttaacgtattataaaagaaattacaataatggttatttagtttatgtaatcatcaaacctaccatttgacgggcatggctaatggaggtacaacaaatttcacttgacaacaaaattaaaaaaaaatgatctctattaatttacaataatacacaaacaataatatcttatataatatagttgtattcagatatataatttaccaaaaaacaaaatgataaaactttacaataaagcaaaaaattatttaatcaaaaaatactttttgatagaatttcaatcagtgttcataaggaaaatacatttaaatgctcaaatggagttcatttttttaatcatttctttcatttgaaatagaacgtggtctatatggaaaggaaaatttatttttaaaagtaatttacagaccaaaaataatacatatgcatcaactttggaatcataatacaaatttcattttttaataaataattataacatagagaataattagatattttagtgcatgtgcacaattacataagtgtactcacccttatcaagataaaagggaagaaaatataaattcttataagaaaaaaataaagtaacttttgactttaaataaaaaggaaacaaatctaagaaattaatgttataattaaattatttaccaaaattaattgaaaaataagaaacatttttttacaaaaactaaagaaattcattagatctgctatgagtatccgtttgggatcacacgttctgtgatagtagtagatcgacaacagattaactaaacgaatcaaatatgaaatatatcacttcttgaatacaatctaaatataaaattcatacatctcggataaacaactcaattctgcttctaagtatatttagtttataaaacgatgctttttatctttatcttatctaaatcattttaaaaagatgagttgaaggcatagtaaagacttttaggcttaataatcatcgagccataaaaacaaaatacaagattagattgcgagaaacacttaccgatgaaagagatttctggtgatgatcttcttgggaatacgtagtataacgaaaaattaagactcgtacactgcattatatagagaaaagcataggagtttgtttgttttactaagataaaacgacctcgtttaaactacctcatttaaaacgacttcgtgtaaaattatgtgtttcttaaaatgaccttgtttttaaaaaggttttcttaggaaatgagtggtgaaaacatgaatgaatctaaccgaacttatccaaattcgaataatactaatagtttaaaatcttataaatagaattattggaactgaaccttaaatcaaatttaaattttatgaaactgaacaaaattaactgaacgaatcaaaattcctaatgtatatatctcatctaatcatctaaataaaaataaaggtttgattcatgtttcttctcatctttcgttcattttttatgcatagtcatgaaacattaaggtttcattccacccaatgatataatttttttttatcctagtacactcaaaaaatgaaaaatttatatagaaataaattggaaattgatacaattatataattgaatgatacgcttttgcttaatactagtcaagatgaaaaaataaaaataaaccaataaaaaaaattgagctgaaaatagaggaaaaataattacttagttgataattatttgtttgatataatgacattaaattgtaattttaggtaatcactttttgttgatatttaaaatacgtttttaaacaaaaacaaaaccgaaataaaaaaccaactcgaacaaaaaccgaattgtgtcaaaccgaacagagaaaaaaaaaagttttccacaagtaaaaccgacaaaataaaccaaaccggatcccaaaaaccataaccaaaaaattgcattaggagccaaatatttccgccacttaaaacatgccacgtaggcacgaatcgatcgatgcaataacttttgtaacggctacaaacttctgatttcatttttgaaattcttctcttccgtctcttttactaattcccctttcttcttcttcctattgaaaccctaaattctcttcttgaaatccaaatcttgtttcaagagtaaaccatg

SEQ ID NO: 5306 - DNA, 3000 bp, Unknown
  misc_feature (1)..( 3000): cDNA_ID_2138913_gDNA_ID_1620778_Annot_ID_167839 3000 nt of promoter + ATG
aaaaaaaagaaattcacgaaagattttataaaattcatgaaggatttaagaaattcatgaagggtttcaagaaattcagaattaaacttttttttttttgtaacccttccttaatttcatgataatttttcatgaattttgtaaaatcttttctgaattttgtggaaactttcaaggaaatttaggaagacttctacaaaactaaggaagggtttcacgaaagatttttttttgtgaaatccttcttgaattttgtaaaatctttcttgaatttcgtgaaattttttccagttttcgtagaatccttcctaaattttcttatgtggaaaaaatttgacggaatgttttgacaaaaattgtttttggcgggaaagtttttacggaattttttttggcgggaaaatttgacaaaaaaaaattcacggaaaaatttgaaagatttttttttcacggaaaactttgactgataatttttttaattaggtgctattttaggaagaaaatgttttgagtgctatttgtagatattttcaaatgaggtgctatttttggaagaaaatgttttgagtgctatttgtagatattttcaaatgaggtgctatttttggaagaaattttgtgtgctaattgtgtcaatctttttttttttgttaaccgatattaattagagctcaacaaagtcaattcacgtaaaatgttgtttacatatgtgatatattgtggttcaatataattttttttgtgcaaaattatccgtatttatatttgcactatgaaatattaaaggtaaataaaaacttatgaattcttctttattaattccttcaaatatactgagaataataattcttgtaaactagagaaattttaacattaacctatttttctattttctttgggagtttcctattaaggtaactttaagaatagaaactagttatgtatttaaaacgatacaaactaggatatctaaattgtattaaaaagattgtacattcaaaatttgtatacgagatcttcaaattttgtatataaacatcgaattatataaaatatttttaataactaaaaaaaaatatttgtatctttggcggtcaactaaacctttttttatagcatatatatatgatatataaagtttctttatgatataattatctatctaacatttaagattgtattaaagtttcgaattttatgtctacgtaattttgtttcctttcattttatacacaatgttgtattgtttgtacatgaattcttttcaaaataattttttagatatcattcatataaaatagagctaatgagataataaattaccttgaaggcttgaacattgtcgagacaaaagttgaaaacagaaggacaaaagatcactgtcaaataattattaatacatcagaaaaataattaaaaacgataatattgttttcagtattcacctacacataatatgaatatcatgtttacatatttcgaccttttttgatcggttctaataatctatatctcaaaactaaccaatctcatctagattccgtcaaattaagtttagtctataattacgaaactaaaaaatattagcaaatgggaaagtgctagagtcattgcactagtttattatgtgaaacacgaagaaacacggtggcgcgtagaaatcacctagaaactacgaagaagacgtgaaccccacgtctctctttcttcttcttctttctctatctcttcccattacaaaactcaagaagatgttaaagtacgaaacatgtcatacttcaaaagaaacgaaggaacaattgtgtttgcgtttgcgagcatcgggttcatagcgttttatatcattaattactacattcggcgatgcagaaaccgtgccgcagcagccggggacattgaggaagctcgaatgagtccgaggaggccaccgcgaggacttgacgctgaagccatcaagtcgtttccttcattcgtttacacggaagctagaggaattgagccaggaataggcgagctagaatgtgttgtgtgtttgaatgaattcaaagacgatgaaacgctgcgtttggtaccaccttgtgtacatgtgtttcatgctgactgtgtagacatctggctttctcatagctccacatgtcctatctgtcgtgctaaagtagttccttaatacgagtctcttaattagccttttactatgcattttgcgttacatagttctccctttgtaaataaattatctttatagtgttgatattttaccaaccgtaatgatgatactactccatggaaggaaataatctacaaaggaattgaggcatattgaattattcaatgtcatgatgatgatgatgaattagactagaaaatgacaaaaacatagtttatctctttggttacttgttcatgtattacacactaaacacatctatttggctttggagagggaccacctatcatgctgtgtacaacaaatatgtatatatgtaagttacaagttaatgaaacgttcggatatatagttatataccatactttgaaggctttaattagttactcatatgatgtaaacatttgttatggtgcgaataatctagcaccaaatacataaaccttattggtccgtcacattccattgagaggacgtgaacatcagagggatgtgactgaccaataaggattaggtcaaaactgttggaaaagtcttgttgcgtagatcaacaagttaatagagagggcatgagtaatgtagtacttgttctacgtctatagtgacgtaaagacttcttcaaaagtcaaaacgttagaggaagaagccaaatcaatcattccgaccaaaactaatctaactaaacatagtagtaatacaatatgtattgtcgtgacgagtacaaaccaaaatgtgtttagtattataaaaacggcttgttcgtattctcttctctcgctcaacacatgaagctcaagtgatccaccgtggttagcaaaaggacggttcacatc

SEQ ID NO: 5307 - DNA, 3000 bp, Unknown
  misc_feature (1)..( 3000): cDNA_ID_2138932_gDNA_ID_1620778_Annot_ID_167834 3000 nt of promoter + ATG
aaccttttgcgttgaaggctttaagtgatcccacttgctcagcaaggcttggcacgattggtcgtggatgtttgcctccaagaagagacgccccattatagtttcatctttgcttatgagtgatcccaaaactgaatcaagcaaatcttcttctaacggtgtagtacagttttcaacctttagagagaaatgaaaatacagacttctgtcagaacacaaagatactatgtttccagctgaaatgatgaaaagtagcaactaatagatacatcttctgactaatgttgacactaacagatctttctaatcttcatttgtttgataaaatatgctacatctcaaggatacagaaagataaatcatggatggaacaagcaatctctcaagcatcatagacaatcaaacacttatcaacagcctttatccacctcaagctatcaaaaacgcctaacaatactgtatatatgaataatatgaaaaacccatttgatatatcagaagaatccaaagttttattaccctcagaaagcaaaacgatatggactgacaattataaaaaccagaaacataatgtggactaccattagagtctctctattaagtgcatctactggataatatcaacaattgtaagactttctgcaaaggaacacaacatggatacttatgaaatgataatacagagttctgtcagaccacaaagaaactatattgaaatgattataagtagcagctaatagatacattttcttactaatgttgactctaacagatctttctaatttctatttgtttgataaatatgcacctcgtattagtaccattaaacattggatggaacaagcaatctctgaagcacatagacaaccaaaaacttatcaactacctttatccacctcaggctattgaaaacaactaacaatagaggatatatgacaaacccatttgatatccacctcaagttatcaccttcagcgagaaaagcgatatggaaggacattttatatttcatagtactaagagaaacttaatgtggactagcatagtctctctctcaagtgcatcatatctaccattctatgacttttctgcaaagagactcaatgagaagtcaaacttcatgagaacttagataaatcaagttgtcaacttaacaaagaaaaccaaatgatggtaccccatgtgctaattaaagagtagagagaagacaatagcacttgagtaaccatttcatcaagaacaagctaaccaaactataaaccagcaagtgcaaaaagcaaactaatttactcgagggcaatgcaattctaaacccaacttaacccaattaaagaaaatttagggttaatatgaagaaactcttacttcaccatctccgatttgacgcttaaatctctgcatttcctcagacattcttccaatttcatcctccaattcacgaaccctagcttctgcttctctagctctctcatcagattcattcccaaactccatcaacgcatcacgatcttgatgataaagcaaacactctttctccaatttcttacactgactcaacaaattcccacactcactagccaatttctgattctcttcaacaaacttcttcaacgcttgcgcattcatactcgcttcagacttataaaaaaaaaaaaaaaaaaaaagattcagattcaaatcaatcaaatcccagaaaacgaaagatacccagaaagaaattactaaccctaacacgatcgattacatgatctttctcctttaatcgcgaaatcagaccctgatactgttcgcgaagacggcgttgagattcttcagccgtataaagcttcttctgaagagattccatggagatcggaagacctaaagaatgatcaattgtatctttgatatattcttcgacttcttgcgagagatttgttctcgattttgtttctgcttcatctgaatcaattctctcgctccgcatggtttactcttgaaacaagatttggatttcaagaagagaatttagggtttcaataggaagaagaagaaaggggaattagtaaaagagacggaagagaagaatttcaaaaatgaaatcagaagtttgtagccgttacaaaagttattgcatcgatcgattcgtgcctacgtggcatgttttaagtggcggaaatatttggctcctaatgcaattttttggttatggtttttgggatccggtttggtttattttgtcggttttacttgtggaaaacttttttttttctctgttcggtttgacacaattcggtttttgttcgagttggttttttatttcggttttgtttttgtttaaaaacgtattttaaatatcaacaaaaagtgattacctaaaattacaatttaatgtcattatatcaaacaaataattatcaactaagtaattatttttcctctattttcagctcaattttttttattggtttatttttattttttcatcttgactagtattaagcaaaagcgtatcattcaattatataattgtatcaatttccaatttatttctatataaatttttcattttttgagtgtactaggataaaaaaaaattatatcattgggtggaatgaaaccttaatgtttcatgactatgcataaaaaatgaacgaaagatgagaagaaacatgaatcaaacctttatttttatttagatgattagatgagatatatacattaggaattttgattcgttcagttaattttgttcagtttcataaaatttaaatttgatttaaggttcagttccaataattctatttataagattttaaactattagtattattcgaatttggataagttcggttagattcattcatgttttcaccactcatttcctaagaaaacctttttaaaaacaaggtcattttaagaaacacataattttacacgaagtcgttttaaatgaggtagtttaaacgaggtcgttttatcttagtaaaacaaacaaactcctatgcttttctctatata

SEQ ID NO: 5308 - DNA, 3000 bp, Unknown
  misc_feature (1)..( 3000): cDNA_ID_2138885_gDNA_ID_1620778_Annot_ID_167845 3000 nt of promoter + ATG
ttacgtattagttataaggatagctcctcaaacatctttcaaattacttgttttcttatcataaatttcgaaaaacttagatatatttaatctgcatattcatttagtttatttcataataaacgtctaatttttaggtaaggaatatgtgtagcatgtttggattttatgatcactttagccactaagtggatctcaaaattaaaaagaatatattgaattaaaaagatatagaaagaatgatggttcaagttctgactaattatactctcatattttagttgttatgttgaattaattactaattatgtattagttattttatgaagtctaggtggcaagctctcatgtgctgatgtgtcaagttgtgggagagagttaaccttctttcatatatatgattaaaacatcaaccactagatttttatatgattgtgatgccccttaaaactttgatatatttagcgccttggatttatagatcacatgtaactggattctgaaagctaaagtcgtgagtttttgtgtagaatttttataaaaaacaactttaagaactttaccccacacacaagctttagaaatcattacaacgcttgattagtgttgttgtagtcaacatatgtcattatatgattaagtataagaactagatatgcaacgagattcagaaagttaagtcgtatatgtatttgtgtagaagctccaaaaaaacttctataacatcacccccatccacaaagctaagtaatcatacaacaattcaatcattaagcatcaattcaatccatatcatatatatttatgcataagtctacacttagctaatatctcatctagaagctaacatttaggcaaccaaatcaatcaaaaactctagatctacaaacgaaagaaaataaacaacaatcaatcttgtttagatgagttccatgaactacatgtaaccacatgaaacacataaccctaattcacattggtctggatgaacgagaaatcgctacccttgaccaacccgatctcgatctgcctaagctttctctgactcgtactaatgatggatataagcttcagaccaaaaaaaaattagaaaaatattctaaaaatattctaaaaataataaaagactaagggcgggtaacacataccgattatccgactaacttgactcttagctatccgactaatgataccgaccaccacagtttctctgacgaagcttaacgacctaattagtttgcttatacgtttaagttataataaaatgatgcatgaaaaacagtattgtttgtataaaaatcaaataatataaaaaatcatataaaagacaaaaaaaaaaatagactaagaatatcaaaaacttacaccttattacaaactgtacacaatcaatcataattttataactaaaaaacaacaaaaagtattatatacaacaaattcatcggtttatacaaaaagaacaaattattaatcttgcagtatatattgaattatacgtcttttaaataaaagtattataaaaaagaaaaataacaaaatgatatttagttttacaggatgggttatatggtaggacagattttgggtcgaaattagtttgagactgtataccatgggtaaattcttaaaattaacaatcaaaatacaatttatacaatcttaaacactagacaaaacaactataatttaaaattttgattataaaagatcgacccccagtgtatccacaatcaaacataagtttataccaattaaattaaaatacaacaatatcataagtttataacaaaaaagatatatatatatcatccggtgtacctttggtcaaatcctgttattatgtaagtaagctaaacttttgatattattaatttgtcttaaacgtcatactcaaacacgacgattacacttaaatcccccattaatctttgatattaatatatatatatatatatatatatatatatatatatatatataattacatattgttatttacgttattatttgttttacgattatatttattttgggtttttatgcaaataaaagggtactacccatatttaagttccaaaattgaaaaatattatcaattaattgaaatttgccactattttgcaaatcacaattatacaatatgtcaagctctattaataatttttttttttttcagtcgaatacggataaagaatttagaaaatattttaatatattaacaaaaataatcaatagaattaagattaatagtttaatatattgaaatttccgttataggaaaaggaattctcaccttttttatataattttttttaacttatgcatatatttttttctgatagagttatacagcttttcttatatttatctttaaatatattaataaatttagatttgagacatgatgatatcgtgatcacatgagttagcaacttgtaaaattcaacttataataagatggtcacattaaataaaaacacatgtatgattagaaatttccattttacaacctaaattatatgtctcttttataacaataataataatgcgtctgttaaaaaaaaaagcgtcttttacattttataacccttggtcttctctaacttgctaaattgagtgctaaaacaatattcgagaagcattcttgtactcaccaaaatcttcacatttcttttgtttacaaataaacgtactaacaattcaacctggaaatgttctgaaagaccattagctaaacccaaaaatatatgcacgaacatagatcattactttggtagttacaacttacaacttagtagcataataatttaataaagtactactggttacaactttaaaaaggaaaaggacatcttttactttattaggacagctttttgagttgtaaatttagagcccaacattggattcctcttctttgaccattcctctctacctgaataacccgttaatctctctctgtccctttcttcttcttttttcaagaacaataaaaaa

SEQ ID NO: 5309 - DNA, 3000 bp, Unknown
  misc_feature (1)..( 3000): cDNA_ID_2140457_gDNA_ID_1620778_Annot_ID_167843 3000 nt of promoter + ATG
gttgtaaatgggtgtttcgtctaaaatacaaatctgacggcacacttgaacgacacaaagcacgtttggttgttcttggtaacaatcaaaccgaaggtcttgattacacagaaacttttgctccggttgcgaaaatggtcacagtccgcgcttttcttcagcaagttgtttcacttgactgggaggttcatcaaatggatgttcacaacgcgtttctccatggtgatcttgacgaagaggtatacatgcaatttcctccgagatttcgtactggtgacaagacaaaagtatgtcgtttacgcaaatctttgtatggtctcaaacaagctcctcgttgttggttcgcaaagctcacatcggcattgaagaactacggttttattcaagatatttcagattactctttgtttatctttcacaaaaacggagttcgacttcatgttttagtatacgtggacgatttgatcatcacgggtactactattgctgtgattacagagtttaaacattacttaagctcttgtttctatatgaaggatcttggaattttgcggtacttcttgggaattgaggttgctcggagtcctgaaggtatctacttatgccaacgaaagtacgcacttgacattatcacagaaacgggtctccttggtgttaaaccggcttcttttccattggaacaaaatcataagcttgcttttgccactggtgaaacaatagacgacccacttcgataccgtcgtctagttgggcgcattatttatcttgcgactacgaggcctgaattatcatatgttattcatattctctcacagttcatgcataatcctaaaccggctcattgggaagctgctcttcgcgtcgtcagatatctaaagtctagtcctggtcaaggtattctcctacgtgctaatacacctttggttctctctgcctggtgcgattcagactttggagcatgtcctcattcagatcgatctctcaccggttggtttattcagttgggtggctctcctttatcttggaagacacagaaacaaaatgttatttcccgctcttctgccaaagctgaatacagggctatggcagaaacagtgagtgaaatcatatggatccgtgaattacttcccgctctcggtattccgtgtactgctcctaccacactccattcagatagtttatcagccataagtcttgctgctaatcctgtctatcatgctcgcactaaacatgtgcgtcgagacgtccatttcattcgcgatgagctcgtcaatggcactatcgctactaagcacgtctcaaccacttctcagctagcggacattctcactaaagccttaggacgaaaagagtttgcagactttcttgccaagcttggtatctgcaatctccatataccagcttgaggaggggtgttgggctgtgtggccttagcccatttatattgtataaattaactaggtctaaacttatcgtgtatataaaggcattgcctcttgccgtaatcaataagaatcttcttttcacaacctcgattgattcttgacaatatatataactaggaggaggcgtaaaaggagaaaacaggtaattttttgctcttgtacctttgatatttttactgaaagtgaagcttatggtgattacacttgtggtctacaggagcagaacattgagagtgggtcgagtattggaaacgcttcaagatgttcttggaaccatatgggacttcttgcattgtgatgcctaataaagaaccatatgatgatgttgttcgtattgttgggtttctcttttactttctgttgtctcttttgtagaataaataatgttttgggtaatgaatgatttaacttgcttgtgaccaaaaaaataaaataaaaatgttgttttgttacgagtcatttcgattgcagatacaatgtaacagtcttcacacattgaacaaaacaaaacctaagttaaacaaataactgtttctttaagtctttaaccatgaatctggcctttattagtaaatagtaatagtggttattgtaacatgagcaacatacgtcatactagccaaccaatgtctctcttcttaaactcatcgaactaaagagaggtcaaatcctcatacttactcggcctcgatgtgaattcacgttataataagaaacaaggaaaacacaaactaatcattttcttagtcctaggtgttcggttttaaaatttagtatcattcaagtattttgaaatcttcattttggtttggatccggttcttttgtttttaaaatttagtatcaatttggttatttttccttggatattttgattatttttgattattttcggatatttttttgttatttttgagtattttactttttctatttttattttaaaatttttgattttttgatcaataaataattaatattttgggtatttttggttaccaaaaatatttcagttcggtaccaattataatttttttttgttatataataatatagtatacatccaattatttttaaatttttgattttgttcgattctttttgcttcggttccaattcagtagcttcgattcagtttaattgcctagacctacattttctattagaactgacacaaaaacaaaattggcgtcgcttataaggtctacaatatatggttggcctctggcccaatagtaagcccatatattaaccgacgtcggtttatagccccgataaacacaaacaatatagataagatagtttcttctacttcaaaaaatggatgctttcagaaatttccagaaattacgggtccaattgagaaaaacgcgtatcgtcgtcttcttcatcaaaagcgaacaatttcgaaaacaaacctaacgaacaaaaatcaaatcttctctctgttaaaatctcaccgactagagaaaagctttgttttttccaattaaagttacattttttgtttgaacaaatcactttctgtgatctacatttgtgtggtcgtgaaatca

SEQ ID NO: 5310 - DNA, 3000 bp, Unknown
  misc_feature (1)..( 3000): cDNA_ID_3076533_gDNA_ID_1620778_Annot_ID_167840 3000 nt of promoter + ATG
aaacagaacatcttgaagatctaaagaagagcctaactgaacactgccttgttttgtagcggttgtaaaacgtccatcaggaagtttaatcaaaacaggaggcatatcacaaacattacggagaaatgcaagagaaccagtcatatgatttgtggctccagaatcaattatccaagattcaagaaaatacttaccagactgatgatcatttaaggtagatttccgttcctcaagaatcgtttgtaaaattttccattgtgaatcattcagcccactaagtcctatgcgatcatctgatgtcaatggagaagtgagcgatgaattcgtaacaacattggcagccattccagaagaagcgacatgattaatagaagatccacgaccatgactctgttttcctttgaacgaacttaaaccaccacgtgaagaagatgcagtgtttttaagacgcaatttttcttcgagccaaggaggatacccgattaatttgaaacattgttcggcgagatgaccaacacggccacaattactacagactctgttttctgaagaatctcgaggtcgtgaagtagtttggaccgcgaagctaacaccgtcaaccctctcgttatgtaagcgactcaaggatttggattcttcgtcttgtgtcaaagcattgtaagcttcctcgagagaaggtagtggcactcgagagagaagagccgacttgacagctccgtacacagattcatcaagtcccataagaaactgatgcaatttgtcttcttcacgttcttttctgacgtcgtccatggttttagcttgttggtaatccgccaagctacaccacagttgagagagacagccgtagtaagtttcaatggccactcctttttgacgacaggttgctaactctgttttgagtcgctgaacatgttgtccattcttgacaccaaagcgtttctgaatgtgtgtccagagctcatgagaatcgtcgagatgagacatagatgtggaaacagtttcatcgatggtgagcttcatccatgaaaccacaagagcattgttggcagtccaatcttcgaaatcgggatctgtctcaactggttgtggaatagatccatcagcaaacccaaatttctttctagcttttaacgccaaacgaagatttgtggcccattcgtcgtagttgggtccacgaagcaacggtttggagatgagagttccgggattatcaccggatgtgagatcatatggcgagattgtacgccttgtttcagtcctagctggtgtggtggagctagcgagagccaattcagtactcatgatgaacggagagtttgatgcaagtattaagtagagaagttagaaggaataagaaagcgatctcttatagcggaaggagagatcacagaatcgatcacaaaaaccttttagtagttaggtattgtgctctgataccatgtcaagaatcaatcgaggttgtgaaaagaagattcttattgattacggcaagaggcaatgcctttatatacacgataagtttagacctagttaatctatacaatataaatgggctaaggccacacagcccaacatatattgctcataaacaaacttttcaattgaggcaagtctcaacatgttttgatcaaatcgacgcttttctaaaccactttgttttctctttttgcatcgtgaaccttccttgatttggaccaaacttggaatataagagataacatattgtttacagtttccgtctacaagattcagtttttctaagtatccatcctctccgacgatgctaataaatgttttgagacaattagagtcggggtcaaggtttctaccgaaacccatgaagactttcttctcttcgtctacgaagaaactatgtgatatctttatcttaggtctcgtatcaattctaaataacttgctccacgacaccgtttcggcatcaatcttagtcgtaatccatatctccaactcagataacgctgaaataaagctgcaagcttctcttctttaacacaagataaagtcacatctacagcgctgcacggtagagggagaagcggcccgaatctctctcttgtaaaatcaaaacagataatgtgatctttgtgaccctgtgacctcctttctttagcacaccagtaagtgtttcccttaatagaaacgccactggaagaacaatgtacaccccagtgtggagtgacatcaagagttgtctataaacccgagtcaaaatcatagatttcataccaaaaagattgtgtttcgggtgtattgtagaaataatctagaaacctcaggaacttaaaggtacgacaagattccttatcttcgtatccaagagcataactaaacctatcaaatccattcggaggttgagaatatcggaggttgatccaccttgtatgcccccaatacggattccaaaccaaaaccctagtaacgtcgtctttcaagatgcataacaacaaaccctcaaagtggaaaatattagatatactcacttgattgtgaatgaaaagttgacctttaacctctatagatggatcaaagtcgacgacaccgctcattaaacaaagtttgtgaggcatcatcatgatcatcatagtctctccatctcttgttggtgttgtcactttaccaatgtgcatcttcgtaaaaccctcacttttggataaattgttccaagttttgcaagttaatctcaccgctttcatagatttcaaaggaaccctagaaatgatctcctcgatcaaatcccttggaagattgtagatcatcgtcgtcattgtttcaactttcacaacgaatgatttcttgcagcttagggaaaggaaaaaggtatacacgacgacaaattataaccctaaataaatttgggccactagtgggctttcagaatctaattgggcttaagcagacccaatttgtatctggcgcgaggttttagtttctgcggaggaggagatgatcgacgattcgtctcttacggcggagatg

SEQ ID NO: 5311 - DNA, 3000 bp, Unknown
  misc_feature (1)..( 3000): cDNA_ID_2140446_gDNA_ID_1620778_Annot_ID_167829 3000 nt of promoter + ATG
actttgcatcatcatcatcatcatcatcaaaaaaaacttttcatcatcaattactaaacaaactatatggaaacaacttaatctcaatagcagcataaaaagggtaacaagttgttccaaattcaagtcaaacgaatgaaatgcgtaaagtattacgcatcattaggttcaatttgctaaatgtgagttcaagttcttagctttctctacttcttagatttcatatatcaaaattcaaacaacattgcgtcatcatcatcaacaaacaacttttaatcatcaattactaaacaagtatacataggaaacaacttaaatgaccaaaatagagttcaagtccttagctttttctacttgttagattccacatatcaaaattcaaacaacattgcatcaagaaacaactttttttcaatcattgattactaaataagtgttgatgaaaacagattggattgaaaaatgaaacctttacgagtgtggaaaccaggaggtttacagttttttcccttgtaaaagtctctgggagctcgtttgggagagagaatatcaagcgaagaagctctctttcttcggaatgttcttccaatcccgaataacaaccctaatgtcatcttccaaaatctatcaaatctggtaaacaaaatatgttgtagaatcgataaaaatggaaactttcgaatgtatcaaatgttgaagaagaaatgtcagagatttgtagaagaaaggtcagagaaagggtttaggggttcttttaggtgaaaaggcccaaaactaaataaagcccattttcatacattcacttatttgtttataattctccaaattacctttaaggggatgtattcaaattagaatttaaagtgatttgagttttcttgagttttaaatgatttaattgatcttagggaagtttatatgatttttgtaaaatccattcaaatctcactttaaaccatgggatttggatttctgtatttttaactaaagaaatcctctcaaattctccaaaataattaaaattcaaatccacaaattgttttcaataacagtaaattttcaggtggattttgaaatcattagttcaataacactgaatttcatgagttttttaaaattcatgtttgaataacatatgatttataaattctacaaaagtctcttaaaatttcacttgcaatacacctcagattttacgatcacttgtgatttcagatatgctttagaaatgtgaattctagtatgcttagacttgctcaaatatgcttagatctgcttaggttttacttgttgtgaacttgtaaattatactttagtttcatcggaattgttgtgtactcgtaaatttaattttaaattatgttttaaaaatgtgaactctaatattttctcatgttgattttatatatgcttagatctgcttagactcgagtagtatataccaaattgtgatttgcttagacttgcttaatttataaattgtgatttcactcctacaatattttttttttgtcggtacaaagaaggtagttgaacaaacttgttctcaaaacaaaagtagtttccagaaaggctagtatagtttcagaaagacttatgctcaaaacataagtcaagtactattacaaacgtctagtttccgatacgaactaactctgtgagaatctctgcagttgatggcataagaagagggtctacagaggtcatcaaaattcctttgacagcgtacaccttttgatccattttgaacacacattggaccactttgccataccctccacgacctaggctaccttcctctataaaatcgtcatgataccttgaaggcggtggacgaatagactttgttgaagcgagtccaaccatccaagataaaagggattaggctttgccgactcgaacctgaacacaaaaatactcgaatattttaatcgaaaatctaaattttacccgaaccccaaaattttacgcgaaaattcgggtatcgcttctaaaatagggcctaaaaatctatatccgaaccgacctaaacctgattagacccgaaccgaaatcgaaccgatattttaaatttatccttttagatcctaaacttttttacccaaaggacctgtacccgatcgagttttatctgaacccgacccgcttactcgaatgtccacctctacgagtgagacatgaaaccctctcttccactccgagtctttcctctcaattgaatccgagataaaccggtttaatctccaaaccaatcccatattcttgtaccaaatgttggtttgcttcttcgtacaagaagatattttccgggaaaatgacaaacagagaaaatctccagaaaacaatgaaagctatacacaaaaactcgcgcttccgttcacgtggcaatcacttccaatgaacgattctccttcgtttctcccaaagtcccatcacaatcaaaaaccttctctccgagaatctcactcactacaaagagtaagattcgattcaaaaacaaactccgatcgttgaagcaacgaagatatgcttacttcaccttcttcttcttctacatatgatccattctcttccaatttctctccgtcgctcactaatgccttctctagtagcttcaccattcccatggggttagtcaatttcactctatcttcctcttcgaaatttgagttctgattctgaatttgtttggtattcgtagattgaaattgagtaggagagtcaccagagctcggatcttctctcgtaaggcacgtcttcttcgtaatccctaatctcgttcatgttcttaagtttacattccaaaaaccgaattagacgatcttcattgtttcatcgtaggtagattaaggatcgttcaacacttaaggtcacttgtcgtcgcgcacacgaacgtgtggttgaggtaaatctcttggtttagttttttgctctttagcggattttgaattgtgtgataagtgcttcttctgtgtaattttctaggaagaagcatctaca

SEQ ID NO: 5312 - DNA, 3000 bp, Unknown
  misc_feature (1)..( 3000): cDNA_ID_2155073_gDNA_ID_1620778_Annot_ID_167822 3000 nt of promoter + ATG
gtaaatcacactcaatttatattgtagttaatcaagctcaacaacactgatgagcagcatctacgcactcgatttaacatcaattaaaatatgagatcatcgattctaaagtattagagtatttgaaatagagaaatgatctctaatagcacataatcaagtttcacaaaaagcaccataaactctttagataaattctcacaaatagcacaattttaagttttttggacaaaaatagcattaaaattttttttgacataaatcgcattcaaataattattttatatttaattattaaaatttaaaattcaaaaaattcaaaaatacacaaattctttaccaaaaattcccgccaaaaaattcctgacaatattttcccgccaaaaaaatttccgtcaaaatttttccgccaaaaaaatagaaattcatgacggattttacaaaatttaggaaggattctaagcaattcaagaaagattttacgaaatatagaatatattttttttgtatcccttcctgaatttcataaaatccttcctgagttttgtaaaatatttcctaaattttgtggaattcttcaaataatcattttctgaaatttaggaaggattctacgaaattcaggaagggtttcacgaaatttttatttgtgaaagctttcctgaattacgtgaaatcattcccgaataccgtagttaccttcttgaaattttttttgcggggaaacttttacgaagattgttttggcgggaaaatttgataggaaagtttttggcgagaaacttttttacgaaatgtttttttgtgggaaaccatttgacggaaaatatttacttttatttatttattttagttaactaatcgtttatatttaatatttaattaaagttttgagtgctatttgttgattttttcaaaagagatgttatttttggaagaaaaaactttttagtgctatttttgtaatcctcctaaattttaatcaaaccttaaatataaattaataattaagaaaatacaaatacgaatacacaaatttatcgccaaacaaagattattaagtttttcatatgtatttatactataaattgttttgtaaagcctttaatttgtggactatactataaatttttcagtagggcctttaatttgtgggcttttttttacatacaattatataaactaaaacctaaatgctagagttaaaaaaaagggcgatttgtgagtcaacttaatttttgtacaagtaaaaatcatagtttttgaggttaattgttagttttgcttatgaatttattgttattcttcctttctatcgtggcaaaatttgtaagaaaaaaaagatgcaaatcttgtgataatgtgattagttaaactccaattttagaatggatcgatcactagctttgttaaaatatgagacacaaactttcatcaaatttaacgtatttgaccttgatttgtgttaaatatttgtcgcaatataaagttgtaaacgttatataaggaaatgttcaatctctcttctttttttttgaattctttttaactgaatttgtagatgttatataaaaatatgacatatgacaatgttttataaacatgagtatatttgtcacaatgtttaacataataattttgaaaagagagaacaaactgcaacaatgttgttatataatacaattttccattaatattgaaaatatgagatttctatgggatattgcacaaaagctaaattacaattcataagattaataaaaatctttaagtacaatgtatcacaccaattctgctagttttagaaaaatataatatcttttttttgcctttttcataatgagtcaaatttatgtttatggaggatagaatctcaatgttaaaaaagagtaacaattcataaaattaattaaaatatttatgtgtaatgtatcacactatttttgccagctccaaaatgttacttttagaaaataaatgagaataggatatttgttttttgtctttttcataatgagttaactttatgtttacggaggatagaatctcaatattaaaaaggggtaacaatttatacgattaattaaaattttatgtacaatgtatcacaccatatctgctagctctaaaatgtaataaataagaatataatatatattttttgtctttttcataatgggtcaactttatgtttatgaaggatagaatctcaatgttaaaaaggggtaacattcattagattaattaaaatctttatgtatatacaatgtatcacactattttcgccagctctaaaatgacagttttcgaaaataaatgagtcaactttatgtttatggaagataaaatcttaatttaaaaaaaggtaagaaaatcttctatataaattggtcaaacttcctttcagtcttcaattcaaatcattgttttttattactaaaaggaaatataggatttaggatagtcccccaaaatgctaagtttcaactaatataaaaagaataaatctaaattacagctcatctctttaaatgaaattgtaatggacagtgtatcacaagatttttgccagtcctgaacgttctaaatctttaggcgtttatttgttctatttataaatatcaaatcgtagctttataatccattcatagtcctttgctcttgttttactactctcactaatttttttataaaaacaattcttagctactagctagctccatttataatcccttcactcaactttcttgtttcactattctcactaaacgtaagttttcttgcatcatttttctaaattttattgtcgatatcaaactagattcgaaggatttcaattgaaagtcttatgatatttaattgttacgtcgatataatctatgtgatgtagaaacactcatttttaggggtctaattacatctattcaagcaaatcttttatttaaagtgtgcatgctaatgatttggataattttgtttcaaattagggttttctcggaa

SEQ ID NO: 5313 - DNA, 3000 bp, Unknown
  misc_feature (1)..( 3000): cDNA_ID_1025318_gDNA_ID_1620778_Annot_ID_167825 3000 nt of promoter + ATG
cggagccgtacaacgaccaatgttaagagcgaaacccccacaccactctcccgcactgtttcttagcactcctcccgctgtagccagacccggattaccccgtgatgccccaccagtattgagcttcagccacccatcgttaggcacaccccaaccaaccattacttccaccctaccgcctatccccgaacctcctttatgtttactagtagcggtagttacttccttagccgcatccttaataaacctcgttctatcccgacacttaccacgtttgtcaaacacgttatcacagcgccacttccaagcccaccaaatagccatcgtgaaaaccgtagaccatacactctcatatatttcccggtcatcacctaggttatcatgctaccattcgatcaacgactgtgcaaagaaggatctcctccgccgctggggaatgatacgatcccaaagtcctgccattgcgggacaatcccgaaggatgtgaataatcgtctcacttccccccttacagacttggcaaacatctgttatacacagatgccttctaaatcgctcagcatccgtcattagagcttgattcccgactaaccaaagaaacatttttgctctctccgtcgccaccaccccccatatgcgactaaaaagaacaacacaacatatacaacaaaacatagaatatcaacattaaagaatataaaaaatatcaacaaaacatatacaactcgcagtgtattatatatttaaaatcaaataaaataatatcataaatttattaatcatctttacaaaaaaagatttttagtttaactaaaatataaacttacccgcggtataccgcgggttaatatctagtgcaaacatatttagtaggagtatcataaaaaatctcaaacattataaataatacttaaaaattccttatgataccatatgagtatcacccatatacatgctattattgtgggtaaaaatagatagttttgcgcaagacctattaaattatgaatattttgattatttgttccataattattaaaatttgaacatttttgttgttagcgcaagattcaatccttgctttggggaaaaattaaagctatacgtaatttcactgatcgtttttggaaagaaacatggaaattaaaaggtgagctttttttttagttgctgcttctctattgatgagttcctagcgttatgtggaatctagaaactttgtgattttgtttataatctatgcttactcttttctcatgtttacgcttctagatgataaacaacgaacacgttggaataagtcctacaacatcttgtttgggatggagccaggaagttctgagatgaatctatcttatatgcccaactacaaaggactttgttgatttcatgtttgaaaagcaaaagcctatccaattcttcactccaacggttaattttaaccacattcgcggttctactatatatccttaatgaaatgtagattctaggaccttaaaattgtttttcctctgtggcagagaactttttctacatcgatgcccatgaaagtctcttgacttcttgcctcctactattttatgcatcctaaagcgaatctcgataaggttgtaatctctattatatccatcctaaacaccgtttgtgtattctccatgtgtttgattccttttgaatgttttggttcctagctgaaactccaatatgaggggttagagcattagttattcaacctaaaactccattatctctgactcaaagacctatcattgtctttagtgtgactccaaattatgaggctttctctctaccttgcaagatcaaacttgaaagaaatcttgataaaatcctaacttcaggaaaattgtgtatatacatatgtcgtttaatcgatactctacatgtttgcttgtttaacaacgatatgtgtgtacgttttgtgcatactattttcagcaaatagtttttttcatagagaaattaaattttagtaaatacacgaatattataattatgatctcacaaaaaagaaaaaaaaaaccgagatcttcaaataaatataaaacttacttacatagacatgcaaagccttcttgacatgcaaatggatgttgtccatgttcctaatagaggggatgaaaccaatccacaaaatttatttttactaaagtgatgaggacttatagccttagaaatatagtaattatgagtatccaaaacagaacagttggtcttcttaaataaaaaaaataaaaaaaataattagatgtttataataatatcttattataacagttggtcctcttaatttttttttaaaaagagataattaaatgtttataataatatttgtaaattaacgatgtcggctcactagatttacgatgattgacgtatttgtttgtaaattttatgaaattacgttcattaaattaaatatttaaatactaaagattaacagctaaagaaatcttaatgaaatattgccatctttgggttttaaattttctatttttcatatttcatatcggatatccgattaaaaatgaaatcagtaagtataccaaaatacaagcgttatatttattgggcctattcgggccattcaataattaattcacccacgcgcaaatgagttaatccgtaaaataggctttaaagcccattcaataaacccgtttcgcaggaaaaaagcccattaaataagtaatttccagaaatacccttttccaatcattgaaaattcaaacttgacctaaaaagtatctgaaaagccagcgccttttttcgttacgaatccgtgtttttgccagctttcaatccaacggctctcctttcttctcacaatccgtaatcatcgctccccactcattcattataaacaaaaacaaaaatccacggagccgataaaaaaaaaaaaaaactctctcagatctgagaatcatttcttcttcttcttcctcactttgttcatcatcttcttctccgatctaaacaaca

SEQ ID NO: 5314 - DNA, 3000 bp, Unknown
  misc_feature (1)..( 3000): cDNA_ID_2997251_gDNA_ID_1620778_Annot_ID_167826 3000 nt of promoter + ATG
ttcacctaaaagaacccctaaaccctttctctgacctttcttctacaaatctctgacatttcttcttcaacatttgatacattcgaaagtttccatttttatcgattctacaacatattttgtttaccagatttgatagattttggaagatgacattagggttgttattcgggattggaagaacattccgaagaaagagagcttcttcgcttgatattctctctcccaaacgagctcccagagacttttacaagggaaaaaactgtaaacctcctggtttccacactcgtaaaggtttcatttttcaatccaatctgttttcatcaacacttatttagtaatcaatgattgaaaaaaagttgtttcttgatgcaatgttgtttgaattttgatatgtggaatctaacaagtagaaaaagctaaggacttgaactctattttggtcatttaagttgtttcctatgtatacttgtttagtaattgatgattaaaagttgtttgttgatgatgatgacgcaatgttgtttgaattttgatatatgaaatctaagaagtagagaaagctaagaacttgaactcacatttagcaaattgaacctaatgatgcgtaatactttacgcatttcattcgtttgacttgaatttggaacaacttgttaccctttttatgctgctattgagattaagttgtttccatatagtttgtttagtaattgatgatgaaaagttttttttgatgatgatgatgatgatgatgcaaagttgtttgagttttaaatataggcaatctaaggagagctattttcaaagtttgatattttaggtggaaagctaagaacttgaactccaaatttggctaagtgatcgtaaaaacgtgaaatgcttgacgcatttcattggaaaaatttgttgcctttctcatgctgcagttgagatttaagctgtttttatgaactcttgtttagtggttgatgattgaatgttgttcttagtgatggaattagtaactagataatgccaaattgtttggaagttagatatatgtaataaggaagcaatttacatgactttaagagacctgattctttaagaggaaagctaagaatttgaactgaattttggcaaattggtcatcatagcattgttgtagatgtatatcataaagtatttgcatttttccgttctttcttttactttttctctaaatttgtgacaatggtttgcatgaggatatgttgtgcagccagataaattgccaaactacgtagtccctgatttgactggctttaaggtttttattctaccctaaactcttctgttacttttctttgattcctcgatattgaacatgagaacaaaacaatagtgaattccttcggatatctttttacaagtcgtaaacttgtaatggtttgaagctccttaggtttgtgatcctgatgatcttattcgttttaggttgtgttaggaacctgaaatggaatgcttacttcttgcattaaccttgttgtgttttgcatgccaccctaaattcttctgttcctttcctttgattcctctatatagatagccgagtatgtaacttgcatcctaattgaacattagaacaaattccctttttaaaccgtttacatgtcttactattcaaagctccttaagcatgtgtgatcctgacgattttttttccggtcttaagttttgtgttaggaacctgaaatagaatgctagcttaatgtataacgcaagctttgttgtgtgatctagctttgctgatggaacatttgtattttatagctgaaaccatatgtatctcagtgccctttagacgtcaacaaaacaaacgagtcaactgaagcttccaagtgacgaagttagaagaaacatgtttttaactttgaagtcttcattagcttaaagttaaggactgtgttattctatcatccttagatatcttttgttactcaacaactcctagcaagttatttcgagattgagttaataaaataaaaactttgaattgaatccaatgaatcttagatttcaatatttctccacttctcaattccctgtttggtaactgctactgaatgtgtgtaccgtttctattgtaaccaacaggtaaaacggtaaattaaagcgggacaatgaataaaaatcctcaaaaaccccaaaaaatactcatactaatttttatttgcaagtttaatacccaatatttttggattggaatcaaaaatacttcatctaatatttatggtcataaaatacctcatatatttattattggtagaatgaaacccgcacaaaattcatgttttttttctcccgtttctctaattctagccgacgtagatgatactccccgcaagtaacatgtgccttataatgtgatcgcgttagttcccagctttgtctagccaccaagaatcatcgtctatgccgcctgccgtcatagctctagggaggagctgagagtgagaaggacaagggaaaaaatgagaatctctgaagttggattgggtgttttactgggattagtggcattcgataagttagtaacaccgaattgtatatatagattaaaaagtatgagattcaaatttaaccccgttaaatagttccgttaacgtccgttaagccgtaggttaattctaacaataattaatatatgaggtattttatgacagtaaataattagataatttatttttataccaattcaaaaatattgggtattaaacttgcaaataaaaattagtatgagttttttttgggatttttaaccacaaaaaaaatctttgaccttttaaaaaactcttattgaaaaaaaaaaaaggagttatatgatgaaaccaaatggacccatatgattgggagatttggataacagagaatccacaaaagtgtatccttcacaaaaccaaaacacactctccattttcttcagacaactctttctcctttcttctctcttctctgtctcatcacaaaccagaaatg

SEQ ID NO: 5315 - DNA, 3000 bp, Unknown
  misc_feature (1)..( 3000): cDNA_ID_4479748_gDNA_ID_1620779_Annot_ID_167853 3000 nt of promoter + ATG
atggaaacactatgccttttatctttgatactgtataaacatttgtctctttttagctttcattttctggttacactttagagtgttaacacatcttatcgttgtctttctcaggtatgggatttgatcaaactagctgaatatcttactcagagggatgatatagacccgaaaaagataggaatcaccggtatttcgctaggaggtcagttatacaacaaattgagtagcaagatttgtattaagagtaattatatatactaattttgttcattgttaaagcatattacagggatgcatgcttggtttgctgctgcagctgacactcgctattccgtggttgtcccattaatcggtgttcaggtgcttaacaagatagcagcaactatgaggcctattcttccttgtatgagtgagtatgaggatggtttcgtaattcaaaaaacttgtcaatgttttgtatgttgcagggttttagatgggcaatagagaatgatgagtgggaagcaagagtcaacagtatcaaacctttatttgaaggtcagattttgaaaaacatacaaaaaatatgattcaatataataagtatgaggattataattaattcctttgctttttttcttcttctatggttccagaagcaaggattgatctcggaaagaacataatcgacaaagaactagtcgagaaggtgtggaacagaatagctcctggcctagcttcgaagtttgattcaccgtactcattaccagtgattgctccacggcctctttacatccttaacggtgagcacaatcaatatatatgtatgatctcactaactaccaacaaacttacaagttttctcggatttcatatgcaggcgcaaatgatcctcgatgtcctcttggcggactagaacttgcgttaaagagagctgaaaaggcgtataaggaaacagcttctcctggaaacttcaaggtaaatcactgatctaacctttaaacactattgcaaccagatagagaattgaaaaagaaaaacttttgatgtttcgagagagcagttcaaagcagaagatggagttggacacgaagcgacgagtttcatgatcaaagaatcatcagactggtttgacaaattccttaaacaagaagatatgacaacttgacagattgtaatattgtgaactaataaagaagaatcatcttcttctcgttaataatgtattcactctcgcaaatcaatatcattacaaatttcaaaaaaaaaaacaaaaaaaaagcaagaggatcatcatcatcatcatcctttcttaggcatagcggcgaggcgtgtatacatttgtgccattgaattgaaccctctcacatcaccagatcttagaagattcccttttttccatagcaaccacaacaaaagcgtcagtagaaaaaaaaaacagttgcttactataaaaactaggcatgggcataataatcaaactgaaagaaccgaatccgaactgaagcaacccgaatccgacccgaaatggtaaactactcaaatagatcctaaattctagaaccaaagtaattagaactgaacccgaaccgaaccaaaatattttgcgtatccgaaatatgattatatatccaaagatattagttatttttagtttgaataatcaaaaatacccaaataaggaaaaatatataaaaacaccaaaatatccggaaaaaaagacaaaaaatatctgaaatattcgaaataaaatattctaatggatcctaaacttcagaaccgaacccgaacctgaaccgaactgaaactgtttcggttcctatatggatcctaaaatcgagaacagaaagaatcggaaccgaactagaaccgaacgggaaccaaaccgaatacccgaacgcccatggttacatttttgaaaacactaaactagcattttgtacctgagtcgcagttaagaggactgtccggctcaggatgagccatcaatgctatgatagctctacacacagactgaagcgtccaagcaggactccaagcattcttcaaaatgtcgagacatatttctcctgtctacaaaattcccaagtactaactaaaaaacctgcgtttccttttatcacaggagaaggttgttataaaaagagatgcaaaccttgaaatgaacattaggatggaatatcttggtcaagaatcgaacttgaggaggttgcaaaggataaggttcaggaacagaaaaagcaagctgaaaaacaccgccttcgtaaggagtctccgaaggtcctttgataagagcggtccatttgaatatgttggtatcgtcacagatcaattgaatatcaggatctgctactttctctcgctgtacctctttgtattctttaaacagtcgcgctcttgatgcctattacatcaatcaaatcaaatcaaatcataaacatacacagagaatttgcaacaaaacaaaaaaaaaattaagcaatttacctgcatctctaatttcccaaagagaacgaattgtcaactgcaaaaagatcaatctaaaatcaagaagaaataaaccctaatttcttgtaattcacagacgcaattatcagatcccgtaacaatctcaatgattaggtgaaaagtgttttatacaagaacagtgataattagggttaagcaatgactctgctttaagatctagaaagaaagacataggagggatgcgaaactataattgaacataaagaggacgaatcaacgaagctttacctgcaaatatgagagcgagagagagagagagagagagagagagagagaatagcgatgattatgtgaagttttttttttccgaaccatagaaagttttattaaaatgactttataaaaaaacataaccggatgatagaaccggtggtaataaggaaacgaaaccggatgatagaaccggtggtaataaggaaaccctaggcggtggtagtgagttaagagctaacattgttgcggccgctaagaattgatccggcgagaatg

SEQ ID NO: 5316 - DNA, 3000 bp, Unknown
  misc_feature (1)..( 3000): cDNA_ID_2108769_gDNA_ID_1620779_Annot_ID_167874 3000 nt of promoter + ATG
aatggggagtggacaatgggcatcttacatctgggccgaagcttgtttccacacaaaccttaggatcaaggactattccatgcagctcaaatacccccagtttctatccgagtatgctgatgagtacaactgttattctacactgctccaccggaaaacatatatgtcagagccccacttttacttcggaggacctggccggaactctcgttgtccttaatctcatgttgattttgtcaatgttcattctcctgtttttttgttagttttatcttcggaggacctggccggaattttgtttgtcttctaatttaaactaatcagagaagatcttatattgatcataatcttttaatttttttcattactaacaaagcctaagaaagtggaaaacacaatagggagggtaaaagaaactgagccaaatcaaaaggaagtctctaaactgctaatcacaaattgcatcgagtcttgatgccgcggtggaaagtttcaacctctacatgtagaacaaagagacatgttgaaaaataaaatgtgataaaataatttttccgtgtatacataaaaaataaaataaactagtttcaacctctatataagtatatattaccgtcgacatcaatagtaataaaaaatactcaaatgaataaaaacaattctgtggataataagttccaccaaaaggaaggatcaaccataagttcatgacttttgggattatctttggtagttaatcttagtttcatagcacaaagaatgagccaaatgtacgttaaatatgcatatttttattaatttgtatatatagttttgtgtatgtttcttatcaacttaaaaaagaggaaaagtaaaatcatatatatatatatatatatatattatataattgaattatactataaggagaaggcaaattttaattgtgtctaagttactatatatatatatataattatgtacatataattaattttgtattaaattaaatatttgctaccctttatggagcttatataccaaattttgtattaaataaaaaataaataaatagtctttaacctttataaggtactgaaaacctttaattcgtataaattaatatatatgttttgtttcacaataactaaaaaaataagtaaaagtagaaacaacagatatgtaagctctataagtagtaggaaaaatgtaattaaggatccaaaataataatatttatattttatttgcaaccgaaaattttatagacaactcgcattgaaaatgttctcaacttgtttttataggaggcaatacttcttgcggtagggttcaattatattggtgctcaatcagggaattgtccgatgccattttccagtggaatttgatagaaaatttaaaattaagcatcaaaaagttgtctgatggcattcatcggagttgtcttgaatcaccatttttccgtttcatctcctaacgtctgtttttcacttaaaaagtctccaattccagtataacttcgtaaaacttgtacaaaacaaccgaaaaatacattaaaaacgaacaaaaatgtgacaaacaactcaaaacaaacactagacaaaggacataagacactaaaaacacaatataccacatacaattttggagacacccgcacaccgctcttcacctcttggactgtcagtaacattatgacatgactatagacattacattcactttcatgaaatttacaactactctttggatttgggttgcagaaagatgcatacagtaaaacagctccatcaacctcttatgctcatgtttcatgcacataagtactcaattagccataggtggaagcttagaccctgtttcgactttcgagtagctcggatatatatgcattatatcacatatcccttagcaccatattttctaatttaatttacaatatcactcattgccacaagtgtataaaaaccatagcaatagaagggtatcaaagttcaagtaaccaattaaattagaacactagaaatacattctatcatccaatctaagcaatcaagttaaatcattagaacaatattgaactaccgccgaagtaagatctcgtctaccggagatattgtcagattcttgcctccgttttgtatttgttgttttgatttgtaaaactttggctcaagtccaattcaggtattataatatttttaaaaaaagaatattgaactattaataaaatcttaacattttctgttggtccctagtacttttgatgggctctctatatcttcgcttttgtatgtttgaagcattaaggccgaattcatttaaaactcaacttctataccaaaaattttattttaaattttatgtaattaaaataaactaaccaattttttaaaaattactattttaatcacatataaaattaagttttaatttatctttctatacaaaaatatcatcattaatgaaattaactaatttattatatttttttaatcattttttcacttataaattttatctaaaactgaatcgattaatttcttatatctctaaagatatccgtatggtaacaaaattgactccaaacatttcttaagtcgatttctaaaaccgctccaaaagaccattgtgcattaaaaatactaaaaatctaaaatttaaaatattctcaataacaaacatttacgaaccactgaattttattttattttaaaaataatctataacataataattgttttatctgttttctaacacaaattattctaaatacatgattgaaatacatttctaaattggcgttttatagactatagtattttgacaactttgttttcaatattggcgtttcattattttggtgaaagattcccaacttataaaaaaaaaaaacgaatttttaattttcgtcctaatcatttatttcctaaccaaagaaaaaggcaaatcgcgacccgtctctctctctctctctctccttgaaatcgaaagatcaaaaaagcgacactgaaaatg

SEQ ID NO: 5317 - DNA, 3000 bp, Unknown
  misc_feature (1)..( 3000): cDNA_ID_1809665_gDNA_ID_1620779_Annot_ID_167873 3000 nt of promoter + ATG
ccgttaagatcactagtaagttgtaatttattattagaaaaacaaattaaaacctaggttgcctggaaattcgttttgaggtatgttttccgttttcgaaacgtttcggaaatagagactcgtcggaaacacaaaaaatgttacgaaaacacgtttttaaaaaatctatttttggaaatacgatggatccgaactagtcacacgacaaatcctttttattgactttagaaatttaataaactaaattagaaatattaagattactaaagtatataacttattttgaaagactttgagttttaagatcttttgacaaaccaaatttgatgaaactaattaaaatgagaatgaaaatgttggtctaaattaaatatttgaacttaaacattttaatctatatcttttagaattttaattaacttatttaatattaatgtcttggacttgtgttgtttaagccatttttaatataatttcatgctaatatacatatatatatatatatgtaaatatatgtatatatatttccaaaatgtttctaatctctaattttagaaaaaaccgtttctcatatccacataatcgttttctttccatgcaacataaattaaaacaatataaaaaaaacttcttattttcttttggtaaacaagacttttgggcaactggtcttcaacaaacatattccgaagcaggctaattcggagtatatgagtctggagatcctttaaactttagactatgtatgtcctctgcaaaatttactctctggtttgtgaatcacctgttttaactttgtttataagttcgttttatggtttctgtaagattttactattagctacaatacaaaagattttgtaaattagggaaatttgcatttataacctacaaaaatattataattaagtaaataacattctcaaaaaaagcaagcaatattgtttgtattttctgtaataatgccaatactatccctgtttgaaatacacgcttttcatcttctcccttccatagaaaaccaactattttctttcgccaactattaacttttgaacataggtttggctctaacaaattccagtccaccgtttatgaagcttttgattttgccaacgattaacagaggtatattgggcacaaaaacaagacagttaatttttggaaatgacatttaggttttgctcgaaattgaattagaggttttgatttacagaggcacgactttagattttgttggggtctttggtttttttaagagactttggttttggtttttgaaattcaattagtcgagattctcgctaataagcgctgaatttgatcaatctctgttctctgtttccttcatttgatttctttttttcggtctctctaatttattggcgtcgttgtttccttatcctgaaccaataaatcgattttgattttgagaaatttttgagagatactattctattttgtgaatatactatttacgtataccttgtactatatacgttttaaaatgaattgtttgttttgattaaggatgttaagtgatttgattagtgttttatattaaaagtcttgggttccctatatattatcttagggtttagtatccttccatcaaaaagtatttaattgattatttggattcatcggaataaacgtttctatttaaacaaatatatactattctatctttctatgatgatctgtatagaatttgatatcactattcatttttttaaaaaattcgtttccgttttttaaaattcaaatcatattagataaacaaaaaaaaatctgtttttacaataatattattaactttaaccaaataatattgttaaactaataaagtaaacaaaattaagaggggtgaatatatattagtcatatatatttctctttcctcctgctagtggcttctctttctctccaagcgcatccgtgggaaagagttgagtgtattttcacaactgacatgtgctatcaaataaattacatacattatagtactatatatttaataactttttcaaaaaccgtcattttttgcaattcaccctataaattaacactttataaaaactataattaaaaataaaatgaaactacatgttgatatacagagcaacacctcccaatagaggtttggtgagtaattattatataacaatagtatcaatttattagaacaatcgaatcatattctagattctttcatcaatttttttttaaaatcattctagattatagataactttgactttacttccgacttttcaaacggcacatttttcttggcaatatatttcagagaaatggcctattaattactctttgattttttataatgttcgcgtctttgaattgaacaacccaacttttagcatactagctctttaagcacacttttatttttttcacaatttggccaataatgttctagaaggaccgcatatcatatgattagtcattattggtgcttaacggagactctgttttttgccaaattgaaagttttagatttcatgctaatagataagagtgatgttttaaaacatatttgaaaccaaagttccaaactaataccattagtaaaaatcatttacttataagttataagccctcgtcatggcccattttacatggttttggattttagatcgtaaagagaatacaacaaaactgtagacaaaacgaaatcaaaatttcgaatcaaaaagttgtacttgtacagtatataagtaactaatcgtcaaatgtgtatccagttaaaatcgtcacatatgtagatacaatgacgtaatgagtacccaaacatcaaatctctatttttattacaaaaaaaaaaaacacatctcatcgatgacttcacctactcttctctataaagacttgaaaaaaacttgaaaacttcttcaaagtttgtatccatttcacattcacagtcaaactcggttgccgaagaaatttcccggcaaaacctcaacaaacaaaaattagaga

SEQ ID NO: 5318 - DNA, 3000 bp, Unknown
  misc_feature (1)..( 3000): cDNA_ID_1809653_gDNA_ID_1620779_Annot_ID_167870 3000 nt of promoter + ATG
gtatgagaccccacacggctatgaaccatgttaccatatattctaagtgggtttttaatttgataaccacctacctataactctaaattagtctattggatttttctaatgatcatcatataaatttattctctttatataatagtaatcgttgtaaataatatatgtgtgtctcccatcaatccgcatcacattcgtagaatcatacacgtatgtaaacgcatttttgacatacggaaaccatacaagtaggatctgttaggtggttattaattcaaaataaaatctcttttcattagaaaatataaagagactacttttataaaaagattgggattgtagttccttgccaaccacccatataataatactccccaacaccaaaaacacaacacaaacttagaaaaatggaagaagaaaagagattggagctaaggctagctcctccttgtcaccaattcacttccaacaacaacatcaatggatctaaacaaaaaagctcgaccaaagaaacatcattcctttccaataacaggttctcttaatctcttctcatgaatgatttgaatcattcttgttcattgtagatgtcttatatgataataaaataaaaataaaaaacaaaatcctggtaattctacagttttcggagattagtttgggtttcggtatctagttatcaaaaagtatttgtgtatatgttataactagatatggctaaaacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagtaagttttaaatcaaacaaaactaattccatttttttttctggaactgaatatgaacttactttatcaaaaattcattttatatctatctacttttgtttttgtcgaatttaacaaatatttttagtatgagttcctaaaaagagtttggccatttctcatcagattattattttcctttaaaggtcatatttttggatatttatctgataataatttgaatcattggacatattaatgatatagtttactttatttgttaggatgtttgtatctactgtaaagaggttgcatgttttaaagacctcccacgccttctcactctcacgtaagattacaattcttacgaaactttttcatacatctcatcacttaattactgccttgaaattaacttatatatttatttattttttcacagctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaatgcctgatatgattcatgccttcgtttcgttttttagtagggaaaatggtatttaattagcgaaatcaaaccgactcattttatgtttttttcagagaggtaaaaatccagagagcctgtttactatgtatgagtaaagattacccgaaataatagagaaatagatacaagaggctatccaagtttggtgggttcgagttttataacaccatccaaaaaaaattgttgttttgtaacacacatgagtaccaattgtttatttcacaaaagacaaaccatttatttcatgaactgtaatcttgttatgttcatgaattatttcggtataacatgtaattaactcgagtaatatcttaaaatagtatttagagtaaagatagtagggagaaagatactttatttttttataactcatataattttaaaaatttcatacacccaaaaattgattatggagtatggaaaaaccatgttaaattacttaaattttggtggctaatactactcgaactcagatggtgaaaacgactttagacttcattaatataaatatatatatatatatatatatatatatatatttatatgagtttttacttattgtcaattggttttggaattagtaatctatgaaacttaacatagtatcagtctatcagaggttgaacattcgctgacccgttaatccaacttggaaaatggtccgattacctctactaattgatgatccaaagaaaaactcaattatgtcgagataggtaaaaaaacattattttaaaagaaataatgaatttaaaattagtaaataaaatttaaaatttaaaaattctcctataaattttgtgtctcacaactttctttcaaactttttttcttcaaaaatataccgtatgctgatgaaatttttatctttaccaattaagaatataatcttttgtttccatctcaaatcatcatcatcacctccaaagcgtttagcaaccccaaaaccaaccacttggcgactacacagtattttactcaaaacatcacaagtttctatgaaacgtaaaacgatgagtttagtaaaaaaaaactagagattatagtcagaaaaactataataataagaagataacattaaacggatagattcatgtctcttttttgaaatccaaaattgggtaaaatccaaaaaccaaaatcttgccaaatgccaataagagcaaaaatccaaactttcctttctcttcactattacacaatgaaatcaacactacattttcacatcaaaatcacattccttcc

SEQ ID NO: 5319 - DNA, 3000 bp, Unknown
  misc_feature (1)..( 3000): cDNA_ID_3076589_gDNA_ID_1620779_Annot_ID_167855 3000 nt of promoter + ATG
aacagaaagccaaattttttcccttgtataccatatgagcaacaagaaactcacaattcagtattgtattttttggtaatattggtttgtagcatctattaatggcgattttcatatagtaaaaagagttgacatttcaagtttgtttacagtaataaaaaggtaaaaaaaacggccaattccagcatgaatttacagaaaataaatccaaaacaaatataaaatttaaattcggaaaaaccttaaccggtcggttatcataaaccaaggaaaaaaaaaaacaataccaccgcacgtgtaaaacactcggagtctctctcctttagcgccaaattccgctcgtatcctctaaaaacctagatcgatcttaatcaaacgatctaaaccgtcgattaaccccttttcatctcaaccgttagattttgttgatcaaactctcatcaaaattcaattttttgatttttcaaaaagatctcaaagagacgacgacgaagcaaaagaagaagaagaagaagagagagctattcaagcttaaagcataaaacaatctctgctccttatatagttcttcactatggaagatttgagtaatcagaatctcctcccgcgtcaatcagatatctccatccctgcggagaagatggattcgtttcaaaagtcgctagaacctccgccgtgttctccggtgaaatcttctcaacaatcagaaacggaagtcacaccgcctcagaaaccaccgcttcaccaatttggtcacaaccaagttcagaagaatcgagtgaggtaaaaattggttaatttctctgttccatcaaatctatttcaatcttaaggaattagcatttttgattgtttgattatgtagcaatcaagatccatcgacctcacgaagacataatgaagttgaatcgaaagagaatactccaaataaacaacaaaaacattgcaattgcaaaaactcaaagtgtttgaaactgtaagtatctatttttgttaatagagtttaaaaacatatttttgtttatacagagtcttgttgatctatataggtattgtgaatgctttgcttctggatcttattgtaatggttgtaactgtgtgaattgtcacaacaaattggagaatgagtcttcgagacaagtagctatctcggggatcttagagcgtaaccctgatgcgtttaagcccaagattgctggtagtcctcatggaatgaaagatttgcaggtttgtgatcttgttacttgaaaaaaaaaagatgtaactttagggcttgatggtagttttataacttgtaggagaatgtgcagcaagtgttgcttattggaaagcacagcaaaggatgccactgcaggaaatcaggatgtctcaagaagtactgtgagtgttaccaggcgaatattctatgttcggagaattgtagatgtcaagactgcaagaactttgaaggaagcgaagaaagaaaagctcttcttcatggatctcaggtctcggatacctacatacaacagatgaccaatgcggctgttaaccgtgccatcgacatgtctgcttatctgtaccctcctgaatcaagaaagagaaagagcaaggacatttcagattctgtagtttcatcatacggtgtccaataccagagggtaaatagtacaattctgtgttgatctcatggtctttagcttcagtttttgcattgaaagcataattctttgtgtttttctatttccaattaggcaaaccacgttagaagaaatggtgaaaattctctattttcactccctaacaacaaggccgtgtccggatctaccacaagtgcttacaggttggaaatatcaaactcatcttctctatgatattgcctatttgaaactaccgtgatacctgactaatggcttctataggtcttcttggtcaaatacattccaaccacatcatgtcagagagctatgttcacttttggtctcaaactcggttgatgtagcaaataaattgtcaggtacatatcatgccgttagatgtacaagatgataggttaacgttcctcatataataaggtctttgataagagaatgtttgttatggtgaaacagacaaagggaggaagaacgacaaaggcccttcttcacttgatggagcccaaagagttgctaatgagatcaatgactcaccagattgtgtccttgatgctaatagaatggacgagaagcctatatctcccgcaacacgtgcattgatgtgtgacgaagaacatgagatcgggtcagagaaagagacatcggcccgagtgaaaacaagccaagagaaagaagacacagacacaagctcggggatttacttagagcaagaaagacagatattgtcaatcttcagggactatctcattcagctctcaaaccgtgcgaggataaatggtaaccttgatatcgtatccttgttcagatatttacaagtagaggattgtgctaatttaagacattattttaagcaggtaaaaatatcaaaagcaacacaaatccaagttgaaagaaaccagaagatgaagaacaaagccatcgagactcaaattagggacattgcttagggaatttttttgattttttttttaggatcatactcatttttaacatatgatccatgtcacattttaaaaaaataattaggaagattagacataattaaaatttaaaaatggtttgaagtttatgagtgaaaattgtcactactatatcgcaaaacagagaatcgaagataatgggctttgcatcgttgtttagttgataatgggctttggaataataaaggtccaatcaaattacatgacccgacccgacccgtccgagaaaaatattctgtcttcttcatcaatcaacggtttaagacttaacactgcaaacaaaactcaaaaccctaggcacacactctctctctctctctatcctcaaagcttcttcttcctcgatatcgattgagagaaacttcgttctaagattcgaaatcatg

SEQ ID NO: 5320 - DNA, 3000 bp, Unknown
  misc_feature (1)..( 3000): cDNA_ID_2140933_gDNA_ID_1620779_Annot_ID_167856 3000 nt of promoter + ATG
cttgatctcattattatcgtttagtgatagctgcttactcattataccattcaaccataatatttttatgttttcactaggatagaaataatgcatgaatcatatatcattgaaattcgatcgcaaaatgaaaagaaaacgtacatatctattgaaaactttgacaaaaaaagtaaagatctactgaaaacttctttgtaaaatacgagtgatataacacaaaaatttccatttttcgtaaaagaattaaaaggccataatagagcaccaactttttttgttttgttagagctagtaagagtcatcacgccaaaaaaataaaaataaatatatataatgcatagagtaaacaaaaatgctattgaataagttcgaatatctcggaataaaattaagtataacctttaaaagagagaatgaacttttttgacaaacttaactttaatttttaccttttttcttgcttgccatttcaagaatgctctcaattattgtcttgtgaaagatattggatagtggagtccgatatagtaaggaaaagtatatactatgtgcaaaaccttaattttatatgttttgttccgacaagacaatattaaatttttagctttatcaaagaagttagaaaaagctgacattttattgttagaaatttttgtaaccaacgtccaggtaatagttgattattagaataactaacttagaaataatgcagccttcaaagccgtttctatgtattgttgcttttaggtttttaattatatagatgttctagaaaagatgatatcatgcattccaaacttctttttataaatatctccatttgatatgattacttctattaattctaactattatataagtcgttcaatctttcaatattaaatgtttataatgtgtattagagtcaggcattcaatctttttatacatatcaaatcatgactatatttaaagtgtgattagagtctcctatgactcaaacccgttatatgcaatattttgaatagttttgaaacataaaagggtttcacggcatatatcatgttttaagatcttgtattaagtttgacatgaaaaaagaagaaggatatgtactaatttttaaagactattactgaaattaatgtctattatattgagtttatgtttgattagtgaaatcggttacggagaatgttcactggaactagaagacttagaacatagaaagaaggaataaagaccagagagccgaggcggtggttgatggaaaaagaaaaagctcttcaagagaaacaagaagaagcatgcatgtagagtagtatcacgatccgtttttagcatgttcgaggatcatattcaatatcattgtcaattttgtcggctttacgaaattcacgttctcaagctataatcaattttataaataaacttgatagcttccatgaacattttcagaatttccaattttcggatagaaaatgtatataatgtaaaattgtattacaacgtaaaccatctactacgggtttaattacctctaaaatgactatgaagcaagttgactattttcgggataaattacatttgttatgtggcacttattataccatcaccatttggactatatacaatgtttatgaggtcaaagttgataaaaagaaatttaacacgagtactcatggatcttagggataattttttaaaattacggtcaactctaataagaaattctagtaatggagatcgagtagaaatgatcaatgactgtgggaaaaataaattccgtcaattctcattagcaagaaataattcgtgcatctatatttacacctattattgcagaattggcaatataaataaaaggattattacatttgataagactatttaaatttgaaatgacattgcaacggtgtttgaatgatatgatggcacagtaccacccgtttttaatatatatatatatatatatataacacttttggactaattctatttgaaagtttctctagtatgcgtcttccaatttccaaattatattcaattcgacatttacagtatttttgatatcttgtttatcaaaaaattgctttttacaaccgcaaagttcggatcagaaccttctaatttccgcgaagtcttttgtgactacccttcattccgtggatttgaacccataacttccttattagtgtttttgttgtgtttcaagaaagccactagatcaaaagcaacttggtgctagttgaatgtttggatgatctagactcaccgattattcaattttatgtagtgataccaaaatggttcattctcaaatgcaaatgaaaacatgtctattggaagatcaaacgaggagatttcagaatgtgaaacttatagttggccaaaactttggtccttattcaagacttcaagtccatgcaaattcactagcacgaatcctaaacaaattgggcaaacaacaataaaagcatccacattaatcaaaaatgccaaaaaaaaacacatgatctcgataccatttcattgccactttataaattgggccaacaactgttttctcgtatttttttctttctccttatgactattccatgaagcttgcaatgtgaagttacaattttcttcttaacatttttcactttgaaatgaaaatgaaaatgtccctactaatagaatgatgtcaaaagtttccacggtaagtctcgaaatccactgtttttgttttgttgtaaaaatacaagcccgttaatatgcgaagtgggtttaaacccttgtcgtctccttctaaccggttagaatccggttcggattgtttaatcctcgatttaatttttattataccgaattagaccaaaactgaattggtcgtctgtacttttttctcaaatcataaacttaaaagttaaaaccctcaatttgtccgacggtgttacgcgacggctatattcggcggcggaagctttttccatctcactctctttcgactaatctttccgccgtctgaagaatg

SEQ ID NO: 5321 - DNA, 3000 bp, Unknown
  misc_feature (1)..( 3000): cDNA_ID_2140937_gDNA_ID_1620779_Annot_ID_167859 3000 nt of promoter + ATG
ccaaaatgctaaatcttaataatatattgatcttctaccaaataaataatggagataagaagctaacgtagaaatgccgaaaaatgggttcccatgcgcatataaaaaatttggcacgttaaatcgtgaagagatagatcattcatgtctcctgacaattaaacgatattctaattatccacaagtcgcatctatcgtgatcattgttttgttagctgaactaacaaagtaggtaatgattctcctcttccaaatcatgtgatctaaagggcataaccaaagtaaaccggggagagatgttgaactaaggaggttttggtttggtttagcaaatagatgatcatcatttgataagggattggatttcagacatatgacttccgcaaaacatgaaacaaatattgaaaaatccacttacaatatccttttgagctaacaagggcacaatagaaacactaattccgatatcaaaagcttgtctcgacaaagttgaaagctttcttttatcagaagctactgataagtgtggaaccagtgaaccctcttctttcagtctactagtgaactacaccatataagagacttgatcaacgagaggcgtctctatgctctccaccattaattaaaccaatccagaataatgccccaattcattaacctcgctattttacacattcaagctctcaactaactaacataaagtatgtttctgagcgggcggaactacactttcttgcaacaaccctaggctacaagtcaatggtattgcacgcattataagtaacaagaactatacgtctctaaactttcgaccaattactaaaacgaagcttagagaaattcagaatgcatcaacttgttcacatccctctcctttaaacgtaatgcagctctcaactaaccaacataagggtctgtttctgagttggcaaagcaacaataactacgctggttacaatgatcctgcaaaataagtgacaagaactaagcaatgacagtttcaccaaatggctaaatttacgagcttccaatctgaaaaactctgaatctcaacaaggtatggctcaaagagacccaattttgaagcccatatttatcgtagcccatgataatccttcaagcccatatttatctacattaaaaggtgctattcctaatatttttacaaacccgtttttatagagaacttttgtctttgtggaaaacaatcattgcacactactatttttttaaatcaaattcattaaataaatgtgtgtatgaaatggtagtttcaacaagtggttttaaaaattaaaactaaagtttatcatatgatatattcaacagaaaatatcagttttaaaagaaatacttaatttgatactatcaaacagagaatattataaattttgatgtgatgtcacttgtcaaccaccatcttgtctacatgcatgtaaattttggttttcattacaactctgctgatttggctttgtcccgaaatgatcaattttcagtttcccgaatttacgtatatcgataacatattaattgccgcaacgtacaagcaacccaaaccttaatggcatcccattttactcgttgcaaaggttttcaatacaatgtcaacgaattcaatgtatttgtgtcattctcgataatagtacgaaaagattaagggtacgttagtccatatgtaatgaaatgtcaaatgttaaaaacagagcattgaaaatatcttggtccaattcggtttggtttggttagtttcaatacgattgattgtctctcatttttgattgttcggttaaagttcggtttagctttaataccgttttataaattcggttgagtttaagattagttcaattgaaagaactaaaccgagtcaaactacattaattggattcagttggtcaacgtaaccaattttgtttataataattgaaagaaaaaaagtgtgatacaatttttctagtctgtaacttttttaacacactgtaataactgaatttttttaaaaatttgactttagaaatttatttaaattcaaaatttaatgacaaaaaaaacgattacattaaatttccataaaaaatatattttaaatcgaaaaaaagagaagaatcttttgtgacttgagaagacgaagaaggtacaaagcgtgacggctctaactcaaagtcctcctaccatatttcctaaattaccctctctcttaatttctaataccctaaaataataataagttcttgattccaaagagagtccgttgggtttctcgtaaaccagagatactcattaggaagaaaatcagacaaaggagaaactattttttgtcatctcttgtttggtggtttatattttggttgtgagtcctgtgttgacctataagccgatcaatttcgacatgcctcttttgatctttgtttgacttctgatcaacttctcaactttgtaagcttttctctgattctctctatctctgttcttgttgaggcagagcatataaattgtatataaaatcatatagggatcattacggttctttattctcttttaatatattgcatgcaatgatgatttctaaaaatatgaaaaaggttttgtgatgattctgattataatcattacagattgagaataacatagaaaatcaatcgttgactatatcagattcaagaattatgttgcattatgattgttactcttaaagattgatacttgagtaacaaaactcgaattttcctctgtaaaattgcttcaagttagctctaaaattcacaatttgtgtaatgttcataatcgaatttgataaattggtttttaggcgttgaccatattagatcatctatatgtcatattgaattatcattgttgttgttaaagattgatacttggagaaacaacaacattcaaatctcctagactatgctctgtagattttagaatcagactgattgatcataaatattgatacttttgagtgtaacaggtacttgcaaggcttgaaaaatg

SEQ ID NO: 5322 - DNA, 3000 bp, Unknown
  misc_feature (1)..( 3000): cDNA_ID_4359668_gDNA_ID_1620779_Annot_ID_167867 3000 nt of promoter + ATG
cgtgtatgtttaagggtttagtttaaaatcttgtttattctcaacaattttaactcaccaacaaagatgtacgtacattattatacatgtacgtacataacatttttcaaaagtacgaggaacaactatactctgaccatataattttatttaattattatatatgaatagatttatgatgaaaaccccaaaagatattttatctaatcaaaataatcaaaagtttctaatgtacaaactcaataaatattttgtatgtcgcctttacaataaaacaacatctaacatgtttatttctattttaaataatattttatttattatcatttgaagacaattcacgattagcaatatcatataaacatatgtgcgtaacggtaataatatatacgtacacggtagtaatgtgtacgtacacggtagtaatgtgtacgtacacggtagtaatgtatgtagtaatgtgtgtgtacgtataccgtaaattacatatacgtacaaattttttttttaatgaagggtataattgtaattttgcactcgtcttcaacctctgcaaccctaattttgcagccgcttgttaactcattaacatccgaaactcctcgccgccgactactcttctttatctccgccatttgagtatgaacaataattcaagaaaccagaaaatcctctttttgttatcctttatcacgagctcgatcgaaatttcctcaacttaagcaacgaatagaactcgcacagagcctcaatcgaactttcactttcgatcggagtttgtgtttcgtcggaattgttattcgtcttcgacaaacagtttttgattttctttggttgttagaaagttaataacgtatttttgatttaattttaaatttaaattttggtaatcagaaaaataaagaaacgaaactgaaccgcctcctttcatttctcgttccagggcaaatttgtccatttttggctgaatggctaaaatctggttgggcgagcccactttgtctctttgtgaaagaaaaagtcagaaaggtgtcaacggtgaaaatttcttttttttaaacgggaaaaatgtcgttttatacgtgaactttcaaaaagtggacattcaatacgtgaactttgcggtcggccaaataaaacatgataaaaacgttgacccgccatttaacacaaatcaaaatgttgaccaggccaaaatcccgagacgttaactggcattaacagatctgataaccgccgtaagcagacgttaattgtttctgttaaagtcgaaaacgacgtcgtttcacgaaacaataaaatccccaattcaattttgaaatccctaattctatcatcttcttcactcttcttccatagctaattgaaatcccaaattcttctatcttccatatcttcttctatcattttctttaagtttgatttcgaaatctctaattttatcatcttcttccattgtttgatttcgaaatcctaattcttccatcttcatccatctttctagctccgtcgattaccaagtatctcctccatgtgaatatacttataccaaaagtggtccacgtgaggaagaatcttcacagctcaatcccaaacgttcctcgcatggttgacgtctttgttccatagcttcattaagcaaccatggatgataaaagatgatatgaaagctatggaagtttgattaagttagaagatggacgaattagggattgaagatggaagaagatgatagaattagggattttaaaattgaattggggattttgctgtttcattttatatgaaacgacgtcgttttcgattttaacagaaacaattaacgtaattaacgtctgcttacggcgggtatcagatctgttaatgccagttaacgtttcgggaattttggcctagtcaacattttgatttgtgttaaatagcgggtcaacgtttttatcatattttatttgactaatgtcaaagttcacatattgaatatccactttttaaaagttcatgtataaaacgacatttttataaacttgacgaagaatctatctacctccaagatttgttattaacggaacttgataagacgttggcgtgtaaattttttcataatattgtggtaccgatgaaattcaaaaagctgtcactgaacggtgattaatatcgtaataaataactaataaattgtcgaacgattctttttttctttagtaatgttgataggcttatagctaatcgcctaatcccctacgtgtgaacactagaaatagcctgaagagacaagtttactagtactatgccattgaaatgcgtgacatttacagtgatacaaaattactattgctttcctttgttagtttagcaactaaaatttaattaaatggcttctgacaggagtatatttaaaggcttaaatttgatttgtgacaatttaaagtcctttatgatttgtgaaaaattttggattcttttttaaccaagtgattaaaacttatctatatcaacaatggtcttttataactctcttgcttttgtgtttaggtacatttaacgaaagataaagaaacaaaaagtgacgaagaagggtttaattgcaacacttgatactttatggtttaaaatacatcccaaatttagtgagtgatttgtagtttgacaaatttcgaagaagggtttcattgtaacatttgatagtttagggtttaaatcaaatctcaaatttagtaaggtaggtttacataaacaaaaccaagaagttgtgttttgttttgcaattttctcaaagacaagagtacgagactcgtcgacgtctttcttcctcaacttcgacaaaagaaaataggattatttcagaccataagtcattgtctccgcctacaaaatcggcgattattaatcacattgtcttcttctatgtttgatccactttaatctcttcataaacatcatttttcctctaaaagctttttcctttactcatcttttctcttctgatcaaaattgtgaata

SEQ ID NO: 5323 - DNA, 3000 bp, Unknown
  misc_feature (1)..( 3000): cDNA_ID_2140943_gDNA_ID_1620779_Annot_ID_167861 3000 nt of promoter + ATG
atgcaagaatgcgatagtttacttatataatttcatattcccaattgattgcatcacattgaagatgttattttcagggttttgtgaaaaaaaactctctaattcgctaatttttgcaactttaccttctatctctagaaaatacagattaatcctacgaaatccaaaataatatgcaatgtgacccttatacgtatattgtaaacgtttttctggatgcaaacattagatttttaaaattataaagatagatatgaactcctcatctagagaattttgatttgacatattatttgtaaaaaaaaaaaatcgaacttgactatagcaaaaaaatatcaaattgcatattatttttgactttgtatgattaattcacaaaactcttattttaaaacaaacattttattctcttatatctaaaaaatatatacattgttttataacaaagcaaaatgcaaaaatatctattcgatagcagtcatttaaggttttcacgacactatagtcgaaggtctttttttgttgacggttcttcacttgagtagcttttaattaagtaatttagttaagggatttaaaatagataaatgatattcgagagttttttcattaaaatccatttgtgtgttattctaataattaatcatattatttgggttactctagtgatttatcctccctagaattatggttaatgcacaaataagtgatcagtagatacaatcactaagttaaaagaaccttcaaaaactttctgaagttttaatatcctcgtctttttcttatttttgttatcatcgagttcataaacttaatacgttctaggacttatgtacggtcttgtagattgatcaggtatatatatatatatatatatatatatatatatatatatattcgctctaattgcatctggcttttgtttatagtacctatcacttctcttcatgcatgtattgggacttctttaaatattgtagatgggttttgtattaattagctacagttattacattagtaattctcatttcgtcttttgaagtgattaccgtgtctgaattttaggaaacgggattggattctaattatgactgatatttcatatttgtaacgtgtagtggttactaggttaatagtaagactaaaacttagggggtaactaaagaagagaatgttttgaccggtcatactatttctgattgcctgagctggaaaattgtcgtggctaaaagtgggaatcggaaaaaggaataaagggatttaacatgggattaggaagaagggttaacgtgtttataagataacaatagttaaaagataaataactcttaatatattcttatacaagtcccgagatatattgttcgatgtggtagataatggaactcggccaatagaaatatagaatgtcttgatattaagaattaagtcgctttccattttctggttgtatagttagctaatttagttgcctatttagggttattaatgatttcttagtttagttttcttgaaatgggttataattaattacttatatctaacgtgaaaagttttttttttttttttgtcttcttatttgcattgttgagagggtttgttcttgtcgcatccattactgataaagtttacgacaaactgctaaaagataaaatcacttaagacttaagagcaacagctattcaatttttttttatcccatttggatagcctaaaagtctaaaactatatgcaaagcaataaacttaactataatctagctctaccaaaaatgtgaagataagaaaatattaaaacatattcaagttcgagtgtcgctagtaattactaccaacatgaataatcacatactcgatcagccattttatgtcatataaatatatttttgttttatactttctataattaattctctagatccgaatatacctcaaatgtacatgatttgatacactatcattttatcaaaaaggtctattgttatcgcctaagcttaaaggtggtgtcggtactgccgatatccaccctgatcaaatctttgatacgttgttgtttcagtttttactttttttccttattttgtggaccgattggcccgtataatacatactattgttaacctatttgggttcagttaatatatgccgtttaaatcaataacaaagagaaaaactttattcttataggtattacattctaattaaaaagcggatgaacaaagaaaaaggaaaaagaaggtattataccaaaaccggtgactcgatccagtttacaatacatataaataattaatgtggatcggtttcaactttcgcgtaatggtgtcgacgcttatcgagtgttggttgatgataatcaacggcgtgatcatcatccatcacatgcacgtgcgtggtactttctgtaatttgaagcaatcttatgactcttttggtaaagttgtccccaccactataccataattgcacatgtttgattcaattaatcctttaatgaagtcaaaaacatttcccacctttgtgtttgtcaactaaccaaattctaattttcccaacaaatttatggcttagtaactaggaaagtgtaaaaataaataactccccacaaacgtgactacacatgtgcttgtacaagcatgtaaacaaactaaaataacactaataattacaatttaacaaaggaaaaaaaactagtaaaaataggaataatagtaagtagtgagtgtaaaaagaaataattcccataaaaactcctttgtcttcgtcaaacttttccgaattagacctcttgtccccttcaagcgcaataaaagtgaaagtaaaataaacaaaagtttatcttttctacagagaaaccataactttctctaactttactcctttttaaactcacattttcccctcacttcactctctcctctctccaaagacctccgacgagagtttaccggaaaaaaaaaaaaaaaaaacaactctttagttttaatcaacgaaacttatg

SEQ ID NO: 5324 - DNA, 3000 bp, Unknown
  misc_feature (1)..( 3000): cDNA_ID_1828345_gDNA_ID_1620780_Annot_ID_50328 3000 nt of promoter + ATG
ggactttcgtctatacaaatgtgagtcacgcatatcatgctagtaaattttttctttaatttttatattttgtatacatgttagtaagaaaatgtatatattgatggaacagtcaggtggaaaatcatgttacaataatgactgcgacgtaggaatgatactcgttcgtcaagattttcatcttggtatggcattattgccagtgtctgttcgtggtgctaagacaactcattatgcaatcttcggtctaatcaaggtttaaataattaggagtatgacacagcattcacaattttatgcatacatatttgtgtgtttcttaaactaatgaaaaaattcacctattattttcgggtaacaggaccaaataaatggaaattggtggttgcaatttggtaatgctgcagaggaagttggattttggccgtcgagtagatttcatcaaagctctggaaatttggtggagtggggtggagaagcgtatagtgcatcacagccgagtcctcaaatgggatatggatattttcttgatgctagtatgcgctacgatgcatatatcaaacggatatctgtaatcgacggttttaataacattgaccgcaaagtggcatataccgaaaaattcgtggacgatactcgtggctaccaagttgtagacgactataatattcccgcatacccagaagccggtcatataatcttttacggtggtccggggaatatctaaatatgattaattacatctctgtggaataaaaattaataaaacattacattgacttgattatacaataaatatcgtcatcatgcgtttcttttggattttaagattataaatgtttgtactaaaagaaatatttcgaactagatcctcgttgattataattgattcctggaaacaaaacaaggtaaaaatagggtgaacaatctaaaattgcttagtgactttggtaacactcaccaagttataagtgtgaatattttgttgtctacgttttttgtttactattctttttcttctccattttgttatatcttgaattttatttaaaattcagtcacaaaaacgaattaattacttagatgttatagaaaagtatgaatattactagaatatcatacatcttttaaaagttactcatatattttgagtatttgtgtaattataattaacacctttgattagctaatattatttaatttgtttttaattaagaaataaataaaaaataattcacatcaataatccacgttaaaaccgaaaataattaaaatctttcaatttcccaatatttttagaaaatataattggaaccaattgtaaaaatgtaagaatatttaactaataagagatgtactcgacgagttaaaaatttcataataaaaatttataatttaaaaacaaggtaaaaataaaaatagtatttttgtgagataaatcatatatatgaaagttgaccaattctctccatatgattgacacatcatcactttaacatttgccatgtgtccactgaataattaatgtaagctcttcaacttttaatttatagattaatgatatatttattatttaattttacatatttaattgtactaatactaaatttattttgttattaaatgtttttcaataaaataatttgattggttttctcatactcaaaagatttttttctgtaatcttaactcaaattatgagtgtatagtagtcatggattaattaatagtttgaatagtttgcatattgttatatatctatataataaatcgccgagggtgaagagtatgtaagaagtttaatcatcaaattcttaggtttcgagaatcccaatattaccctctatttaattagtttaagacgaacattgtttatgaattgtgtgtataatgcattgttgagaatgttgttagaaaaaatatattttaatactaagaataattacttattatataagtaaatgattagataattaaaaattatatttaaattaaacgatacaaaaaatttgaaaataccgcagcatagcgcgggtgattaactagtgttactaataaatatagaagaacggttttataaaatatgttttggaacacataaaatataggaatgggccgaatggccttgtgtgtggagaaaacatttgttactatagtgacgaaaaagaaaatactcccgtgaagaaatttaacagcttgtgttacttacttacttgtttagcactttggttctccattcaaatatctgaaccaataataatagaccaaaaaagaaccaaaatcctttttgtacctgctttgtctgttttataatgtccatggctaagcccaatttttgtcgggaaggcccattatcaatatatattaatttgaaggaaaaaactaaaaagggatttaaaaaagagagaaccaaatcgaatttctaaaacactcaatggatcctagaatccttgaaccgaactatccaacaccgcagagaacaacacaaagcgaatcaaatacccaggaattaagagcgaaccggagaaaaccagcatcaaatgtcaaaacctttctttttctttattttactacctcttgtgctctatttccagctcgagcaggcaatttgtattggtcatcatataggtttgaattttaatgaattggtcaaccctgaagtcaacgagatatttcgttttgtgaattgtggttaaacaaaattttgattttgagattaaaattgtagtagaagtttaggaaatagtgtagacttacttcttcatggcgaaaaaggtatgacaaaaaccataagaaccatcgtgccgtctttggcttgagatattacactacatgccgttttgtgtacaaaaaaagcaatgttacaattccgacgaatctgtgtgtcttgagagcagagagagtccaaagcatcactatcgtgcttctttcggcaaccgtgtctgagacagtgagactccgaggaaaactgaaggggaaatagatagagcgagagacatg

SEQ ID NO: 5325 - DNA, 3000 bp, Unknown
  misc_feature (1)..( 3000): cDNA_ID_1828334_gDNA_ID_1620780_Annot_ID_50331 3000 nt of promoter + ATG
agaaacaaaaccaatatatgttatcgatcgatggagaagtagtgactcttttgattcttcgatagtcaaaatcatcccagagagattgaattgtttctttaagcagcgacgactttgtccttggcggcattctctcctcctccttcgagctggctcaagtttcctttctccttgatcagctgaatatgatgatgcttgcaatatagcttaccctcgtgagctatgtaattcgaagggcttatcgtgcagcctccatgtgtacacttgaagcagctcttgtggtacaatgttccattcaccgatacctacacaaagtccacattataagcaatgtttcagctctggtttaagccaagaacagatcagattcgttatggaaacaatctaacaatcttctttgacacaacttgattctgatcaggaaagatttgagattggataccttctcaattggatacacggttttgtcgcaaccaacgcatttctctcgtgttccaccaaacatattcgaaactttggttccagcaggtctctgttaaacttctctcatgttaaatgttaaaaaaattcaagaacctcaaaaacagaaaaagggttttgttctgctgtccgaaagtacctctccctccaaaggcctatcaggtttcccaatctttggtgtccctgtacatatatatgaatcaaactttagatagataattccaaatttgaaatccccactcacaaagcttttcacattttgatctgtttttggtaatttaccttcgaagcttttctcaagacttccagttctcttgaagttttgatcgaaatgtggtctgcagtagagaactccttcaaaggagttgtaattgctaagctgactcatcaagaagaagaagaagaagaagaagaaacagaacagtcaaatctttagaccaatcagtttccatagccaaaaattcaaagatttctacttaattgattggacttcttcatctacatatatatctactagatctacttctggattaatgagaaatcatcacaaactagaatcaaagatcaaaccttgagagttcctttgcaatggtgacatcggaaacaagctttgtggtagacccggttatcggcggttaacttgtcgacaagataaactgttttgtcacatgccatgcatttctgggttgttcctgcgaacgccattcttgtaagagatcagactaaaagactcaggaaaaaagaaagaagctcaatagtcttgagagagagagagagataaagaagaataagatgaagatgaaagaaagagattgtcaattattgttgcttgttttaatatggggaccagatatattgaaaaatgaacatgcttcttctttttaaatatttaaagtaaaattcttttaggaaaaattgaaatttttaataaaatgtcacaaacaaaaaagttcaagatgagtatcgaattttggatgcaaattcgaatatttggtgtttctgacaaccctagcattgtttttcgtggttgtctaatccacaaaacaagataagcgatgaataaataaataatttgaacgttagcaacaaaactaaaaactgtactacaaaaagaaaaggtttcaacggcattttttgtgttcttaattatttttgtccaaacttgaagtaacccgtcaatatctgtctcctagatattttgcttatattttttttacattaattcagttcttttatatctagagtcaggtaattatttagagaatgcatgcagttgcttgacagtgcgtaagatttacacaaatttttctcaacagtgaaggcaatgctcaatagtcaataactgtttgtaaggaaatagaacagggaaaaccaactggaaagaatctttgtctggttttagataatgattaaaagctgtattggttatgttgaattagttggaaatctctaaatatctatacactatttattttctttaatactatatgttgtgtagtgtgtatatgaataatgaaaatatctgaaacatgctttaccataaaggcttttgatgagctgtagtattgacataattggttgaagagaatgagtgatcataatgatacctaacatcttttatttaatcaaaaatacctaacgttatttttatttgctactataatagactccaaccaatttattagtatcattttatacagtttctaacatttttgccactgcttagatttatgggctttccctttctgtctgcatgggcctcctctcttatattaataatctgacttaatgaaaacttttaaatcttttgtagtttattttcctctagatgctaattttagcaaaatgaaaagatgtgtgatggaaacgtaaagttaaagcaaaagaagatggtgaattggtgatgcaatattttagtcatgtgtcattgtttacatttatgatatattttactttaaaatacttttcttcattttcaatttttataaatcttcgtagaacacatattcacaaatgatgctactttggtgatcagttactaaaaaataccgaaattgattttagaagatagagacgtgaatctgtttgccaatattaattgggctcaacttaagcccaaattatataaggaaagactacctagtaacgaacaagtagcaggtcaactgtccgagcgttggccaaatctctctcacttccacaggtttctctctccggccaaatctaacctccggggaacgtcgttggtcacttatcaccggttagaatttccttcccgctttatcccgtaaacttttttcccattgattccgatcgtttatgttccttcaccaaatcgataaagtttgatctttttccttttcactattattaacagaccaatctgtttacacaagaaatctacagtaacttatcacttgaaaagttttgataaatagttagtataataatttgttaattgtgtgtgtaaatttgatttcttgattgtgtgtgaattgtgatgaagagggaaaacaaaaa

SEQ ID NO: 5326 - DNA, 3000 bp, Unknown
  misc_feature (1)..( 3000): cDNA_ID_1843230_gDNA_ID_1620780_Annot_ID_50334 3000 nt of promoter + ATG
ttgtttaatggatcagagtatacagttggacctgatcagagtggaatgatacttctaatacccagtatcgagtgacgtgacggcaactgattcgtcaggaaaaaacagagaaaaaaaaaattctaaaaaatcacatatacccatactttatgagtatcatctataaccataaaagatcattaaaaatcattgaaaaaatttaaataataaataatactaaaaaatgtttaataatactttatgagtatcacttataaccatgctctaaatttatactcgtgaacatattaaacgggcctcatctggcccggcccataatttgttggctaggcatagggaagcgttttggcctttttttccaaaaacaatttttgctttgatgaaattaaaactattaatacacaaaaaaaaaatgttcacttttacttttaggcgatggcgagaggatgtcagtaattgggttactgaatcggaatactgttattggagtcgttcgttgtgtttttacggtcaatttggttctattcagatatggttatctccggttttggatttgaaatctcagatacagcggcggattcacagagttccccgagtgctgctgcgactgatggttttggagccgatttcctagcatgtatgaatatgtcctgggacaagttcgagacggacaaataaacgagaccatatgtttgctgcagctgacaagtctcactcagctttcttgttgattgatgagatataagagcagatgggattagctggatatgtgcaggaaactgagatggtatgcatataagttaaacaaatcgttggagcatataagcagacacaaacaatcagttgtagccgcagaggcattcctttgctcattgtgagatttggcagatctggagcactaaccattcgtagtctattgacaatcacacctgattcttatcccaggtgattttgctacaattgtgggaagtttggacattatgcttctgaatgtaaagctcctagcaacaaaacatttgaggagaaggccaactacgttgaagaaaaaattcaagaagaagacatgttattaatggctagctacaagaaagatgaacaagaagagaatcataagtggtacctcgatagtggtgcaagtaatcacatgtgcgggagaaaaagtatgttcgcggagcttgatgaatcggtgagaggaaatgtggctttaggagatgaatcgaagatggaggtaaaaggtaaaggaaacattcttattcgattgaagaatggagatcatcaatttatttccaacggttactatattccgagcatgaagacaaacatcttgagccttggacaactcttagagaaaggttatgatattagattaaaagataataacctttcaataagagaccaagaaagcaatctcattaccaaggtgccaatgtcgaaaaatagaatgtttgtcctcaacattcgaaatgacattgcacaatgtcttaagatgtgttacaaagaggagtcttggctatggcatcttcgattcggacatctaaattttggaggattggagttgctttcaaggaaggaaatggtgagagggctaccttgtataaatcatccaaagcaaggttgtgaagttgtattcaagtttaaagcaaagtaataaaagttctatttcctaaaaaactctctcaaaacacttaaacactttctccattacctctaaaagaattttactctaacagatttatcttccaagttaatagctttacttgaaaaacgattccttactgatattcaaagcataacacgtctaggttcatggatgcactctataatttacttgacggttctattgacgacaatacaaagtttgaagatgagtgccgagctatttttggagcacagtcatatgttcttttcacattggacaagctagttcagaagtttgttaagcatgtaagcaaaactagtgtcttgtcttcttgactctctacttccattctctctctttcatctgatcactgggatggtttttggaaatgcttcagctccatgcagttgcatctgatgaaacagacaccaagcttctgcaactacatgcgtatgagaactacagaaaactttgggaagatgatttgatctagtgtatcatgagaatgcatgtgccatcctccatgaggcaaagatataccaaagagcaacactccaatcgttacattggttaaccgctggagcgttttggagcccgagaatgccagctcatccactttagagccaattggtcagatagaagcgagcaattcaaaaataataaaaatgaaaattaccgaacgacgtcgtattgataaatgggggctgtttggtagtacgtgtaatgttgttctaaatacgagtagggaagaggcgtaagataacaagatgcgtaggagaaaggaaaggattattgtcacttgcctgcgcaaattagggcttctccttcgcaagactctcttcgccagcttaaatcagtgtactctctctttctctgtctctatctcttgcaacttctctgtttctaatctcttcacgcatttgtgtatcaaggagtcattttttaacagaatatgaacatatttgaaaattcgaatcatgcgagttttattgaaagcttatgttcttgtgatgatttcaaacttttcgaaaacagcgactttcaaatttcttcagaaactatgaaaaccctatcttgtaattgccattatcggcatccaaaatgtgcttagctcggaaaattcgaattgaattagcttcgaaagctcctaattacattagaaaattcaatctttatacgaaatttttgaattctgaatctttctagcttcgtactcatgagtttaaaagcttgttacagattatgtagcacttcattggagattatctggttattgtagatagtaatgttacagagtctcataagtgctgttgttatgtgcttgtcaggcaaagtgctgaatataccttaggagctaaatg

SEQ ID NO: 5327 - DNA, 3000 bp, Unknown
  misc_feature (1)..( 3000): cDNA_ID_3076619_gDNA_ID_1620780_Annot_ID_167914 3000 nt of promoter + ATG
cggttattatttcggtttagatagaatagtagccggtttaatttatttcgatttgaatttgaattttgggttacctgcaatttgagtacaagaaggtgcaaatggaggagctttgacgatcacagagggaaacacgtccgctaccgttacttaacggtgtgaatacaggggattcgtctacggaacagtcaaggagcgtaaaaacggtgtcgtcatggaaagaaaacggagcgtcccaatccaacccgaatccatggctgggtcgggtacatgcacacgtagacatggacggatcagtgacgtagatctcttgtttggcgtagtcgacagaagtgatagggtaactgcctgtgtgggtggtgagcgtcaaagtctgttggtcagggtcacacgtgatgtaacgtgtgaaacgtgggtcaccgcaacctgacccggttccgagcgggtacttgatgggtatttggccgcatgttttttggcaggcttgtgaggagacatgagaagagaggaagaagaaggaaaagagaaagataaagaaagaagaagaagaacgcttcaaactcatttgctagacctttcagggaaagtgtgaaagaaaagatgtgaagtatatatgaattgtgtgagtgaatgtaacctaatatagatgcaatgctaagcgggatactaaattgcatatgtgaatgtacatttatatgcaaaacataggcgtttatttttgtcaatataagaatataaattagtttatatatagttttttactttttttgttgttgttaaatcctagattcttttggttgggtctattatctatacataccatcatatgacggattacaacattagataatgtgcaaaaccaaacatagaaaataatatacaacacataacattagaattccatatatcatataataataggcttgattatatacacgaacaattttattgggaaaaatatatctggagatgatttatataaaattaatacaacatataattggtaatattatattagtttatggcattcaaagtttgggcaatgcaaatgtcccattaagctacatattgttattgcaaatttggataaagatagttatgttggctctttgagtaatcttttgatctggatcggatataatatttctcactcgcgtgttcttgtaacaatcttctttaactagaatattattcgaccaaagtttgtgaaattgatggtgtagtaggctctttgagtaataagtgataagaatgataaaatttataaacaaaatgaaaagtatgggcatataaaagtttatttaacacagtatattatttagacaaaatgtgcctttaggtgtcccaaactcaccaggaaataaggcctagaagacaaaataatattgcaaaaacatcactaatgttaagtgcccactcatactaaaagtccccacccaaccaaggaaacgggcaagataagggaattagattcaagagaatatagtaaagaaacctaaaggctaaagttgttcaataattctcaactttaatttgtttttaattcattgtataataatgtaaatctgtaattataactagtgaatatataatgcatcttgcaaaggtattattctaattggtattcttctcatgagattgttctggaagccgatcaatttatctttttatatgtatatataagataattggtgtttatttaaaatgttgacacaaaagaaaagacgcttctcttataaaaataagaaagaaaaaataattaaaagagatgcgaccggcaaataaattctgcaatgagacaaaataattgattctatttttgttttgtaagttgtaacacattactaattccaaaataaacaaagttgtaaaacttgaataactagcgacaccatcctcggaatgtaacattggaatatataacatataataagagtaactttgtataattatgtcaatcttgcgtgtttggaaatcaagaaaataaaacttgaattataagaatgggctagtgagaaatgaaaggaacataaaaaagggattatacatccacccaaactttacagcaatattccagaatctgaagtcacataaaactcataatttcaaaatcatagtatatctcaggatttgaaagaatcaacaacttaactaattaccacattttcatactgataaaatgactaaaagatatgtatgacctctttcttatgaagtgttctcatcttgtttgttttttctttatcaaggaagtttcaaatcattttgggcctgtattttttcccgctaggggccgacatgtaatccatttgtacatttaaatgatagccgtacttataccattttattaatgttaagaaaatgtgagtggaaacaatgagcgtatgaaaacaaacaaaacaaaactgagacgaatattttttttgcggtttttcgtgactgcaattcaatgttcacatttcgtgtggtcctgtgatgcatgacatgtttgttttttaggtggatttgtgtttgtcttccctgatatgtaattatcatttagtggtttcacttctttggttttatatcacttgattagctgccaaaaacaaacccaaataaacatcacatcgttactcgttaaaacaaagatattaacttatagtactaataatatatacaaatttcttaaacatgaaatacaaatttaaacaagctaagtgaagctgccggagtttttatggtttcaattgttgccacgcatataaagaaatgccgtctcgtcgaccacaataaagactaataacgttttcccacccgtttaatacacgtgtcaacctataattggcaattcttcgctatctatcaccgccatcaaattcacctaccctcttcccttccatataataagtaacaatacaccgatctaacataaaaacgcttcaacgtgtcaaaacattacatttccactctcacattcagacgcaccaatcctctgttttggattttgaagagaaaatg

SEQ ID NO: 5328 - DNA, 3000 bp, Unknown
  misc_feature (1)..( 3000): cDNA_ID_3076623_gDNA_ID_1620780_Annot_ID_167913 3000 nt of promoter + ATG
ttagattcaagagaatatagtaaagaaacctaaaggctaaagttgttcaataattctcaactttaatttgtttttaattcattgtataataatgtaaatctgtaattataactagtgaatatataatgcatcttgcaaaggtattattctaattggtattcttctcatgagattgttctggaagccgatcaatttatctttttatatgtatatataagataattggtgtttatttaaaatgttgacacaaaagaaaagacgcttctcttataaaaataagaaagaaaaaataattaaaagagatgcgaccggcaaataaattctgcaatgagacaaaataattgattctatttttgttttgtaagttgtaacacattactaattccaaaataaacaaagttgtaaaacttgaataactagcgacaccatcctcggaatgtaacattggaatatataacatataataagagtaactttgtataattatgtcaatcttgcgtgtttggaaatcaagaaaataaaacttgaattataagaatgggctagtgagaaatgaaaggaacataaaaaagggattatacatccacccaaactttacagcaatattccagaatctgaagtcacataaaactcataatttcaaaatcatagtatatctcaggatttgaaagaatcaacaacttaactaattaccacattttcatactgataaaatgactaaaagatatgtatgacctctttcttatgaagtgttctcatcttgtttgttttttctttatcaaggaagtttcaaatcattttgggcctgtattttttcccgctaggggccgacatgtaatccatttgtacatttaaatgatagccgtacttataccattttattaatgttaagaaaatgtgagtggaaacaatgagcgtatgaaaacaaacaaaacaaaactgagacgaatattttttttgcggtttttcgtgactgcaattcaatgttcacatttcgtgtggtcctgtgatgcatgacatgtttgttttttaggtggatttgtgtttgtcttccctgatatgtaattatcatttagtggtttcacttctttggttttatatcacttgattagctgccaaaaacaaacccaaataaacatcacatcgttactcgttaaaacaaagatattaacttatagtactaataatatatacaaatttcttaaacatgaaatacaaatttaaacaagctaagtgaagctgccggagtttttatggtttcaattgttgccacgcatataaagaaatgccgtctcgtcgaccacaataaagactaataacgttttcccacccgtttaatacacgtgtcaacctataattggcaattcttcgctatctatcaccgccatcaaattcacctaccctcttcccttccatataataagtaacaatacaccgatctaacataaaaacgcttcaacgtgtcaaaacattacatttccactctcacattcagacgcaccaatcctctgttttggattttgaagagaaaatggcaagcagcgacgtgaagctgatcggtgcatgggcgagtccctttgtgatgaggccgaggattgctctaaacctcaagtctgtcccctacgagttcctccaagagacgtttgggtctaagagcgagttgcttcttaaatcaaacccggttcacaagaagatcccggttctgcttcatgctgataaaccggtgagtgagtccaacatcatcgttgagtatatcgatgacacttggagctcatctggaccgtccattctcccttccgatccttacgatcgggccatggctcggttctgggctgcttacatcgacgaaaaggtattcttcttttcttctttcacttgctcatcaagattttattaattaaggtttgttcgcaacaaataaatttttatctatagtgcagagtttttgcaaagcaaatagttgtcttaagtgcttttgtggttactagttaatatatatacgcaaaacatagcattttgtggtctaaaataagtatgtgaatggaaacgcaaatgtaaatataaacaactcaggaaaatatgttagtttcattaattacaatgttaagacttaagacataaactgatctttatttttcaatgttggacattgatcaacatgaatgaagtggtttgtcgctctaagaggtttcctaaaagccggaggagaagaagagaagaaagctgtgatagctcaactagaagaagggaatgcgtttctggagaaggcgttcattgattgcagcaaaggaaaaccgttcttcaacggtgacaacatcggttactcgacattgctctcgggtgcttcttggcttggttgagagtcaccgagttagcagtcagctataaaattcttgatgaggccaagacaccttctttgtccaaatgggctgagaatttctgtaatgatcccgctgtaaaacctgtcatgcccgagactgcaaagcttgctgaattcgcaaagaagatctttcctaagccgcaggcctaagttgttggtggactaggttttgtatttgtgggttgggttcttgcaagaataaattaagagtgttattgtttttagatggctttatctttgtgtgtgagttttaatcaggcgtacgttaaacgttacgtatgtatcaggtttggtgaatgattttatttaggttatgttgattgagaagtatttttttttaattattgtatatatctaactcgctaattcctagaagaatcaacaatcacgtgaattggtcctattgccaggatttaatcgtttcattgttggccacacttcaatttctcaccactcgtttacaaggctgtaccacgtgtcgaaatttaattcgtatatcttcattatccgttacctaaaccctctaatggaaacctaccctcttaagctttcatacgatcttcttaacccgcaagcttccctctctcttcgagtcggttcttaatctccgggataaaatg

SEQ ID NO: 5329 - DNA, 3000 bp, Unknown
  misc_feature (1)..( 3000): cDNA_ID_1828299_gDNA_ID_1620780_Annot_ID_167911 3000 nt of promoter + ATG
gtctgtgcatttccaagattgatatacacaattactaatttaatactctaattctctagattaatataagtggtttggtcgatcggtttaattattgtatctgttttttttgtcggctaaataaagtaataattctttcttgtttaactttaagtacgaaactaaaaatgtttgtttctgtttcattaattaaaaaaatacatccaaatttgtcccaatatgtaacttctgattaagcaatcaagagaatttttgtctaataaaaaaagagggggatatgaaaatgatagtgatcaaattttttaccattcaccacaaagatgaagttaaagataaagtaataataaatgccacgtggctccattaagaacaattttctcattctcctttgtcatgttcttcttctaccttacacgcactccactcttcgtttcctttttctctcttccaatttcagattttactggcaaaatatctcgaatccgattccttttttctcttctgcaatctctttgaaatctcaagcttctcttcaaaatttcgattacagctgaagattctctcgattttctggttttgactttttttttgtttggtttggtgaaagatttggatcaaatgggggtggattactacaatgttctgaaagtgaatcgaaatgctaacgaagatgatctgaagaagtcttaccggcgaatggctatgaaatggcaccctgacaaaaaccctacgagcaagaaagaagctgaagctaagttcaagcagatctctgaagcttacgacgtcttgagcgatcctcagagacgtcagatctacgatcagtacggagaagaaggtcttaaatccaccgatttacctactgcggcggagacggcggcgcatcagcagcagcggagctactcttctagcaactctgagtttcggtattatccgcgtgatgctgaagatatctttgctgagtttttcggcgaatccggtgatgcttttggcggagggagtagcggaaggacacgtggagatggcggtgatggtggcggtcggagatttaaaagtgcagaagcagggagccaggctaatagaaagacgccgccgacgaacaaaaaaacgacgccgccggcgaataggaaggctccggctattgagagtaaattggcttgcacattggaggagctctacaaaggtgcaaagaagaagatgcgaatttctcgcgttgttcctgatgattttgggttagtttctcatgatcctgatctcgtgaatgccattggtcaatttattcctttgattatagtgaatgattaggttatgccatttgcccatatgatcttcacaataagattttgtagctattaggttctctagaactgttgttttctctgtgattgagcttctggtgaaacaaaatgagctttgattatgaccttctgataaaatctgtgttacagaaagccaaagacagtccaagagatattgaagatagacataaaaccaggttggaagaaaggcacaaagatcacttttccagagaaaggcaaccaagaacctggtgtcactcctgcggatcttatattcgtggttgacgagaaaccgcattcggtattcaagagagacggtaacgatctgattctcgagaagaaagtctctcttatagatgctttaaccggtctcaccattagcgtaacgactctagacgggaggagcctaactatcccggtgctggatatcgtaaaaccgggtcaggagattgtgatcccgaatgagggaatgcctactaaagaccctttgaagagaggagaccttagagttacctttgaaatcttgttcccgtcaaggctaacgtcagaacagaagaatgacctcaagagagttcttggtggaagctgatgagttgacgtttagttttcaagtaagctattgatcttctttaacaacggattccacaggaagttgctagtcatttgagtgtacatacatttacgtttttcctttgtaaacttgtgttataagaaaaacaagaaaacccaaatcgaataagactggatatgcgggatctaataatggctgccacacacagaacatatcgttttgaggtagaacttggcctatttgactctgtatgagtagtgaaaagcaaagatagaagcgagaagttttcttggtgtgagttggttttgtggcgatgctcttgtgttacgtattctggtttcccaaggccctgtatatacagtgaagtatgtctatctgttgggttacgtcttttctggaaactgtgtagccttgtaaaggagagacgttgagattcctgttttgttcttcaaattagtgagtgaaatatctcgtttgctttctcatatttgttcagctcatgagaatattgcgaacggagaagcaagagattcaacagaagtgatttgaccgaaatttactgacacaacattaacgcccttacatgttgttaccgtaacatttgttcaataggctctgactcagtcgtgacaggaaaagataatgaaaaggtgcctatgggccagttgactcttgagttgatatatccattgccttcgaattatccagagtttttatttttagtcctagtcctgtcatgtctttacgagtacgtcacctcttatcttcaagtgtatgaagatgagttcacacaattttgctaatgaaatgtaattattttcttgtggaaaaactaaataattgcgcgtgaaagaaagagagaggaacctgcgttttagtttgtaagcgtatgaatggtgtctaagtcttctgcttacgaagtcaacgaatataaaagtttcaagattacaatgagtgatagaataaatacaaattggaaaagaagaagaaaataccataagccaaaatgtcaaagatactgaaaacacatatacatggtctatttgagtcatcataaaaagatataaccacttgaaatctccctcccagagtaagaacttccatactttgctctagatttcttgagaaaagatg

SEQ ID NO: 5330 - DNA, 3000 bp, Unknown
  misc_feature (1)..( 3000): cDNA_ID_3076627_gDNA_ID_1620780_Annot_ID_167909 3000 nt of promoter + ATG
tatttcttctcacatatttactgaataaattgcagcttatacgttacattgttggtaagaatatagtagatatcacgtccaagaacaagatgggttttgaagcttttcaacttctccctcgagaagcccaagactttgagttgttatcaaggtggctgagatttggtaccgagacttcacaagagctggattctgagaacaatgtagaacaacacgaaggctctcaagaggtcgaggtaatacggttgctaaggattataggaataaacacatcagagatagcagagagaaagagaagcaaggaacaggaagtggaaagaggtcgtcagaacttggaatatcagatgcatatagaagcattacagaatgcaagaaatacgattgctatagtggcagtcttgattgcttcagttgcttatgccggtgggataaaccctccggggggcgtctaccaagacgggccatggagagggaaatccttagtggggaaaacaacggcgtttaaggtctttgcgatatgcaacaacatcgcactgttcacgtccttgggcatcgttattcttcttgttagcatcataccttacaagaggaaacccttaaagagattattggtggccacgcataggatgatgtgggtttctgtaggtttcatggcgacggcttatatagcggcgtcttgggtgaccataccgcattatcatggaacacaatggttatttccagcaattgtagccgttgctggtggagcgttgaccgtactctttttctatctcggagttgagaccatcggtcattggtttaagaagatgaatcgtgtaggggataatataccttcctttgcaagaaccagttcagatttagccgtctccggaaaatcaggctatttcacctattaagaaaaactggttttctaatttccctgtaacctgtgtaattgtgtatgtgtaaagtgttggattaagtctttcttaggaactgtgttatcttgtaaaaagagacattgttttgttcttcaagtcagtgagtgaaatgtctcgtttgctttctcctattgttcggctcatgagattactgcaaaccctaaacatgaacctaaaggagcaagagattcacagaactaaattagatcaatgttacggacataacatgaacagaacagaacagagattacactagacagtaactcttgtctgaaacaatctattctcacgtctcaagctttaagtcagcacactgtaagcagggattttccgaattccagcttctatcatggctttcctcattttttctgcttctgaccaattgctatccaaagcattgaacgtcgacaatgccacatactggccacagtgttgaggttgcagtccaataagctgtttacctactgtatttcctaattcagtattctcatgaatcttgcaagcgcccaaaagagctccgagaacagaagcatcaggctcgaagggcaaactttgaatgaaattggctgcgtcaaccaatagtccagctctgccaatgagatcaacaacgcaaccgtaatgttctgatgttggaatgatcttgtactcgctacatatagaagagaacaactgaatacctaaatccacaagtttagatcgagcacaagccgtgagtattgcaagtaaagtgatcccattcggatgcacatagcttgatttcatcatctcaaacatctccagcgcttgcttaggtctaccattggaggcaagagctgatattatcgcattccaagcgcaaactttcttatcacgaatttgatcaaaaatggtcaatgccatctccaagtcaccggcttttccatacatatcaagcaaagcagtacccaaagttgtagtaagaatgatctctttactcataacatatccatgaatctgcttccccagtcgaatacctccttgatcaaaattagcacatgaagaaagtacacttacgaaagtagcctcgttaggtgttattaccgcacgctcattctgtatcatctcaccaaaaaccattaaagctttggcgtgtaaccctttcttactaaacccgttgataacagtggtccaagagaccacatcagttacaggcattctctgaaaatactcgaaagcataatccatctctccgtttcttccacaagcgtcaagcaaactgttacaagctacaacacaagggtttaaaatatcatcaaacatcttcctcgagctctccaaatcaccaacttcaccatagaaccggacaaaagaagtctgaacaaatggatcccatagaaaaccccgtttaagagcttggccatgtaaggcaacgccataagaaacagagaaagatgagcaagctgctttaatcagagaagggaaagtgaggttatttggttggacatggcttgcaagcatatgagtgaagagagcaagagaagtcttgtattctcctgtagtgagataggatcgaatgagagtgttgtagacgcatttcgtcttccatctcgaagcaaccaatgcgttgctggtcaaaagaactgtgtgaatctgcttaatctggtttgaggagtataagaaacgttggagaagatgaagtgcgtcttcaagagacaaactgaaacttgagaaggaagtacaacgcatacaatttgcacaaagattaagcaatctacaaagcaaaacaaaaagacgagacctcgttgtagaagatggagaatgattttgaatttcaatgagaaagttacaaatcaaatatctgaaagtggagaaattgtcaatcggcttgagctacaagaggatgaaagttttctgatttcgagagctccggcgagcaatttggagtctccgaggtcaataggtgaaccaactaggggtctccggtttagtatggtttaatccatttttatttcgatttcttcactataccgtttcggttcaaactaaccgaatttgcacccctaaattaaattctgtttccaccaccgtgaagccagaggttaacgctaccgggaaaaaaatg

SEQ ID NO: 5331 - DNA, 3000 bp, Unknown
  misc_feature (1)..( 3000): cDNA_ID_3076631_gDNA_ID_1620780_Annot_ID_167907 3000 nt of promoter + ATG
accagctatgttccaaataatcacataatagcaaaattagtaacaaagcttcatctaatacacaaccttgaaacagatgtagctgacagtggaagaaacaattaaaaggttcaaatcctataaacaatctcaaatagtcacgcgccagtgtaacttggattccatcatgccgattagatctacatgttgttcctctagagaactagatctccatgatccagaatgactatatttcttatctacttatctattactctgttcttgtatacaagattaagtcactggtgaaactaagtatttgttttgttctgatccactgaagaacacaagcaagacacaaaaagttcactgtcctgcatcaaaacgtacctggctggggatctggcggtcgtaaaagggagaatcacgagagacattcatgtcgtatccaggaggcgtatgaacataaacggacaagtacttttcattgcctttaaaaaacttctcccaaagcggaagcataggtaaaggccctctcgtcagaaacataaacgccactttcggaaccctatcgtacggatactcttccttcaccggaaccatcgaagctctccagaacaactcatcatcagtcattccatgactcagattctctggccgaacaaacccatcaatgctccaacaatctcgaacctttggtttctccgccttgactcctccgtcgtcgctctcgttgtcgtcgttacctgtgcagtctcggtggatgattgtgcaattggagtaatcaggagtcgaaaaaggaatcgattggaggttagtggttgatgagaacatcctcggcaaagaattgaagtagcgatcgatgtgagaacttgcggcgagaccgatgatgattccagccatgaaaattagcaaaaacgacagcgtttgcgccagctttagtaaccctatgtgtttttctccttcctctttccctcctctcgccattgttcgagaaactcaaaacttgtctacccaaacaacaacacagtgatgatctctgttccccaaaaataaagtttcagggaaacattcttatgattcaaagagaatctgattgtttcaagcacaaatccattgcattcaatctcctcgagaaatttcctaaatttgtaacatataattaaatccaaggatcaaacgaaatcgaaaaaggtaagtggataaatggaaattggatctgtggaaatcttcgaggaaagtgagaaacgatgactgaaacagatcagaaactgaatttcatgcagagaggaagaagaagaagaagaaacataaacaaatctggtcttttgtttcttccagttgaaatctatgtgtgtgtgtggttgattttgatcttatatatataaaagaacaaaattaattggaatgttatgcttaatttaattagattaattgagtttaaaactccacgtcgaaaagcataacgagttcaaagtccgcagatcttgccagatgggaataatctattggttttaagttattgggccggagggcccacgtttaattgtgacgtggtttagtgctcgtcaactctttggtccgacatttcacttttttttttatagaaataattctagatatccagtagtcaaacttattgattatctaatttctatatccttactatttttaaaaaaattacttttaacatttctagaatttttcgattttttctgtacttattaactattagtaaaatttattgatgcttcttttggttatgttatagtattgagacaatgtattgtattctaattttgattttttttttcctttttaatgatttgtagattttgttttttcattattatatttgaaaaaatatcttcttatatcttaatcaccagaaaatctaaaaccgatggctatactaatttccggaatatatgaaatgtttatttttctattaaggatccaaagcagctaattaagattaaaaacttgggaagaactagtatcccaaacaaacaatatgatatccagatgtccaaaaggaaaaagaaatggtatcaaaagaaccaagaaatgtgcctagaaatttcatatagttagcttggaaatttctgatttttatgtccaatgtttatttattttttccttataattatacttgtcatacatcacaaagaattgtcaacattgccaaactagtcctaagatgttggaaggtatgatgatagacaacagttctaaagaagggaagatgagattcaggcaacaaaaaacacatatagttcaaaaaaattaggttggtaggatcaattattcaaaaaacatacaccaaatagattttagtaggggttgtttgtccaaaaaaaaactataatagtttacgaaaatagttacaccttgtgaatagattttttgtttgccttcccttgaggtaaattatgtcgcgagaactatatgaacaacaacgagatccacaacaacatttgattacatttttatttgaaccttcacattgatttagtaatgtgggattccaacatcatctaatgttatatgaatggatctaatagatgataaattgttaaatgaactgataatttttttttatttttttatgtgtatttcacatcacattgtttttttttttttttttttaagtaagaaaaagaagaagcacttgagaccgatcagaaaaaaattagaaagatatgatttttgtaagtcttttgaaatttgaatcttgtcccgtgtaattgtgaaatcttacgtacgtcctctttatgacctcgtcttcgctcatttctgccttcccttacgaaatccccaacgaaaaatcttagcttaacaccatcgcgaccggattccaaattccggcccatcgtctcaccgggaaagaccccgcctattgccgccgatttcggttccggtctgctcagatctaatcgagtggcttccttcttcctccagatctcttcactttgaatcggttactcgatctcgattcgcggagggcttttgctagtcgcg

SEQ ID NO: 5332 - DNA, 3000 bp, Unknown; identical to SEQ ID NO: 5326
  misc_feature (1)..( 3000): cDNA_ID_1843230_gDNA_ID_1620780_Annot_ID_167902 3000 nt of promoter + ATG

SEQ ID NO: 5333 - DNA, 3000 bp, Unknown; identical to SEQ ID NO: 5325
  misc_feature (1)..( 3000): cDNA_ID_1828334_gDNA_ID_1620780_Annot_ID_167899 3000 nt of promoter + ATG

SEQ ID NO: 5334 - DNA, 3000 bp, Unknown; identical to SEQ ID NO: 5324
  misc_feature (1)..( 3000): cDNA_ID_3076650_gDNA_ID_1620780_Annot_ID_167893 3000 nt of promoter + ATG

SEQ ID NO: 5335 - DNA, 3000 bp, Unknown
  misc_feature (1)..( 3000): cDNA_ID_2148886_gDNA_ID_1620780_Annot_ID_167890 3000 nt of promoter + ATG
gaggctgaggatatacagacccaaatccaatggataaagactaaaggaagatcaagagccttcaaaatattgatgagaaactcccagttgacattatcataggctttagatatatccacctgaagacagcctctagtagtctctccatcagcctcgaaattatccaccaactcagatgcaagaagaacattctcacatagaagccgacccttaatgaacccaacctgatttgcctgaaccgcttggtcaatgaaaagctttagccttctggaaatgatgcgagtaatgaccttataaatagtagtgcaacaagccacagggcgaaattgagttagacgatctgcccctgttacctttggaatcagagtgatggctgtagcattaaagccccttggaagattcccagagataaagaattccctgatcgcagccacaacactagacttcacaatcgcccaagcttcgatgaagaattcaactggaaacccatctggacccggtgctttgttacggggcatagagaagagcacctgagttatttcctcttccgaaggaatagtagtcaactgagaagccaggaaggaatcacaacgaaaggggagaagacctttgattttttcaacagagaatggggtgacattctctgaaggaatgccaagaagatgcgaataataagcaatcaacatcccttttatctgatccacattctcgaccctaaaaccatcatctcctctaagaaacttgataagattagtcgcttggtgagcaatcacagctctgtgaaaaaatctagtattagcatcaccttcatgaagccatcttattctggatttttgtcgaaagaatgactctaaagcagcagcaaagaagatccattgcttgcgggcaacatgttcccgacgaaaaagagtatcagaaggtgacgtgaggagttccacttgaatgtcctcaagccgagttagagattgggctgtcctttgttgaatattgctgaaacggagcctgttaagagtcctgcaacacagcttagcaacttttaaatgctgcctcaaagaaaacatgtgagacccaaccaaagtattctcctcccaagcagtagacaaagccgccaaataagaaggatgagaagacaagaaggagaaatacttaaaggacttcttagaaggaggaggctgattatcgattaagatgatacaaggggcatgatcagagtcacctggaggatcaaagaccgcaagagcagagggaaagaccgcgaaccactcaccattagctaaggccctgtcaagcttccgaaggatgggattgtcctgttgatgatttgaccaagtgaaaaacacacctcgagaaggcaggtctgaaagctgactgtctctcaaacaacattgaagatcctccataccacgcaggttcaataaggattgattgatagaataatgttccgaagcagcggctatctgattaaaatctcccaacaaaagccagggagtaacagaaagaggagaagtcctggacagcacgagaatgtcttcccacagagatcttctatctaactcagaattcctgccataaacaaaagcaaccgcaaaagattgaagaagagaaggaatcttaatgctgcaaaacataatctgatccgttctcttaaacaccaaaactgaaatggaaggatcccagactatccatatcctcccaagttcagagcaacaatagttgctatccatcctccaacccggaagggttgaggccaaaaccgagtttgcattctcttgtgccacatgagtttccaaaaaacatcccacaagaagattattagaagcaatccagcttcgcacaactcgttgacgattacggctatttaagcctctaatattccaacaaaagaccttcatattcacaacaaaaggtgaaggtgaaagcaaagctttcaatgagaagaaggaccgtcaccggccctgccatcgacgaaaccttgaagctctgtcacggggggacgaatacggttgtgccacttcttaagttctttcttttttgccttagtagacatcactgcccagcccaggggaagagggaagtttggatccggatctttgatagactctctcatagattttttagggagagtaggaggttgagaaattccagaatctgcaccaatgacaacagtaggaactggcgaattcaaacctggtctcacaacccatttcttactagccgaaggcttgggcaatagagggacctgctgagaaatgggaatcaacgggtcaacaatccgaggtggagaactgagagagcgcttctttgatctcgaacgccttctttttggtttggaccaagggagctcaggtggattagctgaagctgaaccaatgacactagtttctgaaatcccagcacctgaaggaaggttaacagcagagagagccacttcattagccccggagggatagtcttttttaaagggaagtttcttctgcaaggggatgagacaacggcttattaaatgaccatacttgccacaattcaagcacttcccatatgtgtcatattctgcccactagcaaaaattgttatcgagaataaaatctagaacatcattaggacataggaatctaaaatgacaaaggccaactagttcaaaacttcattacagtctcaaaaatttcactctttggcaaattgaaatcaaatatgtgatcatttgattctcatacaaaagcagagatagaagaagagccacaaactgagaatatttgctttagcttttgccatccaattgaattataccttttacatggttatggcactaaagtaaaacttacaaggagaatattgagaagaaaagattgggtccaacttcatttattcttcttctgtcacaatactaatttttttctacagaaagtttccatatagtgaaaagaaacaaatctctatataaagccaacttaagagaagtgttcttttataaacaaacagcaaagaagaaagagagaaatg

SEQ ID NO: 5336 - DNA, 3000 bp, Unknown; identical to SEQ ID NO: 5331
  misc_feature (1)..( 3000): cDNA_ID_1828315_gDNA_ID_1620780_Annot_ID_50339 3000 nt of promoter + ATG

SEQ ID NO: 5337 - DNA, 3000 bp, Unknown; identical to SEQ ID NO: 5330
  misc_feature (1)..( 3000): cDNA_ID_1828307_gDNA_ID_1620780_Annot_ID_50342 3000 nt of promoter + ATG

SEQ ID NO: 5338 - DNA, 3000 bp, Unknown; identical to SEQ ID NO: 5329
  misc_feature (1)..( 3000): cDNA_ID_1828299_gDNA_ID_1620780_Annot_ID_50344 3000 nt of promoter + ATG

SEQ ID NO: 5339 - DNA, 3000 bp, Unknown; identical to SEQ ID NO: 5328
  misc_feature (1)..( 3000): cDNA_ID_1828295_gDNA_ID_1620780_Annot_ID_50346 3000 nt of promoter + ATG

SEQ ID NO: 5340 - DNA, 3000 bp, Unknown
  misc_feature (1)..( 3000): cDNA_ID_1828293_gDNA_ID_1620780_Annot_ID_50347 3000 nt of promoter + ATG
tgtaacctaatatagatgcaatgctaagcgggatactaaattgcatatgtgaatgtacatttatatgcaaaacataggcgtttatttttgtcaatataagaatataaattagtttatatatagttttttactttttttgttgttgttaaatcctagattcttttggttgggtctattatctatacataccatcatatgacggattacaacattagataatgtgcaaaaccaaacatagaaaataatatacaacacataacattagaattccatatatcatataataataggcttgattatatacacgaacaattttattgggaaaaatatatctggagatgatttatataaaattaatacaacatataattggtaatattatattagtttatggcattcaaagtttgggcaatgcaaatgtcccattaagctacatattgttattgcaaatttggataaagatagttatgttggctctttgagtaatcttttgatctggatcggatataatatttctcactcgcgtgttcttgtaacaatcttctttaactagaatattattcgaccaaagtttgtgaaattgatggtgtagtaggctctttgagtaataagtgataagaatgataaaatttataaacaaaatgaaaagtatgggcatataaaagtttatttaacacagtatattatttagacaaaatgtgcctttaggtgtcccaaactcaccaggaaataaggcctagaagacaaaataatattgcaaaaacatcactaatgttaagtgcccactcatactaaaagtccccacccaaccaaggaaacgggcaagataagggaattagattcaagagaatatagtaaagaaacctaaaggctaaagttgttcaataattctcaactttaatttgtttttaattcattgtataataatgtaaatctgtaattataactagtgaatatataatgcatcttgcaaaggtattattctaattggtattcttctcatgagattgttctggaagccgatcaatttatctttttatatgtatatataagataattggtgtttatttaaaatgttgacacaaaagaaaagacgcttctcttataaaaataagaaagaaaaaataattaaaagagatgcgaccggcaaataaattctgcaatgagacaaaataattgattctatttttgttttgtaagttgtaacacattactaattccaaaataaacaaagttgtaaaacttgaataactagcgacaccatcctcggaatgtaacattggaatatataacatataataagagtaactttgtataattatgtcaatcttgcgtgtttggaaatcaagaaaataaaacttgaattataagaatgggctagtgagaaatgaaaggaacataaaaaagggattatacatccacccaaactttacagcaatattccagaatctgaagtcacataaaactcataatttcaaaatcatagtatatctcaggatttgaaagaatcaacaacttaactaattaccacattttcatactgataaaatgactaaaagatatgtatgacctctttcttatgaagtgttctcatcttgtttgttttttctttatcaaggaagtttcaaatcattttgggcctgtattttttcccgctaggggccgacatgtaatccatttgtacatttaaatgatagccgtacttataccattttattaatgttaagaaaatgtgagtggaaacaatgagcgtatgaaaacaaacaaaacaaaactgagacgaatattttttttgcggtttttcgtgactgcaattcaatgttcacatttcgtgtggtcctgtgatgcatgacatgtttgttttttaggtggatttgtgtttgtcttccctgatatgtaattatcatttagtggtttcacttctttggttttatatcacttgattagctgccaaaaacaaacccaaataaacatcacatcgttactcgttaaaacaaagatattaacttatagtactaataatatatacaaatttcttaaacatgaaatacaaatttaaacaagctaagtgaagctgccggagtttttatggtttcaattgttgccacgcatataaagaaatgccgtctcgtcgaccacaataaagactaataacgttttcccacccgtttaatacacgtgtcaacctataattggcaattcttcgctatctatcaccgccatcaaattcacctaccctcttcccttccatataataagtaacaatacaccgatctaacataaaaacgcttcaacgtgtcaaaacattacatttccactctcacattcagacgcaccaatcctctgttttggattttgaagagaaaatggcaagcagcgacgtgaagctgatcggtgcatgggcgagtccctttgtgatgaggccgaggattgctctaaacctcaagtctgtcccctacgagttcctccaagagacgtttgggtctaagagcgagttgcttcttaaatcaaacccggttcacaagaagatcccggttctgcttcatgctgataaaccggtgagtgagtccaacatcatcgttgagtatatcgatgacacttggagctcatctggaccgtccattctcccttccgatccttacgatcgggccatggctcggttctgggctgcttacatcgacgaaaaggtattcttcttttcttctttcacttgctcatcaagattttattaattaaggtttgttcgcaacaaataaatttttatctatagtgcagagtttttgcaaagcaaatagttgtcttaagtgcttttgtggttactagttaatatatatacgcaaaacatagcattttgtggtctaaaataagtatgtgaatggaaacgcaaatgtaaatataaacaactcaggaaaatatgttagtttcattaattacaatgttaagacttaagacataaactgatctttatttttcaatgttggacattgatcaacatgaatg

SEQ ID NO: 5341 - DNA, 3000 bp, Unknown
  misc_feature (1)..( 3000): cDNA_ID_1828279_gDNA_ID_1620780_Annot_ID_50351 3000 nt of promoter + ATG
ttgagccattgtgggtggaattctctgacggagagcatttgctcggaggttccaatcttggcgtttcctttagcagcggagcaacctctgaatgcgattttggtggtggaagagctgagagtggcggagagagtggtggcggcgagtgaaggggttgtgagaagagaagagattgcagagaaagtgaaggagttgatggagggagagaaagggaaagagctgaggaggaatgtcgaggcatatggtaagatggcgaagaaggctttggaggaaggtattggttcgtctaggaagaatttagacaaccttatcaacgagttttgtaacaatggaacatgatgatgtatgttaacacctatatattaatactagattttaacccgcggtatatcgcgggacgatttattttttaaagtaatatatattaaaatttgcaaattttattattaatatttatattttacaatttaaaattgttataaagtaacgctataccataaatccatgagacaattgttaaaaaactgaagttttaacccctattaaaacagcatattaataatattttaaaattttataaatatttattcaaatacatctaccatataacccaattccaaaataaaacctgttctgtaatttttttacccgtcccgtgattttttttaaagtagtagtttttaaaattgaagaattatttattatatataaaagttttgcaaattgtatcattctctaatacatttatattttatagtttaattttatatatagtaacattatacataccacataacatttttggttttatataatcttttctaaattaggatgatttgatatatttaatattagtggtctaaaaaataataaattaaagatttattccgtattgaaacggtggattaattatattttacttttttattaatgttgattcaaaaacccgtccctccaaatccgtcttgccaaacagccatttattttattaatattaattttatttatgatatgactctgaattataatataaacattttagctaataacataggagtgcaccatatttatttaataggggaatgtaccatatgacctgaatgcacttttacctaaatctaccaaaaaagtcttgtaaaaatattatagagataagaaacaatagtcggttttgatagtataagattagcaaatatattagttagcttaaattatttaaagaatacaaattgaaaaggtatattacactttattcgaatataatatcaaaacttatataacacagagattatataattttttaattgttaaatacttttttgtgctaatttttatgtgattaagatttaattgatttcgtatataaaatattaaattgttttacgaacttatttgtttataatttggtaacagagagatatttgaatattcagtatattttgctttagtttaggaaatctttgatgacccgtctttagatccaataagccatataggtaagagatgaatattgtctttaaatgattctggtaaccttaatgacgtcaataaaaaattttgtttttggttaaatttttctaatgacattatcatgtaattaattacaaaaattaaagttacatttaaaatgtacttcccaaataatatagcaggatatatttcaaagttgctatcagaaacatatatttgagcctgtatttcgaaacttgtataatgttaaactaatttgagcttggattcgaatccatgtttcgagcttggagttttgtgatatgtcgtcaggttcaaaaagtgcacttattaatatatatgggcctaatacaggcccaaaatatgggtctattacaaaccaaagcattgttgtagtattgagacaaaattaacgttggaaacaaagcattttaaactctctattacaatggttgaaagtaaataagcaaaatttactgtatttcctaaaagtgagaccatttccatcggagtatgtgaatgagatacttatcaattaaataataataaaaaagaaaataaattagagagaaagagaaaaaagtggatgaacgtttttcacaggagaaacgattctcagcatttattgacagttgtcatttaaccagtgatttattttcttcgaactgaagctgtaaatgatgactaaaaccgcatccaaaatcgcaccgcaacagtgctgtaacagtatcaaaatctttacatatacatatgtatctatgtattttcgttattatttgaactgcaccattcggaaaatatattgattggattaatttttttttttttgagatactttctatcacttttaccgtgaagatgccctaaattcagcaattaaacacgcaagcaggaagagagaagtcatcatatcataccaacaaaaagggccaatcgttcgctctttgcaagttgcaaccgtcgcgctttcgattccggcgaaattgctccatcttctagtcgcttttcagatcgagctcgtcgttttcaggttccatttctcctacatcttcttgctccacatttgattccacgccgcctattcgtttctcggcgatttcactcctgaaccctaatttcctccacgcagataatttcgacgatcggagcttccgctcttggtctcttgagagtcctttgatatcatatctgattggtcgaagaacgtgtgtccttgttcttctctttttgacatcggattcataggtatttcttcgagtttcatttcgattagttccagctttgattttattgctggatttgctcaagttttatattcattttgcatattcaatttctgagttcccgatgatttctagttgtgatgttgcttagttcaatggttttagaggttcgttaggttcctcatctctctttctctcagtcatacctgcttacaatacactttctaggtcctttgtctactactctctgtagcgcaggaaccaacttcttaagttgatgttgaattcatagtataatttacggatg

SEQ ID NO: 5342 - DNA, 1123 bp, Unknown
  misc_feature (1)..( 1123): cDNA_ID_1828272_gDNA_ID_1620780_Annot_ID_50353 3000 nt of promoter + ATG
ttcaatccatacacaattacacaaccttagatttatatatatagtaatgaaacttttttttttttttacaatgcataatgttagaaagaaaaaaacatatgaaattcatgtaaaaagagcaaaatttatattgaggaagtgtgatattctatgtgaatctcttaattaataatatagatgagtatggtcgtctagaaacagcgcaatgcgccatgccatcggcgtcgaccaagtcgcttagcagctccaccattgaataattgccacgaaagaagctcagacacgagtcacatgacccacttctcttgcatggcttaacctttttttaattttttcctaagttaagattgtcacatcaaaaacctaacttataaccattttttcctgatacaaacattatgaaacaaattagttggtaggatttcaatttatttttaaatgccaaaatgaaatttctactttttttatttaataaagaaataatatatttttttctcattcaggatataaatatatgaattatagaaaataattttttattagtgaaactccatatatatcatatgaattgatgattagcgagcgacaaagttaaggtcagagggagtcatactcctaccgacgtacttaatcagatccggtttaagaactcggtttaattcaatggttcaaattaaaagagagaaaaacaaaacaaacaaaagaacgaagagataaaataactctttaactacttcttcttcttcctcttcttcttcgttgatatttttctctcattttattgactttccgaatctccaaaaatctaacccaaaaaataaacaatagttttttttttctccgcaaaggaaaaatcttttcttcaccaaataatttgtctctttcgcaaatctcagctctctctcgaagtgcctttcaacgataaatttgtgggctttattcatttatagtgttgttttgatgatgacagattctattaccagaaattgatcaaagagaaaaacgttgctctctcttgatttcttttctgtttttttttttatataattaatttgttccggtgaatgatcgtcgtcttatggaaggttgtagctaatttctaatctatagagagagagagatg

SEQ ID NO: 5343 - DNA, 3000 bp, Unknown
  misc_feature (1)..( 3000): cDNA_ID_3015409_gDNA_ID_1620781_Annot_ID_50354 3000 nt of promoter + ATG
taatgacattcctcatcaaccccctatcaataacttcacctatccgttccttctgcactagatcaagaagagtgtttagaagccttgtatgtatcttagtgaaatgcacaacattatccctccacaagttaagccccatcggatgaacatgagtctttttggtgctctcaatataagtcctatccatatacatgagaatgtctcgaatcatctctaacgctttgttgtgctcattccatttcttattaagctcttctagaaacgaccctccctgagctgcctcgataagcttggatttttctttgagatgagaagtcatagtagcaataaacccagtatatagcttctcaccaaacttgtgcaggaccatgttgtacgcatttctgagccacaatatacacaaataattccattaacacgaaacctagctaagttccagaaacattaccagtttctacaggattcaaagaaaggcaagagaatgaaagaaattgacctgtaaagttcttcgaaactgagaccgctagcatcttgattgtaaatctgatggatcgcacgctcaagaatctgccaagttttatcagcgtatttgggatccacaacgactcgatgcttaaacgcctctatctgaaaattcctcttcttctgattactcatattttgaaacctgaatccaaaacaaatcaatctaaattcacacagcaacgaaaaaattgacgagcgagaagaaagtatatatgtataatcataatgaaaatcaggtggatcgaggaaatcggaagactgaccggagaggaaagacggatgatcgggattagggtttggaattgtattctttgcttccgtgaaaagatttgggggaaacaaaaagataggaaatggaataataatcgaaaagtttaaaggagaaagaagcttaaggctaatttgcagcgtcgaagagatatagatagagaggtatcggagaagatagatttcgaaggtggagaagaagaagaggacagaccaaacggagcggaagaaataaaagtggactctccgtctctgctggtggtttccaaactataacgtatttattaaattaaagtcgcggttgtcacattctcgtcctttggtatattggttacaaagaattgtgaaatatcgaagtccaaggatcgatccctagtcgaagccagttatttttttttttttgacattggaggtttagttagcttttatacttatgtggatatgacaaattggcacgtcggtcatttcatttaattgaactaaaaatatgtcaacttctatttcataaagaggctttgaatcccttagagtggcgaatgttgcttctcctcttttggcagaagccatggcgcttcatctagcccaacaaaatgccttagaactcggttttaggaagtcaccttcgcttcagatttgcaaacgctgatcaaagctatcaactcagaatccttcccaaagaatctctacgtgattttccaagatgttcttgctctttcgtttaatttcgatcaaatttcttttcacttcatttttagagaaaaaaacggttgtgcatatgcatatgcaaaatctgcattaaattatgcacttattgtaccaacttatgtatcggtttaagtttcggtttaatgaaatttcagcttcttgacgaaaaaaaaaaatcccttttaattcattcacaaaaaaagttatatcgtctgttacctttctcttcaccagtttaccaacctttgttgcttgcattcactgtttcgatgccatattcaatcgtctctatgcatctgtttaaaaaatgcatttcctccacaacttcagcgacactatgttctaacttctaactagtttttgtcgttgtaaacacgtcaatggatcttcttccttatccctggtcaagctcatgatgatattctttgtctttgctttcttgaagccattttctggaaagcaacgcatggtatataccatctttcttgttttaatcatacaaactttgacttggacctatcttcttacttttcattgtataatctacaaactttataacaatcttcaccttccctataaggttaacccaactagtggattattcgtatccacctcaagcgccaaaacatggtaaggatcattggtagattttagtatgattgtgaggtaggatcattgccggctcaaagttatgggcggtctaaagttttttttttttaataaaaaaattagcagaagtagttgagggaactcgaacacacaacctcttggctgaaaatgtgacataaatcgctgcactgtaaggaatttttataattttattgcccccaaatatttgtgatacctaaggttcttgcataaatgcagaacttgatagaatacggtacacactggagtctgtaactgtagaagtagaaccaagtagccaacatgcgcctcatcaagaaacttgacgtacgtttccgagacgggacaatggtttgatttatgcctttatgggtctttaacactttatgagaaacaaggatctttaagtggatttaaatatttaaaatttaagaaacaaaggtctttaagtgaatactataagagtttctttatttatttttccaatcgaatactcataattttataaatactgagacacataatattcggctagctctaaaacattggagctggaaagtttgccttacgttacgttaattggagctacaaaatactcataattttgtagttgaagcatgatgaaaagtttgccttacgttattactttttaaagcattggagctgaaaataaaatgcttgcacgaaatactaacctaacacaattaagcaaacatataccaatcacacgtcacgtctctctacccaaaacaaaatatcacacttcacgttatatgacttatataaacatattctaaactatttatctatcatccatccttcattggttttcgacaaatttgattcccacaaattatttgatatcttgaggaaatg

SEQ ID NO: 5344 - DNA, 3000 bp, Unknown
  misc_feature (1)..( 3000): cDNA_ID_2147323_gDNA_ID_1620781_Annot_ID_167962 3000 nt of promoter + ATG
tgtaagattaagttaattgctttgtaagataaacaactatacaatatatttgcactgcaaaagttatagatattaaagaaaaagggattagaacacttttaggttttaacaccaaaaatagacatagtcataactatggagagaaatagggagatcaattcgattttacatatcccatatctgaattaccatttcaggcagctttgtgctcttgcctccaaaatagttatacaagtttagcatgaaaacatttgtgacatcctgccaccagaaacagaattagaatcagtactgagttaccaattgttggtgattctctgggtaatgatgcctgcttaatagaacataaaagatgaatgtacctgcttgtattccagcgtgtccaacttcccatcctgcaaaacaaggttaaatgccaaaataattaggagatatactaaaaggagtgaaatgccatagagaaggattctgattccttatctaatcttaaagactgaatgattcacagctgcaatcgccttaatcatgacagatgcagtaaagcacatgccaattgagtgtgaaagagaagaaaactattgatattcagcattgcttatatatggcataacaaaataaaactaagactcaccagtccagtaatcaaattatgcaatgattccaaatccatctcaagtgagctgatattctcacgagcagaaataacctgtgtagcataaccacaaccacatcacgttccaaaactgttcaagacactacagatgcataacaatgaaagccaatagctctaatcataggaactaaagagaaggtaaacatcatcattatcatacctggctattgatttccttcgagagatcgatctgcttttctaccttatcatccagattctgaatcctttgtgttaaatgccttttcgcagcctgacaatcaaccaattaagatccaattttaaccctgcagcttaatatatcaccagaaacaccatacacaaagcaacaaaaaaaactcaccgcaagagtctcagaaacttgctccagattctttgtcaagttagccactgcagcagccatgttggcttttgtcacatacataaggtcagtgaatgagagtccctaatcagtgaacaatcacaaacagtttttagttcccttacaacactgaaatctcttttcaacaaaacagcagaattcacaagagaagagattgaaaacttagtaatcccaccttccaccacatataaccatatccgagagctcccaatgccgcagcaggaacagcaagggcttgtaggtttgctgaaaaaacaagagagtctgatgaacacacacacacacagagacacacttagcaaaactatttgagtagaaatacaaatccctaatcttcacataccaccagaaactccattcatgaccgttatgtgttgctgcgaagctagctgtcgaatctccatagccaaccggcgaaccttctcaccaatattgcaaaagatatcaataccatccctcaccaatattcctatatccaatgaatatgagtttatgtacctgtgcagctatagcatcagaaacatcagaatctccctcagacccttctccagatttctccattcccttcaccaaactctatcgaaagcacaaatcaattagtcaaaaataaaaaaatcaaggagagaaacaaaaaaaaaaatgcatagaatcaaaaaagtacctgcaattcacccaacaaatccgacaattttccattcttcatcatgatcgtaccagtgtaaccttgattccatcaaatcgaaaaacgtatcaggaggatatacagatcccaattagcagtaagtaaacgagcgagttagattgagcagagaaatcaaagtgaagtacctgctccggctaagagaaagatcctggataagccaactccggcctgcatcgccatagctccgactatttttacaccgccgccgacgacttgtcgagctttgtctcaaaaatcgaatttaatttaggtattaagaagacgaactcatggtttatttttcttattgcattttttttttaaacgtgctagtgcaatttacttggaaacgacgtcgtctcgaaactcaatttcaaccgcctcaactcgcggcgagaaaagccacatcgccggtgattgacttgaacattacgtaattttagtgtcgccacgtggcaaattccttttttgtttttaacagacgtaatcatattgataatcttgttaaatattttttttagtaatcataatttaataaagtttatctcttttaagtttatgtaatcaaataaatgtcggaatttttttctgctaagaaacaagttaaatgcaatggtttagaattggattgtaacagaccaaaaatggatcataaatacctgaaaaagtctaatctcaaataataatttctatgttaacataaacaaaaatggtttaatgtggttatgggagcttaagagtgtgaccatctatccattttattgctcataatccttcttttcttgttagccttgttctttgcagctaacttgagtttcttctttgcatttctctcaggatgtatcaccgccattagcttctcctctcgtttcctcttctcttttttcgcttccttactctttttgatttcgccttaaacttgcacaaacatttgactgcctaagctcttgtctcttatactattagattgtatatagtattccggtttgattagattggtttagctatttagagattgtacattggtttagatggtttagagtaattgtatatatactctcattgtaacacatttattcttcgaggaaatagaaaatcattctacaattctctttgttcatgatttctaatatggtatcagagcatttcctcacacaaatctggtgattttcaccatcgtttcttcaatttcttcttaatcacaccttttctgatcttctttcttctccgattgtctttccgcgaccttggatttgaagaaaaatg

SEQ ID NO: 5345 - DNA, 3000 bp, Unknown
  misc_feature (1)..( 3000): cDNA_ID_2992596_gDNA_ID_1620781_Annot_ID_167944 3000 nt of promoter + ATG
taaacccctgtatttactctttctttatgctttaaaacagtaacttatgtataaagaaaggagacaattgatcttaatgaaacagttttgatggattgtgaaaaatctatttgacgggctctaaacattctttccccttttcaccacccaagcacttctctgtttgtccttctgttaattgtttctggctgcaaaagaatcatctaggttttgtttcctacttacgtgaacaagctcactcaattgttaataacatgatggttgttgctggctttgggcatgatggatcataatcttagacagtcagtatgtggctactcaattgttgtcatgatgctgttaaaaaagaaagaaagaatatatatgaaactctattggttgaactcataacctaatagttcaagtgaatgaaatcatgaaatgatagcgtacctagttaaacatattcattttatgggaggaggttagaagttgagatgatgttgagttcctaggcatagattctaactccatttgtgtctcttcaagattgcaggttgctaagagaaagatcgccactctctttaaacactttgagttagcgagaatgtatgtcattagttatttctcatcttctcttcctccatagcctccccacctaaagatctgtaaatgagacaacaagcattcgggaatagtagaagaactcggctggttccatgaaggtgggagacacgtagaatcctgatatcaatacatttgctataatgttaagttcatctataaactagatgcacttgtgtttaaggggaggaggatggtatacttacagtgtcaatcgtaagaatttgtagtttaggagaattttgaagcaaatacataagtggttccaaccaatctaccaaattgcttggaacaaaataaaactccaagagccgagagaacttgatggtgttacaccacgcaacctgtgattaaaaaaaaatataacattagttggctaagcaacaaggaaaagaagaggatcggagatatgtaatcggtaccattggcttggtcaaatacaagtacatatgtatgacagaagaaagagatctcagaaacttgtgatcggggttatgaacatagccgagttttgctatatgaaggcaagaaatattctctatcaagcaatagtccaaaacgttacgtaagcgtaaaatttctaatgcaggggaatctattaccaaggatctattgagatcatcatcatcatcctcctctacctcacctacgtcaacttcctcaaccacaccttcctcatcatcctctacctcatctacatcatcatcatcctctacctcattttcctctaccacgtcttcctcatcctctaccccatccttccgccgagtagtattataatgtaactgtttcaaggtagatactttcacggtaaattttgtcaagttgtcatccttatgtcgatccaccttcaggcagttgagaacaggggagcttgataaaaggctaacaagagattcttcgtctttgtacaccacaaagcgaagactcagagttaagagagatggtaggcgaacaggggaagaaacgttcactagaatcttgttggatagacttaaatcaacgagcgtgttgcatgtgtaaaggcacttaggaaatcctgtgggttctgcggtccagaggagattgaaatctaactctttcacacctctattaactacgttctcaacccactttccgacatctacgtcaacaggacaatgtggaccgagttccacaaccaaactatctagtttcggtgccttatggagttgcaatgacttttcaataaaccaccccacgctctcgctgtcatcttctttgaattcgagtctaggcaccatcggccagacataacgccatcgtttagacaagattgaagtggcgactgcctcttttgttgggacgtgatgcaagatctgcaagagcaaatcgttaggaaaagcacagattctagtttcgtttatctgacaactttcggtttctggaacagttgatatatgctcatcgtcgtgtataatatcccaaaaaaaagaccaacaacttaagcaacccatagatgtggccatgtgggataccggatacctagctagacgccaatggaacttttttctcgtcgctggctgtgacacaaaagtgagtctatattataaagctttttttcaaaaaaaaacaattattatacaaatatttattatttgttcaaagaaaaaaaaaaaaaaatatatatatatatatatatatatattattaatgcatataaaaaaagaaactaaattaaagttgcccaatttttaaagtaaaactgcaatatagacacacataaaatatatcaatcgattctcattcttacataattgttagttttttcccttaaaaatctaatcatcaaaccaaacaaaattgttgaaaatccaaattttctagcctggtccttatatttccatttgttattttggatgaatttattttccaattcccaattttgccgccaaccttgattaatttctctacttggcttgctctaattgcttgcaccacgcccttgtaaatgtatcgattatgtttttacgtgccatgaatttaaattttttgttgttacactatttgataaaataaattgaatgtgttttgactaaacggattataatactaattaatctttttaaagttctacgtataatttaatgcatctatgatttcttaaaaaatcaaaataaaaattggtaataatgtttctagtttctgttcactacaacatacaaacgatacttattctaattgcagctaataatagaattggtttttacaagttgaattttttttaattatttgtacatgggcctttaactggagcataattaaagaccaaaatgagaaaaggcccatatagttgtagtcttagtttaggtttggagtctcacccttatattcttcgttccaaacgaaaaccctaaaagagaaaaggaggcgaaaatg

SEQ ID NO: 5346 - DNA, 3000 bp, Unknown
  misc_feature (1)..( 3000): cDNA_ID_1828377_gDNA_ID_1620781_Annot_ID_167943 3000 nt of promoter + ATG
acttaccaaaaaagtgattgtttggtttgactatgcgagtggagtcagagaattagtacttacaagttacatcttagtgctaatattagtagatgtagatcttaggattagtgtaaacttagtatcatcaaattaaatctactttatcattcttttagttatatatgtagatgatagtaatatgattaagttataaatgagtcactttcttattgcaattttactagatattcacaaaatattagctatgtaaactttctatctctgctttggctctctaaaccgttttagttatgaaagcggtttagataaaaagaaattctttatttgaacaagtacaaaatatgtatctcgaagtcgaacaaaaccatatttatttcatcttgcatctgactcgtttgattggtgtttgaacgaaatagataaaaaccttgctattttgttctttttgataatttgatgaaaccttgttacgtacggaatatgttgtttgtatgtactgcaaagcataagaatattcgtggagatgcctagttatttttctctgtaattcatacatttaagtcgtcaaaataaacatgaaggatatagattcattgaatttttaacgaatgaaaaatttattccatcaaaaactgtgtttacattatatgcagcctttttaagagagtttttgaaaagcattgaaacgtaaattgaaattgagcaacttctaaacaaatcttatcctctagatccaaacaaaatccgaagaacatcgtcgtgcttggatgaaccgttacttgaaaaatcattaatcatagctgatatcggacggatcgttcaatgaaagtgatgatctgcttgaccatgtttgtatcattgtatgctagccgcgttcgacgacggcaactttttttttctcaaaaaaagaaagatgattgtgtgtaaaattaaaggcaggcagaaaaatctcgtaagcataattataacgttaatgttgtaccaaagtgacgaaaattgatttgatttgactttttttttaaaaaaaatatttgattatatttacttgttttttttttttttttggggcaaaagattatatttacttgtttagtatgcatatttatgagtgttttgtggctttgggaatactatgcggctgagaggttaagatatggaagcaaggctacatgatatcatgaaaaatctactacttttgtgttggttgtataaacattataaatttatgatcatggatatgtaatcatttttgtagaagctacatgatattggtatattggctaaattatgggatggcacatagttgaagcttagattcaattaaaacttaacctcaatatactgatttcaagtaatttggtctcacgaacatagagatatcccctccattaccccccaaattggctgcccaagcggcagtatatcacatatggagacagcggaatcatctccttcacaatggcatctcaattccgcctccaattgttttcaagaacatcaatagcgaagtgagaaacaccattactgctagaacgcccccgtaaagtctttcgtgccttaattgctctttggatccgttaatgggttgattgatactcaactcttctttgtattattatttttcttgacaaagtttacatttgtaggttcagctttttgtaaaacttcaacacttcattctaatgatgtttacattcttataataataaaaacatagagatgtcatatttatttctatttatttatgtactatattacgacgaagtttgaacttgtgagaagttagaaaagaagttattactttctgaatcaacatttaaaaaataatagatgaacttaaatagtaaattgtacgtaaaagtcgaactccatcagctaatttctttaagtcttaccacaaaagactaatatgagtcaaacttgagacttgttcgttggaacgctgaagttaccaaaaaggtcagagtgaacaaaatcttttcaggcatttagtcagactgagatccaaactaagtggtgaaatggtaaattacactaatgtcattgccctccattggccattaaagccttctattttctgacattggtcagtgggaatagaaactgtgaagaagaatggaatagaagaaactcggattctgagaatccatttaaatttttttagtttaatcctaattagaaacctgaaagcaattgattagtgaatttaatttcgaatcttttgtagttgcagctggcctcgatcggcccttgtatccttttattaattaaagacttcaaaccaaagcgacaaaattaaagcggttcttaattggtctttaataatttttcatctcgtcctccatatatacgattatacacatacactgttcacacaaaaatacatacgtagatttcatgcacgtcaatgtgtatctatgttcgttgttcaccatatgtcacgatacacacatgtgcacgtgtgtatatatgcgtacacgatatgatgatagtgcatttttgtatcatatgcgctgattctagaagtaatggcaatgcttcattagtaattaagtatcgataacatactaaagtatcgatatgtacatatattttttttcatgataagaagaaatacgaaaggcctcaggcctgagatatagtatatagtacgttattgtcttattgattatattttttcttgatcttgtcctcgtgtttataacctttccttcagctccagttttgaatattgtttaataagtaaaaccaaagatagctttcaaacaaactttcttgggaaattaattcaaaaataaaatgaaattttaaaaactcagctgaaatggcggctgatccttcgggttcagacccctggcaaggaagcatatattgatttcaacttaagctaaaccacttcacttacttcacttcctcttctctaccaaactcactctagctagttccacttagggttcctctcttccaactcttttttgtttttagggttttagagaa

SEQ ID NO: 5347 - DNA, 3000 bp, Unknown
  misc_feature (1)..( 3000): cDNA_ID_2147297_gDNA_ID_1620781_Annot_ID_167940 3000 nt of promoter + ATG
ctaaatacatcagtttcagaaaaacttattaatgaccattaatttatttaacttcatataaacaaacgttgaatcatgtcatagaagttctaaatacgagatatactaacatattttgatacaaaaatgattaaaaaaaaaaggatgatcaaaattacaaaattgttcaaagttgattttgaatacacatatgagaaatacaaatatcggaattacctcaaaaatttttattttattttgtaaatttaaatttcattgctacgtgtctctaagatgttctttattacttgatcttttaaaaaaaacaaaattgtttcaaaaagattaatttttagttttttatgcactatttattagttattatgaataaattttaaattttaaaataaataattgaatatcactggtttagaataatagaaaaacagaaatcacaaaaactaatacatttatgatcaattttaatttttttcttttattttgtgtgctttttctagaaaatcaactaaaaaaaattactgctcatcctaaaaaacatattattcattaattaacattaaatcatactaaggaaactaaaaaagaaataaagaacccagacatcatactaaggaggttaaaaactttggatgctaactttttttttttttgacccagacatcaaagtcttaaaagcattctcatggaaagtacagtgtccgcccaagttatatcacttcttgtggcaaattttagcgggatgtgtaccaataacggacaatctacgaaaacgcggaataaactgtgagataggatgtagcagatgtggtgctctagaagaaaccattaaccacacgcttttcttatgccatcctgctcgtcagatttgggcactttcacagatacctacggtcccagaaaaatttccttatgcatctatatatgcaaatttggatcatttattttggcgcatacctttagaatttgattcatcttcatttccatagataatttggtatatttggaaagcagggaataaaaaaatctttgataatgtggataaagatcctctagagatcttacatttggcggaaaaagagtcagacttgtggaagtccgctcaacttgagcttcacaacgaaaattttggttctttcaatttggaagatcgtaatcgagtgcggcatttttctttagacaacaattattctggatatcgttgttttgtagatggatcttggaaagataccgacaagttttcaggcttaggatggtactgtacatcatcaactggagagacatcaactttgggagctgccaatctcagaagaagtttatctcctttacatgccgagctggaagctttcctctgggcgatgaagtgtatgattggtgccgacaaccaagatgtagtttttcttacagactgttcagatctggtggagatggtgtcttccccaaccgaatgaccagctttctcatcgtatttggaggagttacagagcgataaggatgagttcacaaacttttctctatctttaatctctcgtagtactaatgttaaagcagattttttggcacgaaaagttcgtacccaaccgcttcatattacatttgtaaacaacattcttcaggattgactcgtttgagtcctaattaattttcggatgacaaagaaaaaaaaaaaacccaaattattaattccacagagcaagaccaatcttaagatacatttacagccgttggatccaactagtaatcatcaggggccgtagtccgtaggattaattactacgcggtttttgcaacatatgcttttctacaattgatgggtccccatgttcagaggtatgttcttccctactggaagtaccaatttatagtttaatcaaatttatttttttgtatcaaaaactttaattttgtaaagcctccacgcgaaacttaacttctaataaactctctcaattctctatttttttttcccaattatgcataaacttattcattctggtttctggttataaacagtgtgaaacaatatattttttctggttagagtgtgaaacaatataattgtactgaattacagtaagaaatcacttttttgtattttttttttcaagctatcagcttttcattttctttatttttttcctttttattttttatttattttatcaaatttttcttagcttttattaattttataatttttccgccgattttaggttaaagaaaaaaataaaaatacgaaaatatcagacgtcgattgaatctacaaagtttcatctcctcttctctctctctcaatctcaatggctctgttttaaaaagggcaaattagagagatttctccttcaataacaaaaaatcgccagctttatctctctctttttcacatcccatggctagatggtgacgacgattcacgcataaactagggttcccccacaaatcatcttacacgtatcctctattccttccttcctttctccgtcatcatcatttttcccaccgacaacaatctctcggagtttgggtattattacttctctcatcaaccaattgtaccactagatctcccagattccttcattatctctgtatgttccttctttccgaccaatctatctctgttttgtcagatcgggcttacttttaaaaatctgttttgtttctcaatctgttaataactaatgacgttgtagtagttaaagactagtgttttgttgtagcttgttttattagatctctttcgttattcttacggaagatttgatttattgcttctctttcaagacaaagtttttatttttatgaatgtctctgttctagttttaataatataacagatttgagattctcttttgtctctttagtatatttgtcttgtttttgaactgttgttgttgttgttgttatgtctctatctacttattcaaatctaaagcttcactctcttttttttgcctcttgatctgatttggagctgatctgtgttttgttagatcaataatg

SEQ ID NO: 5348 - DNA, 3000 bp, Unknown
  misc_feature (1)..( 3000): cDNA_ID_2686636_gDNA_ID_1620781_Annot_ID_167938 3000 nt of promoter + ATG
caaaacaagtgaatattgtaccagcattggtaagggcatgaaggagattagctttctgtttgagcttgagaccagcttcgaagtaatcgtgttggtcaagctcggactcagcgcacgtaccgtgtttctcccactcatgtgtccaaaacttcataccatcattgctcggacacgacaacgttggccattctctttgtaaatcgctcatcagatcagaaacctttataaaagttttcgattctcattagttatttacgattcttttcttgtggttaataatttccgaagtcccaaaatacaaaaactattgtgttataagttaaaaacaaacccgtaaatcatcaaatcgactgtcaggattacaattttgcggccatccaccggttttgtagttaggccaaagaccgtgaattccaaaatctgcagctggtttaccggtttgtggatagcaacaactatgtcttgaatcacaatacgctccaggccactgcattgcaacgcacatacacaaacataaaatttcaaagtacaatgataattcttgtagagacatttatcgactttaattacctgtaaaacgaagtagaagaaatcgaaatcttgggcgaaactttgtacgtagagttgttgtaacgctagaataaaaatgaagaatttcatttcctcaagatatcaaataatttgtgggaatcaaatttgtcgaaaaccaatgaaggatggatgatagataaatagtttagaatatgtttatataagtcatataacgtgaagtgtgatattttgttttgggtagagagacgtgacgtgtgattggtatatgtttgcttaattgtgttaggttagtatttcgtgcaagcattttattttcagctccaatgctttaaaaagtaataacgtaaggcaaacttttcatcatgcttcaactacaaaattatgagtattttgtagctccaattaacgtaacgtaaggcaaactttccagctccaatgttttagagctagccgaatattatgtgtctcagtatttataaaattatgagtattcgattggaaaaataaataaagaaactcttatagtattcacttaaagacctttgtttcttaaattttaaatatttaaatccacttaaagatccttgtttctcataaagtgttaaagacccataaaggcataaatcaaaccattgtcccgtctcggaaacgtacgtcaagtttcttgatgaggcgcatgttggctacttggttctacttctacagttacagactccagtgtgtaccgtattctatcaagttctgcatttatgcaagaaccttaggtatcacaaatatttgggggcaataaaattataaaaattccttacagtgcagcgatttatgtcacattttcagccaagaggttgtgtgttcgagttccctcaactacttctgctaatttttttattaaaaaaaaaaaactttagaccgcccataactttgagccggcaatgatcctacctcacaatcatactaaaatctaccaatgatccttaccatgttttggcgcttgaggtggatacgaataatccactagttgggttaaccttatagggaaggtgaagattgttataaagtttgtagattatacaatgaaaagtaagaagataggtccaagtcaaagtttgtatgattaaaacaagaaagatggtatataccatgcgttgctttccagaaaatggcttcaagaaagcaaagacaaagaatatcatcatgagcttgaccagggataaggaagaagatccattgacgtgtttacaacgacaaaaactagttagaagttagaacatagtgtcgctgaagttgtggaggaaatgcattttttaaacagatgcatagagacgattgaatatggcatcgaaacagtgaatgcaagcaacaaaggttggtaaactggtgaagagaaaggtaacagacgatataactttttttgtgaatgaattaaaagggatttttttttttcgtcaagaagctgaaatttcattaaaccgaaacttaaaccgatacataagttggtacaataagtgcataatttaatgcagattttgcatatgcatatgcacaaccgtttttttctctaaaaatgaagtgaaaagaaatttgatcgaaattaaacgaaagagcaagaacatcttggaaaatcacgtagagattctttgggaaggattctgagttgatagctttgatcagcgtttgcaaatctgaagcgaaggtgacttcctaaaaccgagttctaaggcattttgttgggctagatgaagcgccatggcttctgccaaaagaggagaagcaacattcgccactctaagggattcaaagcctctttatgaaatagaagttgacatatttttagttcaattaaatgaaatgaccgacgtgccaatttgtcatatccacataagtataaaagctaactaaacctccaatgtcaaaaaaaaaaaaataactggcttcgactagggatcgatccttggacttcgatatttcacaattctttgtaaccaatataccaaaggacgagaatgtgacaaccgcgactttaatttaataaatacgttatagtttggaaaccaccagcagagacggagagtccacttttatttcttccgctccgtttggtctgtcctcttcttcttctccaccttcgaaatctatcttctccgatacctctctatctatatctcttcgacgctgcaaattagccttaagcttctttctcctttaaacttttcgattattattccatttcctatctttttgtttcccccaaatcttttcacggaagcaaagaatacaattccaaaccctaatcccgatcatccgtctttcctctccggtcagtcttccgatttcctcgatccacctgattttcattatgattatacatatatactttcttctcgctcgtcaattttttcgttgctgtgtgaatttagattgatttgttttggattcaggtttcaaaat

SEQ ID NO: 5349 - DNA, 3000 bp, Unknown; identical to SEQ ID NO: 5343
  misc_feature (1)..( 3000): cDNA_ID_3015409_gDNA_ID_1620781_Annot_ID_167937 3000 nt of promoter + ATG

SEQ ID NO: 5350 - DNA, 3000 bp, Unknown; identical to SEQ ID NO: 5348
  misc_feature (1)..( 3000): cDNA_ID_2686636_gDNA_ID_1620781_Annot_ID_50355 3000 nt of promoter + ATG

SEQ ID NO: 5351 - DNA, 3000 bp, Unknown
  misc_feature (1)..( 3000): cDNA_ID_1828385_gDNA_ID_1620781_Annot_ID_50356 3000 nt of promoter + ATG
cttttcgattattattccatttcctatctttttgtttcccccaaatcttttcacggaagcaaagaatacaattccaaaccctaatcccgatcatccgtctttcctctccggtcagtcttccgatttcctcgatccacctgattttcattatgattatacatatatactttcttctcgctcgtcaattttttcgttgctgtgtgaatttagattgatttgttttggattcaggtttcaaaatatgagtaatcagaagaagaggaattttcagatagaggcgtttaagcatcgagtcgttgtggatcccaaatacgctgataaaacttggcagattcttgagcgtgcgatccatcagatttacaatcaagatgctagcggtctcagtttcgaagaactttacaggtcaatttctttcattctcttgcctttctttgaatcctgtagaaactggtaatgtttctggaacttagctaggtttcgtgttaatggaattatttgtgtatattgtggctcagaaatgcgtacaacatggtcctgcacaagtttggtgagaagctatatactgggtttattgctactatgacttctcatctcaaagaaaaatccaagcttatcgaggcagctcagggagggtcgtttctagaagagcttaataagaaatggaatgagcacaacaaagcgttagagatgattcgagacattctcatgtatatggataggacttatattgagagcaccaaaaagactcatgttcatccgatggggcttaacttgtggagggataatgttgtgcatttcactaagatacatacaaggcttctaaacactcttcttgatctagtgcagaaggaacggataggtgaagttattgatagggggttgatgaggaatgtcattaagatgtttatggatttgggtgaatctgtgtatcaggaggattttgagaagccgtttttggatgcgtcttctgagttttataaggttgagtctcaggagtttattgaatcttgtgattgtggggactatctgaagaaatcagagaaacgccttactgaagagatagagagggtagcgcactacttagatgccaagagcgaagagaagattactagtgtggttgagaaagagatgattgccaaccacatgcagagactggttcacatggagaactcaggtctggttaatatgcttctgaatgacaagtatgaggatttgggtagaatgtacaacttgtttcgcagggttactaatggtcttgttactgtcagagacgttatgacttcgcatcttagggagatgggaaaacaactggttactgatccggaaaagtcaaaggatccggtggaatttgtacaacgtctattggatgagcgggataaatatgacaaaatcatcaacaccgcatttggcaatgataaaacctttcagaatgccctgaattcttcattcgagtatttcatcaacttgaatgctcgttctcctgagtttatctccctgtttgttgatgacaagctacggaaaggacttaagggtatcaccgatgtggatgttgaggttatccttgataaagtgatgatgctgttccgttatttacaagagaaagatgtctttgagaagtactacaagcagcatttggctaaaaggcttctctcaggcaaaactgtgtcagatgacgcagaaaggagtttaatagtgaaactaaagacagaatgtggctatcagttcacttcaaaattggaaggcatgttcactgacatgaagacttcagaggacacaatgcgtgggttttatggcagtcaccccgagctttcagaaggacctacacttattgttcaggtacttacaactggttcttggccaacacagcctgcagtaccttgtaatctcccagctgaagtttcagttctctgtgagaagttccgttcttactaccttgggacacataccggtagaagattgtcctggcaaacaaacatgggcacagcagatatcaaagccatctttggaaagggtcagaaacatgaactgaacgtgtcgactttccagatgtgtgttctcatgttgttcaacaattctgatcgactcagctacaaagagatcgaacaggctacagaaatcccggcagcagatcttaaacgctgtttgcagtcgctagcttgtgtaaagggcaaaaacgtgataaagaaagaacccatgagcaaagacataggagaggaggatttgttcgttgtgaacgacaagttcactagcaagttttacaaagtgaagatcggaactgtggttgcccaaaaggaaacagaaccggagaagcaagagacgagacagagagtggaggaagacagaaaacctcagattgaagcagccatcgtaaggatcatgaagtccaggaaaatactagaccacaacaacataatcgccgaggtgacgaaacagttgcagccacggttcctagctaatcccacggagataaagaagagaatcgagtcgctcattgaacgagatttcttggaaagggatagtacagaccggaaactttaccgctatctagcctaaataagttgaataccacaacccaaaaaaaaaaggctttactctgtttctttctttgctttatttccttatgtttgatgtaaaatcttttgaactgtacggtagtcggtaagaacgaaccaacacagcgtcactaccggtttaatcgaatatacatttgtttccttttcttttgtctttcatcagataccgtatgtgatttcagcttctggacacgttgggccggctcgaggccttttaaggcccattttaaacggttaagagccaaaaaaaacattcgcggctaaaatttcaaccaggcgtaaaaaaatcccgccaaacgttggcaacgctttgtttatagcgttttcatagcctaatcggttccattgacatttctaggggaaaaaatctctcacagtgtctgactttggttctttgtcttgtaacaatcgccggaaaattaaggat

SEQ ID NO: 5352 - DNA, 3000 bp, Unknown; identical to SEQ ID NO: 5347
  misc_feature (1)..( 3000): cDNA_ID_1828381_gDNA_ID_1620781_Annot_ID_50357 3000 nt of promoter + ATG

SEQ ID NO: 5353 - DNA, 3000 bp, Unknown; identical to SEQ ID NO: 5346
  misc_feature (1)..( 3000): cDNA_ID_1828377_gDNA_ID_1620781_Annot_ID_50359 3000 nt of promoter + ATG

SEQ ID NO: 5354 - DNA, 3000 bp, Unknown; identical to SEQ ID NO: 5345
  misc_feature (1)..( 3000): cDNA_ID_2992596_gDNA_ID_1620781_Annot_ID_50360 3000 nt of promoter + ATG

SEQ ID NO: 5355 - DNA, 3000 bp, Unknown
  misc_feature (1)..( 3000): cDNA_ID_1828375_gDNA_ID_1620781_Annot_ID_50361 3000 nt of promoter + ATG
ttggtgatcattgcgacacacttcggtttgatgatttcacttcaacaattaatgagaaccatcgtcatcatcaagacctgaaacagaacatgacattgctggagagttattattcttctttatcgtccatcaatagcgatttgccagcttgtttctccagtacaacctgatgtatgtggatagattttcccatctctgccttcttggcttgcttttttcaagctagggtatttcctctttgtaggctttctctttcactaaattaaatcgtttattaattatgcttccttgagtttttatttttcacaagcaactttgctttaatgaagaaggcatgaggtaagtcaagatgaacaagagaaaaactgaatcgagttttactatattcaaaataaagaccagtaagtatattatttctggagctgacttcattaatcgcatacgagactgtcgttgtagaattcccaaaaattgaagcatagttaagatttaagactcaaaattgctattccatagttgtgtcatgacgctgagaacattaaagtgcaagcttgatttagcctccgagagattcagaaatattatattaaccaagaaggtaatcacaacagcttatgtgatatgcatcaacaatagaacattaaagatgaattcaacaattccaaaactgaagagaagagaattgtcgacaaagttaagaactgataacagaatacaaagcttaaaaattggtcgagtaacatagatgtcctcacatgactgcaccaagtcctatcacttgaacatagccataattccaaaacagagaagaataaaacataaaagcttaagccttgggggctactttctccttagccttttggagtttcaacactttcttcacaatcttttgctcttcgacaaggaatgcccgaatgatcctgtcggaatccaaaaacaacattacgttaaagaacaccaaatttattgtaatagaaagatgactcaagtaagatggacaacaaacctttccctgactgcagaaccagacaagactccaccgtatgctcggtttacagtcctcctgtttcttgataatcttgacctcttgtactcagagggcctcaagtgagggatctgaataaacaaacaaagttattcacataatgcaaaaggaatatgccattgcataatcaaacatatatagttgggaataaactgaaaatttatgccaaaggtggatagcaaatccttatgtaatacaaggaacaacttgaaagacaaagtggcaccgacaatttagcttatgatttatgttatgtactgatgtgggatttatctaatcagcacaagaccgtcaataagcacaatactattaactaagtaacatggtttcttgaaataagaagacatgcccattaaaaatgagactgatcaatactcaaaacattctaaaacactcaatctgattgatttggttatacatagccatcaaattcctaaaaaattcaaactcttaactctatctagacctcaaatcaagactctagatacaagaaccatgtaaaccaaatcacacgaagccaaatcgaaatcagaagacttactccttgaatacgcttgccagtaacaggacatttggggccactagctctcttctttgtggtttgatacaccaatttacctcctgaaatcaacaatcccaacacacattacactatgaagaacagatcggtgattagagaattatgagactaaagcagaggagattgaagatatcaaggaagaagaagaagaagaagaaagggacctggagtcttgacgatacggtgctggttcgatttggtggcgtagctgtgtcgcgaccggtaaacaagacgctgcaccattttcgcctccttttctcttttagggttttcgtttggaacgaagaatataagggtgagactccaaacctaaactaagactacaactatatgggccttttctcattttggtctttaattatgctccagttaaaggcccatgtacaaataattaaaaaaaattcaacttgtaaaaaccaattctattattagctgcaattagaataagtatcgtttgtatgttgtagtgaacagaaactagaaacattattaccaatttttattttgattttttaagaaatcatagatgcattaaattatacgtagaactttaaaaagattaattagtattataatccgtttagtcaaaacacattcaatttattttatcaaatagtgtaacaacaaaaaatttaaattcatggcacgtaaaaacataatcgatacatttacaagggcgtggtgcaagcaattagagcaagccaagtagagaaattaatcaaggttggcggcaaaattgggaattggaaaataaattcatccaaaataacaaatggaaatataaggaccaggctagaaaatttggattttcaacaattttgtttggtttgatgattagatttttaagggaaaaaactaacaattatgtaagaatgagaatcgattgatatattttatgtgtgtctatattgcagttttactttaaaaattgggcaactttaatttagtttctttttttatatgcattaataatatatatatatatatatatatatatttttttttttttttctttgaacaaataataaatatttgtataataattgtttttttttgaaaaaaagctttataatatagactcacttttgtgtcacagccagcgacgagaaaaaagttccattggcgtctagctaggtatccggtatcccacatggccacatctatgggttgcttaagttgttggtcttttttttgggatattatacacgacgatgagcatatatcaactgttccagaaaccgaaagttgtcagataaacgaaactagaatctgtgcttttcctaacgatttgctcttgcagatcttgcatcacgtcccaacaaaagaggcagtcgccacttcaatcttgtctaaacgatggcgttatgtctggccg

SEQ ID NO: 5356 - DNA, 3000 bp, Unknown
  misc_feature (1)..( 3000): cDNA_ID_1807959_gDNA_ID_1620782_Annot_ID_50369 3000 nt of promoter + ATG
gattttttctgaagtcaacacataattgatgattttaatcacaaggtataaagtttatgttttaaagcaccgcaaattgcgaagtcgtgatttaaatgacatttttcccattataaaaaggaccaaaatgattttgattacgaatgagcaggaatcttgatttatcagtcatccaaaattaaaatggttatccggtttactcggattctttattttgaagaattgaaactttaaaatgtttccaaaattataaatattttaacattatgataaagttaaaatctttataattttaaaaactttttctaaagtttatctttaaaaaagatttaaatttttttataattttaaaacttatgaagttttaaaaattatagattgaattttacaagaaatttaaacattataaatatatatatataatatattaatacgggacgatatattacaggagaaatcttaaatataacaatcaaaattcaatgatgaattttgggtcgatattatatttttttgaagtttttcaaattttataatattaaaatttataagaaaatgataaaattatgtttaattttacggaactaggttatatggttggacggatttgggtggataataatatggaatggtatattacgattgtacaatgtccgacgttgcttaaaaaattggacaatggttcaaagccatagtataaaaaggaccaaaatgatttcgattacgaatgagcatgaaatttgatttatgaggtgtccaaaattataatggtttgttaactagggttctttattttaaagaatgaaactttaaaaagtttcaaaaaattataaattgaattttacaagaaatttaaatattataaacaatataaaagatattaatacgggacgatatactacgagagaaatcctagatacatacagcgagagaaatcttagatataacaatcaaaatttaatgatgaagtttgggtcaatattaatcttttttgaagtttctaattttataattgaaatttataataaaatgacaaatttgtatttaatttcacgggatggggttatatggtgggacgggtttgtgtggataataacacatttgattcttttataagaaaattaaatattataaatgtttatattttaaattttatactacaagtgaaattctagaattgactggtttgggttgataataatttgcgatagaactaggagtgaaatcctagaatgacaatcaaaatataattatataattaaatattaccacgggtaaaattctagaattgacggggttgagtcgatattaatatgggatggtgtactacggatgaaatctgaaaaacaacaatcaaaatacaattatacaatattaaatatttaaaaaaataaacaaatacaacttaaaactttaaaatttgagttataaaattttgtctcgcggtgtatcatacatttaaatcaaacaatagcataaatttaaagatcatcctaaaaaaaattcaattattttttatttaatgaaaatataggcctgcggtataccgcggattaatatctagttgtataaaaacaaactgaactatgtttccctaataaataaataaataaaaaaaaactgaaaaaaacaattcctgaacaattttacatccaattcatagtataacgacatatccaataacacaatttgaattctaatagtaatctctaatacacacttttttatttatcggaatatttttaaactaaattttaatagctacacgagataattgatctattgaagtattaactactaacatagattttaaggtctagttatttcacataaaaactaagttgtccaactactaacgcaattgacaaccacaaccaacaccaatattaagtatgattaccgaccaaatttgaattttataaacatatagaattttttttgccaactcataatcatatttttatatgtattttaatataaggtgaatgattatcttttgtttcatgtcatattgggcataacaaaactagtacaacaaagttgtgtgaaccactccttttatatagttttgttgttgtcttttcttccaaggaagattactagacttagacaagtggattatatatatatatatatatatatatatatatatatatatatatatattaactaatctttcaacacttgtggattgataattattcatacttttaataaaaattccatagttcaatgaatctgtaacaaaaccaagaagtgacgtgatatacttttggaactataatcatattgtgagctcaatggataagaattgattgtagtaaatgatgtcggcagttacaagtgtagttagatatatgcaataactcaaatcggacatgaactcattttaacttatctaaagagaccaccgacgaatcattttgggttcacaaaattgtacttcgatttctaagcctgaatgtgaacgcacgtttttgaatatttcaacacgtgtttcatatttcattacatgcattataacataaatattacatctttgagtctttaactagttgaccaacaaaaaaaaaaactttaactaagtctagctagttttgttactacatatataaaaacaaaaccgaaataaatatttaaaatttataatatatttgtgtggctaaatcaatcaacgtgtcatgaaggtctaattcaagttggtaaggaaatcttttgtttatgtccatttcccacgtgtcactatttgtatgacggctagagaaagacatgttgaattaactagtgactccggattatataagcaagcatctactaaaaagataggaacaacacaatttgattacactgagcaacacaaaactggcgaaccaacgtgactctaacgaagaaaccggcaatggccagtatcactacaatgccgaagaaataacaagaatcataaacgagccagaatattatcccccgggttacaacttgtctaccaccgcaatttcaaac

SEQ ID NO: 5357 - DNA, 3000 bp, Unknown
  misc_feature (1)..( 3000): cDNA_ID_2144760_gDNA_ID_1620782_Annot_ID_168002 3000 nt of promoter + ATG
gatgtagttacttctgttttctatatagtccttaatttgtcacaaaaaaagtctttgaatagtggctaatatttgagaccgaaaaaataatctcaaaatgctggcccttagcttttaaagttttatttttctcttttaagactttggtttggttttatattagagaatttccataaataaatgaaaaaagatcttaatttttcatctccagtctctactttggatgtttaactattttctaacatattcatgtgcctttttagttatgtaatatttaataaaaaattacagtgtttaactattttctaactattttcatgtgcttttttagttatgcaaacagcaaaccggagtaaaaataaagcagatcttctttgaaacatcaaaccggagttttcttattttaagttgtaacatcaaactggagttttcttatcacttgtggaatctaatggaatgcttcattagctttggacactcttcttcaatcatgaaaatggtacaacattccagtagtagatgctttcagatcaggtagatggctaaggggtaagctctctagtttctcaaatgggatgataatacctacctgcccttcagtagcttcttcttccttgattataacctttagttgctttgaggaacaaacaacagacaagtcaaatcctttagaccattgccacaatactttgatttgcttaattccatttcgtaatcataacccatttcgtaaatttaattgttaatataagaaaaatatatgattttggcattcatctatggccaattttgctgtgaatacatacttccttgtatctatttaacaggtaacacaaatcatataccaccgattcctcaacttaagcaaacggcagatcacaatcggaatcgagacaccaaatgtgatttctgaccgtaacataaatcagtcagaaggtctgcgtatagtaagcagtgagaagagagtaaaagtacgtttaccgtttgatccttactcgattcttctctctcgccattggtcctagtcaagctgaaatcaactggactcctaaacttttccaggtaagggcaaccgcgagtgaggaaactccatgtgacttgtgagatgtctctgacacaactcagaatctgcctagacttttctttgatatctctgtgtgaattagaggtttcaagcataagacatttcgtgcatttgacatcagattctacagataattccatcaaaagcttcggggccaaatcaaacaataattctccagcatttttccagaattttgctgcagatatagcaaaagaacgttccgcacaaaagagatggtgagaaacaccagcaaggaataaagagtaggctgcacttatcctgctcatgtcacaaacaatgccagtttcagaatcaatcgaacggattctgtaagcagtagctagagtaatgtacgcattcagagcaacgtagtgacacgcatgtaaccgcagacaatgaggctgtgagtcttccttgaactggatgccgtgatgcagaacactctcaatcatctcacaacatgttttaggatcgatattgtccgataaaaaatcatctatagcttcttggatataatcattcatctttcccactgcttcatctttgttagtacttccatcaaagtgaccaacggttgtcttttcactctccaacgtaagaactccctaaatggatgcatcatataacgttaactattttaaaccacacacaactaactcaaactcagccattaataaactgaaatttcactagcttttgatgtgagactacaccaaacaacagtcacaattgatacctctaaaatagagtccacataagctggaggtgaagctgcacatcgtccacagttacacataaatcgatatttcgaccacaaatctgactgtctcaatccctaaatggttaaaaaggaatacacttttaataagataaacaatctagagagtgatgatatctctaaagcacaagactttggacatagaacaaaccgtgggttgaagtaagtcaatataagatacagtgatctcttcaccactcttaatcctcttgatacttctaacaatcaactttggtccatttccattaccactgttcaaactagtaccacaaacttgttcctgcaattctaagtttgacgatgtttctgtgttggtgacatgaacatcatgatacgacgtcctgttgttgacgaaacggtaacaagagtttggagagcagctatggttaatccaagagaagcttgaattatagagagcgattccaagagctagtccgttgctatcgtgcacctcaacggcgtttgttagcacagcacatatagctgcttcttccaactctgtgtttttccggtttgatctaataacggtggctatgaagttggcggcgtggtgaatagcgacggagatggaaggatcagccatgaggaggtggtgattagtgagaaggttgttaagacggtggggagatgaggaagtgtcgacggcggtggaattgaggagatggagagatgtacggatgtcggaggggaggattggtgttatctccggtgggaattgaggggaattggtgaatgaatcggtgagggagcatgcggcggagcagtagagaggttgcggcggagatggggggagaagggagaagcaggaggagcagtgagaggagaggaatgagtcgtagagagaggaagcgagtggagagagtggcggaaatagatctgtgcggatttcgatatcctccgccgcgcgtatctccatctccgccgtatgtcaccggtttgatattttgccggttttactatgttagctacgacgtcgtttaaatggagagaaagcaaattaaacgacgtcgttgtagattgtgttggactgttggtaacgttagtccaaattggagtttatgaattttttagatttaaaaaaataaataacgtaatttaatattgttgtactatttcggttgtctccggggaagaagag

SEQ ID NO: 5358 - DNA, 3000 bp, Unknown
  misc_feature (1)..( 3000): cDNA_ID_3076769_gDNA_ID_1620782_Annot_ID_167992 3000 nt of promoter + ATG
tcgaaagaaatatttgagtcattggtggatttgtttctttttcatgaacaaattgttgtgtgcttcgtataaattaccaacaatctgtataaaatctaacatcgtttgaactgatgtaccttttgtttttctaatatacttgtacttactgagatttaagtttaatgatattgtctatgtgtttatatatatacacacataaatacatttccatatatatttttaatacatttccatattatttaatcaatattcaaaagtatgtgataagttttccataaaaggaaagatacatttaatatttttatttattaatttggacataaatttggtcaaaaggttctattctttatttttttctgatttagattggtttttcatgttaattcattattaaagaaaaatacaaactttcattctaattttatcaaataaattttatttgtagatcgtaaatacacatagatgagtaaaaaaacgctataagcatttgttaatgttttattttaaccaatattttcaaatgcccatatggcattaactatcttaaaaaattagttataaaaataagattaatgactttaatgggactttgcataattaaatccatgagttgaaaatgtttaatgggactttaacagcatcacttaggcccattagcccaatgcgacgtcacctctagttgagatcgagacaaagtgaaggtcgacgatttcaaggaagacctaggatcgaggagagaattgacatgactagtggacgaagtttgaatgacgatggtctaattaaaaaagaggcaacccctagaagagataattgtctattagctctacaataacacttaagcaaaatactctaataatacattgtaaacatcaatatacttgaaactaaatgcattacctatcctatccgaaatgaaggaaacaaatagaggtacatcacgatctaccaactgacatgaacttttgacgcctaacctgacaaacgtctcctaccacctaatcagaagttccgttgaatgctcttgggcattggttgaatgaagccaaaccctagaaagagcaaaaaaactcgcctccctagccctaaagaagtgaataggcctagtctccatggaactaaacttatggggaagatcgacaaaatcagtcatcacaacgacccaactcttaaaaggagagtcataaattacctcctacgactacctaaactttgcagagacaccatagaattgtcgcaaccaaaacgagtcgactttatcatgggaggttcacagcttggtcgtaacatagtaaattcaatcaaagcctactaacgaaaagtatattcgatctctggagggagaaatccctcgcaaggacccaactacgagatcacattcaaggaaagcaaagaccgacctaggcaaaccacatgatgactctctggtaattagaactcttagtataaaacatgatagatgatcccgagtttaaccttctgacaatatgatggcaatccactttgatgtgtttggtacgttcgtgccacacggaattggaagcaacatggttgtcacaatgcatgataacgaactgaattgtcttgactccgagatccaatatcaatgcatttacccaaatgagctcatctgttttgccatagattggtaatcatctttagcactacaccttgacaataccttctggtttttgcttctctaagtgacgaggttcccatcaacaaatatacaatagcaccagctttgatttcctatcaatcttgtgtgcggtccaatccacattacaacagctaacacggaatttttcatctaaaacaaataacgttaaataaaagtaattaaaaattaaataaaaaatagaaaaccttcttaaagtactgacacgcataatgacataatgacacaatgtgattatttagtaaatttgtcaatcaggaaaatctacataattgcattagaaaacgcaaaaactcagaattcgcattttcgcctaaaattacaattaaaaatttattatgcaaaaaaatagttatataattgcttatttatataataaattgttaatattctacacatactaaatattagcaattataaaagaaaacaattataaatgttaacatagaaattatatcattaataatatatataagaaaacattttcacaactttttaataaattttaataatcttatattttatcatcaaatattacttagactttattaaaattgattaaaaacattattttctttattaagtataataaaaaaaatataacttaatatattttattctgtcattctggaaaatgtatctaatcaacatactttaaaaataattgtattttataattttttattctgcaagttttcattcaacaaattttattctaaaagttatactattatgcaatgttgcaatcagagcctatatagttattgtgaacgaaagttgaaaaaatgaaaaaagggtttggctaaaagagacaagaggcacgaaaaagagagaaaaaaactcgatagtataagataaattagtagatagggttaaagcattgacgacgagacatagacgagagaccctctcaaatctcaagctcctttccttccttccttcgatctacactctcagattctctctctctctctttcctctctctttgtcttctctcaggcaagccaaaatctctgtctctctgtctgttttcatctctgtctctgagtatctgtttcctagcgatttggagataaaatgttttatcccttgattcgattcctgtcatcgatttcttccaatgttgtttgattgatgtttgtgttttgattagtgtcaagggaaatctttttttttgtttcttctgaatctagttcttttgaatttagaaattgaaaaagtgttgattttgattctgtgagcgggaaaaattgattgattgatgtgtcctactgtcaatttagtttaatgggtttgtctttgtttcaggttttgtaatg

SEQ ID NO: 5359 - DNA, 3000 bp, Unknown
  misc_feature (1)..( 3000): cDNA_ID_2144735_gDNA_ID_1620782_Annot_ID_167991 3000 nt of promoter + ATG
tttcagagtattgatgaagataagctattcaatctattttctctttacgggaacattgtaaggattaagcttcttcggaacaaacctgaccatgcccttgtccaaatgggcgatggtttccaagctgaacttgcagtacatttcctcaaggtttgtccatgtccctttatttgtgcatttgagattgtacttgggacaagttccgagttacaaagatgtgaaatggaattgttaatttatgcaaagttttgtttcttttgcagggagcaatgctgtttggtaagcggttagaagtaaacttctcaaagcatccaaatataacaccaggcacagactctcatgattatgtaaactctaacctgaaccgcttcaaccgcaatgctgcaaagaattaccgctattgctgctcccctacaaagatgattcacttatcgactcttcctcaagacgtgacagaggaggaagtgatgaaccatgtccaagaacacggtgcagtagtgaacacaaaagtgtttgagatgaacgggaaaaagcaagctctggtacagtttgagaacgaggaggaagctgcggaagcattggtatgcaagcacgcgacttctctaggcggatcaattatcagaatctccttctcccagctacagacgatttaaaatcacgaaagacctctctctctctctctctctttctctatctctctttcctctaataacattagggtttggtgaggattaatgaatgtatgttgcttttaacttaaaactctctgctctttgttctgttctctctgttttttctttttaacgtgttggttttaattgtttgtcttgatttcatgggcttaacatttaatggtaataaagacataagaaaaaaaatggtagagacaattgtagtggtggttgtataatagtgtttctgaaacttcattttgtatcctttctcatttatattatgtttagatatattctcatttattttcttccaagttattgttcataaatttttattatatcagattactagattataaaagattgttcttctatatgaatcaagtttattgtttttcttagttgtatatattgtcttaatgagatccaaatttaatgtcacacatgtaatatctgcataaatgtaatgtgatatgcacatatatttcttgcaatatgcatatgaatggcatgcatgtatctatatttgagatatgatttgtctataatcatatctaatttttgttaaatcagatactacaagaaaaaaaacaaattcttgtcgcaaactcataaaattaagttatatttttttttcctgtagatctgttgttttagtatattatattgtatagaattttaataaataactaacttttgaaaatacaatttttttacaattaatgtaataaaataggttgactaaaaattctctaagaatcctaagtcggtgaaattagttcaaagtattctcgtcgagtgaaccagtgagattcaaatactcaagaccaaccttagatacttttctatagacttacgagacgccgcttgaagaatttcagaatggagatagaaatcaagttgcgttcgccctagttttctcccagtcacaatttacgaggcgtcgcttgaagaatttcagaatagcattccctggccggcgaagcttctccggcgtccctccctcctaatcggttcagtctcaactctctcgagctttccagcagtcactaaagctcttccaacggttttcggtgagatttctctctcttgatggtttgtcggaagctttctcctcctctcgcttccctttgcctgagattttctccggtgttgctgcctgattttcctgctaaactggaaccaccggacttgctaacatctcaaatctgtctcgtctcggttttcctgtctacttgttaacaatcttcaatgcctattggtggcatatccttcgccgtcagacgaccctttactgcataccctttaaaaaaaataagttaaatatatatacgatagttttattctatttattcttgagcaaaatagtaaaaacaaaaaaacattctctaaattttattaattaattagtggaatcaatgattttataattttcaacactaagaagaaaaatatgaagaaacatttgatttagtctagtttcttatattttgtttacaaccaattgcatcctaacaagttatctatcatctttttctcatcttttgtttcttaagaattcccatttactcatttgtaattgtttccttattaatttgttttctttagatactttgagccctttaaaattaaggggtcttgtaatcccattaaaattgtgttttaagaaaattaataatgtttagtatgtatatttgattagattttggggaataattagaaattatacactttgatcctatgggtgtatatgaagttctgcgtatactgatgatatctgatattgggtaaaaaaatcaagaaacattattcttggtggtttattgctagtgactttaatgatttgatgcataatgattagaagtttggtgctagtaaattccagtcatctaaaggaactcttatatcatgaaagagttaaagaactatcgttatataatatttgtggtcgaaggggattcacccctacaattccatgttatttctcctagtacttattttgcaaaaaatttctaaaaatgtgagcccgtaatatttttattgaacacggttcattaattttaccaaaatataattttcattcttagaacgaatacttagtttggcaagaaaagtttccgacaaataaaaagaggttacataatttgtttttaaataactttctatgttgttttgccattaaaaaataatgagcaagtgcagtatcacatctcatcgtttcactattcagctccttatagccaacctaacttgcaagattattaaactattttttttttttgactattgttccaaaatgagcacaaaatcaaacccaataaacatg

SEQ ID NO: 5360 - DNA, 3000 bp, Unknown
  misc_feature (1)..( 3000): cDNA_ID_2992614_gDNA_ID_1620782_Annot_ID_167989 3000 nt of promoter + ATG
gtgtctatgctgactaatgttgtctctggtgagaccgaaccctcggcatctgcgacatggacgatgggtcataagagagaaagagaagagttttctttgcctcctcaaccattgattaccggttcagctggtatgcatgtttttctaaatcgaatttttttttgttgagaacactatactaaccaataaaacattctttaaccaaaaacaaaaatcaataaaacagtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactctatgcaaccttctctgacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatattgtcaacgctttgtatttctacttattcgatctaccaattttttctctcccaatacaacttcagtctgattattgccttcttagatatgtcttcgaatgttatgactatacatgggtgtatataaaatttgtgatcaaagtcttgtaattagcgtgtgattctacatctttttcattagaaaaattgggttttcaaaattactaactcacgtgatcgcaacacatgagtataacataagatgtcgtcactaaccaaatataattttgttaatatatttaaagatagaatcagaaaatttcttaaaaaaagaagtatatacaataaataagaaattattttgtttatatattcaaactctttttattaatatattaaactattaacctctttctattaattttgttgttcttaatatattaaaaaaaagaagttaaaattctttattgtatcggaaataagaaaatgaaatttgttaacaaactattaaactaattttgttattttgttgttgttaatatatactccaaattgaattagttaataagtaaaaggctttagaaatcttttccaaattgtcaagataaatgaactgtaatcttcagaatagagaatagtggcttacaaagagctctcaaaaaagttgcaaaaaaaaaaaacgtaaaaataaaaattaggtctctatgggttttatacccagttaaataaaataagttatgaaactggataaaaaaaatctaatcgtagcatcaagaactggactgatagatctagtaggtggaccgcttgaccccaaggtgtttgaaaaacaatcttcgacgtcgtgacacttagttaatcgatccactctttgggatcaatcaatcccatcccttctagaaatctggtgctcgacgattaaaacccgctctttgtgaatttggcacttagatgggtgaaggttggaccgctcggtcccttataacctctcaaccacaaaggttcagtcttatcgcatgaaatcaattagtaaactacaattcatcctaacaaaaagaaagctatagtagtccatatattatgtagtttttgcttatgagtgcacataatgatgataacacaataaaacatggggtttcatacatgagcggagtaagaggtgttgtactagactaaagattagtttagcgatttagaattagcaaatagtgttaaaaatgacacaaagaaaaattttgaatgtataatctaatacatgattctcaagcctctaaatgagaaatattaaatctagattaagtttaaatatataaaatttagcttaaatctaaatttcaaaatgataggaactactataaaatcatatagtaacaagatacaaaaaaacatccatgtgttaccttaagttatatttattccctttagtaaccaacaaattttaactttctttcacgacaaaacttttgccgtctacaattcacacacacttccaactttgaagcttacatacaatacggtggcagcagtaacacacaccattatactacaaacatcgataaatttttatcaataaccatatcgatcatttgacaaaaccacccacggagtaaccatatcattataagtaaacataatgaaatttttgcttcaagtgaactgtgaacatgtgagtgtgttatcggatttagctgttgtcttttctttttatacgaaacaaaaaataaataaaacctttatcaaatttgtacaaacctctgggctttatttaggcccaataacaaaattcggcccatatttgagaattcacaaaacctagatactcttactataaattggaacatcattgatctaatacaattaattactgtgttaatattatttatactcaatctgaaatgtctttttttagctgtccaccagtttccaatctttgaaatacgaaacaaaaaataaataaaagtataaaacctttatctaatttgtaaaaacatttgttgggctttaggcccaaaacaaaagtcggcccatatttgagtgttcacaaaacctagatactcttactataaattcaaactagggttttaaagctcatttctctcttgcagtcctcatcgttggagcttagaagccgtcggcacaaggttcgtctttctctcatccctttcctcttcctttgcgtgaattcaccagaaaatgtatatctaccttagcgagtctgtctagtttagcgaatctaggataatctccggaagacacttttgaatcatcactgtttttgatctctgtttctttctctaattgtgttgttgtattactgttgatgtagaagaagaagaagaaga

SEQ ID NO: 5361 - DNA, 3000 bp, Unknown; identical to SEQ ID NO: 5356
  misc_feature (1)..( 3000): cDNA_ID_1807959_gDNA_ID_1620782_Annot_ID_167988 3000 nt of promoter + ATG

SEQ ID NO: 5362 - DNA, 3000 bp, Unknown; identical to SEQ ID NO: 5360
  misc_feature (1)..( 3000): cDNA_ID_2992614_gDNA_ID_1620782_Annot_ID_50370 3000 nt of promoter + ATG

SEQ ID NO: 5363 - DNA, 3000 bp, Unknown; identical to SEQ ID NO: 5067
  misc_feature (1)..( 3000): cDNA_ID_1828450_gDNA_ID_1620783_Annot_ID_50373 3000 nt of promoter + ATG

SEQ ID NO: 5364 - DNA, 3000 bp, Unknown
  misc_feature (1)..( 3000): cDNA_ID_2993390_gDNA_ID_1620783_Annot_ID_50374 3000 nt of promoter + ATG
aaaattttaatggggccatcttagccgtccaactcctttttctttaatcagcttttccactggcgtacctttccagatggtgattacgtgtctataccaatctttatgaaataaaaattagcaatttggttacaaattcaaaaatagcgatagaagtttgatacaaaattgacacttcaatttccttccaataccgcagacaatatgatccgtccctttgaatacgatagtccttttcaactttttaacatagtacttaatttttatttttgacatcacatagtacttaattaaactactatatttatcatgtaattgagtatcatttgtgaataagatttgactctctttcttttccggaaaataggtccgatattttcttttatattcttgatttaatgaaatggcattttctaattttaaaattaattgaacagtttgaaaaaaattaacggaaaatgttatgcactgcgttcatcactttttggtgaagaacttacaaaacattctgaaaattttgaaaatcctattaagtttagataaaaatttataaagttttcgtagttttcaataatagtaataaattcaacttaatcaacaattttcaataaggatgaagaaaaaatattaattataaaatgaaatttttaaaaatttgcattgaacatccttctcataaaaccagttaaaatttttttttagtaagcatccttttcatactttctaatagacagaccctgaagagttctacaccaagacgaaactgcggtgaggattttatctgacggggcaaatcagaccggctggtatgtggacccactttcaaatggaatcatacgtggcatacagtcacgtgtcagcgatcggaaacaacttgtcaccacgtcattatttctgactcttatgggtcctacccaccggcctattacttgtcgtcaactgtccacgtagatttttaacatggaaaagatcaaaaactgtaatttaataacaaaatcagtgacctaaataaaatgctgggtaaaaaaatagaaatctcaaagccagaagaaaaaaataatttcaggatactggatactcaaaataaagaaggataaatatatatagtttgttataataatgcgtacaattataaaatatttatataaatgtaaaattatatatagaacatataaaagttctatcgtatacttttaacaagcttataattaagtggatatgaaaacgattaattcacgagtgactatgactcactaaaatgtcattttcattctacccaaattcaaatttctgtaattggttccatatatttcccttacatagaaaatcagatcactaataactaatatttacctctatgccgacttatgaatatattgtggtcaatttcatatatatgtttcactggatacaaacaaacatatattcatatataaagtatgtactattcgctacttttgcggttttacattccatgtgatatcttatctggatcagtaaataatttgctttgtacaatgttaagcaaacgcaaaaatccaaatgctagagtttataataaggatccatttatgatatatcgtgttattttgttagttgtttacactttatatcactcacattctatctcaattcatacaaaaagacgtagatattaattaattctagctttaaaatgatcaatctatatagcaatctaagaacagttatcatctgtgacaccaacattcttaataacattaccgactataagtgaataaatgatcacctaatcttctatgaatgataaaaaattccaaccaccactttcaccgaaattgttactcgagggatcaacttctttttgtgactaatttgaggctaaaactagtaagaagaaataaacaaacaaactgtatttctatcaaaaaaacaaaaccaaaacattgtgactctttaacactgttttaatgtcttggtagaattcgctgatgctaactaaggtttaaacgttttaaaaaaaaagaagtttaagttgttaaaacattaaatcgaccatgcacgatccgagatttgatatgattttttagtgggaagaattgatgaaaatgatttgatattgttcataaacatgttaatatgtttaatatcatgaaaaaatattgttcataattaaatggcacaaagatttacctattgttttgagttctattttagccaattcaatcggtgttcctatattttaaccaaaatacaaaaaaatcgtatttatgtcattatattgttttcatgaaacatattttttcatatccaacctcacttatgataatcagtatctaacacgacatctagaattatgagtttctatacatttttataattaaaatttcagattttttggtatagtgagaattgtagtgcacggttaaatcaacaactagactaaagacgactccatatcattaacattctcattcattgcaatactgtttctgccatcgattttctcctcaccatcatcactccttcaaatattcattttaactatagtttgttttcatgctataatgattctatatttctatcaaacaatagttacagaatttctttgcttaagaaaataatatatatttaaatctataatattcacgactaatagacgttaattgcaagtggtgtaagatctgtatatgatatatattttctttcacgatcacaaactgtacatgatgtttctttctcaaacatctatacaacaaaagcttcattattattgccagagaataattatgcttaatatgtgattttgttttaggattttttttttttaaatatatcttgaaaaatgattctaaagctttttttttttttttgataaaggtgtatttgtttctcctataaattaagccatcttctcaaccaaactcttcactcaccaaagcatcacataacactcacacacacactttctcttctcttattttctcagttcttttaactcttttctctacatatattcaa

SEQ ID NO: 5365 - DNA, 3000 bp, Unknown
  misc_feature (1)..( 3000): cDNA_ID_1828432_gDNA_ID_1620783_Annot_ID_50380 3000 nt of promoter + ATG
tcaggccggtttatgggctctgcccacggcacaaggccaaacttttttcgttttatcaacttcattagcttataagggccttcaatttatattttagttttgcaaaatagggtccaaggcccatttatattgcttggaaagagtgagaaactgttgctagttatcttttgagagtttgattttttaacgtcttttattatttctaaacaagttttcatacctagcgttgggtggtccggcttggttgcatgaacggatagcagtggaaagccgttcgagtcgatgacgtctaaagtacaactcttgcatgggatgagctttttccgttttgtctttggttctaatctattatgttttgcagtccgttttctctgtatttctgttttttttactctgtttctttattactctgtttcatttattaagacgttaaggagaaaaaacaagttttcaaaccaattatacaaacatatcatcaaaattatcaaaaataatatagaacgataaaagataaaaacaagttttgactctgctttttttcgaaaagccttcctcgctatcggtttatcaaatttgttatttttctttttcgtactcgaactcaagcatgcgttatcacatataaaaccgacattactttcgcggataactcttgtttttactgctcatgatgctttactcggtagtccaatctttgatctatatgctctagttattatacccaagggtaagggatgcttgatcgactaatgtatcttaaaaatgtttcctacatgatgacttttgaagaatccctacaagaccaaattattgatgtagattgatcacctacacaaagttaatgtataagacttttgtaggaaccatatatggttaagatctaagaccatgttattgatggtttttgtaccaaaaaacgtcaaaatcgtttatttttgtaattttatccttcacgtccaaaaaatacagaataattatatgaaatcaatatatgtaaagttgttaaaataggctatatacaataccgtattatttttttacttcatatgattttgcattttttcgacatgaatggtagttgaaaaattgttgattttaagattgtttttttttttgcataaaactctattattgatggataaagtcagaatttgatttttctggattagaaaaaatcaagaaatttactaaaaagaaaaaagaaatttacggatgtcaaaaaaaaataaaggaagaaatgtacaagctacaaacaaaaatcgggtagttgtgtcacgtttattcttcacttgattctacaatgattgagataaagttgccgattttgccgggtagcaaaacacgtgaattatgcaaagactgaaataacatgacttgacgatttaaatagtaagcttattaaatatttcactcaacccacaaaacgcaattaaccgaacggtccaagccttcgtacttttaggtggctattcgttgaagaagataaatgaaagagagggtacgtgtccatccatttgcggttaggtctgggtccatggcccgtccctttcaaaatgcaatcaaggtccgtaaatcggtaaatgtaattaagaaattgtaatatccaagctaaaacttactctttccgttttaaaacgggatataagttgttttagagtttttcttttgagtcaaaatatagatgttttcatatcttcatataaaagaaatattaattaaaaagttttatctaaaaggtttataaagaattaaatgactgtttttcttcattggctttcaccgagtatttcttattaaaaatatatatttgactaaaagcataaattttatcaatctctgtcctaacttccaaaacatcttacattttgaaatggatgaaatatttttcttccttctctttcttcatttgaggtatatatgaatttaatcacacattttaaataattaatgttaaaatgataaatcctatgtttttctattatgaattttaaaactagaactattgaagtattgattgtggaaaatattttaatatccagttattgaaaatatttttaacaatggtttttcaatatggtttcaaaattcaagatgatttgggaaaagttaagtttattgatcacatgcaccaatatatatatacactaatacacaattatatatattaatttaagcactaaacttactaatccttatcttaacataagatttatcccgtacccactctaattaataaacatatatctccgaaaattgtagaaccatataaaactttaacacttcctttcaagtttgagtatatatgtaaatcacaaacgctcaacttggacaagtagctaaaacaggaacttctcaaggctatgtggttcgaacattatatgtaataatattgaaccacatctcttatactaagataatccgctttgatatttttagttttctcatagaacattgggttaacagcaatgtgcaatgctgatttcctatcacaaaacatcaacatcggatcactatgcttcactactcctagatccgtcaaaagtctcttactattttagttcaagctggcagccatgcctatatactctattttgacgatttggtttacaccggtaacggttgttgaatgaagaaaatcagattttaaattcgatcatattcttttattaagttaaattagtttgtgtattgttctgacaacaaaacaatttcagctaattttataacaaaataaattgtgctttttcggatatttccccttccatttttacaatagaatgatcgaatatttttgtatgaagtatattgttcttacaacaaagatggttttttttttgtttttggttaaagtacgaaaatgatgatgattagccatcttgtttcagttctattatataagcccattaatagcacggaacgacctttaaccaaaacacagagatcatacgacagtctcctaccaaataaagaaaaatccaccataccataaagttcaaatat

SEQ ID NO: 5366 - DNA, 3000 bp, Unknown
  misc_feature (1)..( 3000): cDNA_ID_1828424_gDNA_ID_1620783_Annot_ID_50382 3000 nt of promoter + ATG
acaacactcttactcttttgggcctaacttaactaatagcccaatatttttttactgcaactctgtttcagccatttgggctgctctggctaaaggtttatggaagtctagatacacgacaagttgcccccagattctggctcatgtttcagccccagatcaagatcgtttggaaggtttccttctccgctatgtattccaagccacagtctacacagtctggagagaacgaatggacgacgacatatcgaaccaccgaacacatcggctcaattgatcagttggatagacaaacaagttaaaaatcaaatcacaaccatcagaagcatgggggattagagctcgctcttgattcatttcaaccttttcagcaattagcaagtttttttaatctatctttcgaaaacacgatgcaatagttgtaaaaacgttattttttctttgaatataatttaacattagaatcaaaaaaaaaaaaaaaaactaatacccaatattaacattattacaaaacacaccaagcccaactctttcttcttgttgaattgtgtccttcttatgtgtcgttgaccctttttacacgacacttcttctgcgacttcttcttcgtggagcttcttctcttttcttcatctcttctcactgaagcttccttttatttgtgcaggttcaattaaggaaatcaacttcaacaagttttcatccttcccatttcctcgaaccaagaagatggttttttgtgtttttattttgggggtgtgccggctgattttaagaagcatataaggaagtaaggatgtattctgttctttttaaaggttaattgcataattatatgggactttacatttacttcactgatgtacaaactgatttggtattttggtttgttttctggtcgagcaagtgcatgcaatacttttcttgtgccaagtgcaacaaccatcaaaattcaaagtttctctgccacaacttgaacttgctttaggtgcaactgtgcaagatctactaatctcacgtcacgcctctaccctcaaatctttgcaacttcggttttatagatctgcttctttttgtacgtttctttgattagctgatctccaaattaacgaaataaatggttcggatttgttactccatttacggattacttggcaagaaaatccttaatttttcttcgcttcttcctcctctcattttttttttcttcactttgacaagcaacttattacagagaagatatctacttgtaacatgaatttgactttgaagtgtttgctagctctgagcctctgaggtccgttagttcttagagtcagatcacatgattgatagattcggtgtctctttctgagatttcagcatatatgtttgattctgtctttttataggttgataaatcgattcatgacccactggaataatgagaaggcttttaggtatgattacgttgaaaaaatcccgctttcactctttgaaagatagctgagccgagatggccagattaaaggtcatgaagttcactgtttcagactatgaagggaggttaggagtttcacaagataactagagaaaattccaactgcaacttgtctcaagaaggaaatgtaattatagataaacgaaagaaagaacagaggaaaagaacagtgatgttgggtaggaaaacaggtgaatgactttcaacgtgcctgaactaaaatgaaaattttcccccataaaatacatagcatcgtaccaattaacgtaacgatcctttcaccctttgtatttctgtgtctagtagttgaagaaatgttggttgaattcagtttggtttctctatggtccatacgtagaacatcaactaaaatcataaagctaattaagaattgtgatatagtgtgatctagcctacgcatctcttgcatgttttgtgtaggacgatttaattgtctctaagaaaacacaactctccttttaaagacacccatatatttcttttaatttatatatatttgaatatatgctcatttaaaaacacttatataaataatcaatgtggatgctctcaaagttttcttgacagattttggtgctaaatttttaaggtacattcctggattttttttcattgttttctattttgtaaattgacttatagagaacttctattgatttttaaaaaaaaatcatagcgcgagtaaatgataacggtaacgatgaaatctaatgagtaatgagaatgaatatgtatacattgatttttgaatttattcgtagtgcgagtaagtgataacggtaagtctgtaacgatgaaatctagtaatgattaatgatttctctttcttatatatatatataaatgaaatcagcgatgtggaactttcgatggatgtaatagtagctttccaaggattgtcttttttttttcttgtccacgaaaatattaactgtagacaattatttgttgtcccatctccaccaagattcctgccttgcaaattccacacgtgttttcactttcttcaccaacctactggatttcactagtttgtctgtaaattaacttgcttgtctacgacagctaaataaataaggaatcgtaaaagactagatttatttaataaagaagttacgtttataacgaaaaaatatttcttagcaaaataagattatcttgtgatgaagtttcatttcaacaaacataagatgaacatgataaaaaaaaaatcataagaataagaacacaaaaagaaatgaaaaaggacctattattaaataaataaactttgacaaaagcaatgcccggagcttaaaaggtcacataaaaattgaaaaatttctaatcacttacacgtcgttcaccgaacacgtggattggaatgagtaataaaattccataaccattagatgaaatgtaacatctgtaatcttgccattaaaatatagtatttatatttggcctgaagctgatgcaacttatacacaaaacctactattattaagatttgacaaaat

SEQ ID NO: 5367 - DNA, 3000 bp, Unknown
  misc_feature (1)..( 3000): cDNA_ID_1828420_gDNA_ID_1620783_Annot_ID_50383 3000 nt of promoter + ATG
tactagaatcgtaaaacgtatggattattttacattagttgtgttgaaacaacaaccaaaactcacattttgaagattccctcgttgtcgcctaatatattttgggcaaaatatccattccatgtcggcaacgtgtgccctactagttaacaacacttggcgtttgatccattccatgtcggcgtgagagatggtgagatggcgaaagctgatacgttgatcaatagtattattttaaagtacgtatacagatatactgttttaaagagttagtttcgtggtgatacagactgacaggtacgttaagttcgacttaacgtaataacaaataaaaagaataacaggttgttttgtttggtctacaagactacaagactacaagactacaagtctacaacgaacaagactttttataacataagtaagactttaaagtaatcaacatagatgcctaagatgatttgatttacttggccgtcttactagtcactggttagtggttacccagtttcttaaaaaaaatgttattattctgattaattaagcagatattttttttttcttttttaatagatatacagataaacgcatttatcatatttcataataaagtaaaaacgattatgatcggacatacaagcgaagtaagtaagtgtgattattaacaaacaaagagttgattgaaaattcaattgtggctgtaaataatatgtcagtataaaacatatcaatttttaactcattatttttaagggttaatatgttaagtgatcaaaacaaataatttaatatttcttattgatcgataaattaacccttactatttttagaattttttactttttattttcaaatctaataatcataggaaaaaaaaataacacacaaaacaacaaaaaatttccaaacatagatcgactaaagaaatttccccctcataaatttcttccgcatgtacttgataattacagcttttattctttaaaaccattttggcatttttgaatggctacttaagtgtggtatcttccgttccaccttatataactgtcttgcttcgtgctccattcatttcatagtgtacttattccataaagatgactttacacttaattcttatcatagttaataagcacttaattctttttctaatgtgtcatgaacacatgtgcacggtaattcgataaagccagtatgctaaagtgtaaaggcacttgtctattcttaagcaataaatcactgaaaacaatatttatcggacaaaaaatcagatgtaatagatcatttatgtttaaatcagtcaaattcaagcatattaaagggtgaagttttatgaagaaaaaattcaactaaaaaaacaaaatgacacttacacagttacactgacataactaaccaaatctaaaatttataaatttgtcacatcgtttaatcgttatctgtagctttattgccttttatctatgtcatctacatagatggagtagtaagctgagaagagaaggagaaatttaaggtcaaagttacccatcttccgacatgcacgtggacggccgaaagttcacgagaatcttagattattccacagtgacacatgtcggcctttgcgtgaggaagttttttggtctctaatttttttttttttgaaatataaaaggagataaaaataaatacgtaattaattatacattttaatattaccgttaaattattcgttataatctcctatattgaaatttgaaaacaaaactttattaactataagcatgataaatatataaccgtttatgataattctgatagtatacgtagtttttttttttttttttggtgagattgtttatgaaattagcaaggtttgacctatcatcaaaccttttacctcatgcaactaattaatgggtgatttcttttttcaaaattgtttttaataataataactaattagtaattagtgggtattttaaataccattatgccatttagctaaggtaaaaaatcaattgttaattataacacccaccaccaacatagattcgtctatggttcattcatcgtgtttaagagttgaaagaaataaattcgcccatcgtgaataatagatatttattcatctcaaacttataactcaaatatatttcaactatatatcgatcaaatagtatagcttttggttaatgacgaatttttattcttttgatccataattcttcttcttcttttttttctgtccggatacatgaaattgatgatacacatttaaaacaacaattcgaatcagggaacaaattacagccacaaccagtgatgatagaccatatatatgatttagtttatttaataaataatgtgtaagcaaatttggctttgctgtaaaaaaagaacacgaattttggcaaaagtttctgttaggaatctggttctattctcctctgcaacctccagtctctcatgaatctggttcggattctctttttccttgtttctatataatttagatacatggttttataattctatcatatgtctattttggatatagtattttaaaaatatatatatttttcataaatggttatggtctattctatgttaatgataatcattagtctttttgtcaactatgtttttttttccaacaaatttagtatgtaaacttttttttactaccgttttattaaatcgacggttgatcagatcaactccggtataacacaacataagtttcgttatcaaaacaaaaacaaaaacagatttttttttgtcaactaccagtgaagattagtcttacgtgtcaagaaaccggataaaaatatataacgtatttgggcaatcagctaagatattaactaacgcggagttcattattaaaatggagtaatgatgttttcagttttctatataaatcacgtcgagaccgtagagtcttacacaacaatccttcttacatttctaccaacaaaacacaaaacacaaacatagcattcaaaactttgaaaa

SEQ ID NO: 5368 - DNA, 3000 bp, Unknown
  misc_feature (1)..( 3000): cDNA_ID_1828416_gDNA_ID_1620783_Annot_ID_50384 3000 nt of promoter + ATG
tatctcaaaatttgatatagtataaactatgtcggtatagtcagatcttctagagagttgtggtatccacaaacaaagaatacaatcgcagattcgcaaaacacttttcattaaatagtaattaataatcacatatagtactctttaaaatgtataaaagtcacttttggtttaacccatgtgggagggattaaatggaatagattaatttgctttgatacatctttaactgtataataataaaccaaacgttgactaaaccatacattaatttgcaggtggtggtagtaatcgggaattttgcgagtggagccgatatcagtagagacatatctaaagtcgcaaaagaagttcatatcgcatctagagcaagtaaatccaacactttcgaaaaacgtcctgtacctaataacaatctctggatgcactctgaggtaaaaactattttcttataatggttaatcttgataagaaaaaattcgaaacaaattataaaattcttgcttctattaattattttatttttttgatatcttgcagatagacaccgcccacgaggatggtaccattgtttttaaaaatgggaaggtggtacatgctgataccattgtccattgtaccgggtatttaacaattctcaatttttttattttccgttacacaacggaaattaacatactaaaatgttcggtttactaatttttttttttaatatgtgaaggtacaagtattactttccatttcttgagaccaataattatatgagagttgatgacaatcgcgttgaacctctctacaagcatatttttccacctgcgctagctcccggactttctttcattggtttacctgcaatggttagttagtttcaatcgattaaaattttccgaagttttgagtgattcaactcttcttgatttttagaaaactcatcaatttcttggtttgatattgttataaccagggtctacaattctatatgtttgaagtccaaagcaaatgggttgctgcagtcttgtctggacgagttacacttccttcggtagatgaaatgatggacgatcttaagttgtcgtatgaaacacaagaagcgttaggtattcccaaaagatatacacataagttgggtaaatctcaggtacgacattttttagttacgaatatgctatggtaatatatatcaacttgaaaaagaatatagtttcaataataaattttgtgtcttttagtgtgagtacctcgattggatcgcagacctgtgtggattcccacatgttgaacattggagagatcaagaagtaactcgcggttaccagagacttggtaatcaaccagaaactttccgtgatgaatgggatgatgatgatctcatggaagaagcatacgaagattttgctagactaaatctgatcaattttcatccttctcgttttctcgaatccggaagatgaagtttgactacgattgtaattgtgtctacttgtttggatttaaagtacattgcattataaaaataatgtgtgagtaaatagtttataagagtgtgaaggtcttcttggctagggttacatgttgttcgatctccggaattagcttcatggtgtctagaaacttttgttttttagaccaatatgttaagaataaaagtatgtagttaattcccgtaagtttttatgaatccctggttcattgtgcaaatgtttttttttttgttattgttctgttaatatcaaagagtgtccttaaatgtatgcataattccctctttttggctttttgattcttttattggaagcatataagttagccaattgactttttcttacaataagaatttgaccgttcctcacatggttctgcatcaagtagattatactagagatcaggccccgcttagagggagtgctcgtccacatttttttccaaatgattttaagctcctaagtttttgatatttttgtaataaaggtcctaaattttaatattctgatgatgagactgtaattagatcaagtatagtgataaaggccacgattgttcaaatgaaaattttgcatttaacgtttgtgtagaattataaaataatctcagttttctttatacaattttcaggatgctaacgtaaatgaaaaaataataataaggaaaaaaatgtaaaggccacgactgctttttttttttttttttttgcttaaaattttacaagttcttatagaattgtatggtttttatctaccttatactccaatatatgggtcaattttgggttgttcacatattgccaaatctagctgcaaagctcgttatctcgaaattcacgaagcagaaatattgtgattggtcccaatcggcgaaagtgaagataagagtacttcgacaattgaaacaccggaaaaaagagcaaaatcatgtacgtaacttcaggattttgtctcttttgttatttattttttttggtttttccttttgtgggcaaacaagatattgtcttatattacaaccatggttcaatttgagacgtcagattgcagtgatcaaagtgaacttgctaacttcaatagagattctttctttttccatgattggcgactgcgtctcatatcatttatcactcttgtcatgtgagactgacacactcattgttcacttttgctgcgtcataaatcttttaattattaacttacaaaatatctcttaacaatttgaaatcattcaaaaacaagagtgatttgaatcaaactcttaatccaataaacgctaaaactctataacactgctgtatttattacaggacaaattttccttgaaaataagtaggacaatgattacgcagtagttaagtgaaaatgaacacgacaggtacgttgtgtttctccttatataattaacacatcgacatcatctccacaaagtctatatgaccaaaagatttgaaaacacttaaaaaatcacatattaattaacatgacacaaaaatcccattacatatcctaactaatt

SEQ ID NO: 5369 - DNA, 3000 bp, Unknown
  misc_feature (1)..( 3000): cDNA_ID_1828408_gDNA_ID_1620783_Annot_ID_50386 3000 nt of promoter + ATG
aagatgttttatttgaagctcgaagcctcatgtattcccaaaagatacacacatcttatggcagaattagattctcaggttcgtactgtatttctttccataacatgtatgaaaacattatccaaatagaaagcatacattaatttgaatgagtttttttggttacagtttgtatacaataactggcttgctgatcaatgtgactatcctcggatcgagaaatggagagagcaaatgttttacaaggtgttcaagagaatacaatcccaagccagtacatataaggacgattgggacgatgatcacctcatcgcagaagcatatgaagatttcgtcaaattcccatctaactatcccagttctttaatcgaaagagaatatacaagctgaaaaacatcacttgaagtctctgaaatgagggtatgtgggtttattacatgcgaaataatgcatattgtattgtaaacatcacttaaggtctctgaaatgttggaaacttacatgtaacaacattacttgaagtctgaaatgttcatgataggagcgagcttcttgtctttgaaggctattcttgtctcaacaagacaacaagtgattgcatcaacttctgtaacctagcaagaaaataacaaatagaattagtcatacagtattttatagtgaccagacattaccacaacgcgtcattagagtaaaagcaaaaaacgttaattcaactcacagcttttaccctcaaggatgatgcaagtgttttaagaaagcatatcgaggaagcttttgtctaatctcccatcatgcaacatattagcgaccaagccaatggttgaagcatctccaacaaacctgcaactcctcatttctctgatgagttcagctgatgctgctttgtcaccatctctcagatgtgccctgataagtgtattatatgtaccactatttggaagaggcccgtcttctttcattttttttagcaaggcataagcttcctgtaataggcgtttactacacaagcctgagatcatggtattgtaggttacaacattaggcttcactcctttaaggctgaggctacaaaatagatcccacccatcatccaccttcccagccttgcacatcccttcaatcatagtagtatatatgtaaatatcaagttttatctcactcttttgcatatagtcgaaaacctccaatgctttctctagcttcccgttattacagagtccatctaacaaaatgctgtatgtcattatatcaggaggtacaccatcagaaaccatctgtttgaaaaccttttgggcattatcacagtcgccatcatgaaaaagcccttggataagagtggtgtaagtgactgtatcgccaaccaatcctctatgagacatctcgcggaagagttccgtaccatcttctactctcttagacttgcaaaatccctttatgagagtattatatgtaactacatctgggaaacagtccttgctaaccatgaactcaaacatctgcttggccttgtctagacgatcatgcatacagaacccgttgaccaatgaattgtaagtgaaaatatcaggatctatagaccttttgatcatgtcatcgtacaatttctcagcctctacaaactttccttctttcacaaacgcatcgatcaatgcattgaacgtgactaaattagggttgattttcttctcaatcatatcactcagtagttgagaggcatcactccatcttccataactacaaaggcaacttatgagggagctgtaggtaacaacatttggtctaattcctttggtttccatttctttgaataggttgagcgcatcatccacatgtctatatttgcagagactatcaatgattgtgttgaagataacaacatccgcctctattttcgcagcttccatcttgttgagcagatttaaagccaaatcagtatcacctctcttacataatccatttactaccactccataagtaaccagatttggttgacagcctctttgaaccattcgatcaactaacgccacagcttcagaagctttgttgtggagaaaaagcccatgaatcaaagttgtaaatgtgattgtgtcaggtctataccccatttccaccatttgatcaaccaaagctacagcatctgaaatcctcttaccgtgacagtatccattgagaagagaagaaagcgtgacaatgctgggctcatagccgagtttcatcatcttgccaagaagagctaaagcaagagagatttgagagcgtcggcagaaacagttgatcaaaatattgtaagtatatagaccatgtacaatttctaacctctgcatcttctcacctagagagatgacaacatcaaactttttcatcttagcaatggcactcaacagtttattgaactcaacaatggaaggtaaaggacgagacttgaccatgccaccgaacaaaccaattgcatcatctaacttcatatcatgtaacccatttctcaatatctctctgtaatcaccactgccactagaaaaagctcgtccccagtaacacatcccgcaaagatcaatggaagaaggagcaattcgaggattacctttcccctgaagattccgatgaacaattctactcgtcgtcgatgaaactacactcgaaatcgagatcctcatcttctcgatttggcttcagctgattctcaatctcactctcactcctctctgcaaatcgcaaaccctacacggagagatagatatgtaaaccggtagaattctggtttagaactgattaccaaaccggtttactaacgattgaatttcgaagcgggccaaaactgttttgggacttccactaccctctagataaaacgcagcgtttaaacaatttctcaggaatttgtttttgtttttttaacattgtgtcgtggtgtgtgtggttcatgagtttttgggccacatatttataaagaggccgtagtatattcaccatcgttaacgaatctcgtaaaaaaaccca

SEQ ID NO: 5370 - DNA, 3000 bp, Unknown
  misc_feature (1)..( 3000): cDNA_ID_3076789_gDNA_ID_1620783_Annot_ID_168050 3000 nt of promoter + ATG
agttacaagtgaaagaaatcagtaattttttatttattttagaagtgaatttggtttgagacaaacacgaacaataaacttataaatctacttaattaattttctgcttagctgaatgagtttctaaaaaaatttggttgcttattaaagattaaacaaaatgccgattgcagatctttcacgtggttaatcaatttataaatttttaaaacaaaacaatcgaagttcaattttatttttgtcgtaatcgaagttcaattgttggatacaggtctgacgcgatcgtgataagattttatatgctatttaaaagaaatcatgtggcctggccaaacacacaagtgttattagtaaaaaactatcttcagacttgttttatataaatacatttatttgtatcacctattatgaattgttttttctccatatatatacgttgggttatatcttatttcaagtgggtagcttatactctctctgttcctttttgtttgattgtttagaaaaaacacacatattaagaaaatatattaaatgttgattataaatgtattatttttagtgttttacagttttctataactctaaaccaatgatagttaactatttttcttgaaaattacaattcaccaatactaaccaataaatattacatagaaaacttaaaaaattaatcttttagaaacaatttttttttctaaacaatcaaacaaaaaggaacagagggagtatttaattgcatcagttacaattttgagaaactctcttactaaaaataatataaacaattaataaataagtagagagaatgacaaaaataaaaaatagtttctctgcagagaaactttggagtaatgatggaaaaactatatgtataggtatgtgtttataattggacagaaactaaattatattaaatatatattttttttttttttgaaaaacttttaaagtatatgtaaatctattggtgagatggctaagtttctcttcttctattttttccttctggatattaagatctattatctcattattatatgtttaatccaagataatcacttacctgccggaattgattctcgttatatgtaaatcatcatgttaaacagttaaaaaaattgtgatatgatcaagtcctataaaagtttgaaatgatgatcaaacccaaacaaaattaagcttacaaaaagagaaaaaaataatatataagccttatgtttaacaaaatgtttagttgatataagtcgtttttaggatctgattggtgcacattttagctgaagaaaatgactcttaacgtcagctcaaaacataccaatcaagtaaaaagacaagagaaaataactatgctagctctactcttcatataactgtaaaaagaaagagatgttttcaccaatacaataggatgaaaatacttttcttttttgtttactccatttaaaagagttacttttactctatatttattatttataccaatgaaatcagacatttatatcagtttataagaggaaataaaactttaaagaaaagagagaaacatagcttttcgccaattttcactgtgtatctgtattcaaataattagagtaaaacaaaaaaaaattatacccaatcttaacataattattttcagcctttatttttcagctaagatgatttaccaatcaatttttaggtgagatagttatgatgcctaataaattggaggtgcaaagttcaacaaaaattttacttttatgtttaattgaaaaagactgcttctcagtttaagaactatggcccatttatagatactgattaaaacgtggattgtaaaatgtgggcaatcaatattattttaaaaatgtggagccatagttattaactgtgattaaatttccccctcctccactttcacgcaaactaatatttaaaacagtcttaactgtgattcaagtaataagatttttcttttattattatttgacagtacttcctccgtatcattttaagtgatattttaggaaatgtttttagaatgtagagttgtagaggaaaaactagcagaaaaacaaaaatgcaatttatatatagtacagaaggttagtttaattgtgtttcgagttaaatctcttttttgatatggaaaattattctttaaattaaaatatttaacatttgactttggataggagaagattaaaagctgaaaagctggaacttcaacacttttgagaaaagtgagctacaatagtattaatcttaccatttactgataaataaatatatactttctgttcaattttaatagttttcaaatttattcttgttgcacataaacaacataggatatataatttttttagttaggaaatatatgcttttacgtttctatgaaaattctagatatgattataatttactcttaaaatatgaaatagaaaaatggagtggaatattattatttagaaagatatatatatatatatatatatatatatatttgtttgtatgcagaatgttagaccaatataattagtggacatttctataaaaaaacaaaaaattgtggaatggatgggataaaaaaaaaagagagatcaaagataacattttaagatgtttttctttctttaattttcaacaattttaggcaatttagtagtagggggaaatgtatttctatgaaaatccaaatatatgctaatgtatgcaacaaggaaagatatagtaaccaaaactccacttcatattacaaacaataattatttttataaaagtattgacttgtcgtctgcaaacgtgattacgtgaaccttactggtaataatacaaaaatcacagctctaatttgccaacccaatccagatctctctagttctcaacttctcatataattattcattaatatatttattttgagattttggttgattttttgatatataaatattggacttgccattttctattacaaccatcaaatctcaataaagcaaaacgaacaagaaa

SEQ ID NO: 5371 - DNA, 3000 bp, Unknown
  misc_feature (1)..( 3000): cDNA_ID_3076797_gDNA_ID_1620783_Annot_ID_168045 3000 nt of promoter + ATG
gttctgaaatcaacagctttggtgcaatcggagtccaagccgcagctcttgagctagacgtttcatcagacgcagacactattcgaaaagcggttaaagaagcttgggaaatctttggaacgatcgatgttttgattaacaatgctggaatcagaggcaatgtcaagtctagtttggatttatcaaaagaagaatgggacaaagtctttagaaccaacttgaccggatcttggttaatatccaaatacgtctgccttttgatgcgtgacgctaagcgtgggggctcggtgattaacgtctcgtcgatctctgggcttcatcgcggtttgttgcgcggtggactagcgtatgcttgttccaaaggtggtgttgacaccatgacgaggatgatggctattgagttagctgtttataagatcagagtgaactcgatcgcacctgggattttcaggtcagagatcacacaaggtcttttccagaaagagtggctcgagaaggtaacggaaaagattgtaccattaaagatgcaacagactgtggatccggggcttacatctctcgttcgctatctcattcacgattcttcccaatatgtcaccgggaatacatacatagtcgattccggagctacactccccggtgtgcccattttttcttctctttgaaaatcttagtcaaaatcttctgtgcttgtacatacaccgtgataagaatgatgtcttttccaataaatggcagtactggcattaacattgaatttactttctcagatatgtttttttgtttatgtgtacaaagagaaatcttgataagcttgagaaactaagtgatgatcatcccattcgtctctatacgtctctggatgggctctcttcttcacgcccgttgcaaaatacatctctttcctccattcctctgtttctgagcaaccgcattgtgaagccaaccaactattgtactcaaactgcgaaacaacaaaaatgttgataatatgtttctgtttgctcttggtttatcagaagtggaaacataagttaaagagaattcatacttgagaaatgcccatttggtgagtatatcgctttgcaatcccttgggcatcaagtgttgagtataaggttttgatttccatcatcatatcttcctttgaaggcagcggtatccgacccgacaaaacaccagcgatccacttgctttgcagttcaaacataggaaaaggtacaacctgaaaaatgaatttgttacagattatttcaacagcttaaaaagctaaaggaaacatatgaaactgattcagagcaatttagagctgtataccttccatggtatcccaacgaaggagagccacggcgcaaaggctggagagaatacgtctttgtacaatggcccgacacggttatcgtctacagtaacatttccattggtttcaagaaacgggaagtgatacttatacctacgataagtacagagctttgttaaacaagcacacttttaaacagaaaaccagaaaactcaaaacgaaaacgaaagagagaatgaatacccagtgcaatgcataataacatcaaccgaaatcgttttcccattctgaaaaactacagaaccatcctcatggacactctcaatctgcgtgacatcgaagaaaacataaaattggttctcctcctgatcaacgaattgcggtaagtactatttaggagctggctaactcaccatcgaatgcatccatagattactgtaaccaggccgctcaatatacgtatcagcagcattggacctacaagccacatgaacctctttggcaactctagcaatatccctacttatatcatcagcacttgcagagttccctataagcacaacaacctaaaccaatgcaacatgatctttccacataacatcacaccaaagcaggtaacattatcatctttcgaaatgagtacctgatctctaaacggttcaggtatacgataattatgactatgcatctccttccctggccaagaacttatacctaaaagtttccaataacaaaatcacaatcacacttctcactgttcctatggaaactcgatgaatcaacggagattaccaggaatttcagcgtgacgaggttcaatgtaatgtccattacaaacaacaacagcatcataaatctcatcacgaagaactttcttctctttctccgtagattcaattctccatttcccgcttccttcttccgccgccggagcaaccttcacaaccgccgtatcaaaccgaatcatctcctcaatcgcaaactccttagcgaaatcttgcaaatacgccaaaacttcaccatgactcggaaacctcctcggatctctagattccgatacatcggaacgaatcacgaacgggaagtccctgtatcccatacactcacgggggagattagttcggagagatccatagacgctcgaatgaacaacggatcgggtcgggtcaacgcttaatggatcgggttcaatatgatcggtgtaaatccaggttcctccgacttgtttttgtctctcgaagacgaccaccgagtgaccttcccgacgaagctctcgcgccgcgactaatccggcggctccggcgccgataactgccacgtggtgtgatctgattggtgataaggaaggcgccattgggtttttttacgagattcgttaacgatggtgaatatactacggcctctttataaatatgtggcccaaaaactcatgaaccacacacaccacgacacaatgttaaaaaaacaaaaacaaattcctgagaaattgtttaaacgctgcgttttatctagagggtagtggaagtcccaaaacagttttggcccgcttcgaaattcaatcgttagtaaaccggtttggtaatcagttctaaaccagaattctaccggtttacatatctatctctccgtgtagggtttgcgatttgcagagaggagtgagagtgagattgagaatcagctgaagccaaatcgagaagatg

SEQ ID NO: 5372 - DNA, 3000 bp, Unknown; identical to SEQ ID NO: 5368
  misc_feature (1)..( 3000): cDNA_ID_1828416_gDNA_ID_1620783_Annot_ID_168044 3000 nt of promoter + ATG

SEQ ID NO: 5373 - DNA, 3000 bp, Unknown; identical to SEQ ID NO: 5367
  misc_feature (1)..( 3000): cDNA_ID_2053165_gDNA_ID_1620783_Annot_ID_168043 3000 nt of promoter + ATG

SEQ ID NO: 5374 - DNA, 3000 bp, Unknown; identical to SEQ ID NO: 5366
  misc_feature (1)..( 3000): cDNA_ID_1828424_gDNA_ID_1620783_Annot_ID_168041 3000 nt of promoter + ATG

SEQ ID NO: 5375 - DNA, 3000 bp, Unknown
  misc_feature (1)..( 3000): cDNA_ID_3076811_gDNA_ID_1620783_Annot_ID_168029 3000 nt of promoter + ATG
taggttactatataagttttggtctagaaaaaagctaactgactacttggaatcgaatgaaccgatcaaatatgaggctatgagctatgcataatattttattaaaatatcttagttttgatgtcaaaccaaattatttatttttatggtccgattaataatttagtcggtgtctctgctccacatagttttttgttcttttaataaaaaaaaaagaaagaatcattgagacttcattctactaaaatggctagctatactacggtatgccacgattgtgtgccctgtcatttccgagttggatggccctaatgaataattaaaattcaatggatctatatggagcccgtgaactataattgtttttttcttactcaacttgtgtaaggaattatatcttattattattattattattattattattattattattattattatgtgtaggtacatagactatggaactgtagaatctatgtgcatttttgaatttgaatagtgaaacacattttacataatactttatacaataaaataaaataaaaacacattgcgaataatttatcgtgaactggattggaccaacttgtaacaatgaactaaactttttatactttccgaagttacatgcagttttatttttcatatatgtgactaaagcttgaagctccttttatcgaacatataatcattctttgacccaaaaaaaacatataatcatttttcatatatttgcaaaacattttttttcttacatattaacactttaatttggtttgaatatatttactaaaaaatcttaacatgttttatgtggatcaacctttaattatcagcaaaaataaaaaatatatatatataatccacagcacaacagagacctaagtaattgaaaaatgatacatatttttttgttaccaaagtaatgatagattttgccttagaataatgcaagatctccatgaggacaaatgtccttgatgttggagtttagctgcgttttatgacaaaagacaatgatttgtatgaatataatataatagttctcttcataaaagtttatttccgtacgatccacacacgttcccatatctgcactgcatctgcatgactgcatgcataatgcatgacaatacacacaaactcctacatacgtagagagagggagatagagagactaaagagtcaaattgatagacagcgagaagctggaacaatacaaaacgtacgaaagattacacgcaaaagaaatttaaagaaggccatgcaaaaaccctagcttaattataacaacaacgacaataacagaaaacaacacttgttaattaaaaccctagataatcaacaaacctgataatcaaaagtaccacatatatatttgaattattacaaaagcctcgaaaaccacccttgatcatacgtacatttgttaaatcaaggggatgtttttagatcaagtgagaggagggcagacaaaaccagaaggaggattgatcccacaagtgataagagcttgaagtgcaagaggaatgaagatgtttaagttgagaagcttaagtcttatggttgtgcaaagacaaacggctgcttctagctcaagtaacccttgtaacactggacaacacacattctccaccggatttccaagtcctatatggatcaatcctcccaaaacatcaacacaggctccaagcttcaatgcattgatcggacacgttggttgtttgccgccgcctcctcctcctccaccggaaggtggaccatatggtggatagccggacgatggtggtgggactgtgaccggaggtgggttaatgattggagggagaagtcctggaggagttgtgactggagggagaagtcccggaggagttgtgactggagggaggagtcccggaggagttgtgatcggagggaggagtcccggaggagttgtaaccggcggtggttgaattggagggattatgatgggaggtcttgtgattggcggtggcctcacaattggtggtggatagacgaccggaggaggtcttatgattggcggtggcctcaccactacgggaggaggtctaacaaccggcggtgatttccctcctcctcctcctcctccaccatgatgcggcggtcctccaccttttccaccgtggggtgggggtttaccaccaccttttccaccgtgatgtggaggcggcttgctaccaccacctccaccaccgccgtgttgtggaggtttcggaaccggaggatgaggacgagtacaaggagtgcaagcttggatcgtgggaggcaatgtgatgaccgtgaagattaagaaaacaaagaaggaagccaaaactctcgaacccattatcgttattaactagggttcttgaaattttcaatgaaactcttgttgcattattgtcaaatccttttggcaaataacatgcaaatatatagttgaagcttaaatgtgacccgtgactcttgtatgggtgttaaccactacgcacataaataggtatagtgtttataagtgtagtagatttgattatttgttatggtacgtacaaacgaacatgtgtaaggcaagaaaatgaagaaaaaagaagatgttccaaacttcgagaaatattggagcattttattgcgttacaactaaaggttttttggatcgttgttggtccgatgcaaacttcaaggtcaagcccgtgactacaaagtatatatcagattatgatcactgtctccgaactaaagagtccgtgaaattgtttgttctcttatgtatttaactttatttctaatgacattttgttgaaacttgaaaagacttgacaacaaacagtgaacgcttcttaataacgtagagggtttcgttgtccgtacattcttaatagagaaaaaagcaaagctacaaggaaagagtggcacagtcgtaaataatggagttagatcattatggctttaacattgttttgagcgattaggcccaaaaggcccaatactctgatcatg

SEQ ID NO: 5376 - DNA, 3000 bp, Unknown; identical to SEQ ID NO: 5364
  misc_feature (1)..( 3000): cDNA_ID_2993390_gDNA_ID_1620783_Annot_ID_168028 3000 nt of promoter + ATG

SEQ ID NO: 5377 - DNA, 3000 bp, Unknown
  misc_feature (1)..( 3000): cDNA_ID_1828404_gDNA_ID_1620783_Annot_ID_50388 3000 nt of promoter + ATG
gaggaacctggatttacaccgatcatattgaacccgatccattaagcgttgacccgacccgatccgttgttcattcgagcgtctatggatctctccgaactaatctcccccgtgagtgtatgggatacagggacttcccgttcgtgattcgttccgatgtatcggaatctagagatccgaggaggtttccgagtcatggtgaagttttggcgtatttgcaagatttcgctaaggagtttgcgattgaggagatgattcggtttgatacggcggttgtgaaggttgctccggcggcggaagaaggaagcgggaaatggagaattgaatctacggagaaagagaagaaagttcttcgtgatgagatttatgatgctgttgttgtttgtaatggacattacattgaacctcgtcacgctgaaattcctggtaatctccgttgattcatcgagtttccataggaacagtgagaagtgtgattgtgattttgttattggaaacttttaggtataagttcttggccagggaaggagatgcatagtcataattatcgtatacctgaaccgtttagagatcaggtactcatttcgaaagatgataatgttacctgctttggtgtgatgttatgtggaaagatcatgttgcattggtttaggttgttgtgcttatagggaactctgcaagtgctgatgatataagtagggatattgctagagttgccaaagaggttcatgtggcttgtaggtccaatgctgctgatacgtatattgagcggcctggttacagtaatctatggatgcattcgatggtgagttagccagctcctaaatagtacttaccgcaattcgttgatcaggaggagaaccaattttatgttttcttcgatgtcacgcagattgagagtgtccatgaggatggttctgtagtttttcagaatgggaaaacgatttcggttgatgttattatgcattgcactgggtattcattctctctttcgttttcgttttgagttttctggttttctgtttaaaagtgtgcttgtttaacaaagctctgtacttatcgtaggtataagtatcacttcccgtttcttgaaaccaatggaaatgttactgtagacgataaccgtgtcgggccattgtacaaagacgtattctctccagcctttgcgccgtggctctccttcgttgggataccatggaaggtatacagctctaaattgctctgaatcagtttcatatgtttcctttagctttttaagctgttgaaataatctgtaacaaattcatttttcaggttgtaccttttcctatgtttgaactgcaaagcaagtggatcgctggtgttttgtcgggtcggataccgctgccttcaaaggaagatatgatgatggaaatcaaaaccttatactcaacacttgatgcccaagggattgcaaagcgatatactcaccaaatgggcatttctcaagtatgaattctctttaacttatgtttccacttctgataaaccaagagcaaacagaaacatattatcaacatttttgttgtttcgcagtttgagtacaatagttggttggcttcacaatgcggttgctcagaaacagaggaatggaggaaagagatgtattttgcaacgggcgtgaagaagagagcccatccagagacgtatagagacgaatgggatgatcatcacttagtttctcaagcttatcaagatttctctttgtacacataaacaaaaaaacatatctgagaaagtaaattcaatgttaatgccagtactgccatttattggaaaagacatcattcttatcacggtgtatgtacaagcacagaagattttgactaagattttcaaagagaagaaaaaatgggcacaccggggagtgtagctccggaatcgactatgtatgtattcccggtgacatattgggaagaatcgtgaatgagatagcgaacgagagatgtaagccccggatccacagtctgttgcatctttaatggtacaatcttttccgttaccttctcgagccactctttctggaaaagaccttgtgtgatctctgacctgaaaatcccaggtgcgatcgagttcactctgatcttataaacagctaactcaatagccatcatcctcgtcatggtgtcaacaccacctttggaacaagcatacgctagtccaccgcgcaacaaaccgcgatgaagcccagagatcgacgagacgttaatcaccgagcccccacgcttagcgtcacgcatcaaaaggcagacgtatttggatattaaccaagatccggtcaagttggttctaaagactttgtcccattcttcttttgataaatccaaactagacttgacattgcctctgattccagcattgttaatcaaaacatcgatcgttccaaagatttcccaagcttctttaaccgcttttcgaatagtgtctgcgtctgatgaaacgtctagctcaagagctgcggcttggactccgattgcaccaaagctgttgatttcagaacagagagagttgagacgatcaacacgacgagctgctgctacaatcttacaaccagctttgcatagatcaagacagatctctctccctataccagatgaagcacctgtcacaagaaccactttatctttaagttcacaccatggctccaattgcttcaatacctgcttctgtccacaaaaaaaacaaacaatcatcaagaaagtggaagggcaaaatggtaaatgagagaaaagaaatctcacagtttgatgattgctcatattgattgatgtttcactgtctcggtggagaagaaatacaatgacacaagttatataataaaagcatttctctctatcaaccaaaacgtggcaatctacgtctgtaataacagattcgtgtaagtttctaacacaccaaattgattattaaaaacattgtaatcataaattgtaacaactgtgtgtgattgtgattcatagattctaatcaaagaacacacaa

SEQ ID NO: 5378 - DNA, 3000 bp, Unknown
  misc_feature (1)..( 3000): cDNA_ID_1828396_gDNA_ID_1620783_Annot_ID_50390 3000 nt of promoter + ATG
agttttgattataaaaaaaaacaaaacgaaggcatgccaattttagtctgtaattaaaagttttgatgacaaagttttgttctctttttttatttggaaacaattgaaagcaaaactatcagttgttttagcttttttcccaaggaagttatatttcgacaattgagtttacaaatgtaatagaggaaagttaatttagcgtcaactattcagataaacttgaagatataatttgcaaagagaaagcttgtgaagttgaaaattcagggattgttccttttccaaggttgatttatcttcgtttaatgaacctactgaagttgaagagtatctactggagtcctctttccatgtctagagacaatcactatacacgaatgtcctaatctgaaaaggcttccactcgattccaacagtggcaagcatggtgaaaatgcatgcatgatacgctacagatatccagaatggattaaaggtgtggaatgggaggacgaagctaccgaaacccgattcttatcttcatgcgaacaggtctaacatttctcctcttctcttagttgattttgaaggagtctaactgcttccatctttaatgcctcttgtctctttttatgtgtgaacttttgttataggtggaagaaccataaaccccaagttgagaacatatattgggctctctacttataccgctctaatgtgtttataatggaagttttagtgttttcagtttctttaataggtttgattctagtcggcttgagttcaatggctcacatggttgcaaatttgtagctcctacttacattatatttgcagtatagacagatttgtgtttcgaatattgtttgtggctactctgttcctatccatggtctttatatataaatgtttactactactaagtctaacctcaaagcctttatgtgtctctgtctcatccaccaaactatgaagcctcttttgttattaagaagacggtgcacaaaccaactacatatgacaacatttgcatcttctttcacgtttgtttttttaggcaagaaatattttttcctttgaatttagtcacttcgattattattattattttattttatttttttattttgttaaagcacttcaataaaattttgaaagtggatttggttaatctcttattcttctttaagttgttcaccaaacccctactgatatatgatcaatactcaaccaccttttgtttttgtcccaattatttgcattatggccttgaatgttttgtagattttgtaagagtttttggattttgtttttcaaaaacttattttcataccaatcaaaattttaaaattttggttttcctacaatttagaaaaactatttttgttgtagttttccattcatgattttagttttttagttttcctaaagttagaaatctagtttttactccatcaacgttatttttaaaacaaaaatatattaacaaaaatctaaaactaaaatctaaaatctagaaactaaaatctaaatccaaaaactgaatcgaaaatcagcatccattcagggcctaagttactaaccacgttaaaaacgaaatttaaacccatgaaacttgaaatagcgtatcaccgaaattgttggtgttggggatgaaaattctcacatttgaaaccaaattttatatttaaactattaaatattgtatcactgaaattgtgtttatacaaggggaacgcatgtttcacttggaatgtcttcaagccaaaagacaggaaagcggacttatatttcccaccaccattcggaaattaaagtcaataagcgacgaggcgcaattgtcaagacattataaatgccatcgttgtattgactcatcatatgcatacttgctctaataaagcgtcgtaaggggttctctatgctgagcttacgagtcatgcaggtcttgcgaaaggtcgaaaaaatggttggtccacctaaaactaaaagtatcataatctagtcttataaaaaaaattatataagaagagaaaaattctaatatctacatttttaaaaaataaaattcctaaatactaaatttataaattaactaacaactatcctcaaattcaaataaatatattttgatttgagcattggaagaataccctatcatcccacatcacctcccatgaatttacgggtatttttgtggtacatatatttttcttatatgattctactgttcccactaataacacgcataattttggaatgacgttttctaatatataatggtaaaagtttactaatcaagaaaatatgcataatgtataacaaaacaccggatttacgtattttctaaaataatacaaaaaaaaatatgttatataagtaagtgggtatatacttgtttatttcatgataaaatgttaaacaaatatttttaattttaaacaaaatattaacaattaaaatatcacccttgtgaataatatttaaaacttgtgactatctaatttcaatcaaatatcaatcatatttgaaattcattaaaaaaattatttaacttacttttcctaatcattgagaaaaaaaaaagttttccttatcataaaaaaaaagagacctaagattatatgtgttagatgtttctatttaccatatgaattggttgggtgtagtaagtaaactattcatctatcataaattaatttcgatattttgtaagaataactaatcactgaacaaaacggtagtttacacttttcagtggcattggaatctcctcaaaatcgagctgtcacactcacctcccctgtctcctcttcgcttcggtacttccgaagatttcattttctagacactccatcctctctcacacacaccttaatttcgaatttttgtcaattggtgatgcagttactctgaactcgagctgagagagaggcatagagatccttgcgattcgttgtatccgtaacatttaacaatctcgttttgtttttcttctgttcctctattatcaacaatcaa

SEQ ID NO: 5379 - DNA, 3000 bp, Unknown; identical to SEQ ID NO: 5370
  misc_feature (1)..( 3000): cDNA_ID_1828392_gDNA_ID_1620783_Annot_ID_50391 3000 nt of promoter + ATG

SEQ ID NO: 5380 - DNA, 3000 bp, Unknown
  misc_feature (1)..( 3000): cDNA_ID_2153638_gDNA_ID_1620784_Annot_ID_50393 3000 nt of promoter + ATG
aatatgtgcatcttgtatgtgggggtcttccatgccagggacttagtggttttacaccgatttagaaataaagataaaccacttcaagatgaaaaaaaacaatgaagtgacggtttcatgaatatcatagactatacttgaagcccaaatacgtcttgatggagaacgttgtaaatcttttaggtttcatggaaagatttgttggtcgttatgttgtagctcgtcttgtaaacaagaattaccaagcaagatgaggcataatggctgctggtgcatacaatgttcctcaatgtaggtacatggtgtattagtatcggtagattaaggatcccaaatcaattcatgaagaggaaatgaggactaagggaagaaaggctagagtttgggagaagatgaagattgtggaaagtggcatgttgttgctgttccagtcgggattgccttaggatacatgtttgggatggcgagtcaaaggttgtgtgatgataaacctgtcatagactaccctttcatgtatccctgaatgtcttaagagaaaggtagattctgatagattaaagatcccaattcagttcatgaaaaggaaattgaggactaaggggagaaagccgagagtctgtgagaagaagaaaattatggaaagtggctaagtgtcgagtaaaggagtattgaagaaacctcttcctgagctagaggattttttcttcttattatcttcctttagaggattccaaaacaactgttgtgatctcatctcttaataacttcttcattgtttatcttgctttgacttggatttatattaggatttaggactgtttattttttttcttttaaatgatttcattaataactctaaattatctgctaggtttcatgatactatggggatcctcagcttttgttagataggtttgaggaacttagtgaagaaagtacacatcttgaattatgggtggatactaagaattaaattatgaatttcgtatttattagattagttgctgaggacgaattattgttggagtgactaatacttgacgaaatcttgatgcactctattctttcctttttatttgctctacttcaacatgaagactaaaactatcaaaagagagtttagatccatggaaatatggaatggatgtatttagggatggtagagtgtacaccaagctagggcatgtgcagaacctaacctaaagcttaggcagcaactgttttaagattttacaaccaatttttttttaaatagatcatgggatcataggggccagagagtgattgcgcctatctacccgaactattaacatcagataaatcaatcgtgtctctccatcttttgcaattaccatattctcttttaaggtttttttttttttgtttaactggtcaagttacttattactctatctgttattttttaattgattttctagaaaaacacacaaacacatattaaaactaattataaatatattagtttttgtgatgtagatttttttataattctaaaccaataattatttgtcttaaagtttaaaattcatcaataataactaaaaatagtgtctagaaaacttaaaaatcaactttttaaaaacaattttttttctaaaaaatcaaataataatgaatagagggagtatcgaccaaaattaaattttgttattataaaaatgtgaaattattttttcacaacaaattatttagcactttcagttgggaaaatggacacaaaaacaattgataatttctttacggaaagataagtatgttttcatataaaataaataagtcaaaataattaaataaataattcgaaattagtgaattacctctgtgaaaactatggaaaagtagaattttccatatatttttaatttctatctaccaagctttttatttcaaaaacattcatccaattaataaaataaattgaaatgtcaaagtgaatccaataaacgaataagccgacaaataaaattttagcgtgaagcccacgaggttttttttatgggccccacttttctccgcaccaaatcactgacttctctttctccgtatctttcttcagctcctaaaacccagaaccttctttttccggcgagggaagagcttcctcagccctaatcgctaaatcgatgaaattatgctcccaacgtttaacggtttaaagatcattccaaaaactcaaccttttgcgtgtctcctctcgccatgaccctaatctcaaggttcgtctctaatctcatattcagggtctctcgtgaatctctaatccgattaattttgattgcccttttagccggagattgcttaaattgattgctatgtttaaaaattgaacctttgtttataaagttttgaacttttctccaaagtcttcgtttgattagatcttcattgggtgggtttggttttggtttcttttgcagatttttgatctctagagtgattagtagaactctgttttcgaatcagaataatagaacagctattaatgtttctgtaaagttgccacaattcagaattcagagtaatggatatcacacattgggtcttcttcataatgttaaaggaaggtttttaggtagtaatcatcatcagcttgcgcgtaggagctattcgattgcagttgcgagtaatgtagttaagcaacatgctcaagtctcttggggaaggcttgtacagagagtaactctgagtcgtagttggaacttacctcggataagtcagattgctcaagcgtgtagcttgtctttagcccgttcgcacttcttgttacctggtttattggctcttacctatagacaagtggcgtatgcgcaaagggtggttccaaatcctgtggtctattctccttcacacatttctccttataggagttcgataaacttccctatcgttctctcgtctttagtgttttctgcggtcaagggtgttgttctgatcgggagagctctttatttagcaattttgttttctccaaatgttatt

SEQ ID NO: 5381 - DNA, 3000 bp, Unknown
  misc_feature (1)..( 3000): cDNA_ID_1828496_gDNA_ID_1620784_Annot_ID_50396 3000 nt of promoter + ATG
agacctagagaagctcttggcctagacgaggaactaagagctcgtctcccagcatttggatttccagtttctacaattcggtcaggaagtgtgatagttggagaatggtattgcccttttatgtttgtgaaggagaattgtagtgtaagtcaacaaatgaggaagtcaatgttctataggatcacactatcccaatactgggaacgaatttaccattgcggaaacaatgatcttgatgaaaacaatgatgaaaacgaagaagaagttgtgagagtagaggctaacgtcgtgagagaggccaactatgtgaagggtatggaggcggttaagggagagaaagaagggcatggagggttttattggtataggcaggttcaaggtccacggggaccgggggagaggaggaggaagacgggtttaaggtctccggtggggctgagttttgtggtggtagaaaggatgagaagggtaatggaggaaggagggtgggtgggaggaggaaggaaagtggtgagggtggagagagatgaaccaatcagggtttgtagaagagatggtaggaatatgaatggtaacaatgatagaaattggaggagatttgggtgttatgtgttggtggagagttttgggctgagaagagcagatggagttttgttggttaaatgtgtatttagacatactaatagattgagatgtaactgggagtgacacttcatcttatgttataaaatttattacttctatatatatatatatatactaaaatccctaagcctatgcttatggattatgttttataaactgtagtacttctttactaaatcattactctaaaatgatggaaaacattaaataaaatcagccaacaagttatatctattagaggattcttaacacaagccatttcaacaagcccaaactataaagctttaataagctatttcaattcagtctcatttttatctattttaataagctcatgctctattgagcataaacctatctttgtttggtttggtttgtcccacaatatctttactttataacttagtctaaagccgaaataatagtcagtttaaagaattgtttattaaaatatcatacatgtatggaattcagaatataagaaaataccatctgtgaatgtcattgtgttccttcaatattggcgttttagtttcatatttaaaactcatgtttctctcttttggtcgacggagaccaaaacaatactgaatgattggtgtttccgtgtttgtagtttcttaccaaacataggaaatgactctaatacgggtttggtacgactgaagaatccacaaaccattagaaagaattgtgttcatttgaagcatttgacaatcttgatttctttgtttttctttcgttgagaattattgattcaaaaatgaaaagcatgacaatgtacaaaggtttatagcgttatctatgtatttcaccctttggtttttgggtagagcgtatttcaaacctgcaggactagtgtttaaagttttggttataaatgtgtaaaatttacaagggctttgaatgtttcgtagattttgtaagagtttttggattttgtttttcaaaaacttattttcataccaatcaagattttaaaattttggtttccctacaatttagaaaaactattttgttgtaattttccatttatgattttagttttttagttttcctaaaatttaggaaatttagtttttacttcatcaacgttatttatctcaaaaactaaaaaccaatttttgggatttttaaaacaaatatataataacaaaaatctaaaactaaaatctaaaatctagaaactaaaatctaaatccaaaaactgaatcgaaaatcagcatccattcagggccaagatctccaaattttaccagttgcaaaaatgatggatgagaaatattgtaaaagttgattcatttttacatactttttttatttatcaataacgtgaaatttattagtgttttttaaataacaactgtcatgttattttaaccgatatcacactgtttgatatgaaatcacattatttcttcaaatcaaatgcaaaacacacacacacaccatttatttaaggttttgctatatatatatatatatatttttttttttaataacaaatttgctgaaaatttcttatctataaaccaaaataaaaataaaaataaaaatctaagcatatgataaagccatgtttaaaatgggtttgtaccaaactaggctataagacgaggacttacacgagtaataagtggtggggcaatataattctccaaaagtcatgccttcgccagtatcatgtcactcactgtcggaaaatgtagtttatttgcttcctcacacgcatgtcaatgagtgaatctgcgcaagaggaacttgtgcttcgtaatgcagctagattatattcatcacaaaatttgaattatgcatatttccataattgcgttttgtaaggtgaaaacgccactcaacaatagaatttacagtttttcttcaccaataaatttttgaactcataaaaataaaattgtactgttgtgccccaatctatattgattaccattctacattagtatttttatgtatttagaatatttatttattttggatgttttcaaccacccaaatgaagaaggtcgtattctcaataagagataaaaatcaattgatatatccttttcttgccttaaaagtcacaattttgcactataaaatcaaaagtcttaaataaaacgtgaaagttcatattcttgtcaacacgaattcgtcggttgtccttttcattcgttggtatttgtttttggagatgatttccactattttcctcaattttaaagacgacttttctcgttaaattgagaaagaccaaactagtctacatgaaacttcgatagccactatttttgttcttttctttcttttccttcttgttatatacagatctctgaagctcaaatcatctcaaatatg

SEQ ID NO: 5382 - DNA, 3000 bp, Unknown
  misc_feature (1)..( 3000): cDNA_ID_1828493_gDNA_ID_1620784_Annot_ID_50397 3000 nt of promoter + ATG
agttggagacgattttttaaggggaagcttttttatcactacatatttcacttaatggctaaattaagattttaacttagttttggctctgaagatccagttacaagagaaagagagattacgagaaattaatcaattgtaatcaaagatgttgtttgataaaatttataagtttttagctttacgaaatgccaataaatgtatattacgaaaaatgtaggagtagaaaaaacatttagttatgttggaataaattgatagataatgtttttaatttatttttattatgacataaacctattaggccatggttacgtcttcggccagggttacctccacctctaacaaaggtctattgcatttttgggtcttaagggttagttaatttgactgaatgacagatcattcaggaaaaattctctgatcggatttgatatatccagaaaggactctgagttaagtgtgaacttccattccaataatagaaatatatttactttagttgatccacagtttggtcattgacctatacccaaatatttcattttattgttaaggaaaatatttttatatcatattactgtggggtttatagtgtgtacaaggatatttcctcaacggatggtttttggttttcagttttgtttacatcttaattaatttcttattattttttcttgtgaaaaatcataggagcagttaaagtgagataatggatgatgtatgcagaaatggataatgtctactataacaaaactttatcatttccattacgcttcttcctgctccacttttcaaaactattggcttattctactccatcttttctttttttttgttccttgatcaaccatatgtggtatcctaaaattattttttcttctgtgtacagtgtacatatatagtttcaaatacaaaccacttaataaattaactcgaatagctaatgtcgataaaaatttcttaacacatccgcatattttccatgcatggttatggttcatgattgtcttataaagtaaggttcatggatatagacatatagttattgtatgtttatatcacttatatgtaaaaattagatagcatgctcgcgaagtaacaaagtaatagggttataagataacaagtgtttaaacaaggactgagtatgttagttattatacgtgattgagtattaagatgaatgcttgtgtaaaccatttttagtttacatgagactatgtataatcaacctttcagaaaaatttatatgactagattgcaggcccggctctaggggagtgccagaggtgccaatgcacagggtcctcatattttttttcttaatttttgtgtgttttagtaataggtttagaaaaagaatacagtaaatacatgtcacataaggttattttgtttagagttaagagtttaaagaatatcattttttttgtagcacatggcccaataaaatattgagccgggcctgctagattgttaaggttatgtttggacatagatccactcagtcttgtacttgtcctcttgatctcttgaatatctatcatattctatcttataggagaatatagtatgtgcactgcaggtgatggcttaagtgtgtgcgtgtaagatttgaccaaaataaacgtgtaaactgttgaaatatgattcaacctcgagactactctaaatcatcttggagaagcttagacaaaaacttgaagactgcttgaagtagaagaaaggaaaaagagtaagtaaacacaagaatcaactaagtgttaaacattctagttgatgcagaggatttcaggggtttaaggaaaaggctaagactctgtaccaagtagagattttgaaaggagcttatgatgacacttgtcatcatatgagaggagctgtcttaaatcatcatcgactataaaacctgaaacagagcgtacaaagaagcgagcttggtgattagcgtgatcattcgattttagatcgttgtgtgcgtaagagagatgatgatgagagatatcttgttagagtcttctcaagttagggttcatctctgattcattcttcttctttgttcttcgctatttttcttcttctttgtaacacgattgatttgtaatcatgagaaagtgagagaacacaaacacttgtatctcttgatctttagtggatgtttgagggtaccgatccctcacgagacgtacctgttgttggcagggaactcgttaaaatcgtttgtgtctttgattgtgctttttggattcgtgaggttatgtgtttcgattaggtggaatcgatgctttgtttcataacataaaccatcaaattttcatatgttaaatttacagtaagaatgtcataggaagatgttggttcactttttaaaccttaaattgtttgtcttactcaaaatattttaaatctactagtatgtgtatgctcacaagaaaaactttagatttattaacacaattttttttatatacctttattcgttttctttctttttccctccttttatatcatcgctttagtccatccactaagttaaagctattcattatgagtggctccaggctacaggtatctctaattttcattagttagtataattttattaaaatcatttactttaatcaaccgccgaatttacgaaatacaaaatcccaatttatctgaaatattgaaatgaaaagaatatcttagatctgaattttaaatagtaaaaaattaacttactaagaattgagagtggaatgtgactgttatagctttatctttttatctttactttcataaaatcaaagttaaagacttggcaatcagcaaacactaaaattacataactttaccctccactatcaaaagttacattgagccacccaactactttataatctcgtcgtttacacccctacaattgttaaaattcattaataaaatccctcagattgatactaaaacttcatcataactcactaattcccttaaagcttcaagaacgaaaaaatg

SEQ ID NO: 5383 - DNA, 3000 bp, Unknown
  misc_feature (1)..( 3000): cDNA_ID_1828481_gDNA_ID_1620784_Annot_ID_50401 3000 nt of promoter + ATG
gttatttgtatacactctttacatcctcatattcatctgttaatttggctttgtaattgattgtaatcacatcgtgttatggtcaatcatatataaatattttaacgatatatcgagctatttttcaatttcttatagacatttgagcgattatcatacttcttgccacaataacaagaactatgggaatatacaataactattaatccctaggatggaacttggaagaggtttcactttttgatttcactttcaacaaatgcgtgtggccacataaacttttgagctttgacccaaatgttttatctaaagtgggcttgccaaaaagctcttgttaaaagacttgatcacctctagattaatagggcttgactcggacatttgtgccaataggaaacaaaaatggataaccaaaaagaataccaaaagctgttagatagaataggaaaaagtgttaagtgatcatcagtacaacaaatgtcacatctaataaacaagtaacaaagtactacacggttcatttacaaatgagcttgtttgcaatcttcaaggaaaaagtagtatgcagcaaatttcttccaagcaggaacattttgtttgttttcgcgatttgcagtagcgaacagaattgaccatgcacgtttgtattttgtaagattgacgttgagatcacagcccaccgggactggtgagattaaagcatgttagagtatgttagagttttgtaaggtaagtacgaccggataatacacatattgaattgctatttgtcattaataaatgtcatcacgacagtcgaaataacatcatttgtagtagacatgtatgttgtcgtttgttacaatattttcttaccagattagtattcattatagacgtcaatgcataaaattacagatgtacgaacgtatatgtagtaccatgtgcatggttatatcaatattcgttttaggtttgttagaatgcaaattaatcgttgtagagccatgtccgcattgcattgaaaaatgtaagtctataacacagttttacatgacatgttaatgactagggtttgccaaaatatataaatacttgatttgattagttatatgtccgaatctgttttaaattatcatacgcgcgccaattacaaattgtttatcacaatatacaaactacaacaccatatttcattatagtaaaaccaaaatttaactacgaatctgaacgtagccctgctttatgataaatatttcccgaaaaaaaatcattagaattcctataatgataaaaaaaacgctggttcttatggtaacaccatgtgaaaagtgatgactttttcatagcagtagaagtagtcaactacctcagataagtactgtaattaaataaactaattgcccaaaatgatacaactttgtcgcattaaattaaaagttaaaccttcactggatgcattaccaaaatggtcatataacaatacgtaatccaactcgctgtagctatcaatctctttatcacaaccaaccaatattcaacaatgttgttttatttatttttcatatggtttatttaatcacctcgacttttttggcatcgatcacatctacaaataaattgttagttagcacgaccgttattattactttatgaagaattgttaatctgaaaaatatccttttgatatcagttggaaatatttttttaaataatttattatgtagagcttgcggctgagtcaaataaaaataaaattgaaaactaaaagcgtgattgacaaaatgactttaaaggctgatttgtttttgaaaaaaccaagttcttaagaacacatttgaaccaatcatcgaaatatatggtggaaatatatttctaccaaagatttgttttttaaccaaataattgaacacaacgctaactgaatattttataaaactgatacagatttattaaaaattttgctaataaacattataaaattgcttttaccaattataggatgtattgtatctcttggactttaatatcgttgacgatcttgacaaataaaaagctggcgtttcattaaattggtatttacaatgagaaaaatgtgtgggatccaaaactggatataggattcgctttactgtatctggatccgaaactctaaaatatgatgtttcttatgatctggattttttcaaactataaatgatttctgaatttccgtgtatgtcaaccaatatttaaaaacagattatatttcttaaatatttttcagattttttgaaaaatattctgtaaattacaaatgcaaataaattatttaagaccgttaaggatcaaatatgtttttagtttattcaaatctctcgttctctcatatcgctattttgtacttagtttagataaaagtattaagtttggcttcttagaatttgatgtttctttttttcgtttttgctatcgacttttgttttttttttttttactattttggtgttatttatctattccttaaattttggttttgtttctgatacttatattttctgtaatttatgtcgcaacttcaaaaataatataaatactttacattgatattaaaaaaaaaaaattgagctctaatgacctttggagctcatgctcatctatggaaaaaaaaatccatgcaggaagaaccaagaggaaacggtatacaaaataatattaaataaataattatttgtcaataaaataaataaaaactcaccaaagtacataacagttcacacagcatgtttttagaaaagatcatatactattggtttcaaagtctttgactttgaatgtttgaacttttcaaggttcgcctactcgccggtcgtctcctttaaccttcgtctctgtgtttatataagaacatatacgtatttgatgattacaaaaagacaattctttatccttctttagatttctgtggaaagttcactatttattaggagagacaatttcaaaaaggaaagctttttgcttggaactgttctgtgagttcta

SEQ ID NO: 5384 - DNA, 3000 bp, Unknown
  misc_feature (1)..( 3000): cDNA_ID_3076827_gDNA_ID_1620784_Annot_ID_168084 3000 nt of promoter + ATG
cggttgatggtcgagtccaaggtagaatgcttcgatattttacgcatgcaccagtcaacatttaggactttatgcaagattctttcagaacaatacaagttagaggagtcctgcaatatctatcttgaagagagcgttgcaatgttcatagagatggttgcacaagatttaactgtacgggtcatagctgagagatatcagcattcacttgagacagtgaaaaggaagctggatgaagtattaagtgctcttttgaaactcgcagcagacatagtgaaacctacaagagatgatgtcacaggtattagtccctttctagtaaatgataaacgctatatgccttattttatagattgcattggtgcccttgatggtacacatgtgtctgtgcgtcctccatcaggggatgtggagcgatatagaggtaggaaatctgaagctacaatgaacattctagctgtgtgtaatttcagtatgaaattcaatattgcatatgtaggagtacccggaagagcgcatgacactaaagtactaacctactgtgctacacacgaagcttcatttcctcacccacctgctggaaaatattacttagtagattcaggatatcctactagaagtggctacttaggtcctcaccgtaggactagataccatttagaactgtttaatagaggaggtcctccgacaaacagcagagaattgtttaatcgtagacattctagtttgagatctgtaatcgaaagaacatttggtgtgtggaaagctaaatggagaatacttgataggaagcacccaaagtatgaagtgaagaagtggattaagattgtgacatcaacgatggctttacataattatatacgagattcacaacaagaagatagtgattttaggcattgggaaatagttgaatcatatgagcagcatggtgatgaaaatgatgggcatgttccatatgtgcctactggtgacagagtaatggagaatatacgagattccatcactacagagatggccaaaggaacaagactcccatattaacaggttccatctctctgtcttatgttattgattgtctctgtcttatgctattgtctgtttctgtcttggttttaaattttgtgactaatagtgacagctgaatggtcacgtcactacataagttggttgattacacacgttttaaattttgtgactagtagtgacagctgacaagtaattcgttgaacatagtgttcattagtttggattagacttgattcaattgaatagcttgacataatgacagctgaatggtctatgtttctggttttagctcattgttgaatagtctctctctcaatctagttgttgtattcttgagcagctgcaattctagtgtctcttgatgttgtttgctttagtgttatggtttggtaatatgcataagaccatactttggtttctgattctagtttgtgtcatgattgaattacttttgagaatgtgtcatggttgaatcgttaggtaagtactagccaatatgcatgcttgctcttattggagaattggtgatgattcaggttattgctcttctttacaggtttagtaatttgaaattgaagtttgaaatgggaaatgatcaacgacgacaagatttgaagcacaaaaccaaattctctttttcaaactttactttgatttataagaatgtagcaattgacttgttacttaacagagggtattttagtcatttatatatatatgagaaagtgaatgattcatccaaatgatcaaacaaacaaagctctatctaaatgatgcatttagatgaattagcaaatgattagcaaatgatcaaacaaacatcattaagatgaatcattcaaatggattatttggatgaatcatttggatgcaaattccaaatgatcaaacaaatagagcctaaattttttgtttattccaaaatattgaagttgttttgctataattttttatttttatatttaaacttactaatttcggtttctttttggtttcaattaaagcgtaaaagccgcacttataaatagtttagtcgactgttttttgaaattagtaacttaatggtctcggaacagttatgttctacctgagacacaccaacgttcactattaaagtggcgatttttttcaagatatagttaagtccaaatggtgggaattgaattaattggccatactatctgtctcgatcgtgattttaggcccggcgacattagcaagtctttaacatgtgtctcttcgaacgtttagattacgcactgtatgtgttcgatgaaatgcctgaccgaaatgtgagagttcaaagctacgctctttttatctggagataaaaggagtctcaggaatcgcttgtagatcctataaaatagaaagtgaactgctcaagcctaagctctccagttgtttctttttttaattggtctttggtctatatttgagttcttgcatctcggtaagtcggtatattggcttacacacgagatgacgaatcacagttccatcttttttattgattcagagtgtagacgtctacctctcactgagtctggtcaattttgcgtggtttgattgggtaaaagtttggagttcttggttcagacaatgaaaggtaagagctacaaattttcatcttttgattggttcaaactgttgatgactatctattattggttgtatcaaagacatgaaagtgacacaatgtttctatatgaggccaaccgttgcatggtttatttggaagaaagttggaatttttaagattcaattctttgggttcaacttgtaataaagttgttttataaacaaggtttaagttgattgtgaataaagtaatgcagaatcttggaagatgggtgctgtggtcaacactgtttagagaattattgtttattaagtacttgagtttgttttcgtggattactttctcttgcactaatctgaagaagattgttcttggagacacaaggagcacac

SEQ ID NO: 5385 - DNA, 3000 bp, Unknown
  misc_feature (1)..( 3000): cDNA_ID_2992819_gDNA_ID_1620784_Annot_ID_168080 3000 nt of promoter + ATG
cattgccaacattgctttgagtaggaaggatatgcgctgcttcatcatcatctagatttagagggatctgccttgattcaccatcatcatcttgagttatagggatctgcgttgaatcaccatcatcatcttgatgcattgagtctaatttctcttcaccttgtttaggagcccagccctcggctccactgatatgcactgtaccaaataccttttccatcaaatccacatttgccactggcttatctttaaatttccgagctccaggccattcttaacaaacaatgagaataaacaaacaatgagaacttgatctagaacaaacaaaggacagaagaagtttaagaatctatataccttacaccgttcattccaccaatcatcagacattcttatgctcccatttggatagtaaccaagaccggttctgttgtgagtcagcttcttaaaaccttcatactgcttcttacaagtagtaaacttgatcccaaattttctccatgtatgtctttcccataaacctcataaaatctatctataatagtctgtctcccagcatcattgacattctgattcctaatatttcctttaagcttctcctcaattcttagttcaaggtagaaacgagtttgctcatcattccacgcaagattcttagttgatcatgtgtttttgtacaaaatcagtctaaattacagaaaatgttacagtaaatctaagtttagaggaaaatatactcacatcggtaccattgatagttgtcatctgtagcacacaatgaaaacaaacgttttgtagttgtgttagaacaagatcaaagataccaaacaaataaaacaaagatcagagataacaaagcaaacaatacacaacttatgataacaaagcaaagcaaataaaacgtgtacaaagattagagataacaaagcaaagaaaaactatttgatattgaacaatcatgagatattattcttgactatttctacagtatttgaactcaaaccttagacgaactcatgctactactacagaaagccaaatgcaaccactaattacagaggacgtacctgagaaaccaaagctttcttacttggagacaaaacttgctgaaacaaggactgaagagaaaaaatcttttataagatgaaattctcccgtataaataagcagttataagctatacacgagtcacaacatcatcaatcaacaaaactcagagccaaacttgttcttcgagactaaatagagactaatgcaaagttttttatcaatgagctatacacgagtcacaacatcatcaatcattgtatctcaaaacaaatcagataacacaatctggatcctagctttctgcatcaaaaatacaaaagacctataaacacaaaaacaattccactttggatgcaattgaacacgtcaaggaggcagctgaagtttgtaactatggatggtcaatctaaagagggctaaagtgcagatgctaaagtggcagcaccaaatggttctgttgctcctaatgtagagacaacaaagcctcttaagagcaaatcgaagactcaaaagcaacacaaagcaagcaaagcaacacaagccgtaaactaaagctaatcgaagaatcaaaagcaacacaaagcaaagtaaagcaaacccacaattaaacaatgtaaccatggtggatcaaacccaagaacaagtgattgcaacaaggatacaaagagaaacaacgagagagacatggagcgagagagaggaagcgagagagggagagagagagagagagagagagagaaacacaaacctactacactccggcgatggatccgacgagtctccagtgaagaatcggcgacggcgagatcaccggcgaagaatcagcatcattgacggctatgaatctcaattttgagtgttttgtgtcgaggagagggtgaagaagagatgtggtttttggatgtaattccatatattagattagggtattattgacattttataattttggctgaatcagcttcagcagaatgaacaaatcaaactcagtcagattttttttattttttggatgagtttagaaaaaaacattcaactgaatcattcaaatgatctatttaaacatgaaaaacaaacaacaattttcatcttcattgagatggttcatccaaatggacaaacaaacaggaccttaatagaacaacccaaaaaagaactcttacaaattgattaataaaataatttaatcaaaaagaattatagatttttattttaaaaactacaaatagtttaaaaaaaatataatatttacaatttccatcacaaattgtttcttaatgcccaaggatgaaggatcacatagttaataagtaattaagtactattttattcatgtactttctctttgccctatccagagttgctacaagcctaaaactcggttttaccacgatttttctttggtgtatttgacagactattaatggtttgtttatctctattatcagttgaattgttatatcaaaatttgaactgattgggtataaaaagaaactgagaactgattcatgctaaggaaaccttgtttaacaaataccatggatgctttttaaccgtatcagcctctccaatgttttcgtaaatcaatagttcaaaatttttttctaccacacaagtgcatctccattccaattttcaatctatataaatcatatgtattttttgtatccaatagtcatctttgtaaagattttttgttcgtgtgtggcggataagcaaaaacagaataacataatctcttatccaacttatattgccacgtggacagatatagttggtgaagcagatactaatctaatctgagcaaaaccagttgggctatttgaaagccacaagtacttggaacctttgtttcttctaccctaacatagcccttgcaaaccataaccaaaccatcatcatcatcatctcttggtgacagaagaaaagagttgaggaacagagaaaatg

SEQ ID NO: 5386 - DNA, 3000 bp, Unknown
  misc_feature (1)..( 3000): cDNA_ID_1828477_gDNA_ID_1620784_Annot_ID_168077 3000 nt of promoter + ATG
tttcaacaaggaatgattcggataatgtagatcccgagaggtttaggtttgcgcgggatacatctttcgggcgtagacatctgagtttctggagcaaatcaactattacgctgtggattgtatgtttcttcaggcagttctttagatctgtaaccaaagttgattacttaacactgagacatggtttcatcatggtataagtcaatcttttgatctttaacttttctgttgtataataacttatctctcaaggcaaagatcttacagcattgcacgaatgcttcttctttttcttctgtttcaggcccatttggctcctgggagcgacgcaaggttcgatttccgaaagtatattcagagatcactagaggaagacttcaaaaccattgtcgagatcaagtatggaactaattaagattacaaactccacttcactaaccactacttaatctgatgttttaactgcttatatcttcagccctgtgatctggttcatagctgtgctattcctcctgacaaacacaaacggtacactcgttttcaaaacgtcgctgcatcgatacctctttaaaagccttcaacaatccaaaactaatagattactctgcttttctaatgaacaggattgaattcttacctctggctaccgttcattcccttcatcgtaagcaacaaccaaaacctttagactaaacctattttgtttcggtttcaactccgtaacaagaatgaatgtataaacaaactgcaggtgattcttattgttggaacaaaacttcaagtgataataacaaaactaggacttagaatccaagagaaaggcgacgtagtgaaaggcacaccgctagttcaacccggtgatcatttcttctggttcggtcgtccacgtttcattctcttcctcattcacttagtcctcttcacggtatacattcatcttttactttctactctctctccttacaaaaatgcctgaaatttaaccatttctttttcgccatcatcagaacgcgtttcaactagctttctttgtctggagtacggtaagcaagcaatcctgcattctccatgaacttgaaacgtaataatacctatacaatcatcattttcatcaaaatcttttgttatctcttcagtatgaattcggtctaaagaactgtttccatgaaagcagagttgacgtgatcatcagaatctcaatcgggtaagtggaaaacataagcttcaaaacccttcatagaaaccatcccttaacatctaacaaagtcacaaccttttggaaaacataagcttcaaacatagaactgagaaaccattccttaaaatctaacaaagtcacgaccttttggatcttgcagacttttagttcagattctttgcagctacgttactcttcctctatatgctcttgttactcaagtaagatccacgcacacacaaaaacacataaagattgaaactttcaatttcaaaaactgacatttttgaattcaattttggtgaagatgggttcaaagatgaaaccaacagtgttcaacgagagagtagcaacagcgttaaagagttggcatcacacagctaagaaaaatatcaaacatggaagaacttcagaatcaacaacacctttctctagtagaccaacaacaccaactcatggttcttctccgattcatctccttcgtaatgctcctcacaaacgaagcagaagcgttgacgaaagctttgcgaattcgttttctccgagaaactctgatttcgattcgtgggatcctgagtctcaacatgaaactgctgagacttcgaattcgaatcatcgttctaggtttggagaagaagaatcggagaaaaagtttgtttcttcatcagtggaacttcctcctggacctggacaaatacgaacacagcatgagattagtactataagcttaagggatttttcgtttaagcgatgatttaatgttttcttaattcattatttagtgatttgttaatatgctaaatgaaaccagttcttgtaaattttctatactatgtttgttaaaaccagcccttgaagctttaatttctcaatgtaaaagtctgatgattttggattttaagactatggagattcatgggtagttggtgaagagtgttcttgtcttttgggtttgagagtttgtggaagatgtgttagcagatttagaaagcatgcaaggggtttgataaaatgcctgagtgagacttggttttcctgaaacacagtggtttctgggtgtagatagattggattggcgaggattgtattttgatatggtttgtagaatctgaagactcgttttatcgccactatttttttgagtattgacaaggtgattagggatctcttgtgaatgccttcaaggatttggttgaaatgcaatttgctagatagctctttagtggaatgttatattcatggggttcgatgaatgacggggtatgtgcaaaatgagaattttaaaaaagcaattcgtgaatttatgccggacaaagggttggaaaccaagatcattggtgctttgcatgcttgtgcttacgcaggtgatcaggacctagtggccaggccaggaccgttgtatcttggaatactagatggcagatacgttgtattggggtcaaaaaaggtcagtggtacaattctcatgtttgaaaatgaatggtagcggtgttgcctatttttcattggttgtgggctcaatttacctgaaaataataggtcaactgttgcatggttgattgggtaaacataagcatttcacttttctagaatctgtattataaaacaaggttttaagttgatcgtgaataaagtaatgcagaatcttggaaaatgggtgctttgtagtcaacattggttagaggtgcttccattttctattcagcacttgactttgttttatttgcttacttttctcttttttacagtatacatgttctcttcctacaataatctgaggagattgttcttggacattgggg

SEQ ID NO: 5387 - DNA, 3000 bp, Unknown; identical to SEQ ID NO: 5382
  misc_feature (1)..( 3000): cDNA_ID_1828493_gDNA_ID_1620784_Annot_ID_168068 3000 nt of promoter + ATG

SEQ ID NO: 5388 - DNA, 3000 bp, Unknown; identical to SEQ ID NO: 5381
  misc_feature (1)..( 3000): cDNA_ID_1828496_gDNA_ID_1620784_Annot_ID_168067 3000 nt of promoter + ATG

SEQ ID NO: 5389 - DNA, 3000 bp, Unknown
  misc_feature (1)..( 3000): cDNA_ID_3076852_gDNA_ID_1620784_Annot_ID_168065 3000 nt of promoter + ATG
tgagaaaatagggtttccgatttggatccttaattcagacacctgactcgtcttctcatcctacccccaattcaatattcgtcgccaatatgccgcaaagacactcgaagaacaacaatgatcttgcgtatttcacttacgacgagaagaagaagttaggttatggaactcagagagagagattggggagagactcgatcaaaccctttgatgcttgttctctctgcttgaagcctttcattgatccgatgtgttgccataagggtcatgtcttttgcagagagtgtatacttgaatgtttccttgctcagaagaaagatatccaaaggtataaactttttggagttttctttcaaaagtttggaactttaagttcctttgttatgtatttatgaaacactttggatttgtgattgaagtttctagctttagtatctatataggattgttgaattcctcatgaatctggtgtgaattggatgattgaggttcttagatcaagtcatggattagatcaagtctctttagcatcactctgataacaaagatctgatatttaatgcttgaatagtgtttgtttaaaggagtactggttttgttactactagtcccacagtttttgagaaggagaagctggtaactttacttgagttttggcatgaaagcttggataaacgtatggagtgataactaaagtaatgttagagttgattttgatgcttctgttttgggtttaatgagtacgggtctcagggttagcctatggttgcatatgattgtttgagtttgtatataaataaccaccggtgtagaaactgttggagctgactctcctcacttgttaggacctgttgggaattttaaaattacatattttaaaaagattttgtgtctgatttatctttgctctgtatatttaagatactgatatgtagtgctgagatgtctataggaggcttgctgcacattcgtctcaaaagaagcaagataaggatgaagaagaagagaggctaatgttacaaaaggcgagagagctcgacgaatttgatcagcaaaaccatagtgcaatgcctcgaaacagtgacaagaatcacaacgaagataagaatggttttcatggggcaaacagtgtgaagacgacttcctttgaagaagaagcgcttaggacaatgaaagccttctggctcccatcagctacaccagcagcttcggtcagagtagatgctccagaaactcacacagtctgtccagagggcaaagagaagctcaagcttaagaacctctttgcaattcgtttcacagaagacaacagcgaagaggaagagaccaagacaaaatcagcatcttcaagctcttatgataaatcctacatctgcccgagctgcaaagtcactctcaccaacacaatgtccctcgtggcacttagctcatgcggacatgttttctgcaagaagtgtgctgagaagtttatgcccgtcgacaaagtctgtcttgtgtgtgacaaaccttgcaaggataggaacttggttgggttaaagaaaggaggcacgggtttcgctgagcacgacgatcatcttgaggctaaggagtacaagcatttgggtagtggatctggtttggggcttgtgaggccggttaagacatgatgtaaccacatcaaatgttctgttccagttacagaaaatatccttgattttgtaatacttatggcttgtatcctttgctacaactaagagacgctgctttctccattttggctcttggtttgtccttttgatcggatcctatttgtgtttcttccctacggagatcaaatggaaatttaacatttaagtaattgatcaattcaaatattcttcttttaggctatgaacatgcagagatagaaatgatcaatgagctgttcaaaatattggcccataaattatctcaaacataagacaggttgttacgatctcagtttataatgtccatccccgtattattatttgtttcaatttctcttgtagttgtggctgatacgtacgtttaggatcacagaatatcacaaggaagctccaggttagtaaatttacataatgtgcttagctttcatcaatgtaaattaaaattgatttggattatgatgggtgaatatatggactagggtaagtttaaagtagtggtggtatgttgtatcctaggaataagaaaacttgtagcactagcatggaacacaatcctcaccatttttgattattagtaccaagtcttgcatgtaagtctcattttgcataaatttttatagaagtgtaaaaaaccaaattgtctgactatatatatttttcatacaaatattcttctcatatatatttacttggtatttaaacattttatttgtttgttcatgttaacgtttaattttcaataattaaaatctaaataattgtttagtgaaaatttaaatatatatatatatttcaaattatttgttcgttactgtcattgatgattctattcaattttaagtttggattttctttttttaggtaaataatttattctttgaacaataaaaaaaggtaaattatttcttaattaattgatctcctttcgtttttaagattctagtatatctattaattataatatcaaaaactaaaaatttccactttaatcctagataattttcttattaattaaataatatgagttaatgcatctcttttatccaatcaagtttttgctttcctaaaatctagagaatccagtaacatttttttttattttagtagagaatctaagatttattttaatgaatgattttcttttcgaaaatttaaatccaaagacttttaaaacttcaaaaaaaaacaaaaaaaacaaacatatatgcctatttcggcctttgttcataaaaacaaaatttgggtccattatggcccataacggattacatcttctatataagcaattagatatcactataacctaatacttttgattctcaacaaaaatatg

SEQ ID NO: 5390 - DNA, 3000 bp, Unknown
  misc_feature (1)..( 3000): cDNA_ID_2153638_gDNA_ID_1620784_Annot_ID_168063 3000 nt of promoter + ATG
tctactatcatgaatcaaaatatatccgttttatattgatatcctttatatattgatatcatttacagattttcttttgaaaatcttttacgtgaaggtttttttccataaaacattcgaatgaaattgctcatatagtttatgaagtttgttaattgttcccaatatatttagaatcacagaagtaacctttaaattgtgacatagtgttacaaagataacattggtaaaattactttatttttggctttttttttatatgaacggtaaaataaaattatctatttaaactagaactgtacggttttctttggaaaaaaatcagtccaaaataaaagagcttacatgaaaaagataaaacctcgtgctattgccttttttgcaagacaatcagcacgtatattgtttataagagtcctctttttaaatgctagtcatcatgcatgggattaactatatatcaactttctcttatgttacatcatttttaggtgtattagaaggaatacaaatcagaagaagatacttgggagccgtatgatggattggggtaaggttttttaaattactgctttggccttctcatgttgtcctctaatctgtatatggtttcattagaaaatacaaataaaaacttaaggaattcgtaacgaagggtttcaagtcaaatttattgccacttcttgtaagctaagtcatgttaattacacatgtaaatcctccaaatatttcttgttccccacttttcgtaacttttcgaccttgtgtcgttcttttaggaatatgtgcatcttgtatgtgggggtcttccatgccagggacttagtggttttacaccgatttagaaataaagataaaccacttcaagatgaaaaaaaacaatgaagtgacggtttcatgaatatcatagactatacttgaagcccaaatacgtcttgatggagaacgttgtaaatcttttaggtttcatggaaagatttgttggtcgttatgttgtagctcgtcttgtaaacaagaattaccaagcaagatgaggcataatggctgctggtgcatacaatgttcctcaatgtaggtacatggtgtattagtatcggtagattaaggatcccaaatcaattcatgaagaggaaatgaggactaagggaagaaaggctagagtttgggagaagatgaagattgtggaaagtggcatgttgttgctgttccagtcgggattgccttaggatacatgtttgggatggcgagtcaaaggttgtgtgatgataaacctgtcatagactaccctttcatgtatccctgaatgtcttaagagaaaggtagattctgatagattaaagatcccaattcagttcatgaaaaggaaattgaggactaaggggagaaagccgagagtctgtgagaagaagaaaattatggaaagtggctaagtgtcgagtaaaggagtattgaagaaacctcttcctgagctagaggattttttcttcttattatcttcctttagaggattccaaaacaactgttgtgatctcatctcttaataacttcttcattgtttatcttgctttgacttggatttatattaggatttaggactgtttattttttttcttttaaatgatttcattaataactctaaattatctgctaggtttcatgatactatggggatcctcagcttttgttagataggtttgaggaacttagtgaagaaagtacacatcttgaattatgggtggatactaagaattaaattatgaatttcgtatttattagattagttgctgaggacgaattattgttggagtgactaatacttgacgaaatcttgatgcactctattctttcctttttatttgctctacttcaacatgaagactaaaactatcaaaagagagtttagatccatggaaatatggaatggatgtatttagggatggtagagtgtacaccaagctagggcatgtgcagaacctaacctaaagcttaggcagcaactgttttaagattttacaaccaatttttttttaaatagatcatgggatcataggggccagagagtgattgcgcctatctacccgaactattaacatcagataaatcaatcgtgtctctccatcttttgcaattaccatattctcttttaaggtttttttttttttgtttaactggtcaagttacttattactctatctgttattttttaattgattttctagaaaaacacacaaacacatattaaaactaattataaatatattagtttttgtgatgtagatttttttataattctaaaccaataattatttgtcttaaagtttaaaattcatcaataataactaaaaatagtgtctagaaaacttaaaaatcaactttttaaaaacaattttttttctaaaaaatcaaataataatgaatagagggagtatcgaccaaaattaaattttgttattataaaaatgtgaaattattttttcacaacaaattatttagcactttcagttgggaaaatggacacaaaaacaattgataatttctttacggaaagataagtatgttttcatataaaataaataagtcaaaataattaaataaataattcgaaattagtgaattacctctgtgaaaactatggaaaagtagaattttccatatatttttaatttctatctaccaagctttttatttcaaaaacattcatccaattaataaaataaattgaaatgtcaaagtgaatccaataaacgaataagccgacaaataaaattttagcgtgaagcccacgaggttttttttatgggccccacttttctccgcaccaaatcactgacttctctttctccgtatctttcttcagctcctaaaacccagaaccttctttttccggcgagggaagagcttcctcagccctaatcgctaaatcgatgaaattatgctcccaacgtttaacggtttaaagatcattccaaaaactcaaccttttgcgtgtctcctctcgcc

SEQ ID NO: 5391 - DNA, 3000 bp, Unknown
  misc_feature (1)..( 3000): cDNA_ID_3076862_gDNA_ID_1620784_Annot_ID_168061 3000 nt of promoter + ATG
gcatgaatctcattgttcgtgatcaagttttactccaacatccgaaagtgttcgtatacttgcattgtgaaaagcggtatatttcaaaactagtcgttgattcaactatatatgttgccaccatgaatatactaaacagaaaatggaagaaagctgaataagattggggactataaaatttagcatatgtgtccgataataataaaatccaaatatcgaccgacaagagcttagaggagtgtcggtgtacatatcgatgggatcgaccagaccgttagagaaaacaaccgatgggctgacaaagattcttcggatttaacttatgttgtcatacggtggctgtgacacattcttttgacgttcatttcataacttttattttatcgatatcaacctaaacgaaacaagtgttttcataaataaataaaaagttagtcacgttgcaataatgaattattatttttttcatttttggcggagtggactggtgggcttaagcaaattgatcaaatttgttttgacactttcttagtttatattaaaattaattttaattgcacgatgaaaacttactagtcagtcgcatggatctgacctaactgtctctgtatttcagtgcttcaaagctcttttaagttttaagtcaaaatgcattgtgtcgcatagagagaccattaagaaaaaaattcaattagttcttaattaatattttaataataattagataaattggggcctttatagtcttcatttgtcctcaatagccattatccaataaaatattaccagtttcatttgatatttttgtgtcatatttttaccatttaagacttttcacaattcgaatagccatgaacaataaaaatctacgagtttcatttgatatttttttttttttgccgaatacatttaagactttcacttctactaaccatgaacaatggtctcccaattacaaaatatatttttgaatcattggactaccataaatgattagtgtcttttttgtattacatgtaacgtaaaaataccattcttcaagcattcataacaattttttttttgtcaagatacataacgtaaatttgaatttcgtaataacgatactagcacaatttagcttagaatatgtccaatttttttttttattttgaaaggagatagatatataaatattatatacatggatatcggtgaaattatgtttattatctatgcctatcgtttgataaaacttgtatattttatggacggtgacacagcccggttcactatgcctcgagccgtataatgatcataaagaacagaactggttactattatcaggttcaacaaatccattttttgatattttgtgtggctatcagtctatcacataaaatggaaaaagaattaagagaaagaagaaaaacaaaacaatgacttgtaattaaagtgcaataattgattgacttatcaaatttattagaagaataaaatatttacggaatttagaaaaagctagttgaaaagaataaggaccgtttggtataaagagattgtgaaaaaagtcacaaacacaataggtccagaaacggtgacgtgacacacagatcgaaactcagcatcgatcgacgatcgtcatcatataccatttatccctttagcctcaagccacaagaacaaatcttattttatagtactatttttaaccgaaagaatccgatcgacaatgaaataaatatcgaactcatatcaagtgctaactctaggttttgccattaattttgcgttttccaatcgagctaaaaacaattgatcgtctattaaaaaaataaaaattcctatgatcgctttttcgatctaaaactaatttttagtaatagtaatacctgttaaagtataaatatccctcccaagtactgaaaactcaaacctgaacgagctagcctaggactcaacttttatctcgaaagaatctttgaatattacttttgaaaataagtgagtctaatccttgaagatatatgttttaaagttttttttagcaaatgcgattgagaaaacatatattttaacttcaagataatcattactgtatgaaagtatggataattaattagaagaaacgttgttcaaaaattggttagtcgtttataattaccaaaataataaaacaattattaatacgcttgcatagactaattagtttttttttttcctaagcttactaaagtgatctgataaaaatcatgtatggaagcatgaaagtaataaaaaaatatcaagtttcaaaattttagtctttcatatttatgtacatttatatatatacgcatgcgtagactataatcagtcattttcgtgttttgtctatacaattactaaaaactgatttaatcaaaatcgtgatatgttttctatttctgaccacttaatataaacgatcgatttgtagaatttgatggcaaccaatcaaaggttaccgttagatataatgtctatatataaatagtatccccttttggcatcttgcataatagtaccaaacacctatctaatctcaaattaaatatttaaatatttataaaatgaggatcattatcacttcttcgaaaagctaagcagcaaagaaacaaatctcacaaagacagttgttcttataataatagaagaaaattgagggattaggaacactattattacaacatctttctgtcaaataaaatatttagcttaaggaaaaaatttaaaatcaagattatttaattaaaaaaatcacataggaatgttatgatgatataagtttttgtcttcaaatgtcaactaaattccggtaatttccacacacttgtccgtacttgcctatataaacatacacaccctcataaacatatatcaaaattttacacttatgctcttcatatcacatacaacaaactcatatatataaaaactttaaccttcgtatagcaacgatctagtagaaagcttatactaaaactttctgattctcttaat

SEQ ID NO: 5392 - DNA, 3000 bp, Unknown; identical to SEQ ID NO: 5386
  misc_feature (1)..( 3000): cDNA_ID_1828477_gDNA_ID_1620784_Annot_ID_50402 3000 nt of promoter + ATG

SEQ ID NO: 5393 - DNA, 3000 bp, Unknown; identical to SEQ ID NO: 5385
  misc_feature (1)..( 3000): cDNA_ID_2992819_gDNA_ID_1620784_Annot_ID_50404 3000 nt of promoter + ATG

SEQ ID NO: 5394 - DNA, 3000 bp, Unknown; identical to SEQ ID NO: 5384
  misc_feature (1)..( 3000): cDNA_ID_1828462_gDNA_ID_1620784_Annot_ID_50407 3000 nt of promoter + ATG

SEQ ID NO: 5395 - DNA, 3000 bp, Unknown
  misc_feature (1)..( 3000): cDNA_ID_1828541_gDNA_ID_1620785_Annot_ID_50408 3000 nt of promoter + ATG
aaaatttagcatatgtgtccgataataataaaatccaaatatcgaccgacaagagcttagaggagtgtcggtgtacatatcgatgggatcgaccagaccgttagagaaaacaaccgatgggctgacaaagattcttcggatttaacttatgttgtcatacggtggctgtgacacattcttttgacgttcatttcataacttttattttatcgatatcaacctaaacgaaacaagtgttttcataaataaataaaaagttagtcacgttgcaataatgaattattatttttttcatttttggcggagtggactggtgggcttaagcaaattgatcaaatttgttttgacactttcttagtttatattaaaattaattttaattgcacgatgaaaacttactagtcagtcgcatggatctgacctaactgtctctgtatttcagtgcttcaaagctcttttaagttttaagtcaaaatgcattgtgtcgcatagagagaccattaagaaaaaaattcaattagttcttaattaatattttaataataattagataaattggggcctttatagtcttcatttgtcctcaatagccattatccaataaaatattaccagtttcatttgatatttttgtgtcatatttttaccatttaagacttttcacaattcgaatagccatgaacaataaaaatctacgagtttcatttgatatttttttttttttgccgaatacatttaagactttcacttctactaaccatgaacaatggtctcccaattacaaaatatatttttgaatcattggactaccataaatgattagtgtcttttttgtattacatgtaacgtaaaaataccattcttcaagcattcataacaattttttttttgtcaagatacataacgtaaatttgaatttcgtaataacgatactagcacaatttagcttagaatatgtccaatttttttttttattttgaaaggagatagatatataaatattatatacatggatatcggtgaaattatgtttattatctatgcctatcgtttgataaaacttgtatattttatggacggtgacacagcccggttcactatgcctcgagccgtataatgatcataaagaacagaactggttactattatcaggttcaacaaatccattttttgatattttgtgtggctatcagtctatcacataaaatggaaaaagaattaagagaaagaagaaaaacaaaacaatgacttgtaattaaagtgcaataattgattgacttatcaaatttattagaagaataaaatatttacggaatttagaaaaagctagttgaaaagaataaggaccgtttggtataaagagattgtgaaaaaagtcacaaacacaataggtccagaaacggtgacgtgacacacagatcgaaactcagcatcgatcgacgatcgtcatcatataccatttatccctttagcctcaagccacaagaacaaatcttattttatagtactatttttaaccgaaagaatccgatcgacaatgaaataaatatcgaactcatatcaagtgctaactctaggttttgccattaattttgcgttttccaatcgagctaaaaacaattgatcgtctattaaaaaaataaaaattcctatgatcgctttttcgatctaaaactaatttttagtaatagtaatacctgttaaagtataaatatccctcccaagtactgaaaactcaaacctgaacgagctagcctaggactcaacttttatctcgaaagaatctttgaatattacttttgaaaataagtgagtctaatccttgaagatatatgttttaaagttttttttagcaaatgcgattgagaaaacatatattttaacttcaagataatcattactgtatgaaagtatggataattaattagaagaaacgttgttcaaaaattggttagtcgtttataattaccaaaataataaaacaattattaatacgcttgcatagactaattagtttttttttttcctaagcttactaaagtgatctgataaaaatcatgtatggaagcatgaaagtaataaaaaaatatcaagtttcaaaattttagtctttcatatttatgtacatttatatatatacgcatgcgtagactataatcagtcattttcgtgttttgtctatacaattactaaaaactgatttaatcaaaatcgtgatatgttttctatttctgaccacttaatataaacgatcgatttgtagaatttgatggcaaccaatcaaaggttaccgttagatataatgtctatatataaatagtatccccttttggcatcttgcataatagtaccaaacacctatctaatctcaaattaaatatttaaatatttataaaatgaggatcattatcacttcttcgaaaagctaagcagcaaagaaacaaatctcacaaagacagttgttcttataataatagaagaaaattgagggattaggaacactattattacaacatctttctgtcaaataaaatatttagcttaaggaaaaaatttaaaatcaagattatttaattaaaaaaatcacataggaatgttatgatgatataagtttttgtcttcaaatgtcaactaaattccggtaatttccacacacttgtccgtacttgcctatataaacatacacaccctcataaacatatatcaaaattttacacttatgctcttcatatcacatacaacaaactcatatatataaaaactttaaccttcgtatagcaacgatctagtagaaagcttatactaaaactttctgattctcttaatatggcggaggagtttaaagctacggcatcgatttgtggtggcggaggtggcgcgtggtggaactcgccaaggagcgttatgtctccttcggatcatttcttgtcaccatgcttcggagcggctatcacttccaatgattttagctcgcaagagaatcatctcaaatctaggatg

SEQ ID NO: 5396 - DNA, 3000 bp, Unknown
  misc_feature (1)..( 3000): cDNA_ID_1828537_gDNA_ID_1620785_Annot_ID_50409 3000 nt of promoter + ATG
gattttttttagataagtaaaatttttgcaatctttatcttgattagtatttaaaatcaattaatttatgttttaagtgtaaactaaaataaggtagaaaaaagagataaaaacaataatgtgtgatacacttaaccatgattggtactttggatccactaatttatgttttaagaaaatgatattccattataatgtttcccggaaacaaaccgtgatttgcggatgttacaacgtcaattagttcaacatggctttacttaaggcaaaagactacaaattcaaatagtgagactatacagataataatattattaaaaattaagtggattgtttttcaaatcattaacatggtacaaaaattatttaaatatatgtatatttgaaataatcacaatttttcacaaaacacaactcattgctaaccagctcatatgctaaaaaagacaactcatttctccactcttttgacaaaaacagagcaccaaacattaaacccttcaaaaacacaaatctcaccatcacacgtaaaaaaagaaaatatgtctatgcttcttcttcttcttcttcttgtcccattcattactccatcttcgcaatcttccattcgaaacctcctcgaagctcgcggtttaccaggtggtttgtttccagacaacgtggagagttatagtctagatgataagacaggagagctcgaagttcagctacaaaatccttgtttcgctcggttcgaaaacagagtatattttgatcgtgtgattaaagcaaatttaagctatggtgggcttgttggacttgaaggtttaacacaagaagagctttttctttggttacctgttaaaggcattgcagtgaatgatccttcttctggacttgttctcttcgatatcggtgttgctcataaacaaatctctcgttctctctttgaagatcctcctgtttgttatcctcctggtgagtcaaagtttgttcctcaaaacgttttagtgtttaatgccaagtgttttatttattggtaacatatatatgatcttgaacagaatatttttgtagtaataattgtatgtttttatttgtaggatctataatggagaagttagaaaaaagcaagatggatattcagctcaagagatgaatgagtttttttttttttggggttgtgtaagattcaaaactcaaacttgtctctttgaaacttgaacaaaaaatgtgtttttttctttcttcttttacctttttgttcggggttgtttgggaaaccgtggaaagtgtcgggagatatgtgtaaaatctggaaagaagggaggaaaattttggaactttgtataaattatggggtccataaagtaatcaattttgtcacttgtcaattatttttcttttctttatatagagggaatatagagtactttagatatttgtttaacttttgctttaatttttgaggaatgatgttttcgtttaatcattatcctctagcataatcattgacatagaattattctttgaatggaagctcaaagctgcatttgttaccaaacaggcaatcacagctgttaacctaaacacaactgacggattataaaattctagcactgaaatacctatttaaaactttcactcatttttacacaagaagtttaaaaaaaaaaaaaatcaggtagatatttcgggtaaaataaatactcccatttgtaccaaaataaatgatgtttaacttttttacacaaagatcagaagttattatatttttttccgaaataaaaacgtaatttatttatttatacatattcaataaatgataaaataaaatataaatagtcataaggaaaaaatataaaaattttgcatagaaaaaaaagaacacgggtcaatttcaaaccaccaattattctgatatcacagatgtcaatacgcgtcagagtgtgatatatgttagttatatgcgattttagtaacatttttggaattttcagtgttgaatatcacatgtatatcgttgatcaaattattttagtaaacatgttttcaccagttttatttgaatttatagtcatttcaccaattgattctagaatatatttaaaattcttaaatgatataaaggtagttgaaattagataacctaacattttttatgttaaccaaactttttaattaaaaataatatatttataggcacaacctattgtaaattttttaatttacatagttttaagtaaacgagataaaagaatcagttggtgatcttcaaatcggataaagtgttatgagtgtataggagattttgatacaaattgaattctttttggagtcatatattttgtctatgctcaccacagcatcggaagatcttccatcacaaaacagttcacatttgtggtggacacgagagatgaagaatctgtctcaaggtttaatcactgtggtattatatagtaaaaattttatgatgatattaaatcatgattttggctatgttaaaatttgaggtttttggttctaaggattttttttgctagatttatgttaatatctaaagtttaagaaatttgataataattatagttacgtgacataattcaaatttatgatgaactacatttactatatatagccctcgagataataatgttatacatttatttagtagatatattattagataattcaaaacttaaattacattattttgtttatatatttcatattatgttaaagtttaattgataaatgatatttttacgaaaaatttgtataatactaaagataaattttaaaaacatcaatttcgttttatttttattaatagtacataaagaaaaataaataaattaaattaatttgtgactattttggtatatgatcaatgctcgtctttttaagtagtaatcgtgtctgttacaggtgaatgaacccaacaaaaatcttcgacgagcatcttctgctttcttcatctctgaatgatcaatttctagaatcagatcggatatttcg

SEQ ID NO: 5397 - DNA, 3000 bp, Unknown
  misc_feature (1)..( 3000): cDNA_ID_1828533_gDNA_ID_1620785_Annot_ID_50410 3000 nt of promoter + ATG
tgtaaccgaagttttacaattaatttgtattggttaaattatttaattaacgactgtagtggttataaaagaaaatgatgatgtttgttatcccccatccccattaacgactgtaatagttataaaagagcatttcttttgaagtttagccttgatacatcatgcccatgatcataggtcccacgatatgttcactttcttgttttgatgtttctaatatcaaaagtttcacagtacggccggtagcttgttcttccccagcaaaaactgcaaacataatgctttgaatttgcaaatgtttttttttttggtaaaagaatgtgtaaaatttggtttggaatgtgtaaactttcctcccaccaacaacattctttacccataacatcaagttggaaccactaaaatttggaattgtaatacaaaatcttaaatatatgctacaaccattttcgtaatgtgaaaaaaaattgaaatgtagagaaaacagtgtacataacataatatatatttgccaaaaaaaaaaatatataatactagcactttaccattgttcaaacgtaattaggtaagaaattaaaaacattattttctagtttcttttgactaattatataaggaaataaattgaaagtataagttatattcttttgattataaatctataaaaaaataaatggaaaggttatagtacctctcaactttgaccacaaaaaatatcatttacacaatgaaacccgacccggacgatgaaccggactaccttttgggtcaccgggtcatcgggtcaaccgggttggaccacgggttaattagttaaaatttatttaataaatttaatattaatagaaattttagagtattttatataaaaaaaaatttagtattataaatataaaacaaaaataatcatatcatatttaatcaaatataaaattatattatgtttaacaaaatataaaatcatttacacccaaatatatatatatatatataatcaaacaataataataaagtggttaaaaatttgaaatccaactaaatgtctaacaccgtaacaaatatattaggagatcatcaatgacagaaataaattaataaaacatcgtgaattcaaacaactaatctcgattgtctctctcaccattcgattcaattttaaggcggtattgtaaagtcttcaccaaaatctaaaacatcaaatgaatttaagaactgaaaaaaatttttaaaaataattgaataaagtctaaaatcccatattttattgtaaaatcaagagaactttttaaaacccacactcggccggttcaaccggttcaccgggtcacgggttaattgcgagtttttgtgggttttttcggttttgaacttgttgggttttagcactaaacccaaaccggaaacgtgttcgggtcacgggttaaccggtcggaccggacggttcgggtcgggcgtgaaaacactggtctaaatagtaaccgaaaaatctggctgagtcaggctgaattgctgactaactgaattttagtgattttcagatggatctagctgaacttttacatttccaaaccgccggaatcaaactgaactttcttttttgtgatttttggtcaaatctgtcaaaatagttaagaaatttaattcaaaaataacgtcaaataattatgaatgttaataatataaaatacatcaaaattatctaatggtttaattaaatcttatactagaataattatctaaaatgaatactaacattaatatattgcttaggaaaattgagttatttttccatctttaatttttgaacaattaaatatgtaaataactaatgaaaaactttgacaaatcattatataaaaaaaattgtttcaaaaattaacatgataatagaaaatagcttatcgcaaggaagcatcattaaattcattttttcgtatttgttttctttagtatatggcacataacttggcttatataattaaaagaaaaaatctgaagttttgtagtgcactttgtacttgtttttgtaataccaattttctaatgaaactttttaaactgaaagaaaaatggaaaaaaaatatcagtgtcagtcatcattattggtttgttccgttgatcatttggttcttcacgttcttcggatttgcttccacaattgatgtcttccgaacttgtctaacaataaatacaaaccgtttctatattaagttgaaaaatatagtgaagccaccaaacatgatacataatgcatttaatatttacccaattaatcttaatgttagctagccaaacttattggaatgtatcagttctataagatcttaaaattacgactccagtaattcaaataaaagcttagtacaaagactctttataattcatttatatatggttgaggcttgaagtttaatgcttttcactagtatgcacatgatacaaattatatatatatatacaaaacatagttgataacgaattttattatgcatggccccgtcccctaaatgctacatccaccactcctttataatccataatcgctatatgtatagagcatttcgtttgaagtttaacaccattctcattaaaagcttaagttcatacaaaaacaaaacaaaacttaagttcatacatcatggccttaatagctaccaaaataagttcacgttcttgttttgtttctgcttatccaaacaattctccaacgtttctgatatccaaatttcccaatacggtcgattctttgtcgcctgcaaatactgctaaaagatcgatcttgagaaacgtccatgcttcagtttctaacccttcgaagcagtttcataataagacatccttagtatatatattctgcttactttttgttgctcatgctgttttcagaactaagaatgtgtttgttcttgtacgtaggaatatttacacgagttgaatatcaagaagatcaagaatatactaagtgcaaacgtagatgttccatccgagaacctggagatg

SEQ ID NO: 5398 - DNA, 3000 bp, Unknown
  misc_feature (1)..( 3000): cDNA_ID_1828527_gDNA_ID_1620785_Annot_ID_50412 3000 nt of promoter + ATG
gacggtgattatggtgcatatacttgtgataagtgtggtcattatgctgttcattcgagatgtgctctagagaaaaatgtgtgggatggaaaagatctcgaaggtttaccagacaaagatgatattacacaagatgttggatcattcaatataatatctaaggaagtgatacttcattttctccatgaccatcatttccggctcgaagtcagtatactttataacgaaaaaaaactttgtcaagcgtgttatttacctattttcgaaggtaatttctattcttgtgtggagtgtgatgatttcatcttccatgaaacatgtgcaaaattttgcaggatattacaacatgcattacatcctcatccactaacattaaaagctgcaagtagatatggtatggatcgttttggatgcagttcttgtaatcgtggttgtcgtggctttgtctatgagtgttgcataaggggatgtatcttcactctagatgtaaaatgtgcttcaattgctgagccgttttgtttccaaggtcataaacatccattgttcatatttgtaggccgagacggaaaactcatatgtcgcgtatgcaaaacagaacgtcataatcaattaaattgcatcaaatgtgattttattgtttgtatgaagtgtgctacattaccctatagagcaaggtatgaacatgacaaacactttctcacagctatatgggaagaagaggtccgtgaaaaagattggtgcgaagtatgtgaacgtaatttaagagacacaaacacaaaagtgttctattggtgcgttgagtgctgcaccattttccatattgaatgcgtactaggtaaaaactcgaatttgagtctaagccaaactctcaaattctgggttcagcgggctcaaattcttttagaaaatcttaatctgtaatagactaatagacaatatttccaagcattcagtgagttatatagctctacctctctattcaaatgtaatttgttttcttcatatttgtctccttggtttgtgtttgaaaaaaaataaaataaaaaaagtctccttggtttgttaagttcagtatattgttcaataaacatatttcagaataaatttttataataaaaatatatcttaataaacatttgatccaaaataaatatatattcaactaattatagtgtatatttaatataaatatttatatttcttttgttaaatggtttccttgaattaatacaaccacttgtaactaaaaaactttgatattctccggttataaaatgggagctccattcaaattgtttttatgtgctctgttctcattaccaatttgatatcgtacaaaaagagctgcttcctactcgtgatctagattgtagatttgaaccttatcaaatgtgtgatctttactatttatcaggattagattaccaaaaacaaatcaatagatgatgactctacaggcttgagctttatttttggctcgaaaaattgtctagatttctaaaaccgaacaagaacatcagaaaacattgaaatatcaacattcctagttataaattaaaccaaaatttctgaaacattgtggttttattaagacgcccacatggatgagatgcatcactccttcacttcagctcttgatgatttgttattcattatagcatctttttttaattggggtcggatttctccatagctgcaaaagagaagtattcgaataagcaagttaacaaaaagaatagagcagaggcaacacaaggcaaaagaaccgggtatggagatattactgttgtagtttagaagcttttcgattagatcgacatgagtcataagcatacgcctgcagcagtaacggactaatccaagcgcgtcaagagcatccctgcgtattccaaaaccaaaattcagattttcagttcaacaaaatgcaattttagcataatgcctaaaaccaaagtagctaaaagattagatagaaacaagagaatggaatatatcagtgatcacctaccatcatgctctttactaacacttaagataacatctatgaacttcaagatgatcaaattgcaactaaaacaaaaacgaaattgcgcaattccaaatcatgtagcttaacacctagaaccaaacgggctaaagattacactagcgattaaaacaagaaaatcgaaaaatcccaatgatctaacttcatgcttttagtaacaaggctaaaacatgtataaactttcaagatgatcatacaagacaagatcatgcaatctctttgactacacaaaaccatcaaatcattctattgtcatgttccactattgtttcatcttttacatgactctcatttcaactaagaaaatgtcagaaaacgttcaaaattccaagattcaatcactctcatgttcaccaaaaaaatttctcacaaattatgattctttttctaatcataaactatatatcgcttacccttcagcgtaatcagcctggagaagttcaaggtatgtgtcccatttgttcccaatcacctacaaaaaatcataaacaaaagcttcataaatctcaatactacaaaccctagagatttgtcacacacatatatatataacaaatcgaaatcgtacaaaaagagagaagaaaaaacaaacctttccacaagtaaaacaacgaacagggacgatcatcgtgaacgaatcgaaactttaagagtttatcgtctcaaagcgatctttagggcttgtctctttctaacttcgttctcgtctcaaagcaaaaattagtttcatgtctaattattattgctttatatattgagtcctattatgtgttttagctaaaacgataccgtattagttaaaattatttattttatatctgacaatagaggaggaaaagtattcttcttcttcttcttcttcatctgctcgatcttttacatttccggtaagatcaaaatcaaaaccaagttcgtttcgcggcggaggagaagaagaatcagacgggaaaatg

SEQ ID NO: 5399 - DNA, 3000 bp, Unknown
  misc_feature (1)..( 3000): cDNA_ID_1828519_gDNA_ID_1620785_Annot_ID_50415 3000 nt of promoter + ATG
tttagtaggaaaaaaaaaatcaggttaaagccatgaacatcaatagaagacttagaatcttggaaaatcgtagacgatcttgtcaacgttttcacatgatcttaagaattctattgagttcgtggctataatcccaaccaaatttcatcactggaagtaaaaagtcataactctgccacaaggagatgtttagggttccgatggatttgtttaagaggttgtctctgtatgtacttcctctaaagtattactcttagatcgaaaatacaagaggaaccaaaatcaaaagcaaaaagaaacgtataattaagaatggtggtaagtaatgtgggtagacttatcatctttcgttcctttatataatgtttcaccatgctcatttaataataatctaaccatattttcatcaacaaggcccatcatgccttgtaccatattttcttcaacgacacatgatgttatgttttctattttgtgagctgattgtatctgggtcaaaatggtctctgggcctagtaatgggctctacacaattggatttacacctcatttaacagaagaacagaagttaagcatgtacaagcctgaaagcccatacttcagtttgatactgaaaagagaaatttaggccaagattttaggagattttagatttcagattttggtttttgtaaataacatgagatttttggatcttgttaagaaattagtaaaaactcttagaattagattccctaatttatatagggaatcaactttcctcaaaatcttgaatggtttaaaaaatggatttttggaaaaagctaaaagcaaaaaccatagccttggcttaggccttttttttttggttatacataagaaaaatagagaaaatatttaccaaagcaaataataaaaatcctaaattactttgaccaaaagaaagagataaaatattaccaaagcaaaagtaataaaaatactaaattactttgaccaacagaaaaagagaaaaaaataattaattccctatattaaaaaccctaaaatatctattggaagacagcaaccactttaaactaaagttaacacctttatattcccaaacacttttgccgtcctctcctcacaaaccctaaaaagcttctctcttctcttctgcttgaaggattccgatttgcctccttgaaaatttccaatgacgaagaaactcaatccactggaagatccaccaacggcaacttcaagcgacgaagatgacgtcgagacttccgaagctggtgaagcttcagacgattcctcttcatctgaagaagacgtaccaatcaaaattcgaatcaaatccccttccgccacaaccgccgccgctcctccagctaaatccaccgccgtctccaccgccgctgattcagattctggatccgagactgaaacagattcggattctgaatcaacaaatccaccgaattctggatctgggaagacaatcgctttaaacacagtgaatctaaagaagaaagaggatccaacgtcgtcgtcagctactttagctttaccggcgatgaaatcaggaacaaaacggccagcgagtgaagctgctgctacgacttcaacgaaacgagtgaagaaagatgaagagagtgtgaagaaaccaggaggttttcaaagactatggagtgaagaagacgaaatcttagtgttacaaggaatgattgatttcaaagctgatacagggaagtctccttatgtagatactaatgcgttttacgatttcttgaagaaatcgattagctttgaggttagtaagaatcaattcatggataagattaggagtttaaggaagaagtatattggtaaagaaggaaggaacgaacctagttttgtgaaagctcatgataagaaagcttttgaattgtctaagtttatttggggacctaaaggaatagctcttgattctaatgttaagtcgaacggtgtatcgaaaaagagtgtggcgaagaagaagattgattctgttaagcaagagttggtgtttgccggtggttcttcaactaatggtaaaaaagttgaagaagatggtggtgatgatggatgtgattggtttgataactcgtctcttgttaggatgattgctagtttgggtgttgatgagtattatgtgaagcagcaatggagtttggtttcggttgagagtaagaagattgttgaagagaagtataagttgttgcaagctaaggagttggaatttgtgttggagaagactaagtttttgaatgaggttgcttctatgttcgttgaagcttctaagaacaagccattagatacatagatttatcggttttttaaaatcggaatgctattgccaatgccttcttttgttttcgatttaggatttaccctctcttttttttgtcttcttcactttttatctttcaatgtaactttctggttattttatctttgttaaactctgttatggatttgtagcttaaatatgataaaattgcttaaggccagattctgtgaaacatggacaagaacagagcaagttatgttgaattgactcgtgtaattcgtgaaacagaacatagcaagtccaagttgtgttaaaaactgcagagaatttgacagattggtggaagtaaaaagcattcttttgcaactcattttaagatcggcaaagaaaaaattgaagtaacagaaccttactgtaacactattcgttactctaaagctgtgttatattgtttagagacagaaataatcaaactcttgtgataatttggtagatgataacaaatcagaactctgaaggtcaatcttttttgattcttaggtgaagacaagttggttatttcaaagatcacgtgcttaccttctaaaacagccttattgatctactgttgtacctaatgagcaaggactatttgcaaatctttttacttcttatatagaagtctcaagacgataaactcataacaactaaatctctatctctgtaatttcaaaagtacaatcatg

SEQ ID NO: 5400 - DNA, 3000 bp, Unknown
  misc_feature (1)..( 3000): cDNA_ID_1818013_gDNA_ID_1620785_Annot_ID_168123 3000 nt of promoter + ATG
cattttgtgggctagggatctacaatccaatgactgcaaaatatttacggcatgcaaaacttcttatgacaagtgtgtttgacacacgtctctaaaatttcaattatgtggatgtgcttatttgtatcaatgcatttcatgcttgcttggcttcgtatggaaaaagtatgagccatcataaaaatttgttaaaaaagattcgagtcatttacattgttttaggagccttttttgatcggttagggtgctagagaacccattacatactagtcatctgggggtattagtattttgtaagctgttttaaacgattccgaattttgtttctatattttgtggtcagatctgatggcctgaaaatcatccccaataatcaaatcttaatgcgcgtttaatattttactaaattatgatcatattattttttgcgatctagtcagtagtcactgtagtgaagttggtgagacgacacccacccaaaaggagtacgtaaagcaattccggcttccaattattttatgctaatcttgtcggcagatgagatggatacatttatacatatcatatataataggttgggaaattgttagtttcgttgataaaataattaaggttttgacttttgactgattctggatttgatttcaggaaatgtaaaattttccagattctgtatgtactttttgataagaaatttcaagttgctgcatgtcaaaaatttcaactaatctcttttgtagtgtataaatttatttactgtccaatagacaattgccaccgatcctaaggagcaacgtacaataccaaaagtttgcatgcataataaaagttcatttaaacataacgtataataattttcagagtgattattgtaactttcaaattttcacataaattttagagtattaaatcaaatagcctttgtaatttttgagtaaactaaatgacggtctttttttactcaaaatcaattacaaccctttaaaatatcctaaaagctttgttttaaaaaagaagataaattatcacaacaagaatataatctaactcactacaaaatgtaaggccaaagaagagatacgttcactgattggacgtgatggagagagctcacatctcgtctggccttatcatcatcgtaatctattgaagatatatatatggtaagacaaattaactttactcacggattctattctttttacccattctcggttttgtaacgaacgacgaaccaccaactagacaacgaaacgtcccacttgtttccattagttaaatttgggtaacaccaaaatcgcattaacttaataaaacactgttccaatatcaaccactgccatattttctcccttatttttttttgacatcaaaactgattttggagaggctttgaaaccccgactataaatttgatttaggtgttattctgatttatgagtgaatagttacacagtcggagtttgaactgaaagttataggattacatttttggtaaaaaattgttgagtcgtatttttggtagaaaacagtaaaattatgttttttgacagaaaattggaggatagtaattttggaggaaatcatatatatgaaaattggccaactctctccatatgattgacacataatcactttagcatttgacatgtgtctattaaataattaatgtaagctcttcaacttctaatttataggttaaagatatatttattatttaattttacatcttattttattttacgtatttaattatactattactatatttattttaatattacatgatttttcaataaaaccattttaatagttttcttatactctgaagttttttttttttttttgtaatccaaactcaaagtatgagtgtataatagtcgtggattacttaataatttgagtaagttattctcttaaatgaatatttatattttcttaaattgatatttatataataaatcactaagggtgaaaaatgcgtaaggagttccatcatcaaattcttaggtttctagaatccaacactaacctctgttaaattggtttaaaacaaacgttgtttatgaattatgtatatgatgcattgttgagaacgttgctagaaaaaaatatttttaatactaaaagtaattgtttattgcatgattgaatgattagataaatataaattatatttaaattaaacactacaaaagaatccgaaaaaaccgcgacgtagcgcggataattacctagtagtgttaaaacaaaattggaggaaattttggagatcacatttttaacataaaattagtagaaatatatattttaattattaaataaaaaattaaagtaagcgctaaatgtcattaagaaaattttgtgaaaggcggaaacaaaaattttaaaagaaaaagaaaggactaatcacatcatcgccattcaatgatatagtttgacaatgatatgattcattaactaccattcaataaatcggtttatgaaatctaacggttaaatattagttggtaaagcatgattaattaagataatcactcaacaatcaattcaggaccaacgtcacctagctaccaccacgaaggaaaatgctaatacaagaaccaaatcgtcttattaaccagttatctttttctcatggaccacatttaaatcgtcacggcaattaagctagattttaagaaagaataaatgggatactcaactaattgccacaaattttattacttttaaaactcggctgctcggcccaaacttatccggtacggatggatagacctatcttttatcgtgtaaagaaactcttgggctccactcttgacgttgctcattttatctacttttgttggtttcttagtgacctttgacgtttatttacatagagttgacagatttgaattgacgttttctcaataatgcagaccaaaattttcacgtttcttacatgtacatatatatagtaaaacaaatctctgaagacacacaagagaatcaagaaca

SEQ ID NO: 5401 - DNA, 3000 bp, Unknown
  misc_feature (1)..( 3000): cDNA_ID_2139018_gDNA_ID_1620785_Annot_ID_168122 3000 nt of promoter + ATG
taaaatatgataaaatggtttcattaatcaagtgatactggttaagtggttcttacttaaggaagaattgcttcttatgtcgccaaagaggcaaagatcaattcttcttaaacgtgtgatttacaaaatcattttatttgatcaatcgaaatggtgttatatttttacgctcattaaaaaaccatgtgagtggactattcaatagctaaatttactatatacagagatttttcgggtggtagaaacccccgattacacctgatttcattggcttatatggccttgtgccgatatagtagtggacatactctaaagtcttgaaaaatgcaccaaaaagctaatactttgttaacatgggctaaacattttgcctagcatatatgatccggcccatttattaatatgtatctacatctttaagaagtaacgaatttgtagtagcaaagaatgaatggaatcgatattgttcagtgaccatgaaattctcatatattgccataagcccataccttttttttattatttatactttttacggtcgaagaaaaagagaatagtagcaggattcctactgcaggcaatgataataaacttatagaaattttgaacagcgaaaagaaaacgacttgagattcaatatcaatcgttggtgctgtccaattggcaatgaagtaaaatttatgaacattgaatttttttaatttacctattaagcttcgatcgtattcaacctaagaatattacattttataaaatttaacagtaaaaatatctaatttaagagataattattaaaaattatataaaaaagtgactgactttttaatctaattttaatttattaggagaaaatctactttgaaaattattatatatatatatatatatattgtgaggtagaattttttatttcttaaaaaggtttactattttaactgaacattgtgtaaacgatgaacatcataactcgattgtgtccaattcatatctaatagttaaatgaatcaacgactcatatatcacggagcaaaacgcgcatgcagaaaaatccaccaagcgaacaatttggaaagcgatatttctgatgaatcgttgatttccccaatattacgaactttcctgaaatctttcctagccgtcgaatatgaaccaaatttattacctgacctataaacacacacatatgcaggcaaatggacacatgtgttctatgaatcagtgttggtgaagagagagcttgtcgtgtaatgagagttgcatgtgttcaacaactttgtgtatgttttgtaattttcctcttgtgatattttctacggtgagaattccatttgcaaggttacatcaatgggtgaagcctgtacgtccaacatgtgaccagaccttcttttatatcaacggtccaaattaacattacattaacatacacaaatatattatatatttaatactattgttcctgttcttctttttattgtcgttacctcgttagcatcaatgacgaatgaaaatgacaaacgatacattgtgttgttcgaattcgtgttattgttgccaaaacgatgtgataataatggaactatgttcattgtattggcgttgcccgctggtttacaacgatctatttcatcgatgaattttggtaattaacgatataaaattttcaatactaaaagacacacctttttcaacatttctttttataacttatgatgttcccattccattatattatagctcaacttacaaactaacttgtcacatgtaaattactcattgactcgtgacaactattgacggcaatattatcaaactcgtggttggaaatattttaagtccacaaaggaggagaaaataaaattcttgaatattgaaaattcttatacctctatgatataaaagaaaataaaatcaaagagaagtaccacaaaaacaaatttttagtatttaaaaatgccattactttggaaaaggtcccaaaatatcacaaaatctaggcttaggaagggtctctaaacgtttattaagaattactaagcccaaaacttgaaaactcctaaaactctttcttcaaatttagactaatcatttttaattctctccaaaatattagtaacccttgtaaagcctaaacattttagtaaattttatgatttttggtggtaattttggaaaataaagcataaaatgtggtattccgaggactgaccaaatttcaaaaattcaaataaatgattaatatcctaaatcaatcattattttttataattgtttttgagaaacttatattaatactattttcaggcattttcttataaattaccctatggttttagtaggcaacaaaaagatgaacgtctcagatttttttgaattcaatttaatcttaacaaaagcgataaatatcaagaagataattgggtacgtgtattgtgtactatttcaaaattgatatttgcttccataacgtaacgtaacgtaagacccaaagattaacacttggtttcttcatggtcgtagattattaaaagtttataactaatgacgacaaagtttaaacgaaaaacaatattttctcaattttcactagttttttttttttattccagaaaattattagtatacaaccaactatttttacgattataaacttttatttgatgatattcataatttagaaaaaccttaaacggatcttaatgtcaatatcatcagctcatgcaccgcctctcggatatgttgacaaaattaccccatacaatataaaccaccaaaccataaccacaaagggtatattcgtatattataaaaatatctgaatagtcgaacttgtcgttacactcaaaaacgaaatctttccctcctctgttctcaatctttctataaattctcttcttcttcttcttccattttcccaacaacacaaagtctctctctctctgataaaatcttaaaacccacctcgagatcatagtcttcatcaattagccataaaaaagcaca

SEQ ID NO: 5402 - DNA, 3000 bp, Unknown; identical to SEQ ID NO: 5399
  misc_feature (1)..( 3000): cDNA_ID_1828519_gDNA_ID_1620785_Annot_ID_168111 3000 nt of promoter + ATG

SEQ ID NO: 5403 - DNA, 3000 bp, Unknown
  misc_feature (1)..( 3000): cDNA_ID_3076890_gDNA_ID_1620785_Annot_ID_168104 3000 nt of promoter + ATG
aaccatttatttattatcaatataatgttccaagagtctctactagtaggtctcatgtattttctcgggtctgtgggtctatttctgtccaacgatcgatacgccatgtctgagaggctttaaaaacttggtacttaccttacaaatcaccacatgattttctcccgtattttgttctcactcacacggttccgacaatcatttcctcgaaagttatctatcataagactttcccagcttaaaaatgcttaattgtagaattttctttaagacgtttgacaaaaaagataagtgtgttttagtaacatagatgaccaaattaatttttataaatttctccacatgcaccaccatattcctgtaaccgaagttttacaattaatttgtattggttaaattatttaattaacgactgtagtggttataaaagaaaatgatgatgtttgttatcccccatccccattaacgactgtaatagttataaaagagcatttcttttgaagtttagccttgatacatcatgcccatgatcataggtcccacgatatgttcactttcttgttttgatgtttctaatatcaaaagtttcacagtacggccggtagcttgttcttccccagcaaaaactgcaaacataatgctttgaatttgcaaatgtttttttttttggtaaaagaatgtgtaaaatttggtttggaatgtgtaaactttcctcccaccaacaacattctttacccataacatcaagttggaaccactaaaatttggaattgtaatacaaaatcttaaatatatgctacaaccattttcgtaatgtgaaaaaaaattgaaatgtagagaaaacagtgtacataacataatatatatttgccaaaaaaaaaaatatataatactagcactttaccattgttcaaacgtaattaggtaagaaattaaaaacattattttctagtttcttttgactaattatataaggaaataaattgaaagtataagttatattcttttgattataaatctataaaaaaataaatggaaaggttatagtacctctcaactttgaccacaaaaaatatcatttacacaatgaaacccgacccggacgatgaaccggactaccttttgggtcaccgggtcatcgggtcaaccgggttggaccacgggttaattagttaaaatttatttaataaatttaatattaatagaaattttagagtattttatataaaaaaaaatttagtattataaatataaaacaaaaataatcatatcatatttaatcaaatataaaattatattatgtttaacaaaatataaaatcatttacacccaaatatatatatatatatataatcaaacaataataataaagtggttaaaaatttgaaatccaactaaatgtctaacaccgtaacaaatatattaggagatcatcaatgacagaaataaattaataaaacatcgtgaattcaaacaactaatctcgattgtctctctcaccattcgattcaattttaaggcggtattgtaaagtcttcaccaaaatctaaaacatcaaatgaatttaagaactgaaaaaaatttttaaaaataattgaataaagtctaaaatcccatattttattgtaaaatcaagagaactttttaaaacccacactcggccggttcaaccggttcaccgggtcacgggttaattgcgagtttttgtgggttttttcggttttgaacttgttgggttttagcactaaacccaaaccggaaacgtgttcgggtcacgggttaaccggtcggaccggacggttcgggtcgggcgtgaaaacactggtctaaatagtaaccgaaaaatctggctgagtcaggctgaattgctgactaactgaattttagtgattttcagatggatctagctgaacttttacatttccaaaccgccggaatcaaactgaactttcttttttgtgatttttggtcaaatctgtcaaaatagttaagaaatttaattcaaaaataacgtcaaataattatgaatgttaataatataaaatacatcaaaattatctaatggtttaattaaatcttatactagaataattatctaaaatgaatactaacattaatatattgcttaggaaaattgagttatttttccatctttaatttttgaacaattaaatatgtaaataactaatgaaaaactttgacaaatcattatataaaaaaaattgtttcaaaaattaacatgataatagaaaatagcttatcgcaaggaagcatcattaaattcattttttcgtatttgttttctttagtatatggcacataacttggcttatataattaaaagaaaaaatctgaagttttgtagtgcactttgtacttgtttttgtaataccaattttctaatgaaactttttaaactgaaagaaaaatggaaaaaaaatatcagtgtcagtcatcattattggtttgttccgttgatcatttggttcttcacgttcttcggatttgcttccacaattgatgtcttccgaacttgtctaacaataaatacaaaccgtttctatattaagttgaaaaatatagtgaagccaccaaacatgatacataatgcatttaatatttacccaattaatcttaatgttagctagccaaacttattggaatgtatcagttctataagatcttaaaattacgactccagtaattcaaataaaagcttagtacaaagactctttataattcatttatatatggttgaggcttgaagtttaatgcttttcactagtatgcacatgatacaaattatatatatatatacaaaacatagttgataacgaattttattatgcatggccccgtcccctaaatgctacatccaccactcctttataatccataatcgctatatgtatagagcatttcgtttgaagtttaacaccattctcattaaaagcttaagttcatacaaaaacaaaacaaaacttaagttcatacatcatg

SEQ ID NO: 5404 - DNA, 3000 bp, Unknown; identical to SEQ ID NO: 5396
  misc_feature (1)..( 3000): cDNA_ID_3076894_gDNA_ID_1620785_Annot_ID_168103 3000 nt of promoter + ATG

SEQ ID NO: 5405 - DNA, 3000 bp, Unknown
  misc_feature (1)..( 3000): cDNA_ID_3076862_gDNA_ID_1620785_Annot_ID_168098 3000 nt of promoter + ATG
tgaatctcattgttcgtgatcaagttttactccaacatccgaaagtgttcgtatacttgcattgtgaaaagcggtatatttcaaaactagtcgttgattcaactatatatgttgccaccatgaatatactaaacagaaaatggaagaaagctgaataagattggggactataaaatttagcatatgtgtccgataataataaaatccaaatatcgaccgacaagagcttagaggagtgtcggtgtacatatcgatgggatcgaccagaccgttagagaaaacaaccgatgggctgacaaagattcttcggatttaacttatgttgtcatacggtggctgtgacacattcttttgacgttcatttcataacttttattttatcgatatcaacctaaacgaaacaagtgttttcataaataaataaaaagttagtcacgttgcaataatgaattattatttttttcatttttggcggagtggactggtgggcttaagcaaattgatcaaatttgttttgacactttcttagtttatattaaaattaattttaattgcacgatgaaaacttactagtcagtcgcatggatctgacctaactgtctctgtatttcagtgcttcaaagctcttttaagttttaagtcaaaatgcattgtgtcgcatagagagaccattaagaaaaaaattcaattagttcttaattaatattttaataataattagataaattggggcctttatagtcttcatttgtcctcaatagccattatccaataaaatattaccagtttcatttgatatttttgtgtcatatttttaccatttaagacttttcacaattcgaatagccatgaacaataaaaatctacgagtttcatttgatatttttttttttttgccgaatacatttaagactttcacttctactaaccatgaacaatggtctcccaattacaaaatatatttttgaatcattggactaccataaatgattagtgtcttttttgtattacatgtaacgtaaaaataccattcttcaagcattcataacaattttttttttgtcaagatacataacgtaaatttgaatttcgtaataacgatactagcacaatttagcttagaatatgtccaatttttttttttattttgaaaggagatagatatataaatattatatacatggatatcggtgaaattatgtttattatctatgcctatcgtttgataaaacttgtatattttatggacggtgacacagcccggttcactatgcctcgagccgtataatgatcataaagaacagaactggttactattatcaggttcaacaaatccattttttgatattttgtgtggctatcagtctatcacataaaatggaaaaagaattaagagaaagaagaaaaacaaaacaatgacttgtaattaaagtgcaataattgattgacttatcaaatttattagaagaataaaatatttacggaatttagaaaaagctagttgaaaagaataaggaccgtttggtataaagagattgtgaaaaaagtcacaaacacaataggtccagaaacggtgacgtgacacacagatcgaaactcagcatcgatcgacgatcgtcatcatataccatttatccctttagcctcaagccacaagaacaaatcttattttatagtactatttttaaccgaaagaatccgatcgacaatgaaataaatatcgaactcatatcaagtgctaactctaggttttgccattaattttgcgttttccaatcgagctaaaaacaattgatcgtctattaaaaaaataaaaattcctatgatcgctttttcgatctaaaactaatttttagtaatagtaatacctgttaaagtataaatatccctcccaagtactgaaaactcaaacctgaacgagctagcctaggactcaacttttatctcgaaagaatctttgaatattacttttgaaaataagtgagtctaatccttgaagatatatgttttaaagttttttttagcaaatgcgattgagaaaacatatattttaacttcaagataatcattactgtatgaaagtatggataattaattagaagaaacgttgttcaaaaattggttagtcgtttataattaccaaaataataaaacaattattaatacgcttgcatagactaattagtttttttttttcctaagcttactaaagtgatctgataaaaatcatgtatggaagcatgaaagtaataaaaaaatatcaagtttcaaaattttagtctttcatatttatgtacatttatatatatacgcatgcgtagactataatcagtcattttcgtgttttgtctatacaattactaaaaactgatttaatcaaaatcgtgatatgttttctatttctgaccacttaatataaacgatcgatttgtagaatttgatggcaaccaatcaaaggttaccgttagatataatgtctatatataaatagtatccccttttggcatcttgcataatagtaccaaacacctatctaatctcaaattaaatatttaaatatttataaaatgaggatcattatcacttcttcgaaaagctaagcagcaaagaaacaaatctcacaaagacagttgttcttataataatagaagaaaattgagggattaggaacactattattacaacatctttctgtcaaataaaatatttagcttaaggaaaaaatttaaaatcaagattatttaattaaaaaaatcacataggaatgttatgatgatataagtttttgtcttcaaatgtcaactaaattccggtaatttccacacacttgtccgtacttgcctatataaacatacacaccctcataaacatatatcaaaattttacacttatgctcttcatatcacatacaacaaactcatatatataaaaactttaaccttcgtatagcaacgatctagtagaaagcttatactaaaactttctgattctcttaatatg

SEQ ID NO: 5406 - DNA, 3000 bp, Unknown
  misc_feature (1)..( 3000): cDNA_ID_2153638_gDNA_ID_1620785_Annot_ID_168096 3000 nt of promoter + ATG
actatcatgaatcaaaatatatccgttttatattgatatcctttatatattgatatcatttacagattttcttttgaaaatcttttacgtgaaggtttttttccataaaacattcgaatgaaattgctcatatagtttatgaagtttgttaattgttcccaatatatttagaatcacagaagtaacctttaaattgtgacatagtgttacaaagataacattggtaaaattactttatttttggctttttttttatatgaacggtaaaataaaattatctatttaaactagaactgtacggttttctttggaaaaaaatcagtccaaaataaaagagcttacatgaaaaagataaaacctcgtgctattgccttttttgcaagacaatcagcacgtatattgtttataagagtcctctttttaaatgctagtcatcatgcatgggattaactatatatcaactttctcttatgttacatcatttttaggtgtattagaaggaatacaaatcagaagaagatacttgggagccgtatgatggattggggtaaggttttttaaattactgctttggccttctcatgttgtcctctaatctgtatatggtttcattagaaaatacaaataaaaacttaaggaattcgtaacgaagggtttcaagtcaaatttattgccacttcttgtaagctaagtcatgttaattacacatgtaaatcctccaaatatttcttgttccccacttttcgtaacttttcgaccttgtgtcgttcttttaggaatatgtgcatcttgtatgtgggggtcttccatgccagggacttagtggttttacaccgatttagaaataaagataaaccacttcaagatgaaaaaaaacaatgaagtgacggtttcatgaatatcatagactatacttgaagcccaaatacgtcttgatggagaacgttgtaaatcttttaggtttcatggaaagatttgttggtcgttatgttgtagctcgtcttgtaaacaagaattaccaagcaagatgaggcataatggctgctggtgcatacaatgttcctcaatgtaggtacatggtgtattagtatcggtagattaaggatcccaaatcaattcatgaagaggaaatgaggactaagggaagaaaggctagagtttgggagaagatgaagattgtggaaagtggcatgttgttgctgttccagtcgggattgccttaggatacatgtttgggatggcgagtcaaaggttgtgtgatgataaacctgtcatagactaccctttcatgtatccctgaatgtcttaagagaaaggtagattctgatagattaaagatcccaattcagttcatgaaaaggaaattgaggactaaggggagaaagccgagagtctgtgagaagaagaaaattatggaaagtggctaagtgtcgagtaaaggagtattgaagaaacctcttcctgagctagaggattttttcttcttattatcttcctttagaggattccaaaacaactgttgtgatctcatctcttaataacttcttcattgtttatcttgctttgacttggatttatattaggatttaggactgtttattttttttcttttaaatgatttcattaataactctaaattatctgctaggtttcatgatactatggggatcctcagcttttgttagataggtttgaggaacttagtgaagaaagtacacatcttgaattatgggtggatactaagaattaaattatgaatttcgtatttattagattagttgctgaggacgaattattgttggagtgactaatacttgacgaaatcttgatgcactctattctttcctttttatttgctctacttcaacatgaagactaaaactatcaaaagagagtttagatccatggaaatatggaatggatgtatttagggatggtagagtgtacaccaagctagggcatgtgcagaacctaacctaaagcttaggcagcaactgttttaagattttacaaccaatttttttttaaatagatcatgggatcataggggccagagagtgattgcgcctatctacccgaactattaacatcagataaatcaatcgtgtctctccatcttttgcaattaccatattctcttttaaggtttttttttttttgtttaactggtcaagttacttattactctatctgttattttttaattgattttctagaaaaacacacaaacacatattaaaactaattataaatatattagtttttgtgatgtagatttttttataattctaaaccaataattatttgtcttaaagtttaaaattcatcaataataactaaaaatagtgtctagaaaacttaaaaatcaactttttaaaaacaattttttttctaaaaaatcaaataataatgaatagagggagtatcgaccaaaattaaattttgttattataaaaatgtgaaattattttttcacaacaaattatttagcactttcagttgggaaaatggacacaaaaacaattgataatttctttacggaaagataagtatgttttcatataaaataaataagtcaaaataattaaataaataattcgaaattagtgaattacctctgtgaaaactatggaaaagtagaattttccatatatttttaatttctatctaccaagctttttatttcaaaaacattcatccaattaataaaataaattgaaatgtcaaagtgaatccaataaacgaataagccgacaaataaaattttagcgtgaagcccacgaggttttttttatgggccccacttttctccgcaccaaatcactgacttctctttctccgtatctttcttcagctcctaaaacccagaaccttctttttccggcgagggaagagcttcctcagccctaatcgctaaatcgatgaaattatgctcccaacgtttaacggtttaaagatcattccaaaaactcaaccttttgcgtgtctcctctcgccatg

SEQ ID NO: 5407 - DNA, 3000 bp, Unknown
  misc_feature (1)..( 3000): cDNA_ID_1828516_gDNA_ID_1620785_Annot_ID_50418 3000 nt of promoter + ATG
ttattattgaagaattttgtagcaaaaaaagaatgttactgttgagaattgagaattgactcaattgagtcttttgattaagtgagaagaagaagatgaaaagcagagatcataaatcaagatgaaaaagaagaagaaatgatgggaagaggaagaagaaagtcaaaatggagttagtcaagaaggccattactgggccattagtcaagcccatacatttgggttgttttgtttaaaagtaactaagctaaactacaatgattaagagttgtttctaagatgagtattttatccttgcttgtaaaactaggctattatctaagagctaaagtctaacttgtagttgttaaattagatgcctatacaaaccctaagaaaatagaatatttttacaaaccctcatataaattatgcatttatagttaattagttttggacatatgggctacttgggagttgggatgaagtacttgacaagaaaatcaaataaagaagtacctcaattctatctagctcgaagcaaatctaattttggacttagggcctttttcaaaatttctaacagggtattaggacatatgttaattcgaaatcttacacaaaattctaaaacttttcttttttataatatcaaatacttctcaagcactccttcacatcacatgttagcaaaactcttaacatatggacactttgcaggagtatgtccctccagcaagaaacctcaaatccgctcaaaataaattaatcgatttttagagaagaaaattacatgcaaatatatcaacttaattgataatccacatagctaatagctaattaatcgattaaaaattttacaagtttcaggcattgggccggccttggtttcaggaactagctagtaaggacaaggagtttggtctaaattttttaatgaactttatgattgcatctaaatctttgcattgcatatacggaaaagcaatgcacttttagctacttagttttcctctatctttttagttaaaaatttagatacttagttgtctattcttttcttctcaaagtgtaataaccataatattttccaaggtatcttttgctttcttcttaactaccaacaatgtttttcttttagaaaaaattgctacataaacctcacattacatcattttacttcccatgacccactaacactaaatctacccccaaaaaaaaaatgcacaacaaggtcgattctttaccggttcgatcgaacccatcaacgcgacccatatcccgtcaccactcggcgagtaacatcgttcatcgggttaaagaaagcctcacaacaagagtctctaaactcatatgtgccattttcttatctcttttactatgtttaggcattatcactttcatcttatggatcagtctacaaccacaccgaccacgcgtccatatccgcgggttctcaatctctggtctatccaggcccgacgggttcgagacgtcacacataagcttcaagataacggctcataacccgaaccaaaacgtcggcatttactacgattccatggaaggatccgtttactacaaagagaaacggatcggttcgactaaacttactaatccgttttaccaagacccaaagaacacgagctcgatcgacggagccttaagtcgacccgcaatggccgtgaataaggaccgttggatggagatggaacgagacaggaaccaagggaagataatgttccgtttgaaggtaaggtccatgatacgttttaaggtgtacacatggcatagtaagagtcacaagatgtacgcaagctgttatattgagatcggttgggatggaatgttgttgagtgcgactaaagacaagagatgtccagtttatttcacttgatttgaacaaaagtgtatgtgtcaccaacataatttacatagatatgtattaacattatgaaattacattttgtttttaatgcttacaaaaaattattggaacattttattggttttcgtgtattgaatttggttgtaacttgtaacattcggcctgatgacctctacgatatttgtttttgtttttactagccattatctatatatgactcgacgttagtgttctttttttgttttcgttgacggccgacattagtgctttatataatcttattgtcacctaattatttgcacaatttacgcgtttgattaatatacgttgggaaaaaaaaattatgcttatgttgtcacgtcgtagaacttattattaaagatagttatttgaaatttgagagattgagactgtgcaatagataatatgattatcatgaacaacataatagaaaagaattagtcattttaaattgaacttgtaaaagaaaataaacgttttgtaacttttgttaaaatgattacgtacattttaaaagaaaagtactaaaatctaaaagtaatatgatttttgttttattaaaatcaaaatcgaaataagaaaatgggcaaaattcttatgttaattttgaattcgatctttcaaaataaatctctgccacacgaattactttagtaaaacgattatttaagtcataattttacatagtttatctttattaatatctttcaagatatactttaaaataataaattcctagtttcatcaaatcaatagttttcccaaacttaaaaaatttactcgtaaaagggattggacttttcttatagaaaaaaaatcagctaaaaggcatataggcatgcatataattttatattaagtttgaaacctcgtccttatttatacattatcaagttcataatcattaaagtcaaattaggacagcctggcccaaagttgaccattagaagagggaaacaaaatagtgtatagtttttttaaaaatgaaaatatgcgaaccaaactatatcgtctactaaaaggatatacataagaagagtcaattcaaataatatagacctatagctcgatattatgttgaagaacacaacaagtttactcaaacgaagatg

SEQ ID NO: 5408 - DNA, 3000 bp, Unknown
  misc_feature (1)..( 3000): cDNA_ID_1007534_gDNA_ID_1620785_Annot_ID_50421 3000 nt of promoter + ATG
ttagtttttaaatatttatttacctaaattttactaaatgagtattctttaaaaatttgcaaacctaaattatggtagactagtgattttgttttgttagtccagagtatatttaaatgttcgccaagagcactaatgaaatcttattagattaatttcatataaagatggagaagagagttgtaccatcagcaattctaaagttacttctcttcttctcattacacaaatttatctctgaatctatcttgaaagaaaccttaaacacatgggctaatggactatttttatgataatgattgggctgctctaataataagaagcatacataccaaatttactagtggttaattaaaattagagtcgtaaatccattaaacatagcaatatgtcgaaacccgaacatgcgccagtccaactcaaacgaagatcaatctgacccgaaattgtcaaatgagagacctaaagaaatatgtaagaaacgtggattagcaagacttagacccatacacaacgtacaaataaaactcaaggcccaagtcgagaagcccccaaaaacttattagaaaaagtgaaacactcatatggattaagctcattttttctgtgtgggctagaaatggatcgaatgagctaactaagtcgagattgtccaactaaattcaaagacgaaagaaaatttccatcaaccatttgattcgacaaaagacaaatcataggttacttcactttctcgagtgaaatctgaaactttttcaattttgcgtgtgagtgtgacatttttttttttttaccataaacaagtataatctgttttaactgctgaagattgtaaattcatttgatgaaaaaaaaattaattgcacaataaacgcaaacaaacaatcaaagtcatactgatgtatcagagaggcatgctttgcaattttcaagttgaaatgatctcacaaaatgtgtgtacacaaatgaaaagcctatcaagaagagacttggttcccacctgcgcaagcctatgtcatgtcgaatggctaaacctaatccgaaactccatctctatcacaaatttatacttgaacctaaattttacttagactcattctaaaacagagagcaaaacgagaagaggacacagtcaacgacaaaacataaggtcccataatgcttaaacagaaacactatcctcaatcacaaagtccctttttctgaatagatgcagtaagcaaggggcgcaaggctgaagacacatagaaactctaaaagtgtcaatgtaccaaataacaacaatcctagactgatctcaagaaacagtacctgaatttccaaatatggttcctatattcaatcgactaaagatcccatattcttggttatataagttactcattcagataaataacttaacaatggactaatgtaacagtaaggagttttaaaccatctgaaatagtagtactacaccgattcaaaagtatttcaaatcgaaacacaaaacatccagaaacatcattactcaattcccataactgtttttccaaaactaaagccattaccttgtgaaacagagatcctcaagtgtgatgtaatcaacgccaactcgatggccaatacggatgaattccatatccagtcttccagttatccaagtaaacaactttcttcacagcccagaacgatatgaacaaagccaaaagcataatcaacctttgtgcagtaatattcttcactcgaacaagcacattggtaacaaacgccaaaagcaatccaacaacagtatacaagaatccaacagcaaatccttcagctccaagctgcattccagatccttggtagaaaaacacaagcttattcggatcgttacgatcttgaagaaacatcggcattttcctgataatgttgtgcattgtaccagcaacactaaagaagtaaatgaagatagcaccagataaccaaagtctagtatcatgaagaatagtttctcctttcaaaactcttttgatgataaacggagtagcgataacgatcaacgcaacgataataccgatctgtggtttcgaaagtagcggtggacgttgaataggaccgaccttgagtttagttcgttgctcaacaaactcagccattgattcagctaatctagagtaatccgattgatccatttgaccagattcatcacgtagattcgatatcgaaggacttacaagacgaatgtgaggtaaagcgttaacgccaaagagctggaacgaagattgagacttcgaaaactcgatctcacagaagaaaagcttagttccttcagatccattgttgttagcgaggaatgaagcggagacgatgccgaattcgcgacggagctcttgaagacgaagctcgtttttgctgtggagttgagtagcgtcgaagaagacgagtaacgagtaaggacgaggcgtggaagcggaggttaggaattttgagattccatggtcatcgagatggattacgcctgattcgcttgttgatctgagagatacaagttcgttgagaagatctgaatcggaatccgaatcggaaaacgaagctgcgaatgtggatgatagtgttgctatgaggaagagaagagagacgagttttgatttgagcgccattgttgttgatctctcgttctctcagattcgagaagacgaagaaagtgaaggaaaagggtatttgccgtttaccggaaagcctctatctggagaagaaggtctcgaagttcttggtatctcgctggttgtaccacgtggaacgtttttattggttgatgtaccacgtggattattacgattcgtggcataaaatacctgtgaggctatgagttttgacgagacatatccgactttccaaatccagaaaaggaaaaaaaatatatttaaacatagataaaaatttcaacaccgataagttttcgtcgtaactctaacccattcgaattgatttaggcgttagggtttcttcatatttctctctcggaagaagaagatg

SEQ ID NO: 5409 - DNA, 3000 bp, Unknown
  misc_feature (1)..( 3000): cDNA_ID_3076928_gDNA_ID_1620786_Annot_ID_168138 3000 nt of promoter + ATG
ggggttgatatacaagcagtttcaaatgctttgcgtacttcatttggttctactacgagaatatcacaagatttccaggtatcttcatcttgtgatgaaaattacactaaacctaaagacagattcactgaaatttaaaattgtggcaaagcctttatcagcatttttaatattattgcctatgagctgaaatgtttcatctaaacatgcaagtcggaaaaggcacattttaaaatgatttctttacaacctaatgcttttgagtagccacaaaggtggagaaaacttaataggagtaatagtaggagcctggttgttttacaatgatggtaattagaccgacctcattagcactttctttacttctgctagaatgacttatgtctggaagctatctcatgcattaaaccaaactctcagcttcatgatagttcaaaacgttggatggctactataaatttgagaaattcggatttctgagagaggtgtattatttctgtagatgttttcctactcttaaaaccccaatcagcaactgaccttgtcatagttaagtgaatttcgttttggtgagattccatcgacaggattcttcaccgtgattatagttttaccctgtcctgtcattatagttctaccataatccttactttttgctgtacagggggtgatggaacaattatatgatgttatgtacgagttcaacttttcgctgcctccagactatgctcttgttataagatctcttggttcactggaaggcacggctaagattcttgatccagagtttaaagtgattgagagtgcatatccatttgttatcgggaggctattagcagatccaagcccagatatgaggaaaatactaagggagcttgtcatttgtaatgatggatcaataaggtggaatcgtcttgaacgcctggtactgtcatatagctcctctcgttatgattattgaataatctaacgaatgagcagctaacaagctctattttccaggtagcagcaatatcagaacaggcttctgcgacttcaggagactctccagaagataaaacgttgaagaaatcatcggaactgaaatcattcgacatgcattcagtagtttccgcaacagaagatctgctactgttcatattatccgagaaagggcagagagttcgggtcttccttcttcaagacataatcagagtggttgatattttcctggaagtagaggctcttgagctcaacaagaccatcaatcttaagacggtcagtaaatcatccttccctatttctttctttcgcaacggaatcttctgaaaataatcttgtcaattcaaaactgcaggaagaagggacaatgaaaagagtgagcaatggattcaaaggtctgagtgaggcggtgaagcttgcaccgggaatgtggatatcaatgcttcttcggatgtcaaggaagtctgaggttcatagttatgctttagatattgtttctgcattgtctacacattttggccacaaagtgcctcacacttgttggatccttctctccaaattgctccatcacaataagagccaataattaaacgttcgtctatgctattacatacttttggatatcatatttagcaattagcaaaactaatagaaactagccagtaaatacgattgactcttagtaagaggcttaaaaataacggatcactatggactcagtgattttggtgctaaggcggctgcatttctcgagactatctcaccggactgcattgtcaggtactaacttagttttgggtggaatcatattgaaagtgactttatggatggaattattcggaccgttgtagaattagggctaaatacctctatgacggattcaagggataataaatgttaaggaaagtgatttgcactacatgattttccaaacctatgagattcatatgagatgagagatgcgagaaataatggagagatgtgttgagtcatatattttatttcatctgttaagaaaaattgaaaaaagttttaaaaaaaactaaaactttatgttctatttctaaaatcaaaaaaattgaaccgttatccggcatcacgggtcaaagaaaagtttttatggacgtgaaaacactgactaacacaaaacaatcgtaggttgtgttggggtacaatgggttttaccactagtagctaattactacccatgttggttctcttgattcgaaatgttttttcctgttgtggatctgttgggctctttgcggctttgcctattagatttagacgtttcggctttgtaaaattttctttcttatgcaaccaatagcaaatcttttaagaaaaaaaaaaaaaaaaaaacccgtaattaatatcgtaagtttgactttatttgcttatatgccagcgtcaaatccgattgagcacgtataacaatatccaaacaaaaactaataccattatttatacatacatgttgcatcacgatgaaataaacaccttaatggcagtttaaaagtttgtgtgtatcaccagatctgttaccaacacgtaaatctattacgagatctattacgacttacaagagagaaacaaattgtttaataattcaagttggattgctttcaagtagttaaagtgagttgtggaaataaaagaggattgtttaatggttcctcggtaggaggcaacacataaatatatatcacgagtgagagaaactggatttttttatgttcaaagaaagaaatggaaatgataatcatctctctctgcctagcaacaatcctagcccttcttctcctaaaacaatttctgaatcgaacgtacactgccaaagtcaacctaccaccgtctccgtggcgagttccggtaatcggaaacctccatcagctaagcctccaccctcaccgctcccttcgttcccttagccaccgctacggtccactcatgctccttcattttggccgtgtcccggtcctcgtagtctcttcctctgacgtagctcatgacctcatg

SEQ ID NO: 5410 - DNA, 3000 bp, Unknown
  misc_feature (1)..( 3000): cDNA_ID_2147918_gDNA_ID_1620786_Annot_ID_168148 3000 nt of promoter + ATG
ttcagtatcggatgggagatcacagctcccgaattgtcagctgccgtcaagtcgtacagcgaaattgtgcgtcggacctcaattacagatggaggtggtggtggagcatcagtcatagcttcagagaaaactcacttgaaatactcaattcgaaaaacacagattgcgctctgataccatgagaaacttaagacaagatgtagtttggtttatgttgtcttatcttattaaagaggcgttaaaaccttacttatacaaagcaaaagatataacctaaagtgttgcacaaaggaaatgactaaacaggatatatattgttgactaagccaactaaaatattgaccagcaatagcttcaacactctcgcactctccataaagcttttcactacctcatggtgtttcctgtgaattgtacacacaaatgatgatgattactatataccaaagagtttaacaggaaaaaatgttgcaataagtaatggaccaaactttatgttattctcacgtatccaaatgcataaatactaaacaaaaatcagagcggttccaaacatgcgtacggtacggatattttgagttatagatcaaatactgagatcatgattaatagactcctaatatcctacgcatatcggatcagatttcaaatgttttgtccatccctatatcacaatatacatgcatgatgaaataagctttcattctcacgaccaaaaccttaccctgcacgaatgaaatgaaatatgattttgtcatatcgagctaggcgacaatctgaggtcatggaatgtatgttaacaccgcggaccacggtgcacccaagtctctccaactcttccacgttggcttttccattgttgtagttacgacctagcccatctaccgtacacataaaacattaatcagtaaagttgataagctatattgttgagtttatttttcatgtagtgattatgctagtatatgatgataacaattaaaacaatataaaacgattgatggttttagatctactactacctcgaatatcaaaagatgctgcagtgatgttggtggaagaaccaaatgctttggctagggacaaagagaatgaaaaatctccttcaccgaccagaagtatttgcttatcactatagtggcataccattttacaatctgctgtttttcttttcacaacatgtccttatatacacatgtataacacatatggatgcatgagtcaaattacgagaactcgtattaaatgtttagttctgtctcttcgaactttgtgatcattgaagtacgttgaagaccattcatatttctttttttttttggttcaaatttttttttttacaacgggtttattttaagtttaggaccatcaatttattttggccctaataaataagattatcatacactggaagaggtgacttgctatttgcattcttttttctagtaatgaaattatttttctaaaatgctttcttgataaagatttatatttgcgaaaaaagaatataaaaaaagattcatagtttctaaaacaataccagaagttttattagtttttttgtaataggtttatcaatgacaaccaccacaacatcctccaatgttgaatatcattagagattgatccgggttatacgtcagaacgatatccttttacaaaatagtttaaattttaaattacatttattttgttaatattgtttgttttgttaagtatttaagattatacaattttatttcttaattctataatttcaccgtagtattatcagatgaattttgtaaagactgaaagtgaaaatactaaatactttaagaatttttggctaaaaatctacaaaaacgtacatgtagattatcagtttcaagtattttataaaataaataaaaaaagtaatataataaagagtaacaacagttagtagttggtggcaagcttttgtctaagtctatataaattatcaataaaggtgacaacaatatcccaaaatgctgggatatatatatttacttttgttataaagaaatgaaaatgggctttttggtatttcatgatcagtggagaagtagtggtgacaagatctatatttcacccaacgatttccaaacacgtatttaaagaggatatactaggttaagaaacacaaacaaaactacttctgttcctttgtttggcgactcttcaaaaagcttttggattttattttattttgggaaatactggaattagaaaacttatacacataaatcaaattctttcagatacattgtattctctaatatactttaaagttacgtaattttaattacaaattcttacgttcacctttaacaacaacgaaaaaggttcttcttatgtagagaaagaaaagtcaaaagtattgatgaagtaatatggtgactttgatgcaaaaccaagcttaattccatttaacaaagaactcatcttcttctattgaattaataaccttataaattctataaaaagcttctatttttgaggtaaaattgcaaaaaataagcagaggaaaacagacaagaatgttcttagtaagagacaaagaaagatgtgtgttctggtcaaacatttagcagcaaaagctttgaccttttcctttcgtctctcttgatctaagttttatcctttagtttctttattcattttctttttcttctcttcttcttcttcaatggtcatttgttgttcatacgaaaacagggtcaacgaatgtgtgcaaatttcatttttgtttcttgagtttaattcaagattcatcatatttgattcccaaatctttgatttttgacttgcttacatcaaaagattcatcctttttttaataatctgagctcaatccaatccaagacataccaacttcaaacaactctcttgtcctcgcccctcggatctgtttttcagaccaaacccatatcaaaagtttcaacatttaagctcaaaacagagccaaatcttgaatctttctcctccttgcaagtt

SEQ ID NO: 5411 - DNA, 3000 bp, Unknown
  misc_feature (1)..( 3000): cDNA_ID_2147908_gDNA_ID_1620786_Annot_ID_168146 3000 nt of promoter + ATG
ttgaggttgatgttgatataagtagctcggcgattatgacggcgcttattaggtttatgttggggtatgttacgtatttaatggttgatattggttttgttgtggaagcgcaaacggaggaggagttgccggagagattgattggtggtgctaggatttgtcatatggagttatcgtcggcgtttgtgatttatgatgatgttgatgggaagaagagttcgcagcaacggcggagaatgatgggtgcggcggaaggaaatcacagcgaggatgaggattgagatttgaaacgaagatacgtcaacgcttactttttttttttgttgggatctgagttattaaaaaaaattgattattttgtttccacgaggtgggcaagatttgagattagtttttttttatatatataatgtaaaaaatttggcaaaattaataaatatgttttgtttatttctaaagtagaacatcattttttaattatctaaacatgattcaactaataataaaacaatttaacaaattaaagaatcaaatttattaattttattttaaaaactaaaaacatcatttatgttaaaagaaatttttcaatgatatatcagaaaattacttacattatgatcggtacgaaaataatatttatcatatttgaaaacatagaaagtggcgccataatatttaaatctattaatctgtagtgtcttgtgtgatacaatgctagcttgtcaacacgataagctgcgaagtttcattgaactgaagagtatagcttgtgcgatacattcaaatgtaaatttgacacttgttaaatgcaaaatatgattacgatgcgaagatatttaaggtttggcaaaacgaagtaaacaaaaacataatcagacatatatttgagaatcagctatttcttaaacatgtaagtgatagctgatccgataggatatataaaatcacaattacttccactttctcttttgttggaggaacttgggaatgcccatttaatgaattgcattctctggattaaacgcaaaccactttcttcagctagagcctttaaatcccacttgttaaatgggtttagtgtgtttagagtgatatgaatctctccatcttcgtctttcatcatctctcttgcactctccataaatcctccaaataccttattgcgtttcctgtgaattgcacactcaaatgttgaatatacattcatatgaataatatatatataatcataataaatattatacatatatatttttaaaagtatatatatgaaagtggttccaaacatatatggatgtatcaggaatccaagatcttgttatgaatttccaaatatcaaacttttgatatataagatctgaaacaagctcatcaaaaaccaaaccctgcatgaggaaaattaaagatgattatgtcgtaatgagctaagcgatcgtctgatttcatggagtgtacattaacaccacggaccacagtgcaaccaagtctctccaactcttccacgttcccttttccattgttgtaattacgccctagatcctctaccatacaaaacataatcgccaaacttgataagctattgttctttatatcggataacgacaataacaaaattgaaaaaaaaatgattgataattttagacatattactacctcgaatatcaagcgatattgcagtgatgttggtggcagaacccaaggcttttgctaaagacaaagaaaatgaaaactctccttctccgaccacgagtattttttgctcattgctatatcgacttaaccttttagattcctgaacatccatctcagatcagttgcatgtttaagtcaattcacaccatgtccttttatacacatgtacatacacatcacagggatgcattagtcaaatttagacaattttagtgttaaatgctggattttgtaattcgtctcttcgaatttagtgatcatttatgtacttttgaaagaccattcattttttttttccgttcatatttttatttttatttttgttaaaaccattcatattctacagaggataatcaaacttcttgttttgtttttcttggttcaaaagttctttctatcacggattagttttagtttaggatcatgaatagccctaataaatatgattatgatatagtaataataatacttaggaagagtgactagctcgttttacattctttatctaatgatgaaatcatatttattattcattttgtaatatgtttatagataacaacattcttcaaaagttaaatatcatttaattttcaagtattttataaaatagaaataacaagtaacaacaattattaattagttggtggcaaggttttttgttttttttgtctatttcagtatttctatataaatgatcaataaaggcatgacacactcccaaagatgctgggatatttaatattatttcttttgttatgaagaaatgaaaatggacatttcactttttggtatattataaaatcagtggagaagtatagtggtgacaagatctacctttgatccaacgatttccgaacacgtatataaaaaaggaaatactacgttagaaaaaacaaaactgtccctttgtttggcgacttattttgaaaaaaacttagtagattttttcttttttttgggaaatactgaatttagaagacaataatgcaatgaatattatacataaattaaattctttcagacacattgtattatttgagatatgtggtcatatatacgtcggctatctttttccctttatcctttattttcttcttcttcttcttcattgtaattcatacgaaagcatgtcaacgaagcttgacttttaacttgcgtacgtcaaaagattcatccttatgatctgagatcaatccaagaaatatccacttcagacaactgttgtcctcggatctgtttttcagacaaaagtggagctcaaaacggagacaaatcttcaatctttgactccttgcagaaccagtt

SEQ ID NO: 5412 - DNA, 3000 bp, Unknown
  misc_feature (1)..( 3000): cDNA_ID_2147922_gDNA_ID_1620786_Annot_ID_168149 3000 nt of promoter + ATG
gaaggaaacagtgttttcattatgtgatcatagtcataaagtattaggagaaagaatcgttttttttccttagacatccacctagttggcaattctagagatttgctttcaggtgtcaaagataatcagaagagaacattaccatgatatattggtaataaatcaggctgtaccaacttcgacatcatctgaaccatcagctgccgctactaaagggcccttcaaaccattttcattgtgaccgataatctcacgagctgccttttcaagaaagtccttcgcagctgactgaacagactgtttctcatttgattggtatttcctctttctcgcagatgtttcagaatacctgatcctcgatttctctcctttactgaggtctctaatgctttgcttttgggctagattcatttagcaatgactgttagagaaacaatgatatacagtaaaagagagaggtggaaacaacaaactgtacaaaagcttactcgatgtaagatcaggtagagaatgttcgatgaaacgggttgctgcctgacggtttaagacagtggtcgggcgcaaaggtcctacggtaaaaaaaaaaaagagaaatagataagagaacatttagaggataagatattgattagaggtagccattcaatgtctaacaaaatcgaaatgactacaaaatttccttatcagataaaccaaacatcaattagacaagttaaatatgaaacgatgtgcatgaaaagaaatactttcgagaaactaagtcgaactagtcggcccattagtacccggtagcatatcgacaaaacgattcttgcccgaaaggcccacgagtcatttcacaaaaacgcagagcacaagtgttaccaattgagtaagcactttctaaacggaatataaaagctcgttgataaacaaagataagacactagcctccaaaatttgagatagtagacaagaacaaatggatcttccacaataagaaaaaacttcgaaaaacatcgcgaaacattaacatcaacaatgagccacaaataaattcaaatcaaataagttgtctaaatggaagtaaatcttgacaaaacaaagttgaaactatccactttgattttaaagctattcaacggaaaaacaaatacagagaaactagatcacgaatcagtctccctaatttcattcaatagactacgagaggaaatctcctttcaatataagatgataggtagatgcaatagtaaggtgactaaaagataagtccagaacaatggattaggcgcgattcattattagaaagccttccaatggaaatactacttccctgcatttaagatgggtacatgcaataaagagtctttcaacgaaaatcatcatatctaccaaaaataaataaaatcatcactgagcatagaacaaaacaaagaaaacaatctaaagcagatacatcatcccaacaaacagaggatcagaaaagcaagtcctcggaaaatgtactaatcaacgaagaggttagcacctatctgcctaatattaagactggctaaataaattctaagctgagagcaaaatccttgaacacggttgaaatattatccccaacaactttataaggtaaatggatgcagcaattctccaatgaaaagagaaagccttctaatggaaacactacttccctgcatttaagatgggtacaagcaataaagagtcttttaaagaaaatcatcatatctacgaaaaatagtatcaacactaaacatcgaacaaaacaaggaaaactatataaggcagatacataatcccaacaaacaaaggatcagaaacgcaagtcctcaaaatgtactaatcaacaataaggtacacagaggatatcatttaacgcttaagaaatcgttagcacctattagcctctaaaattacgaaaggctaaataaattctaagctgagagcataatccttgaacatggttgaaatattatcccccaacaaaggtaattgaaagcagcaattctccaatgaaaagagaaagccaaaaaaacttgcttaatccacgagacaatacaatggccaattcaaactgaaacaaatggtttaaaccaaaagacacacagaaccaaacaagtttttgatctctctacaaatcaatccaggcaccagaaaatcaatctttacctttactttgatcaacacacttctgaaacttctctctgtacacgtttatccgctcctacaaaaccaatactaccatcaatcaaacaacaaaagataccattttgattaagttaacaagataataagagaactaaaacatccaaagacacatacaatttcagattttacacgatgatcatcaggatcaacaccagtacatctcaacctcactgtaaacacacaaaacaacaaaaaaattcaaatttatcacaaacaaacaaacttcaatcgaaacagattcacaaagaagaaagagtgttacgttcgtaaagagtagtggtggcttcagctagcaagtgcatagtcttagctcgctgtaatggttgcattgcagcgagaacctctggctcagctaaagtcagcatctgctcaagctgtggcttcagttccttgaggtacgcaagtgtttgattcaccgcttcaatcgctgattccggaaccactcctccagctcctccgccgctacttcctccacctccttccatcttcaatcgaatcgagaatttgaaaattgaaaaatccggcgtagatagactcagaggtaaagagattaggtttccggttagattctctgagtcgccgacaagtgttgaaatttttatctttatggagatgaagaggcgctaacacaatcgggaaagagtgacgtcagcattatcaaatatgggccgttaataggcccaagacaagtcaaacatttaaggcccattaaactagtgaatttatttttatgaattattaaaaggtttcaaactcaaatgtagatcagatcggtgattgatcagatcggcggcgatg

SEQ ID NO: 5413 - DNA, 3000 bp, Unknown
  misc_feature (1)..( 3000): cDNA_ID_2147937_gDNA_ID_1620786_Annot_ID_168154 3000 nt of promoter + ATG
atgttttttcaacattttttttatttagaaacactaactaattataaataaaaaacttcataaacttaaagtttgaaatgtttttctattagtatcttttaagctattctttttatgatattttatgaataagatatttctataaatatattggatttgtgtaagtttttttttaatgttttttactggccattgtagaataactccaggtatgttttgtaaatattttacttattcatgtagttaaactcaaaaagaaaatatatttatgtagtatttccttagtttatacatatatatatatatatatatatatatatatatatatatatataagttcctgaatatgcaaatatactctacaactacaagtggattcaaagttctctgaagtttagtcatcaaccattgttgtgtctcgtgcatattatattgctcatttgtaaatcgacaattgatgattatcaagatatcatacagtagctagagtgtaaacgacatctgggaatgtacttgtttttgcacgaaacagtaaaatgaagtagtggcttctatatcggcagttttgaaaatctcccaatgctacattgcataatcgaactatgataatgcctctcctcaatccaaaaaaaacataagatacgtacatcatgctaaatgtaaagacacataacacttcaaaaaaccgttttacattacttctttcagctattttttaatgttcatttcatatggtagcattgtagttaactttctcaacataagtctttaataatctaatgtctacacataattccataaatatgaaatttagaaaaacgaatattaaaaacaaacgcaacatagcgtggatactcatctagtgataaggataagaactttaggatacttcttaagggttacatttagaactatgaaaatataaaatcaactccattgggtaaggaccgggataagctgaagtggaactttcttaggacagacaagtccatatgattcttcaagatcaacatcttctacctccattccttccggaagcttccaatcaaatcggtaaagaagattgataagagtcaagtgtaccaaagccatacccatccctataccagggcacattctccttccgctaccaaacggcaaaaactcaaagttcaaacccttataatcaatctggttatccataaacctctcggggatgaaagcttctggatctttccaaacgtttggattcctatgaatagcccatatgttgacatggatccatgttttctttggaatgtcataacctccaatctttacatcttttgaagcctctcttggaattagaagtggaacgagcggtaataccctaaacgtttctttaactaccattttcagatattcgagtcgttctatatcttcctcaatgatatcgtctttgttttttataacttctctcacctcggcttgcgctttcttcataactcttgggtttgaaatcaaatatgtcatcacccatgtcataacttgtgcagaagtgtctattccagcgttaagaatattctgtaataatcaaagagtacatatttttaaaatttatgcaacatgtgaagaatgaaagtatattacaaagtgagaggttcatattacttacgaaaagaattcctttggtgttgtctcgagtaagttgaaactccccaagttcaatctctcccctttccatcttgaggagcaagtcaatgatatcatccttaatactctcatcttctagatgatgctttatagattgatcaaaaaatgcatccattgccttgaaaatcttctcacatttgctatgtaaccctgtgatcctatcgatgattctaccaatgatcgggaagtaatctgctgctgcaaaactccccaccacctccatggttccttgaataacttcctcataaagattctcaagtttacttcctttaagattgataccaaatacaactctacaaatcacacttcctgatagtttcattaacttcgtgttcaagttaaccggtttctccaatgacgcagcttgtgtgatgaaatcaacgagtgatgcaacttcttcttttcttgtatgttgaaatgattgtaccctttttgcagtgtagagttcaacaactgtcatctttcgtacctccctccaatatttggtgtagggacaaaagccaatatcttttaaattgtatgtaagtcttgcaggataagtcatataaggccgcgaacaacattctgcgtcaaatgtttttaaaacttcctttactgtctctggtgtagaagccacaacagtagacacacttccaaaccttagagccattagaggtccatatttttcggataatttgaacattgaactatgaggtttagatcccaattggtgcaagtttccaataataggaagtcttgggggtccgggaggtagattcttctttgtctttctagtgttccttacaatgattatagttgaaaagaagacgaatgcaacaatgatataccacaaactcattttgcttcctacacaaaaggataagtttatacaaagcaaattagtttatggttgaaaagaagacgaatgcaacaatttatattttacaatcctaaaagaaatactataagtttataactagcaagcttagtggatcatttaaccccaaaaaaaaagtgtggtgttcattagttatgagtgtgacaataaattctgatgttaaaatgtttgttccagtaattttgactttaaaaaggaaaaaaactactaaaccaaacacatgggccacgagaaattttagaagattttttagggctatgaatgtgttaagtttgattcaagaaaattggattttaaagactcaacaaaaatatattatctaaagtcttaaaagtttttgtaatcaatcaccaatagatgaaaaatatagaaccccataaaataaaaccaccaaagcatcatcactctgtcgtttttggcaaaacaaaaaaaatcatcactctgtcgtaatg

SEQ ID NO: 5414 - DNA, 3000 bp, Unknown
  misc_feature (1)..( 3000): cDNA_ID_3076908_gDNA_ID_1620786_Annot_ID_168156 3000 nt of promoter + ATG
tagcaaatgtgagaagattttcaaggcaatggatgcattttttgatcaatctataaagcatcatctagaagatgagagtattaaggatgatatcattgacttgctcctcaagatggaaaggggagagattgaacttggggagtttcaacttactcgagacaacaccaaaggaattcttttcgtaagtaatatgaacctctcactttgtaatatactttcattcttcacatgttgcataaattttaaaaatatgtactctttgattattacagaatattcttaacgctggaatagacacttctgcacaagttatgacatgggtgatgacatatttgatttcaaacccaagagttatgaagaaagcgcaagccgaggtgagagaagttataaaaaacaaagacgatatcattgaggaagatatagaacgactcgaatatctgaaaatggtagttaaagaaacgtttagggtattaccgctcgttccacttctaattccaagagaggcttcaaaagatgtaaagattggaggttatgacattccaaagaaaacatggatccatgtcaacatatgggctattcataggaatccaaacgtttggaaagatccagaagctttcatccccgagaggtttatggataaccagattgattataagggtttgaactttgagtttttgccgtttggtagcggaaggagaatgtgccctggtatagggatgggtatggctttggtacacttgactcttatcaatcttctttaccgatttgattggaagcttccggaaggaatggaggtagaagatgttgatcttgaagaatcatatggacttgtctgtcctaagaaagttccacttcagcttatcccggtccttacccaatggagttgattttatattttcatagttctaaatgtaacccttaagaagtatcctaaagttcttatccttatcactagatgagtatccacgctatgttgcgtttgtttttaatattcgtttttctaaatttcatatttatggaattatgtgtagacattagattattaaagacttatgttgagaaagttaactacaatgctaccatatgaaatgaacattaaaaaatagctgaaagaagtaatgtaaaacggttttttgaagtgttatgtgtctttacatttagcatgatgtacgtatcttatgttttttttggattgaggagaggcattatcatagttcgattatgcaatgtagcattgggagattttcaaaactgccgatatagaagccactacttcattttactgtttcgtgcaaaaacaagtacattcccagatgtcgtttacactctagctactgtatgatatcttgataatcatcaattgtcgatttacaaatgagcaatataatatgcacgagacacaacaatggttgatgactaaacttcagagaactttgaatccacttgtagttgtagagtatatttgcatattcaggaacttatatatatatatatatatatatatatatatatatatatatatgtataaactaaggaaatactacataaatatattttctttttgagtttaactacatgaataagtaaaatatttacaaaacatacctggagttattctacaatggccagtaaaaaacattaaaaaaaaacttacacaaatccaatatatttatagaaatatcttattcataaaatatcataaaaagaatagcttaaaagatactaatagaaaaacatttcaaactttaagtttatgaagttttttatttataattagttagtgtttctaaataaaaaaaatgttgaaaaaacataaactttcatatttggaacgaaacaaacataaaatttaaaatgccatgtcaaaagcaattgtttttattgttttaaatttgaaaattcatgttgttttggatattattttttcatttctaaatcattcaaggagtgtatttgattattttggtggattttagaattggtctgcttttcagtgaatttcaaagatattctaatgattgttaacaaaaggcttttcgattgagtgtggttttataaactgctaaggagaattttggtatcaaagttagatacccctacacggctagtgatgaagaagacaacactaagaaaaccctgtgaattgtgaaaaagatttgttacctgcattattgttccatcactatctcacaacataaaatgtgtaagaataataacaaaacgtcttgcgtctccaatctccaaagctaaccaaaaaaaacaatcagaagaagaggaggaaagaggagtagagacgccaatagatctcacggactctcacctattgttaaaataacgccaataatttgttagtacgagatctagtaatagtagttttatttaaatacaaaaccctgtgaaagagatttgttaacttcaaaattgtacttttatttaaatactaaactgcagtaatagtggaaagactgaacaagagatcaaagtaagaatcagagcttaaacgagattatgagaaatatgagaacatgagacctgcacgattgaatgatgatgagacatgaaagggtttcggttcctttttttttacataccttaaatgttgtctactttttttttttttttcaccaaattcttatattaaaattaaaaagatacatgaagattagttttcatcggacaaacccgaataacaaacccgaataacaagtttgaaaattgaaaagttgaccaaacataactcaaacatagagacactagctgaagtaagtttgataggagaccatgagacgtttcgaaactaactaacacaagcatgcccatgagagaaatcgtaaacaacacaaaaacctcgactggtaagaaaatagtcaccgtaactagtgacattaaaacgaaattcaaaccatcaaacgtggttctaggttggaaacaacgtggatttgccttagacgcagacatagagacgtcggagaagtattcggtaaacaagcttcgctgacg

SEQ ID NO: 5415 - DNA, 3000 bp, Unknown
  misc_feature (1)..( 3000): cDNA_ID_2147955_gDNA_ID_1620786_Annot_ID_168160 3000 nt of promoter + ATG
catttaaaatcaaataaaataatatcgtatatttataatcatctttacaataaaagtttttagtttaactaaaatataagcttacatgcggtatactgcaagttaaaattataaataagcaaattaccatcacgatgtttgtaccttctcacatacacacctatcaaaaacttaaaacctttcaagacctcttggtatattcaaattaggatttcttcattcatggaatcattcttccaagggttttaggatgtcccatgaaatgattttggcagaagaggatgtaaaacttttcgaataaaacgtagacagcaaaacatatgtttttttgggagtttttagataattaaatcagagaatggggctgggcatatgagtaacctattcaagttcgggtagaacccgttcgggtagaacccgttcgggtttgggattaatgggtatatgatttactacccaatagaataattctaaatatttggttctggttcgggtcgggtccatttgggtttgcgtcagtttggataaaaagtttcaggccctaaaaatacccaaaaaaattgaaacgggtattttgtatgtagatagtgggtctccaaacaaaaaaaacttttagatttgttaagttttaataaatttaattatatttgaatatattttactaaattttgacaaacataacacataatttttgaatagtttagttgttttggatatttaggtccaaaattaattgacatatttagatttataattataattttagataattagattatattacgattaaatataattaatattttggatattaaattaatgtttgggtttttgaataccctctttggataaagggtaatttctggaccaatcggatatccacgggtttactaaaactctacctaataaggaaatttcctaaaattctaacccgctctaacccggttttttggttcggataatggattggttatcgggtctgttttttcgtgagccctatcaaagataatctaatatagggcccaattaggttcacaaatataaccaaaacattatacaaaaactaattttaagttaggccaaaaattagatcttttaatacaaaggaaacatgtttcttactagaacaacttgtatacaaattttacacatttacttaaaattatatatgttgtatttattataaaaataatatttttaaacaaattcaatccaatgcagcattatatccaaatagtaaaaacattgaaaaatattatgacaacacttttatattatactatttcttatgtaattcaaataaagtatacaatttagtttatacacaatattaatgtccgtgctatacagcacgggttatgatctagtaatgatgtaatacacaaccttatgtgggaaaccaacaacaagtaaactatatatcaattcaaatgacagattcactgctacaccacagttaaaaacaatcaatcatttctcatcgaaataaatctgccatcaaataattccaatgagtttttttttttttggataaaattccaaagaggttactagtgtgcataactccacgtggtaagtaaacccatagtggatgaatgttatgtctgcaattgataatatgtcaattttgggttaattagtttttagtaattttttaccaataaaattattccacttttagaaaataatcactgcagatttgtaactttcgttcactttgaaaacttttattgaattgaataaatttagctaatcatgttaactattagattataataaggcccaaaaacacttagatgaacccggttagtggttaatacttttactatatgatacttaattacttaccgatagcattgacagattaaaaaatacacaaaagctttgtcaaacaaagagatttgaaagacgaatcaaatctctctacatacagggaaaattatgaatagctacatgtcaccatctgtttaaagtaagatccaatgttctcatctgtatcttttgactatgattgatgactatgtgacctatatcatataaatacaacgtggtaaattgttatactcattaagctaccatagtccataatacactttaatttcccaattcacgatttcacattactcactaatctaacattttatgatcaatctattgagtattgaggattgatgaaacaaagaacgaaggtatacttaaatggagatgtcatataactcagaaagaacttcacatatacatttattaaaggaaaattagttttcttatgaaaataattagccattaattagaaactgaaaactcttaattagctttttcccatttttgtgtcggccatatgtaacgttggacccatcaactaggtcacaattggcatacgacaaatatacataactttaaaccattagatcttttctctttcattacaagctaaagtaattcaaatttagctaaataaatttaaactaaaactttggaaatgtggtttagattgttatcaaaagcttaagtgggtttgatcttgccgatgtggcttccaaaagaaaagtattaattggttgaagaaagtgacttttgtcatgcaacctagttgtatgtcatgatgtgaaattaagtgggaaaccaaaattcatattgacaaatccactaaactctttagatgataaagtagaagagcgtgtggaagtttcaaatatcatttcctttaagattacacaacaagagaaaggttgatccatcataaagacgaaatattctttaagtcatatacatggtctacaatttctcactaagatacaaagtaaaatcgataaatataataatgaacgtacgagtggtttccaagttgttctaaccaggtgctttgtcaagatcatcgatctatattcttacccgaaatacttacttaactattattacaaagttcgaataaccagttcttttactttgtgattagtttgagctttggtttgactcaatagaagacaaaagaaagaatag

SEQ ID NO: 5416 - DNA, 3000 bp, Unknown
  misc_feature (1)..( 3000): cDNA_ID_2147947_gDNA_ID_1620786_Annot_ID_168157 3000 nt of promoter + ATG
ggaagcttccagaaggaatgaaggtagcagatgttgatcttgaagaatcatatggacttgtttgtcctaagaaaatcccacttcagcttatcccggtccttacccaatggacttgatgttattttttcatatttcaaaatgtaacccttaggaagtatcttaaagttcttatcattattatatatgaataaagaaattatttgatgaataatgctcattttatttggtaacgtaaccttaacttttaataaccattgctaaagttagtctaacaaatttagagatttaattacacaaaagagactcttatcaatcattcgttccacatattttgttcattccacttataatgttgatcagttttttctgcattgccctttcagttgtcactatttaaatccctactcacaatcgtttcgtaaacattggaccccagctattgatatgcttgctggaaattttggcattacctctcatattcaaataaacatatacctcatattgaaaaaattggcattattaattcgtttgtgtggacaaatatattatgctttattgcaaagtaaacttatcgtgaaggaattctatccaaccatcctttgaataaacaaggattgataagactccaaaaactattactataattttgtggttgagtgatagagattcccctgtaacaaacaaggattgataaaagacccgtgaaaactctcttttaaaagaattcacgtaaaatatattttatcaaacagacaataaatactaggatttcaatataaatataattgccgaccaggaaaatatgtggtggttcatttcttttggacaccgccacaccggtcaatttgatcagtcatcttatgaagattattacatatgtgtttgacgtaagacgtacattataaaagggcaatttgtatataataaattattagtttaattttccaaaaaacaccactaaaatatattatttccaaaagtaacaaaactaaaactaaacaataccttcaaaaatcaaaactaaaccctaaatcttaagcaaccatatcccataaaaactatattctaaacttcaaattgaaattttaccattgaacatcaattttggtgtttatggtatttttgaaaaacatttttagtggttttttagaaaatcctaagaatattgaatacccaagcaggacaaaataaaataatttgagacagcatgagaaatggaatcgttgagttggatacaggtaggaatccgaagaaataattatgtttcaaagacatgatatactgcaagaaaacatagtaaatttttaccaattttcctatgaaaattttggtacgaaaaaaaaaccatatacctacaacctttttatgaatattttgatagaaaaatggtaaaaaaaatttatgatttttttacaaaatattttacgaattttcctacaattttttttttgtataaataacatgcatatatatatataaatattttacaataattttgaattatatcataaataagatcaacattaataaaataaatgatttttttttgtaagatgtgtttggcgagacattatttaataaaaatggtaaactataaaatatatatattttataaatatatataatttgttaacttttatatatagtaacttcaaaaaataaaacgttttgcggtataccgcgggttaaaatctaactatacttataatacatataataataccaaaatcgttgctaagaatcagacctagatacgtcgccggcgctgctaatcaatcctcgatcgaattccttttaatacactgtcacggatatgaatatctctatcaggtttgtcgtgtcacctgattcttgcttcaagattacttctttataccattaaagtttggatttagcttctggtttctcatctactaaaaaaataattattaaaagcaacattagtatttagaacgcaaaaaatatatatatgtggatagattaaatttctttgtaaatatttatgggacaacgagtacgaaagccattttgaagattcaaaataacaaaattatcattttgttaaagtgttttgtaagagttcaaaaccttgaaggtttaaagtataagtaaatattcgtttgaagatttttaaatggattttttcctaaaactaaacgttgaataaaacttgtggagttgtggtattgcaaaccaaagttgtactatagagttggtgggtgtgaaaacttctttcattgggagacctatgatttgtagctatataccttttatgtagttgccaataagtcagtatataattagaatatgtataaaaacccttataaatttaataataatatttatgaaatgagataaatatttttactaacaacaattatttctaactttaggtatacttaatatataaaatatattaccaaaataaggagctcaaaatgtgatgttttctagtggacgcttatataaatgtgcgattgtcacacagtgtcatctctccctctccgtctccctctttctaaaatctgcggcacaaagtatatgaattaaggtaatcttcaattttatatttatttgtgtatatatatgtgtattagatgttgcaatattgtagattttgaacccggaatttaatacaaaaaaaattcttaaacccggaaaacaaaaactaggtgaaattaaaataaataaataaaaacgaaaaggtaaaatttgttaaaagctataagcgttatttattacttattcgaatattgcatgcattttgcctaccgtgatcatataacgaaatttgcaattcttacggcaaattgattctttggtgatcatcttggtttgtgcagctctatatatatttgcatccacttaacatgtttttttttgggtagttggcagcatcatgctatttatttatattctcttgttaatcatcaaataaactgaacaaattgaaaattaatttactttacataaactatccctttttgtgtagaaagcaac

SEQ ID NO: 5417 - DNA, 3000 bp, Unknown
  misc_feature (1)..( 3000): cDNA_ID_2147939_gDNA_ID_1620786_Annot_ID_168155 3000 nt of promoter + ATG
aatagtccaaagattttggtgaaagagattagtgttgttgactgaaatatcgaatataaataagtgatgatgacgcaatggtagtatttgtttgtagctatcgttggagaagatatttctagcggaatttttgtcattagctccaagtatcaaaaaagaaaatactaatgacacaaatagtgagtatacttatacatgcatctatatattaaagtttttatgtcgacgagaaaggacacgatgtggaagtcaatttcgtcatgttgttttggatctttgttttttgaggctaaactatagctaattaatactaaacacgattactgtatatacacgtagaaatccttaaatgttgagctggtttatttatttcactaatatcattttgttaaacgtacaatttttattccaatcgagtaagctttttcctttaagttgtttggaattttgtttgacatgaaatcagtaaaaaaataatcaaagtatttggtatttatacaaaggcctagtaacaatataaacaacttacaaaatcaaatctatttatagaacgatcttaaaatatcaagatactaaaactttgggaaaaatacaaaacaattacaaactttaagcttaggaaggttgttaaataaaagaatttgttagagtttctaaataatttaactatttaagggtctattggattaaggattttgattattttggtggattttaaaattagtgggcttttaataaatatcaaatatattctaatgattataaaaaggcttgagattcagtgggctcttatgatttttttaaaatgctgctaaggagaattttcgtatcaaaagttagatacctctaggcccatagttttgacgaagacaacaactgtgaaagaaaagtgttacctccaaaattgttctactacctcacagaacataatgtgtaagattaacgtcaatgattttttttatttttttgtcatctacgtcaataatttgttaataagagattagagatccaactactaggatataaaattttaaatagtaaatgcaataataatagtagaaagatcgaacaagagatcaaagtgagaatcagagcttaaccggagattaagagagacatgagaacaacgaatggtcaagatgaataatggagactaccatgaagagatcaatacgatagaatccgacgataacgaggcatgaatgaggctttttttttgtttttttacgttgatgttgtatatatgggagatttcatatttttaatttgtttgaagtcactccaaatttcatgtttaacaaaaaatagtaataatatatgaagtttcataaaatcctttttcattagatttttcccccaaattgctatattcctattagcatcacattttctatgaattttcatataattaatcgtataacgagatatttcaaattatttttcaaaagtttcaagttcactaattacacatttgagaagatattattgatgatttggaagtccttcaaggctttaacaaaaaaagatgattagtgatttaatttgggctactgtcacggatgtgttactatccgaattcgaactcgtgtatattacatgacaaagaaaaacacatttaaaaatcatcgattaaataacatgaaaacatatatacactcttcaatttttttctaaattttagattttggtggaaaatttgtagaaaaacctaataagtagatctaaaatcgaaagttcaacactaacaacatttatattgttgattgttcataataatttataataaaactaaatcaaaaatatttatagtgataatataatataatatatttggaacaaatataatatctaaagcatcaagtttcacactaaccacatttatattgttgattgtttatcacacaccgtagatttgctgccacgagtcaaatccacaatccttttcgcaagcgtttgacccagacttttgatactcgtttaattataaacacacaaatatcaaaataacatatcaccttatcttgaaaattgtggcattatattcttttgtgtggacaagaataatatgcttaattaaataaacttataatgaaagacttccatgccaccacatccttgaagcttatgtaattgaaatgtcgtgaaatgatgtataaataattaaatatgaaatcgtcacaattattgctcaaaaaaagaagaaatcgtcacaattatatatcccacacaacaaagtccaaaaagaaagaagttatcaacaacaaaaaaagaaaaaaaaaagtcccacaaacacaaagtgtaatatctaaaaatccatatctccatctctcccctctatctatcgctccctctctctaattcttcggacacaaagcataagacttgaaggtaatcctacagaaatatcaaatattacatattctcaattattattttttaaacacaaagtgttctttacttgttcgaatgttgcatgtctcttgaccgtgaaaagaaatttaggattcttcattacgacagagtgatgattttttttgttttgccaaaaacgacagagtgatgatgctttggtggttttattttatggggttctatatttttcatctattggtgattgattacaaaaacttttaagactttagataatatatttttgttgagtctttaaaatccaattttcttgaatcaaacttaacacattcatagccctaaaaaatcttctaaaatttctcgtggcccatgtgtttggtttagtagtttttttcctttttaaagtcaaaattactggaacaaacattttaacatcagaatttattgtcacactcataactaatgaacaccacactttttttttggggttaaatgatccactaagcttgctagttataaacttatagtatttcttttaggattgtaaaatataaattgttgcattcgtcttcttttcaaccataaactaatttgctttgtataaacttatccttttgtgtaggaagcaaa

SEQ ID NO: 5418 - DNA, 3000 bp, Unknown
  misc_feature (1)..( 3000): cDNA_ID_3593861_gDNA_ID_1620786_Annot_ID_168152 3000 nt of promoter + ATG
tcttattattttctaataccgtccgtagcattttaatcattaacttttccaaaaagtttatattttcttagaaagaatcttagatgattaataaatcggttggcaaaaaaaaaaaatgttagatgatttctttgataaaaaaaatctaatatgatttctttaataaaagaatctaagatgatttctcatatttttcaattactagttcatactgaattaaagtttaagggtattattgttttatgatttaaatagagttttagtgagttaaaatgtatgtagaatctattgttattcaaacaagatttaaaaaagtttattaaaatttggtattaatttaagatttgtaagaagtaatttaaaatcttcagttattggattaatacttttataaagtcataaaaagtatatatttttttatgattgagcaacaatcaaattcattgattctctaaaagctgtctctttctttacatttcctggaattgtaggtatgatattttagaagaagaagatgttatatatcacataacacaagattgagactgtaacaaccacatgacgtgaagaacactctaaatatgtcatcttccggttatatactttggtcggaagattcgacaacatatacaagtaatttcatcatcctccaagtcgggagatcattatgagaatccataatagttatgagaaccaaccgaagattcttcatggatagatttactcttcaaaagtcaatgaatttttctgtcttctattgttgctattcacaaatatattttccaaatacacaaagatccacttataccaaatttaggtgaatccttcttcttcttcataacaaattccttagctaaagaataataattgaaacaaaaccaaagatgaacatttgtgaaaactaattctcattcttcaacaaaactcaaagcctagactcttttcttcttatgcttcttcttcacgtcatccttcacaatgatagcatcggctcatctgaatttcaaatgctggaacaatctgactcctgcatttagtacactggtacgtaccaccactactctcatttaacaatcctgaaccagtcctcaactttaacatgtgatatttttgcatgtgatggcaatacttcatgtagtaaaccaagcattatgaagtctacatgtgtgactgtgatggcgtctatttgttagctgactatcattttccctaatcaattttatccattcatattgcttcttctcacaactacaagcacaaaatcgtcaaaagcttttagctccaggactgtggaaccgccactatagctatgttgacaaaagagagagattttgaacgagagaaggaagaaagaagacagagcatgaatagtatttgacaattaattagaaaatctaaatctgttacaaaacaaagacaacatctttttatagacgtgaaacagatcttggccgaaacaacacaaacaataagagttgtatagtaactcttcagtcatgactcttaacataaaacaaaacaacttttacgattgtataaacaaacaaccaaactcaattatacactaacaagctattgagtcttatagaacttctagaagatcattacaactttttggatctgtggttctttttttattcatggccttattttttaccttgggttacatttcaattttgaatcttatggatttggatatgattttcttcaaaataatacaatttacttttcattttttatatatatattatgattcttggcttttattcctttttttttttttggggggacactatatatggttaataagtactcttcttctactactcatgttacatatacttccttctcatgcttctttatccttctttctcttcaatttttccattaaagcttatggagatttcttaaaaagctctctaggggattgaacttcttgaagaagtcaccagaggcgattgaatcttcaatttatccattaaagcttcaacgacgtctgacgatttcttcaaaaagctcaatggaggcttggattcatcatcatcatcaacaattcatcaccatcttcatcatcagtattgtcactcttagtctttttggaaggaagacttcggggttttcactttcacaatgtatcctctcatgaagatgaagaatgccttttctgtattcggttgtttgattcaaaaaccttcttgcatgatttcaagatctttggcatctctttttccgaacaattatccttatttggactcatatccatcaaaggcttggactcctcatgagatgtatgctttcagcatccttagagacagccaccaaagatcttaaaaaccaaaaaaggaggtttgtgaatcaaagaacccaaaacacaaaaagccttcatcttcatcaaaacctaggaattactcgaaaaaagatcaagagaaattacaccaatgacgaagaaggtggtgatggtgatgatacatctgatgatgagtctaatcccaaggccttgccttttatatattttgtgatcgacatgatgtaaatgttactgtaacgtttataattaataaaatatactgttttcctttctcatcgatatggtttctttctttacatgcattaattataattaagtcgaaaattaacgtaaaaatctctaactcgtaaataattccaaacgtatgaaatttttgtactagtttataaaacatctttgtggcatataggtttaactggacatcaaaatactgtatagccagttgacgatcattatggatcatcatgggcttaagaaattaggcccatttaaagttttctcgacggggttagacacgtggcggaatatgaatggagaagaacgatgttacagaaacgaagcaataacggagagagaaacaaggatctaattcatagtgctgcttcttcttctctctgagactctcacaaaatagaaacacaagatcgttaaaaagcttttagctccagatctgtggaaccgccatagctatg

SEQ ID NO: 5419 - DNA, 34 bp, Unknown
  misc_feature (1)..( 34): cDNA_ID_2147566_gDNA_ID_1620787_Annot_ID_168164 3000 nt of promoter + ATG
tgagtcatctgagagtaaatctccatcggcaatg

SEQ ID NO: 5420 - DNA, 3000 bp, Unknown
  misc_feature (1)..( 3000): cDNA_ID_2147570_gDNA_ID_1620787_Annot_ID_168165 3000 nt of promoter + ATG
aactcgttcttcatttagctcacatgctatgatttttccttgtccttccataagagcagcaagatgaatagttttgtttcctggagctgaacaggcatcaagaaccttgataacataggaaaaataaagcacattaactaggcagacaagatacattaagtctattccacaatcaccatgagaaacaccaaatgggacattttttgtcaaatggaaaaatactggtaaatgaatgcgagaactgtggcctacctcccatcctgcttgtggctgcagtgctgctgctaccattgaacttgctttcccctatcatttgaaagaataaatgtcagtcaaattaaccaaatatcaaacagaattcacaaagatcattcacaatttacctgcaaaaatatacgtccattcgcaaccaaacgatgagcatgcaaatcgctgccagggggcaacaccaacaagtcaggaactgtctcgtccttctgcacctgtttttatagtgaaaaaatacgagttaaaatgaaatctcataacaaagagaagattgtgacatcatagaaagcacagttcacatatattgtacacatccaagattttaacatcactaactatacgaggattcagagaaaactcccccggtgaatgacttaaactagacctcccttccacaataactaattctaacactcatcctgcgagaactaaacaacatatctagcacacaagtattcttcaaggtttatataaaaaacttggaaagtaccgtgtaatgcttctccagctcctgcactgcagaatccacatccatcttaagcgtattaacacgaacataccgtggtttcaaatgacctgcatccaaatttaaaaatcaagctacagaaacatactcaaaagccaaaagtaagtgaaacacattatataaaggagggtaacaaaataccagtaagcttagaacccaacaactgatcaacactatcgactttcttcctcactaaaagcgtagctaaacctgacaataacgcctctttatgccgcataagaaacttctctgcatcaccaattgatggagtatcctacaatcacaaattcctcttctagtaaaccaaaacatcttaattcatcacagaaaattgaattaagctattacaacagaaccagtcgcaactggcgaccacctaccttgccaaagaggatatcgtagcaaacgatgaagaccaatggctcttgcctctacaaacaaaagtaaactaagcattaaagataagtgaaacagagcaattttagcaaattcatatgaacaaatacataccttccatttactattcaatacattagctatatcaagaacatctttaatcacagtaagatctgaatacacaacaaattagttccttaagctcaaaattaggaacgaagaagaagaagaagaagtttagttacatttgagagtctcgcagacaagagcgaaagtgccgcgtttgttgcgaacggaaggacttaagacgagtgatttgatggaagcaacggctcgtcgctcggcgtcaccacggagaacggtacggagtatattagctgcttctcttctggcgtagagagctgatctctctaagctggaaaacttttgcttagtagctggtggtgtttttggtttgcgactctcggcgccggaaaatcgttgttttcccggcggcgtttttggtttgtgactctcgacgccggaaaacttttgctttgtagctggtgatgtttttggtttgtggctctcgacgccggaaaatggttgtttagtagccggtggtggttttggtttgtgactgtcgccgccggaaaatcggtgtttcaccagcggcgcttttggtttgttacgacgcgccaccatgataacctctcagtctctctcccctcacaaaaactaaaaccctttttcttcgtcttggtgactttaaacgcaccgttttcggtttcagttaaaccggatcaaattcctatagcaccaatttacatattttactccggttcacaacaaattgtggttcaagcccatgttggcatgttcagtatcacgatcttgttcagtttcagatttgtgtccttgagtttttatgagagttttccaaatgtctacatctatcgacttattacatttttcaatcttgttaagtcagtatttcaaaaatgattacataaccatcaaattcataacacaaacaagaagagtggtgtataatatctagattcacagcatcacgtcgatcatgtaatttattcatcgatctcaatgactcaatccttacataagtgtatatgttttgaaacaacgtcttgagaattgtttcaaagttagatattgcaatttgcatagtatatacactaaaacatatttctatatcatctaacaatactttttgtataaaaaagaagaagaatatgactccgcattagtgcgcaagtccttagaaaccgaggaatggtacataacaagtcctcttgactagaaaattcaaagtgttctaagttataaagataaggcaaccaaacgttgaaaattaaactcaacagtctaatccaaagagaatctatcttttgtcatttaatttatgttcaaatatgtctctattgcttggaaacacagatgcaaaaagaaagaaaaaaatggtgtctttaagatgagagatggtaatttgcggtagcgtaacttaagcattaagtccttgcacaagaagacttgtgaaaagacttgaaaaaaacaagaaaaataataaaaagagtaatcgtggaccaagacacaagtcaaccactagtctttgtcatagagaaagaacaaataaggctttgaagcatccatcttcctatgtaagtttccttaaagaaactgttacacacaagtactcattttcttacaaacactaaacatcgaagcttcctttctaaagtaaagtcttcagaccaagaaaagggaagatcacgcattcttataggcgtaattcgtaaatagtggtgagtatg

SEQ ID NO: 5421 - DNA, 3000 bp, Unknown
  misc_feature (1)..( 3000): cDNA_ID_2139660_gDNA_ID_1620787_Annot_ID_168171 3000 nt of promoter + ATG
tatataagttttactgtacactatatacttcctgtttttctaaatatttgtagtttaaggttttacacacaaattaagaaaacatacaaatctcatttaatttatttctttcctataaaaacatcattaattacaactaatccaatcaataaaaaaatatgatgtaaaatataattggttaaaatctattaaataaatttaatttttgtatagaaacgtgaaaaacaacacttatattaaaagaagtaaaaaaacctttaaattacatataattagaaacgtatacagtagctactagtgtgactaatgattagtcgaacaattagtaaaacaaaaaaaatgggtaggttacatggaaatagacagttaatgataaccagtgatatgtgtttagtaagatctttagagcacctccaatgtagagagtcccttcaagggctctctcccctttttaatgattaaattttaaaaaagaagaagtagagagctttgtgttttttttatagttttttatactccaatggtaggttctctaacatgagttctctaaaaaaaatattaaaataaaactattttattttatataacttaataattattacaaagcataaactattaaacatacattattctgaaatattttgaaatagatgtggaaaaaaatggaataacgatcagttgttctgttgattgttgcaaaaaatttcccttatatgttctaccaaatcacctttcaattgcaaatgcatcttttgatcacgaacttgatatcgaatgcccataaaatctctgagacttgtaggcatacatgtacaataagataaatcgacttgtgaagttcagtttgctttatattttgttgttttagcaaattcccaaatcttatagatattttgttaaagtaaaggtcaaaatcaatgtaagtggaattgtattgattttcatggctgaaccattttcaaagttgaactaaattctcaagtacaattgtatgttagcatattaacaagattacgaagcacactcgcaattaagataaaacaaaacaaaacagagtggtctctttttttcttatttgttcttcttccacctacaacacacttcttcttgttctcttcttcttttgcttacgagttacgattgttcttactctcaccatcttctcacatctttctcttccaatctctgttgcatattgttaacaaagatgagattccaacagtctctcttattgagagataaaaaatggaacctatctcatcaacacaaatccggcgtctgccaattaaataaatccggcgtctcagatccacgattacacacatcatcgccgtcgactaattgcaaatcataccaccggatttttgttttgtagagagagagatgaaaccgtcgggttcttttttggcggaggaaacaaagcactagtgctttatttttttggttttgttacaaataaaacccaatcacattcggccacgtcgtcgcctctctcactctcaataatctctcttcgtagagccagctctctcaattttaatgacttctgtagcatactagcatcgctgtctcaacgacaatatttattacatgctctgaaaatttaaagagtttgtgagactgatcgtcacagtgtcgctgtaagactactttcggcgaacaatagaagaattaattgaatcagctaacttaattaattttcaatattttggtaacaacttttatatttccgtgaagacaaaaattcagtcaccggaaatatatatcttagtgatgttgctctgaaatcaacgacgttggtgccattctttgaccatcgatcgtttcctttgctttcgtcggcttctacatttctgccgttgaaggtcgtcgtcaacgatacggtgctacacatgccctacgtatactgactatatagagcgtaaatgtctaaataacaaaagaaacattatgacggtggtataattaacaatttggagttgaacaataatagtatataatgactttagtatttgtttagggagtgacagtaattacaagttacaaccaaaacgtgccaccaaatccaaaatgagtggtccaacaccaatgaacccacggctcaacgtgctttcaagctaatataaataatatggctgcagaaccgatactagagtcattttgtttcttcattttttggttgtactttcgtagaaactatattttcttaagaaggcccaactattctccccataaataaattcagccgttttaagagcccaacttgtagataaaagaagatgcgacccaactaaggacatccacttgtgtagcttacaccaacttatagtaaaatttagtcatcaatttgactcccaaaacgagtcacttctccataatcatctctcccaactcaaccaattacacatcgatctctttcgagtagccaatcatcgtcaacattacatccatatacaccaaatcaacaaaaaagatagatattttgagagttgtgcacttgtggctctgtccactcctctccatctcccttttgtttccaccaaccaatatttaaagacaaaatttgacttttacccaaaaaaatatcctaaccagaatgaaaaaacgtgggtttgggctaagacttatgctatgttggaccatttctgtctctattaggtaagaataataataacaaaaaggtgtcttgattcaatgtatcacaaactaaaaacaagaaagaaagaaaaaagatgcgttagattagagttaggaagagagtaggatctgctttaaatgccgaaatgtacggtaaaaaatgtataaacctcaaaaagccgtctagattcaaatcattaactcccacacatctcgggattctatttttacacccaaaatcttttttcactctgtatatattaatacaattctctcccacttctttcaaaaatatcacattctttcttcttctcattttctctaaagattgttgtttgtgtgtgaggctaaggatcaaagatg

SEQ ID NO: 5422 - DNA, 3000 bp, Unknown
  misc_feature (1)..( 3000): cDNA_ID_1842707_gDNA_ID_1620787_Annot_ID_168177 3000 nt of promoter + ATG
ttcttcaatgactaaacattgtagaatgtgtctgattttcttgtaggcggtaccgcttttcttatcagagattgctcccgcgaggcttcgtggaggtctcaacattgttttccaacttatggttacaattggaatcctaattgctaacatagtcaactacttcacctcctcaattcatccttacggatggagaattgccctcggtggcgcgggaattccggctctcatcctcctctttggatcgcttctcatctgcgaaacacccactagtctcatcgaacggaacaaaaccaaggaaggaaaagaaacactcaagaagatcagaggcgttgaagatgttgatgaggagtatgaatcaatagtccatgcttgcgatatcgcaaggcaggtcaaggacccttacacgaaactgatgaaacccgcgagcaggccgcctttcgtgattggaatgttgctacagtttttccaacagttcactggaatcaacgcgattatgttctacgctccggttttgttccagactgtagggtttggaaatgacgcagctctgctttccgcggttgtcacgggaacgatcaacgttctcagcacgtttgtcgggattttccttgtcgacaaaactggccgaagatttctattgctccaatcttccgttcacatgctcatatgccaggtaacattagttaagttaacttttcttgtgtcacaagcgatcctcctaaactaacaattttctcaaacagttggtcattggaatcatcctagccaaggacctagacgtgacgggtacgctagcacggccacaagccctagtagtggtgatcttcgtgtgtgtttacgtgatgggtttcgcttggtcatggggccctctaggatggctaatccctagtgagaccttccccttggagactcgaacggaagggttcgcattggccgtgtcttgcaacatgttcttcacgttcgtgatcgctcaggccttcctatcgatgctttgcgcgatgaagtcagggatattcttcttcttcagtggttggatcgttgtgatgggacttttcgctttgttcttcgtgccggaaacgaaaggagtctccattgatgacatgagagatagtgtgtggaagctacattggtactggaagaggtttatgctcgaggaagatgagcatgacgttgagaagagaactgattgagcttgttgatcgatcacattctttctctaactttccttagttttttttttgtcatatggggaacaacatacagtaataagagaccaacttgttattcttgtattataatatgctttcttcaggtttggtatcttacataaaaaaagaaaactccagggtcatacaatttttatgtgttttaagtcacttgatacaagataaatattgttcataataaaataaagttgttgttttacagtgggtaaaagtgtcacattattatcaacgattgatccatgtacaatactttctatgttccttaatatttgatttaaaaaaaaaaaacacatgttaagaaaacatattaaaaaatgattctaaatattttgttttttgtgatttatatttgttataattttaaaccaataatatttaactatttattttgaaatttgatattcatcaataataactaattaatattgcttaggaaacctaaaaaatcaatctgttaaaaacatttttttttctttcaaaaaaatcaaataataagaaacagaaggagtaattaacaaattatcacccgaaaatattcggtgctccatttgtttctgattttagttgtggatttcgaattgaaaattttattttattttattatacaacatttgccattttatttccacagaaaaatctgaatactgagagtgagaggtacatggtcatgaactcatgatcacatggttttggtagcacatggaactgcatttcagttctacatgtagttgtaaacatcagaataactacatgtatggctatatgcatgtaaaaccgcagttgtccgtattcacaaacgtaccaatttttaaccgctaaaatagtcgttcaaaatgctttaaaaccgcaatcgcaggcatccataaattctcgcagtcgtgatcgcacgtcagctccgtttaaacatgtcaagccttgagtcgatcattacaataatatctcgtgtaccacgttatgcttaaaaaaattaatcatatcttaaacacttgccttgccacccactacttctagatctcccacaaatccacagaaataatatatatggtacttagaaaaatcataaaaatatcaaataccaaattgaagtctctggcatgagtcggtcactacaataataactaaactgaaatacattttatggctaattgatgcagaacctgaaattaaaaaaaattaaagatacaacaaaccatacctttttgtctttttttttttttaattattttaaagataactcatttattttgaatgtatgtacgcagttttcggttccgtattgtgtattcatagtctaccataaaatttaacatctacctttcccaatggacccaaacgcttcgaattgaacatgggcgttgctttctcttgtgagttgtatctaatataaaatttggataattatgatttcgtcggtgattttgatatactatatctctcgtgtacaacgttttgcttaaaaatttgttcatatcttgaacacttgtgacttgccacccactacttcgagatctcctacaaatccgtagaaatatcgtttcacaatagacttgcatgttacttggaaaaaggattaaaatattaataaccaaatcgaaatctgatactttacacattcgaagtcaaacaaaataataaaaatgaatgtgtaacaaatatatttttttccccacgaagaatccacttttagtattaactaaactcgatcagtaagtaatccgtctatataaatgtggaggcttcccaaaacaaaacaaaacaaaaaagatctcaaaat

SEQ ID NO: 5423 - DNA, 3000 bp, Unknown
  misc_feature (1)..( 3000): cDNA_ID_3050787_gDNA_ID_1620787_Annot_ID_168180 3000 nt of promoter + ATG
tcccccacctttttaatatattgtaatatctcgtgtacaacgttttgcctaataatataatcatatttcgaaaacttgccacccactacctcgaggtctctcccacaaatctataaaaatattgtttaataatagaaatgggaacttgcaaaaagcattaaaataacaataacatccaaagtcaaacaaaaacaagaaaaaatgatttgtgtaaaaacatatacatatacatatacatatacatatctctcgcttttctgttcatcacttcagctgagtttctcattcaacatgtaacttttttttgaaatatgttgcaaaaacaaattccaacatatttataaaactagtaacattattatttataatttgcaaaataggtcatgaatcccttttttaatcttttttttttttcatttcccctcatgtttaattattaaactacttaatagtataatatttttcaaattttctatttatatacaaaagcctatgtttttttttctataatttgatatgtagtgtctaataaattcaaaaacatttttattcatacatctcattaattgttaagatgtatacaaattgatacatttttattcgtacaacttatttagtatacattagctatgaatatatgaataaaatatgtatattatgtacatttgtatactaaatgtgttgtatgactcttagtatacaaaacaacacaaaaaactttatcaaaaaaaaaaaaaaagctcccagacccgactcccgaggaaacctaagcttcttcttgctatggccttcgtggccgccggcgaggaccctcccttgccagaaccccctgacccgcctgatcctccctccatcttcgcccaaaccttcatacccgatccaccttctacttcttctctctttccaccttcatcgagtctagatctagatctatgttctaccgtttcttcctatggtgttactcctttcgtttttttgcgattctttactgctgtgtgcagtcccttctatcagatctgtacccgttccgtgtctttgcggttctttactgctctatgcagtccatggaaactagcctattcccagatcttgggatatcctctcgtttcaagtggatatgtttcacaggccataacctttgatgtccacgctgcccctcctacctcaactcagagagcctctcctactcgttccatggcccagacacgacaacggtttgttacttctgtaagatggtgtatgtctttgtttctggttttacccctcattcaaaatttcgtagtggtgcgatttaatgctgcagtatgcagtctctttgaactcaatctggccttttgtgctgtttgttttgtttctctttcttggtggcagtttgaaaagaaactaattaatacacctcgcctgatgaatctggttttatcgggtatttggtaccctagtagcttcttatcggagctagttatcttcccaaagttccctcctcagtggagtggtttggatgtccaagagtcgtcggtattgcaaggatcttcctcccgattgatgttcttctctgcatttgatgcagttcttgtaacctcttgtgttacgttggatacagtcttccaagaatctagccagatcgttcttattgttcgttttgccttatgttattcttatgacttctgttgcatatctatctatcctttaaccattgttatatggtctgttttggcttctgttgttgtgttttatgtagttttcttcatgttggttgtaattcctctttctgaggctcctaaaatttagtgaaaacaactattggtttgaaaaaaaaaaaaaaaaaagaatcttagtatacaaaacaaagagtaaaattgtctattttgcaaattgtaaatagtagtgttactagttacataattatgtttccaaaagtaactatatttccaacaaacccttttttaatgtatttttttgatagatatattagtagattttttttaacaatggaaaacgaacaaggttataagggcagatgagcagagtacaactgttcttaaagtctcatggcaaatcttggcacacttgtgttatctgaaatagccagtctttagattttcttgtactttttattttgttgattggagtttgaagagtgttgagagaggagcgacgaggacaataacaaatttctcagtgattaaaggtagcagagaaccctatacaattatgggttccgcattatcctttcgtaacctagatttttttttttatatatagttaaactcctagcctaaaactaaaacacagttgatgactaattggtggagaaccattaaaaaaaaaaaaaaaagacagagtagactaacgaaaccacacctttacatttttctatttatctcaccttcctaaataaaaaatatttattttaaacaaaaacacattttctgtacagacgtgggtttcgtaatgtccataagtccatccatagtctaccatataatttaacatctacttctctccagtggacgcaaaagcttcgaattgaatgtgggcgttgcttctctcgtgtctaatataaaatttggataatcatgaattcttcgatgatagtgatataccgttgacactgagtagttcattgcaataagtaagatcttgtttttgctaaaaagattcaatcatattttgaacacttgccacccaccacttccaaaacttccacaaattcatagatatagtaatacacaggttacttgacaaaaggaataaaagtacaatatgatgctttacacattctcagtcaaacaaaaacgataaaatgaatgtgtaagataatattgtttaaaaaagaaaaaaagaacaaaaaaaagataatattgttttcccgacgactaatccactttcagtattttataaaataactgaactcaagttgctcgatcaaacaagtacccttaaatgtctctctgtctatataaatgtacactcttcccaaacaaaaccatatctcaaaat

SEQ ID NO: 5424 - DNA, 3000 bp, Unknown
  misc_feature (1)..( 3000): cDNA_ID_3076949_gDNA_ID_1620787_Annot_ID_168179 3000 nt of promoter + ATG
cccaggagaaagtgacttagacgacatgtgttctatggaggtaagcattttcaaaaatatatacactaaggattgtaattagggaacccaagcaattagggaatagagaacaaacctaagaggagaggagaggaccggagccaagatgaatcttgttacaatgaatcatgagaaattatcattttctcttgttcgctgtatcaattgcagaggcagagcagacggtgttaagcgcgagaaaagcagcgaatcagacggcgttaaacggcgcaactttggcgagaaaagcatcggcggaagaaaataattgtacctgatcagattagttggagagaaatctccaaatatagaaacgagtgagtgaatggtcgggtatatgggcaacgacactagtcaggtaggtggctctaaaatggggaaaaatttagaagatgcttcaacagtagaggaagaaaagaaataaactagaaatcaaataatttagcggaagctttgaggggtgaagttgtaaaagattagaatgtataagtacctaatttggtgagtaatttgagatgttcctaaattcacaaaggcatagagttttttgtgccaatctcataattgatccaacttttcatatgaaacatttacaaagaacatggtaggattattttctaaaaaattcctacccgaataacggaaaattttgaattgctttcaatctcgtaccatatttcttactaacatttatgttgcaaaaaggtaggatatttcctaacctttttcaaaattttcttacaaatttcctattagttcaggtttcgtcaaaaaatcataggttaaaattaggatattttcttgtagtatatatcttattatataaagtatgattttcaaagttactaactcagaagattatgccacttgttgatttgatcgatcttagattgtgacacgtgttagaagaaaatttcttgaaataatcttaaaacaataaaattataattataaggaaataaaaaaaaatggatatgtaaataagatcattataaaaacctataattataaggaaactaaacaatttgaaattttaaataagatacatttataaaacctaagttagtaactcatacgattgtcctatgtgtcaatttatcgatcttagattttgagacatgtaaaacattttttattaattttaaaacaatataataaaatataacaaatttttgaaacaggaacttgtttaaatatatattattattagataactctaaaatatagatgtcagcaaaatacataaaatgttgagatgcatagataaatttataatagaaagaatcaatagtatcaacgatgttagaattaagtacaatcatgtttgagtaagacctttagtacaagttaataatgttcaaagtttaagtcacatagtagtagtaattttgtaaacaaaagataataacttacatgatttaaggataaatctagatagattggataaattgatataagcgttaaaatattaaatattgaaaaaatttgtgtggtttactatttaaaatttaaatataaaacaataatatggagtgagtgtaattagtattttagcttttattttaagatggagtctatagactaaaaatccagtttattttaataaaataaataggttaatttcattgtaaaataatatgtataaaaatgaaatataatttaaaaatatttagataaaatgaataagtatgaattactaaaagaattcaaaaattattaaaaattctatttatttgtcaaatccgcctatttaggagagttttatctagtatatatatacatgtttcctgtaaacttttaaaggaaaatgtttttcgccaaagaagggtattatcaaagtttatcattaagaagggtattatcaaagtttgattatctggatagtgatattgtcttgtgcctggataaaagacaatctacctttcccaaattgtcttgtgtttggactttggataaaagtttggttatcggtgacagtgatattaccattgacactaaatcgatcattgtagtaatatatcgtgtacaatgttttgcttaaaaatataatcatgttctgcaacccaccggtgttcaaaggaaaaaaaatagttttatgccacccattactcccaaaaatccatcgaaatattgttaaataatagactcattctaagtcgaaacaaaaataatatcgtttcccccacctttttaatatattgtaatatctcgtgtacaacgttttgcctaataatataatcatatttcgaaaacttgccacccactacctcgaggtctctcccacaaatctataaaaatattgtttaataatagaaatgggaacttgcaaaaagcattaaaataacaataacatccaaagtcaaacaaaaacaagaaaaaatgatttgtgtaaaaacatatacatatacatatacatatacatatctctcgcttttctgttcatcacttcagctgagtttctcattcaacatgtaacttttttttgaaatatgttgcaaaaacaaattccaacatatttataaaactagtaacattattatttataatttgcaaaataggtcatgaatcccttttttaatcttttttttttttcatttcccctcatgtttaattattaaactacttaatagtataatatttttcaaattttctatttatatacaaaagcctatgtttttttttctataatttgatatgtagtgtctaataaattcaaaaacatttttattcatacatctcattaattgttaagatgtatacaaattgatacatttttattcgtacaacttatttagtatacattagctatgaatatatgaataaaatatgtatattatgtacatttgtatactaaatgtgttgtatgactcttagtatacaaaacaacacaaaaaactttatcaaaaaaaaaaaaaaagctcccagacccgactcccgaggaaacctaagcttcttcttgct

SEQ ID NO: 5425 - DNA, 3000 bp, Unknown
  misc_feature (1)..( 3000): cDNA_ID_2139674_gDNA_ID_1620787_Annot_ID_168175 3000 nt of promoter + ATG
gagccttttaggcagagatgggtactaaggtgcagatgagcacggcttatcatccacagagagatgggcaatctgagaggactattcagacgcttgaggatatgttgcggatgtgtgtcttggattggggaggtcgttgggcggatcactttagtctggtagagtttgcttataacaatagctatcagatgagtattgggatgactccttttgagacgttgtacgggaggccatgcaggacaccgttatgctggacccaagtgggggagaggagcatatatggtgcagattatgttcaagagaccttagagaggatccgggttcttaagctgaacatgaaggaagctcaggatcgaaagcggagttatgctgacaagaggaggagagagcttgagtttgaggttggggacagagtgtatcttaagatggccatgttgcgaggtccgaacagatctatctcagagactaagttgagtcctaggtacatgggtccgttcaggattgttgagagggtgggaccagtggcatacaggttagagttgcttgatgttatgcgtgcgtttcacaaggtctttcatttgtcgatgctgaggaagtgtcttcacaaggatgatgaggtgttggctaagattccagaggatcttcagcccaacatgactttggagacgagaccagtgagggttctcgagaggaggatcaaggaacttcggcggaagaagattcctttgatcaaagtcctgtgggactgcgatggtgtgacagaggagacttgggagccagaggcgaggatgaaggcaaggttcaagacgtggttcgagaagcaggttgctgcatgagtttgcctttccttggtttccagtttcagtgttgttgagtttttgagcttttgagttgttgttcttatttctcttttatttgtattttcgtttggagttgtaacgatcataacagttgatgattaataagatgagtattttttcttggatttgacttgagttgtcttatttaagattgtgttgtgcggtttccaaaaatgaaaagtttcctagaaaggacttgtctatttttggaaagtttgagtaaacaacctaagagatccgtgtgtttacgagatggccgggagttggtcataaggatattctcgagggatatgatggatggtgagacatagaggtgtcttacgcgaatccatgagagagtctggagatatgctcggaagcgtttaatattgttgctcgagggacatgaaggtcccaacgactcgtgaggagcggggtatgctcctgaggtaccggtaactcgagggacatggtgtatttagagaacgaggggtacggtggcttcgggtgacgatccgagagcacgctttagggtgacgacccgagagcgagttttgtggtattattttcgccaagtgtcgtaactcgatgactttgtggctgagagtgagccgacacaactcagggtttgactttgagtggggaagataatatgtgtgatacccgagataccgtagccgaggcctgagagtgacggtttatgctcgaagattgcagtctgagagtggagagtgagttgtgagcaacaatgactagtaaatcgtgagtatattgactggatagagagacctagagggggtctggttgaagggagtgcagactgtagtgatggttgcacggagttcctcggagtggaagggtgaagctagattcgaggacgaatctatgttagtgggggagaattgtaacgcccgtgaactggaaaatcggttagggtttgtttttaaatcatccggtttaattggttatgttaattggaaaccctagagtgtgcctataaaagaaggaaactcgaaattagggctttagttagccacttttcgttttataaaggagaaaaagagagttatttccaagtcctttatagttattctccagtttacagaattggatttggattaaaattggttgagttattcgcagtttcgtgagacacgttttctcagacgcgaattaggaccagcggagattgaaactgagatcgtggtctcgtcttttttccgatcggcacgagattttgtgggcatctttgtgacgtctgcagataggattttaccggagcgattgaatagttaacggttagcttatattttagggtttcgtttttgagactgcttgtttctggtttttcctgtccagtttgcttcaaggttgcttttggttgtggacttgttgtaggacgtttctgaactgtttcagacgcaaggagagtctctcctgggtttaattggtattagaatcaatttgttaaggtgagtgcgtgaccatgaatttatctgagcgattgagttgtgtgatgatatataggtgtggtgaatatgttttgggtgaattgttcaatgactggtttgtttgtattgtattcgtgattatatttttttatttgcttttgtgtatagctcgtagatgggagaatcgcctcactaagtatttatgataatacttaagcatcttattgtgttgttgatgcagtaaaaataaagtgtgattgtggaatcatggcaaggaagagaggatgatgtaggaactcgtttgttttatgttttgtgtttttggttattggaacccggttaggattgtctgttatttttggttttgttgatcgaattatttatttatttataaaatagtatttctgatttgcggtttaattattatgttattggttgatttaattaaatatttaattatatatatatatatatatttttttttttaaatgggtctggttgtttcacaaagatatctgagtcatatttggggaatgctgacattaatactttcgataacaaaaagaaaatacactcattaaacagaacaaacctcagaaacagaatttaattaaaaacccacaaaatgaatctaagatagtttgctttacaattcaaaaacccgtctctgtgattcaaaatccctaaatccagagatcgaactctcgatc

SEQ ID NO: 5426 - DNA, 3000 bp, Unknown
  misc_feature (1)..( 3000): cDNA_ID_1828614_gDNA_ID_1620788_Annot_ID_50428 3000 nt of
gacagtctcaaccctaaatatacacgtgtagttcttttagtagtcaaactctattaaaaaactaaaatataataacaacattaaaatattattattattttggtttttagggactcataagatagaccaccattcatgttgctctaaggagttgaaatgtgtgtcgagaagggtaaagagaggtgcaatttgttgtctttagccaccggatatcaccggtcattacttttttttttattggcaacgtttcagattttggtgtcttgttcttgtaatatctccaccgtcacgtgtctatttattcgatcaaaaatattgtcaatttatgttctgagttaggtttggctttgcatgcattttataaaaatgaacagaattgacaaaagaaaattgcatatagaagaaactgaaattggtaaagaagagttttggccgtatcattaagaaacaagagagaattatatatagtatttgggcatactatatatagatctagtaaaatcagaatattgtagtatatatatactgtataaaacagatctggtagggctaaaacaatatttttttaatcagttacgttggagtaactttttttgggaagtatataagactaattaattttctatttcaaatcttacacctggtaagatactttgaaccaattctacggatagtagtaattatacatacactatattcgacgtatgcatgcatcttaaatgcacacatcaaaggatgtggaaaagcttatattttagtgtatctggatgattcaattctaaacagtgaatcaatgtcaaagctacgtaaatatgattggtgaagtgtatacatcatttctgttttcaacttttttaatttctcgagtactaaaatgcaagaaatatatatacaatgtgctaccattgtatacatatctataaatccttcactgattaatgcatcttaatgcatgcatacacatattttatctgtctatgcatgtttttacggcattttctaatttgtatattaaatatggtacttaagaaaagaaacattaacatttattttttaaactgcatagaacagatagaagacgataattttacaaacaaagtcataatcttgatcaaaccctagacacaacataaataaatataatctttaaactattgttatatagtactggcaaaaataatcagaacttgggcaataaaggacatgaaatcttgggaagctagcataattagaataaagaggtaattaatcaacttggggtactaaataatgaaacacaatagcactccataatttatgtttcgtgtttctcttagttagcgagtacattatataattgtgtccttgatgaatttcatgcttgaaatcttgtgcaaagaaaccacttaatttagccaccataacaaagtcgatcggaacgaaatcctaaacccaaatgttgttgtgcagttttagtcggtttgggtattagaatgccacttattgaaatcatcgactttactcgaacaaatcgtttaatttaatgatgtataacttacctatattgtctataatattctctctatgcggtagtcggtgaagaaattaatgaaacaatttcagcatgtggtgtctttatatacatatttgaattataggacactataaatattgcacaaattcgaaatgagataaaggataaatatatacatataattgacatacaatttaccgggttagtttatgtcgggtaaatttttctctccgtagagttttatgtcaaaccaattactaacaaaaaacaaatgttgaatcgggtaaattcagaagttttaaaactatgtagagagaagttctttctaaactctatttttcttttgatttaatttatgcaatcttattcaaacatgctttctatttctatgatcatatttgagtatcttcttaggtttaggtttctcattagagatttagataaattagtagatcgataacctgttaggatttatctttacagtttttcatctttaattgttcttaattctagttgtagagtagctaactaaaatttgttctgaagttaataggtaaaatccaagagggctcttgttgttagaactatcataaatgggtctaaatagctagatgcggataggtttgatttagatacgtaagtaaacttaccaaaccagatattaatgtttgcttaattctaagaatctacatataaggtggggtaaatactattgaacatagtaagtcaatgcaacgagagttgattgattatagaattgagatttgcagttctagaacggtgcaataacaattttaagtaactcatagatctactatttgactatttcttgagaattctctaaacctgatattttaattatctgaattttacgtcaatttaatttgattttttgtcttttaatttacaatgacttgatttagcttaatttcaaaatttaaacttaccttgtgagtaaaagaggtttgtagaatttgaccattaagtagtaactgtggatgtcggattcggcccacttcggcccaatccgcattctatgggcttcaagatgaattgggcccaattcatagcccagtatgagcctggccgcttaaagggtgatccgacattaatacagaaacggaaggatcgcgacttaaactgcgcattaaagtcccgagttgaagattcgtaacgtacgacgtaaataaggcgagatccgcagcgtgaaatcagcaaatagtttaatacgtttgatccgatgtattgagtataaatacgagttgatgacaattgtaatggggacgattcatgaaatactaatactatacacaaaattcacaaacacattcttctcttctcgattcgatcattgttcgtttaacaagactaaagatcctcgtaaaaacaaccacaagattctaattgcggattccgacatccacaatttggcgctagaaggaggggaataaagtcttttacttcagagcaacgatcaatccaccatg

SEQ ID NO: 5427 - DNA, 3000 bp, Unknown
  misc_feature (1)..( 3000): cDNA_ID_1828587_gDNA_ID_1620788_Annot_ID_50436 3000 nt of promoter + ATG
agcccaacttctttccaagaaaatgtaatccgaaaaccacatcgaccaacctatgatctgtgaaagacttgtaatgtttcagtaaatcattaaagagagtaaactaaaaacaggaaaattcaacaaaagatcaaaagaactcactggaagatacttggcttctttcttcatgatggctaatgagcttccaagacaacctacacgctgttatatgattaatcagagacagtgtttatatttctccaaatttgaaaaatcatgtttcagtgaaagacaaaaacacctgagccatgacccatccaataagccaatcaatgtcacttcgatgattgcttaagacaagtgcgtgttctttccctgaaatttaatatcaagattaaaaagaatcattatattcaaatactgaagactaggttgcataaattgatctttaccaattaactctagagtctctgcatcgacgtataaattgatctgcagcaacaacaagacgaatcacatatcagactatgatacctctatgtaaaccacaacaagattcatgaaaatcaccaacctttatacaagcccaccaatcaaacaaccatatgagctgcaaccaaagtaattccgcaacatttttgtttattcttctatacaaacttcttgagaatggacgaacaatgatgaagaacacaagctggaaacagagaaaatgtgtccaaaaacctttagttgacacaagtttcgattttataacagacattatagaacataaaatgtttcagctatgtctcttccattgagaagacaatacaatgaagatagacttcttttggtatcagagcaaaacaagttttaacaaaaatggatgacctgaatgatgttgacgatgagccctgagatcaagaagaggacaccaacagggataaagacaagagccgcagggatcttcatgtctgagagagataaggaacaacacaaagcagcaacagaagaatatgaaaaattgttgaagaagacaccaacagaggatgactgttatctttgttctcaaattctttttgggagattagagaattgaaaataaggaaaatccttgttgttttgacgcaagagcgtttttcatgctctattttaagcccatcaaagctatgtctctctctcttacaatatttggttgccaaacacatggagacatgtgcgcatgtaaagctctcccatgaagtaatagagtaaaatgcaattaaaaacagcaaaactcacatatgtcataaaatttgattttggcggtttttgagtttatttttaacttcacggttgttaaatccggatttcacattggcaataagtggtgagatcaaccttccttatatactactaaagtccttttccatctttctaatatgtgatttttctccaatgttaagttttatggagttttaattcagaatcaattgacaaaaagtagaaaagcacatgttccttatatactactcaaatcatttcccatctttcgaacgtcggatttttctcaaatgttaagtttcataaacttccaactcaaaatcaactaacaatgtcttgaaagttacacgtttcttataaactactcaagtcccttcccatccttccaatgtgggatttttctccatacatccccattcccctcgaaataatggctcttctagccactaatctcgacataatccatcatacctctcgagataatgctcgtttctagctatttcacggaattgggctttattttggacaatcaattagtgagggtgatcaggtctcttttctgggccagattagcagggtagggtgtgttcggactctgatacaatgttaaattcgggtttatggactttcaattaaaaatcaattggcaatgagttgagagacctacatttcttctatactactcaagttacctatcatctttttaatgtcggatctttgtccacaaaaacttttgcaaagatcaaaaaacattaatcgtcccatgactctagaataacgcccgaaccattgcaagtggttcccttgtaaaatgctgcaaactgtccagcagctagagtgctaccttgaccaccttcaaataggtgtacaaccgcaacatgtgtagaaccaaaggtgtgcctagaatttttaatgccaaagtaagaaaattaatttcatgttctttttcttttggtacagtacttggtgggattcaaaaatgtacatactatatacaccaaccgccaaaaaatgagattcaaactacagtcaataagaagcaaggaagactaaatagagggagctagtgattatctgacaatcaaatcaagtagacaaccccgatggatgtcctctccctacataagggagttcagttcttactagcactttgagctccaaaacaaattcaatatttgaattttcccaaagcctggtcaagcaatatatggtcaaatttaattgaatgtttatataaaaatttatggtaactgtagaaaattgtaaactattgttaaatattttataagaaatataatacaaaaatttaagcaatatatttacttatttaggtctgggcatatgagtattctgggagccagaaattttagttaaagtttatatatatataatatttaattatatattatagtagatgatatatttaaagaatagattattgtttacatggtctagagaattgttttttttttcacctaaataaaactaaaattatattttttatatgtagtattgagtttttgaccatttctcaacaaactaacaagcatcactggttgtggataaatatttgaataaaaagaactctgacttttgatatatagttttgaaaatgacattatttccctctcactgtcagaggaaagaacgacgaaaggacgaattgttcttccgcgtatttactcatatatcccttcttgatcgacgaccatccaccatgaaaagggatcttccgttggcctcgtagatttaatttatcgacatctattcaga

SEQ ID NO: 5428 - DNA, 3000 bp, Unknown
  misc_feature (1)..( 3000): cDNA_ID_1828580_gDNA_ID_1620788_Annot_ID_50438 3000 nt of promoter + ATG
tcataaggtgtagtgttatacagacagaggctacgcattgtcttaattctttttgtaactgaatggttcaaccatatgtatacaaaaacgtgccttggtaaagtgtagcactggttccaagtaatctcaggtccaagtgattgagtttcactgtcatcagcttggttttcatcaatttcgcttctgtcactaaagaggaacaacaaatcctcattagctctctgctcgtttagaaggtttcttgttcttaagaaacaagttctgttctgactataccgagaacagatgaaagagacaaaccataatttgttggaacagacgttaaagctttcttccaaaaccatggtctgttattgttcccttcagtgtcttcatatcctctgaaataaccttgtaaaatatatgaattacttgaaaactgccttgatccatacattaatgcaaatgcaaatggtcgaaagagagtatcaatagtattacgattagaatgtctatcactgatatctactattattataagtaatttctgaaatgatctcaatcatagaaattaaatatttatttcattttcatttttaaaaagaaagaaatacagcatggtatatgtttttttagaaatttattaattagtttgactttttttatttagaaacggacaggagattcaagatattttggatatctgagtgtgcaaaaacttaaaatgctaaatgaaaataccataaaatccaaaatattaataacgttagatgatttttgacaattaaattaatatatcagttttaaaacgtaattatgtactttatcaatcttgaaaaaagttaatgaaattctcgcaagctcactgtaaaccaacaaaaccttctcttatataaataagaattctatggtgtatatataaactagatgttgataaataactcttgaactttatcaataagtgtgacttagaaaaatagtagctttcagctcttgccaaccaacagagtcgaaactttaaggttgtggacctttctcagcaaaagattagagatattatagatagacgatggtaatatttttccttgcaatgaaacctttgttaagttacttcattatttagggagctaatgtgtgttagagaaaacctacaaatgaattcttgtgttttcaatgtatctccattgaatgataaatctgtatatatattattacttctagttacagattagctcttgctctttggcatttttttaaattgtttttttgtagtgactaaaagttatattcagaaataatttcaattaagttggtttgttgaagttacctgaataatcaccaatcaatatttaaacttcatgatctgtagtgattcacaagttgttaataaagaagaatgttgctattatatgaatagaaatagttcacaccattttcttaaccttcccccacttttgaataaaagaagcagaatgaaaaaaaataaaatttgttagcattatttaattttaaatttaaattttgttgaaccagaagcaaaacttataaattcttccaaataataatgatcaatgtattagtttttaaatatgaatctcaattaaaattattagacgttgttaaaataattcttgcaatgaaatctcttgttggtttccttcattaattagtaaccaaacaaagattttgaacttttgattcaagggaatagaagttgtccgaaactatccacattaacctctttttgttattgtcatttctagtaaaaggttgatgaatacaaactctcatttcaaactgaactatttatggttcacaacccatatgatatatacatgcactctgattctcaccaaaattatcacatatatatatatatatatatatatatatatatattttaatcttaaaaaaaaaatcttgaaaaaaaacataatcaaaacaaagaaaataaaaaaaccctagaaatttcaaaagaaaaagaagcaaaaatctaaaaccacctagctagctaacaaatacctggtgtgttagagaaaaacaaattaattcgtcaattttctatttattgccattgaatcataaatctgtatgtgttttcaatttattgcttattgtagttgtattataagttatttttagaaataattttatgtaagttactttgttgaagttacttgaataaaaacatagtcataattttctaaaacctatatggtttgcaccatttttaaaacttccaccacttttggataaaagaagcagaatgcaaatgctgaaaactttgcattttttcagtattcaaatctttaatctggttgaaccaagagcacaaattataaattctttgaaatagtatctaatatatttcaaatatgatgtctcaattaaaattttagtctgaactttttccaattaaaagcacaattttcagtttgtttttgtaaattaagtgactggagcatattgagtaataactattttatataagaaaagttagatgactggaggtaaaaatagtaaatgaaattttcataagactctgtacctttatcgagagggttataattcttgagtttttatcaataagtgattcagaaataaggttgctttcagctgttggtaaccacatattcgaattacttaaggttgttatgggcctttttctgaaaaatagcaaaagattaaaagtattaattagccgttggtaaattgcaatgaaacctcttgttagtttccttcattaattagtgaccagggaaattttttgaccttttgattcaagggaaaagtgtagaggaaaagcaagctaaagtcttcaaccttctgtctcgtatacccaattgtcttttatcattatttaaaagaaagttatatcttgtatacccaattggtctataaattacaacttcactcaaaccttcgcttacattttcttttcttgtttcgtttcagggatccataagataacttcaaactttttgaaagaaactctgtaaagagcgttttaaaaaagtcatg

SEQ ID NO: 5429 - DNA, 3000 bp, Unknown
  misc_feature (1)..( 3000): cDNA_ID_1828561_gDNA_ID_1620788_Annot_ID_50444 3000 nt of promoter + ATG
tatccgcagccaaacctctcttgagtttcatgggagtaaaacacgtaacgtatcgatcttttgttctctataaatgatgttatgagattcaaaatcacttaacatggtttgattttttcaggattctccaatgatgagaccttctcagagatatctatctttaagatcacttggtgcaccagctgttctactctcacttgcggcacaaggcgttttccgcggatttaaagacacgacaactccgttattcgctactggtaatactatttttttcatatgttcaaaatccttaaaacagaacaaagctaatgatccactttacttttcttgtttgatgattaatgatccactttttttttgtagtgattggagatgtaacaaacataatactcgacccgattttcatatttgttttccgcctaggcgtaacaggagcagccactgctcatgttatatcccagtgagtttagttttgcatgtgaaccttgaataatctcaaaatggcctctactttaattgactagtggtttctatgttcattttcagataccttatgtgtggaatactcttgtggaaactgatgggtcaagttgatatcttcaacatgagtaccaaacatcttcagttctgtagattcatgaaaaatggtattgtaaaatacttcaaagaaaattcaatgtgtttacaatgaaatctctgataaaataacactgtttggttcttgttttcttgtgaaatatttctctcccaggctttcttttgctgatgagagtaattgcagtaacattctgtgtaactctctccgcgtcactagctgcacgagaaggatcaacttccatggcagctttccaagtttgcttgcaggtttggttagctacttcacttcttgcagacgggtacgccgtagctggccaggtttttagataatgatgtctctaacattgcatccttttacgattaagcgcgtggtttaaagttttaacaaatgtcttttcctttaggcaatactagcgagcgcgtttgccaaaaaagactacaaaagagcagcagctaccgcctctcgtgtactgcaggtacacacaatttatgcatttgtgtttgcgtttacattatgtttacgattttggatttatatgaagaaaatatacacagaaagtatacataataggtaattcaaaggcaaacaaacaatggaggcctatgtgtactttagcttataaagattcgattctagatcaatttaaagctaaagaactaaatcttgtgacagttgggattggttctcggttttgtacttgcggttatacttggagcaggattgcattttggagcaagagtgtttacaaaagacgataaagttttacacctaattagcataggacttccggtaactaatcatttcccattaaaccactaatcaggatcaatattattacgtaacattaatttggctaaaaatcatttcttgtttcctaaagtttgtggcagggacacaaccaattaatgccttagcgtttgtgttcgatggagttaactttggagcatccgatttcggttacgccgcagcttcattagtaatggtggctatagttagcatcttgtgtttgctcttcctctcatcgactcatggttttattggactttggtttggtctcaccatttacatgagtcttagagcagccgttggattctggcggtaaaactttgtgaaactctctgtttcttgtagtacaaatgtaaaaacttttccaactttcttataacagaatgtaaatgtgactgtaacaggattgggacaggaacaggaccttggtcttttcttaggagctgaagaaggaattttagagggaagagcatgttttaactgttcttaaacctttatttctaatgaggttgtgtaactaaataaaaataccaagagtacaagtctggagattcaaataattctatgcgatttttactgctactcttgtaaatattcaagttgtatcctgtaattagaggtggttagtccaatttttggaggttttatttcagatattgtagttaaatatagaaaatcgatagaacatatagaaactgatttttgtttggttgactatagtgttgaacttcagattaattttttcaaaacaagtagttcgaatatgacttctcaaatgatataattaggatgtcagttttggtttggttttgtttcagattttgtggttcgtgaaatacaaaatatatcagctggtttggttttgacaacagtggtttcaaatcagattcatctttcttaaaacaagtaattaaaaaataaactgagtgaatttcgtgagaaatatggtttgtttgaatataagagttttgatttaatttttcttcttttctttttggtttagttttggataggagtttatcaaagaaaattcattttaaaaatatatgttttgtttttttcttcattagaaaaaaaaaacacattctgaatatgcaatacatatttataaacaaagtgctaactctattcacattacacttcagtttattaactagattgataaaatttatcatctattaaatataaatagtttgacatttctaaaatacgtgaaaattcattaataaaaaacatttataaaataaaagagtggaggtatttgtcacatattatatatttctataatatccaaacttataagaataaatatcgtataattgaatctcaaccgatctacaattttttttacaaaaattgcaaataataaaataaaataaaatttaataaggcctatgtttagaaaactcttttcttcaacatgattggctcatagccaccctcaattattactttaaaccaaaaataaaattccaatctttattagcaaaattaaaaacaagaccaaaacaaaaaaaagtagaaacctttacggaactcctctgccattcttttccaatctaagccaaaactcaattaccctttttccgatttaccggagaaactaaatctccgcc

SEQ ID NO: 5430 - DNA, 3000 bp, Unknown
  misc_feature (1)..( 3000): cDNA_ID_1828549_gDNA_ID_1620788_Annot_ID_50447 3000 nt of promoter + ATG
tgtattaaataaaatctttttttattcaacacatttaaaagctcatttacgtcggtattaatcatattagaccaagaccaactcggtttcataagagttaagatgaaactagaagcacgaacactacacaccgttttcatcaaccccaactgagagataaacggcaaggctttcgcaattgaaattctcacagtggttaaaggcacttggatcgatggtgccttaggcttcattcatcatcttgctacataaccgtagaggaagacgaataggtttgatctgccgaggtaataattaaactgcaattaggtgagttcatgcttcttcttcttttaactgtttcttgatttttagtaatcttcaggaagcccttacatctaattttagttgttctatctctttccattacgatatctgttttgagtctctcaaagggcttttctttcatgtgaaaatttctaacatttcttaactggaacttaaaaggagtattttgcaatttatcagtattttgagaatcgcatccagattaggttgatacaatttatctcgttttttcactcgaaattagatggttgtttgtgggactttcaatattcagtcttggtaaattttgatgatgcagattatatataattgcgtgaagaaaagagaaatggtgggtggcaagaagaaaaccaagatatgtgacaaagtgtcacatgaggaagataggataagccagttaccggaacctttgatatctgaaatactttttcatctttctaccaaggactctgtcagaacaagcgctttgtctaccaaatggagatatctttggcaatcggttcctggattggacttagacccctacgcatcctcaaataccaatacaattgtgagttttgttgaaagtttttttgattcccacagggattcatggatacgcaaactccgtttagatttgggttatcatcatgataagtatgatctcatgtcatggattgatgctgcgactacgcgtaggattcagcatcttgatgttcattgttttcacgataataagatacccttgagcatatatacatgcacgacgttggtacacttacgactccgttgggctgtcttgactaatcccgagtttgtttccttaccttgtctgaagatcatgcattttgaaaatgttagctatcccaatgagaccacgttgcagaaacttatctcaggctctccagttctagaagaattaatactcttcagcactatgtatcctaagggaaacgttttacaattgcgctctgatacgctaaagagactcgatatcaatgagtttattgacgttgtgatttatgcacctctactccagtgtctgagggctaagatgtactcaacaaagaactttcagatcatcagttcgggtttccctgccaaactagatattgatttcgtcaatactggtgggagataccaaaaaaaaaaagtgattgaagatatcctcatcgatatttcgagggtcagggatctagttattagtagtaatacttggaaggtatacatcttaacatttgagcatatttgtttaaaaatattcctccacaaaagtttctcaccgtaacatttttttgttcacttatgttaccaggaattctttctatactcaaagtcaagaccattgctccagtttcgttacatatcccatttgaatgctagattttatatatctgatcttgaaatgttgccaacgcttcttgagagctgcccaaaacttgaatctctcatattggtaatgagtagctttaacccttcttgagagctcctatttacacatattgtttgagataacctcttatatgtatctctctactcaatttgttttcttttatttattcttttgttcctgtttttgcaggaaatggtcaagaaccaatccacgcgacgtcatggggagaagcgagaaccaaatgtgatggtttcaacagtgccttggtgtttggtatcgtcgctcaagtttgtggaattgaaacgttcaatcccaaggtatgaaggagaaatggagctagtaagatatgtcctgacgaattcaacagtcctgaagaaattaaggctcaatgtttactacacgaagaaggcaaagtgtgccttccttacagaactcgttgcaataccaagatgctctagcacatgtgtagtccttgttctttaattacttgaaaggtattgatgaacttttcgtttaaggtcaatcttttggtcgttaaattagttgattttcggaggctttgagccacatgtaaattttgcagttaagtccttcttatgctggttgctgctcatgtaataatcatcaatcaccaagtttgtttcgaatttgatggatacttccaccaagtcgctgtcaaatattttgtatgctcccatggataattattttgtatttttgtaactgcatggtgattccttacatttcaggcttgttagctttgcaattttgttatttgtattttggtttgagttaattacgagttggattgttcttcttacctactttatggttcctctgaataatctattcgtagtcttatcaaaaccaaatccaaaaaagtacttgtgaatctatttcctttttaattattgcgttcataaatgaaaatgacaccatttttatcatagtgaggagctcaaatttcaaaacttttgatccgagacatctaagtgtaccgaaatttgaaacgggttatgtctccggtgtaatttcgacggcggatttcgtcgattacagtcgtcgccaccgtatattaatacacatttggaagctcaaataatgggcttcttgcttgaagcccattgacgtcggtactattgtatttgcaatgattttaaacgtcgtcgtacaagtaataaatcagaacccctaaaacccttttcatctctccggacacttcttctcccgacactttcctcttcaaatcccaaacggctatctgactttggaagaaagagagattcagagtggagaatatt

SEQ ID NO: 5431 - DNA, 3000 bp, Unknown
  misc_feature (1)..( 3000): cDNA_ID_1828549_gDNA_ID_1620788_Annot_ID_168222 3000 nt of promoter + ATG
caactcggtttcataagagttaagatgaaactagaagcacgaacactacacaccgttttcatcaaccccaactgagagataaacggcaaggctttcgcaattgaaattctcacagtggttaaaggcacttggatcgatggtgccttaggcttcattcatcatcttgctacataaccgtagaggaagacgaataggtttgatctgccgaggtaataattaaactgcaattaggtgagttcatgcttcttcttcttttaactgtttcttgatttttagtaatcttcaggaagcccttacatctaattttagttgttctatctctttccattacgatatctgttttgagtctctcaaagggcttttctttcatgtgaaaatttctaacatttcttaactggaacttaaaaggagtattttgcaatttatcagtattttgagaatcgcatccagattaggttgatacaatttatctcgttttttcactcgaaattagatggttgtttgtgggactttcaatattcagtcttggtaaattttgatgatgcagattatatataattgcgtgaagaaaagagaaatggtgggtggcaagaagaaaaccaagatatgtgacaaagtgtcacatgaggaagataggataagccagttaccggaacctttgatatctgaaatactttttcatctttctaccaaggactctgtcagaacaagcgctttgtctaccaaatggagatatctttggcaatcggttcctggattggacttagacccctacgcatcctcaaataccaatacaattgtgagttttgttgaaagtttttttgattcccacagggattcatggatacgcaaactccgtttagatttgggttatcatcatgataagtatgatctcatgtcatggattgatgctgcgactacgcgtaggattcagcatcttgatgttcattgttttcacgataataagatacccttgagcatatatacatgcacgacgttggtacacttacgactccgttgggctgtcttgactaatcccgagtttgtttccttaccttgtctgaagatcatgcattttgaaaatgttagctatcccaatgagaccacgttgcagaaacttatctcaggctctccagttctagaagaattaatactcttcagcactatgtatcctaagggaaacgttttacaattgcgctctgatacgctaaagagactcgatatcaatgagtttattgacgttgtgatttatgcacctctactccagtgtctgagggctaagatgtactcaacaaagaactttcagatcatcagttcgggtttccctgccaaactagatattgatttcgtcaatactggtgggagataccaaaaaaaaaaagtgattgaagatatcctcatcgatatttcgagggtcagggatctagttattagtagtaatacttggaaggtatacatcttaacatttgagcatatttgtttaaaaatattcctccacaaaagtttctcaccgtaacatttttttgttcacttatgttaccaggaattctttctatactcaaagtcaagaccattgctccagtttcgttacatatcccatttgaatgctagattttatatatctgatcttgaaatgttgccaacgcttcttgagagctgcccaaaacttgaatctctcatattggtaatgagtagctttaacccttcttgagagctcctatttacacatattgtttgagataacctcttatatgtatctctctactcaatttgttttcttttatttattcttttgttcctgtttttgcaggaaatggtcaagaaccaatccacgcgacgtcatggggagaagcgagaaccaaatgtgatggtttcaacagtgccttggtgtttggtatcgtcgctcaagtttgtggaattgaaacgttcaatcccaaggtatgaaggagaaatggagctagtaagatatgtcctgacgaattcaacagtcctgaagaaattaaggctcaatgtttactacacgaagaaggcaaagtgtgccttccttacagaactcgttgcaataccaagatgctctagcacatgtgtagtccttgttctttaattacttgaaaggtattgatgaacttttcgtttaaggtcaatcttttggtcgttaaattagttgattttcggaggctttgagccacatgtaaattttgcagttaagtccttcttatgctggttgctgctcatgtaataatcatcaatcaccaagtttgtttcgaatttgatggatacttccaccaagtcgctgtcaaatattttgtatgctcccatggataattattttgtatttttgtaactgcatggtgattccttacatttcaggcttgttagctttgcaattttgttatttgtattttggtttgagttaattacgagttggattgttcttcttacctactttatggttcctctgaataatctattcgtagtcttatcaaaaccaaatccaaaaaagtacttgtgaatctatttcctttttaattattgcgttcataaatgaaaatgacaccatttttatcatagtgaggagctcaaatttcaaaacttttgatccgagacatctaagtgtaccgaaatttgaaacgggttatgtctccggtgtaatttcgacggcggatttcgtcgattacagtcgtcgccaccgtatattaatacacatttggaagctcaaataatgggcttcttgcttgaagcccattgacgtcggtactattgtatttgcaatgattttaaacgtcgtcgtacaagtaataaatcagaacccctaaaacccttttcatctctccggacacttcttctcccgacactttcctcttcaaatcccaaacggctatctgactttggaagaaagagagattcagagtggagaatattatggaaggaactttagatgaagagaatctagtcttcgaaaccaccaaaggtatcaaaccaatcaagagtttcgatgac

SEQ ID NO: 5432 - DNA, 3000 bp, Unknown; identical to SEQ ID NO: 5428
  misc_feature (1)..( 3000): cDNA_ID_3076986_gDNA_ID_1620788_Annot_ID_168212 3000 nt of promoter + ATG

SEQ ID NO: 5433 - DNA, 3000 bp, Unknown
  misc_feature (1)..( 3000): cDNA_ID_1828706_gDNA_ID_1620790_Annot_ID_50452 3000 nt of promoter + ATG
tacaaaaaatgtctacattgatagcataacgtagtagcacaactactcaactattattgaagattaattgtaatttttaattttgtatgatagtattttacaaatgttagtaaataattttattaatatagaatttttattaacgctatgatagaatttttctaaccttgaaaactaaaatactcataccgccaaacacttagacaaaaatttctctttttgcatcaaaattatttttgccatattttctcgagaaaaccctaaaacttaaccatcactcctaaagctctctcaaaccgacgaatcgattccgggagccagtgattaaactcgccgccttcgtcgttgaaggtagccaccgtcgttgaaggtagctgcgacacataacctcttttcggccctaattcaccgattaaaccatctctttgagtcccaaattgaaggcatgtctctctgaatatgtagctttatttcttccctttcgttaacctagcttgtttttttttagctgtcgtgaagctcgacaactattttgtttcttaaagtctgaatttatagatttctctcattcgatacttcaaagtttttatcttttgcatgcccgtgttctttgcaaaattataactatttgtttgtgtggtttgatttaggcgtagctggataaataggatgcacaattttgctttgtaaaaatcttagatttttagataacttgtattggcctgataacttgtattgacatgttctcgagatttagaagtttttgttgacattctattacaacaatttgtattgacttgttttttgaatttttaaatcttttcggtgcttgtaatgacatggtctttaaatctttatattatttttggaacttgtcaaacacattcttgcataaacaaacacaaacaaacacatgaaactagatatactcattcaatatttttgttttgcaagtgctgctgtgtaaataatgagaatttgaagctgatatttggctcttattacacgacaggttagtaccatcttaaacattactgtgacttttgtcttgaacattattgtggattattatgtgttgaacatttctatgggttctgtaagccaatatatagcatgaacagcccattggaaaataatttcattaaactccggtacaccggaagttctagatcgaagagaaatagaatgaagaagctaacaaacttttattattaattaacagaatgttacaacaacttaatcaacaatgtcattaactaagcttatatacataagattaaaccaacatcaataaccagaaataaccaatatgtaaaccggtccatatttgcaataattatatctcagaacattcattaaattgttataaatgccatacgtatggcccatatatttttaatactaaaatagcaattttggtgaagaattttccgtaaatccatcacgaatgttagtaggtatgtggtcatgatggatttgttgttttgttgttacagtttcaattacgagtgattgattttaaacccgttgttgatagtttggcaactcattgctatgagttttggtgattaatgatcacataaatttttgaaatttggttgaagaattagcagcaatgaaataaacatgaatttactatcgaaacaagatgttatcaccaaaatatgttggttttaccacaaacaaaaatgcctgatatatctttggtttagaaaagtaagattcacataacatgtattggtacacgtgtcccacctcctttcactgtagatccgcccctatgttgagcagacagataaaacaacacgagcattaaatagatgggacattccatagcccacaagcaatttcacgaaattaaatgagaaatgggtcaagattggatcactcgaaaaactgaggaaaaaaagaagaatacgtaaggagttgaaacggaacgtggactatgtcagcccgaagaacacgtttaatgactatggccccatgcaggaccattcccctttttttgaggtgttaccctgttagatccatatttgttttgaacactatcaaaaaatatttgctaaagaaaaacactatcaaaatatgttacagtattctcttccgttttgcctaaactcgaactcataactttaaacctcctcttttaagattaccatatgcatgtacataaactggtttaacaccaagacaccaaattttaaccacaaaacaccaaacaccaaatacgttggatatcttaacctatttcttactcacttaacctttgtgtgtgtgtgtgcaagtgtattactatatatataaagtaaaatatatgcatatattgttaaaaatatcacattaataatggagacggtttataaaagataagaagttttttctttcacttattgttagttaattttgaataaaacaaatcataatttcacatagtattaaacctatatatgtattacttaaaaaggtaaaatttgatacgagatgaataaacaaaaaaaaatcaaccatttcaaatttacatgttaaaatatctcgatttggatatagtcatatagagatgattttatattgatatataaatcgccttcacttattggcaattagtattgagttgaaaatctataatttttctacatgcattgattcaactattatctttcacatcatgcattaaattagcttgggttccatcgtacattagtgtatacatatgccatcttcttcatcattagataatttttcttataaaataaatgcaattataacaatttgattggatatgtcttgtcatttagttgcggaaaaatcttgacgtctcttcttgtctgaagtcttaagtatataactggaaagtccgtattggagttcaacaaaagaagaaaacgaagacttttagttagatcctacattactgaactcattatatatatctggtgagacattctcctatatatgcagtttcaactttcaaagccagcaaataataaacagaggagaaat

SEQ ID NO: 5434 - DNA, 3000 bp, Unknown
  misc_feature (1)..( 3000): cDNA_ID_1842723_gDNA_ID_1620790_Annot_ID_50453 3000 nt of promoter + ATG
ttggagtatgtaggcctctcaatgtctaaagatctcctgcagatatcgtatatggcttcattgtccaaaagaacaacaacatctgtgtgttcgagaagagaatgagtcgagagaacactgttatacggctccacaactgctgtagaaacctgagaccaagaaaagagtttgaacattttatctttctgcagtgaagagtttaagtatctgtggaaggttacctgaggagaagggtagatggtgaaaccgagttttgatttttttccaaaatctacggacaagcgctccaacagtaaagaacccaaaccagaacctgttccacccccaacagcattgaataccaaaaatccttgtaaccctgtgcaattgtctgccaatttcctcagcctttcaaggcaggtgtcaacaatttcccttccaactgcatcaatggaaaaatatttcaataccatatgaaccagtcatggttaaatatgccgtttctcgtcataagcaatggatgaaacagagccattttgagcaaagcaaataaagaagacagagttctttgttacaatggcaagcaatcatttggacattgataccctacttgttagcttatacatgaatagttatctagatatgaagtacccggtattaccacgaaaacacatgacacaatttacaacaaccgaataaaattgcattaaagctcacacaattacgttattaaattttgtcttagctttgttagactctctagtacaaaactcaaaactcagacatacatacttaagaatgtccaatgttttgctagttaccgtaaaacaaaacgaaagaacatatgttttcagtttaaaatggcaatgttcggtaacccctgaaggtggatcaatctagtaaggctaagaagaatactataaaaaaacaagagaggtggaaaatgttaataaccagtgtaatggcctctagcaaagttattggctgcatcttctttgccagagataagttgctcgggatggaaaagctgtctgtaagtgccggttcttacttcgtcaatgacggttggttcgagatcaagaaacacagctcgaggcacatgttggcctgagcttgtctcgctaaagaatgtgttgaatgcatcatgacatgcaccaacagtactatcactgcaaaacaaatccaattattaaaaaacatgaacttgtcaaagttttttttattactaccctaaatcatcagagccatgtcaataacaataacaagaacaaaaattcgaacccacaaacaataaagatggtcataaactagagcgatgagtataaagacctgggcatggtgccatcgggttggataccatgttcgagacaataaagctcccaacaagaatttccgacctgaataccagcttgtccgatatgaatgctaatgatctccctcatgttcgaaaatttctcagagacttcttcttcttcttcctctttctctctgttttcgcgaggaagaaggttgttttgttggctctcccgcttttagatgtgaaaggacaaaaagctggaatggactggacgaacttaaaaaggggccggccccgaaaagtctcttccgctcgaaatgcctaattaaagaattcaccaatcctgggtcgatattttcttttttggattttaatccattccatttctgttttcttcttttttcccccataaaacttttaaaacatttagttaaaaaaaaaacttttaaattttccaattgaaatcatcctgttaaataaagtataatttttaaaatcagtaactcataacattgtatcacatgtaaagtttatttattctttcgtccccttccacatatctcaaatcttaaatatttttttaaacattttctataaaaaaattaacttgtgtcaaaaaaaatgaaacatttctaaaataaaataaaaaatactcattttctcgttcatttattttctcatccccttccacatatctcaaatctcaaatattatttttttgtttagttttaagttttttttttattgttgtcgtagtatgagtttaaaaatatcattgtaaaagcttagttctaaattttaattttagactatgaaatttacattgtttttttggtttttttttttgttttaaaataaatctgcactgtctatttttaattacatcttatatatagtaattctctcatcatcttccactatattcatgtatatatatatatatatatatcttatattgttatatgggttgaaaatcaaagaattcatcatggtaagaatttggttctaaatttattttggaaagtatggcatatagctatcattgtttctaatttttattttatttctaacaccatacaagattatatttattttttaatttagatacttttaattttaatttacatatgtaaaaagttaaagtttttttattttatttgctaatctttttatactttcaattaaagagtttttagaaaaagaatctatgtaaccacgattatatgaccaattatatacaaaatctattctaatgctatatttttaagttatgaaatatgcttagttttgcaaaagatcttttttaattaataaaaggtttttttttataaagactttaatcttaaaaattttaaatggtagcagcaaatataatagcaaaacagaaaagaaaaaaagaagggggagggagggatgcggcgaccacagaatcgaaacgagtggagacaggcagtaataaacactttggtcttttttttatccacttattaaagaaatgggtaatggtagtcgtgtataaaattgagagagaggtgtgtatagaaacgagaggcgaagattgcatcgaacgccgaaattgggcctacagtaatcccaaattctaatccttatcctcttctctctcgtttttattctccttcttcttcaatctcttggtctcctcgactcctcccagcgcttcaatatctcccaagacccaaccatcggagggagggggcgagatg

SEQ ID NO: 5435 - DNA, 3000 bp, Unknown
  misc_feature (1)..( 3000): cDNA_ID_1807104_gDNA_ID_1620790_Annot_ID_50454 3000 nt of promoter + ATG
cactcggggataaacctgctcccgctgctttagccctctgatatgcacgtaggcctggctcaatcttcttgactgcaccccacataccctgtctcaccccaagctttgcaatctcccacggtattcccatatcttcatggtgaaatagtagtacctcacatgatgtcatctcaccatcgcctctttttgattcaactacaccatggtaatatccatttgagaaactaaacaacacttaaataacagagacaacttgcttagtagtacctgcacggatacaccagcttgaatagtacaagtcgactcgccttggcttgttttgtctaggtacagacgggtattgtactccctgatgcaaatacaaaggagcatacttactataaacacatgaataaaaagagtgaatttaaaagacaatattcacaagaagaacacatgtttaatagctcgcactagaagaataagttggatatttgcttggttactagcagcgaaagaatggaataccttagtaatgcagtaaaagactcggccagcatcccatatacgacggcctataatatactccctgtcgctacaaaagaaggggaactgcaacagtagcggaagatatgagtaaagagaagggagaagaagcaaacagaacgaagaaaaaagagaaacaagtagcgacctttcgcacccattgcacaaccatagtgcccgtgtccttgcaacgctcgagagtagaagaatacaaaagcatatcatcccacttggaacggaactcatcatcccaaaagaagtccctgaccatctcgggagtggcatcctcaaacacagttctgctacggtactggggaggcccattctggcatcatacaaaaaatgattcaacttggaggaacatgttaaactaaacttaaaggaaggagggaggggggtacctcaggatctcgcctccaagcttgatatgagaaggttggggttgatcggtccatcatttgaatccaacaaggaccgccatctttgacctcaaccaacttccatagatgcctaaaatcatcgtccgttacaaacccagttttctctttggaagaaaggctgcgacccaaagagaagcagagttatttatttagcagaagagtaagaaagaaagagagacaagtggggaaacgggttacatcaatgaaatcatctcaaccttacctggggttaacgtggtgagaagaagttttgaggatggaagtgggaagctgaagattgaggaatttaggtgaattggacaagagtttagaatcgagataagcccacttgggcctccaaacccaaccaaccaaaacaccggcagccacagcaatccagagtggcgcaacaaaaactataaggtcagagaagccgaggctgtgaaactcggtaaagaccaaggaactcaatcccatcatctcgccccctccctccgatggttgggtcttgggagatattgaagcgctgggaggagtcgaggagaccaagagattgaagaagaaggagaataaaaacgagagagaagaggataaggattagaatttgggattactgtaggcccaatttcggcgttcgatgcaatcttcgcctctcgtttctatacacacctctctctcaattttatacacgactaccattacccatttctttaataagtggataaaaaaaagaccaaagtgtttattactgcctgtctccactcgtttcgattctgtggtcgccgcatccctccctcccccttctttttttcttttctgttttgctattatatttgctgctaccatttaaaatttttaagattaaagtctttataaaaaaaaaccttttattaattaaaaaagatcttttgcaaaactaagcatatttcataacttaaaaatatagcattagaatagattttgtatataattggtcatataatcgtggttacatagattctttttctaaaaactctttaattgaaagtataaaaagattagcaaataaaataaaaaaactttaactttttacatatgtaaattaaaattaaaagtatctaaattaaaaaataaatataatcttgtatggtgttagaaataaaataaaaattagaaacaatgatagctatatgccatactttccaaaataaatttagaaccaaattcttaccatgatgaattctttgattttcaacccatataacaatataagatatatatatatatatatatacatgaatatagtggaagatgatgagagaattactatatataagatgtaattaaaaatagacagtgcagatttattttaaaacaaaaaaaaaaaccaaaaaaacaatgtaaatttcatagtctaaaattaaaatttagaactaagcttttacaatgatatttttaaactcatactacgacaacaataaaaaaaaaacttaaaactaaacaaaaaaataatatttgagatttgagatatgtggaaggggatgagaaaataaatgaacgagaaaatgagtattttttattttattttagaaatgtttcattttttttgacacaagttaatttttttatagaaaatgtttaaaaaaatatttaagatttgagatatgtggaaggggacgaaagaataaataaactttacatgtgatacaatgttatgagttactgattttaaaaattatactttatttaacaggatgatttcaattggaaaatttaaaagttttttttttaactaaatgttttaaaagttttatgggggaaaaaagaagaaaacagaaatggaatggattaaaatccaaaaaagaaaatatcgacccaggattggtgaattctttaattaggcatttcgagcggaagagacttttcggggccggcccctttttaagttcgtccagtccattccagctttttgtcctttcacatctaaaagcgggagagccaacaaaacaaccttcttcctcgcgaaaacagagagaaagaggaagaagaagaagaagtctctgagaaattttcgaac

SEQ ID NO: 5436 - DNA, 3000 bp, Unknown
  misc_feature (1)..( 3000): cDNA_ID_2166275_gDNA_ID_1620790_Annot_ID_50455 3000 nt of promoter + ATG
ttgtttcgattcggttttgggttgggatcaaatcatcacaaggaattagatcacagatgcaccaaaattttgaaatttttatgtcggtaaccatatgtcccatgaactaatttgtttattagttgttacgaggacaaagactgaacgagcattggcccatgacatgttctctccggagaaatagagccgttataaatccacccacaacgtcatgatacatcattattaaatagtactatcattcatttagcaacgaaactcaccgaaaatatctccaacttttatctctcttttagtttccccaaaaccaaaaagtttacctttttaggtttctctacagtctccacgcgtttcttcttctctctctgtacgcgttttatcagtctccatatctaaggagaggtaatgggtcctctaaaagtttctcatttcccaaatgttagatttatgaaactgttaattttacaattttgggttaaaatctcaccttttcgatctttctcaggtgaaaatcgatgtcgaatctgttggctctcgtcgtcggattcgtaatcgtaattggtcatttgggtattttggtaaatgggttgggtgtgaattggggaacaatggctacacataagctacctccaaagacagtggttcagatgcttaaagacaataacatcaacaaagttaagctttttgatgcggacgagacaaccatgggtgcactcgctggatcgggtcttgaagtgatggtcgctattcccaatgatcagcttaaggttatgactagttacgaccgagccaaagattgggttcgtaagaatgtcactcgttataacttcgatggtggtgtcaatatcacgtgagtttgtctctcttcctctctgttctgtctcaatgttattgttattgattggttgtagtgtttgtctaaacgtcaaaattaacattctttgtgtttgtttgtcgaaacctcataaacccatggttgtttagtttatgacattgccaaatgcataaccatgagtgagttatgtctatagacaaaatgtgtctagctatatatgtttgtttctgaagattggatgtttagggttgattttcaatgtctggtgaaatctgtgttgtctgattatgaaatcaaatatcttttaacactactgtcaaatgcagaacctgtttccactaaaatgtatttatatctataaaagtcaaatcttttaacagtactgtcaaaatgcagaacatgtttagagaaaaatgtgtttacatgtctcagtgaagctaatcacttgtggatgtgtttcaggtttgtagctgttgggaatgagccattcctcaaatcatacaatggatcgttcataaacctcacattccctgcacttgcgaacattcaaaacgctttaaatgaagccggactaggaaactctgtcaaagcaacagtccctttaaacgcggatgtatacgattcaccagcaagcaatcccgttccatctgcaggaagattccgtcccgatatcatcggtcaaatgactcagattgttgactttcttggcaagaacaatgctcccatcacaattaacatctaccctttcttaagtctctatgggaatgatgatttcccactcaactacgccttcttcgatggtgctgaaccgataaacgacaacggtattgattatacaaacgttttcgatgccaatttcgatactttggtgtcgtctttgaaagctgttggtcacggagatatgccaataatcgttggagaagttggttggccaacagagggtgacaaacacgctaatgcaggttgatatctgaccttctttagatggatttttatcctttatgaagtgttttagttttgattttgaaaacggttttttcacaggcagtgcttacagattctacaacgggcttttaccgaggcttggaacaaacaaaggaactccattgagaccaacctacattgaggtatacttgttcggattactcgacgaggatgcaaaaagtatagcaccgggaccgttcgaacgccattggggaatatttaaattcgacgggcaaccaaagtttcctatagatctttcaggtcaaggacagagtaagttcttgattggtgcacaaaacgtgccgtatctacccaacaagtggtgtacgtttaatccagaagccaaggacttgacaaaactcgcggctaatatagattacgcctgcactttctctgattgcacggcgcttggatacggatcttcttgcaatactcttgatgcaaatggaaacgcgtcgtatgcgtttaacatgttctttcaagtgaagaatcaagatgagagtgcttgctattttcaaggtttggccaccattacaacgcagaatatatctcaaggacaatgcaatttccctattcagattgtggcttcctcagcctcttctttttcttgttcgtcttattctttggttgtgttgatcgtttggtttctgttatcagggatgatgttttgaggttagattgaatttgttgaacttagtgaggttttgtgagcctaattgttttcttacagatatatatattacaatgattcttttgtccatgttcttagaagttgaatcctagataaatcggaatatccagatacttgttctatcgatattttaatacagttttacactacagttttattttacaaattcattaatgttacaatttcttttagcaattaaaaaataaatagaaaaccatcaaattttacaaattcacaaaaaggaaaacacggtcgaaccggttctatacaaaaagaaaaaaccttccctttattatttgcttcttctcttaagaaaaacaaaagttcgcttactctctcgttaaagctctcagagaggttagggtttcatcattatcaattccatgcttttgcaataataacttggaaaattttatcgagttttcgtcttcctcttcttcttcttaggttatctcgatctggttggttcctttaacaatctgtaactatg

SEQ ID NO: 5437 - DNA, 3000 bp, Unknown
  misc_feature (1)..( 3000): cDNA_ID_2107069_gDNA_ID_1620790_Annot_ID_50456 3000 nt of promoter + ATG
aaatagtttttggattgaaagttttgtgtaagacatcgtagataaaacaaaacttaaaagtaacatgttacatccacacattgagactctatatcaagattcaacatctaccaaaatagttttttttttttgcatcttgatgttgtatttggataaacagttgttttttgcttctttttctttctgagtttgctagaaaatctgaaaaaaaaacttatgaaattatgatattgatgatttaagttacgcttaaattatagcgttaaaatacagttttatcaccaatatagagttttacaatttttggaccaattttggtgagaatacataattccgctagcgtcaaaccgaaattctgatattttgtgtcaagatgcgattcataaatttttggaaattattaatttacaaaatgtatgatttattaatatatattttagtactaaatgagttggaaattccttttggtatttttattttgttttttgcatccaaaacttttttttttttctttttttttatgtaattggttttcattcgagatgcaacttggaacatatataccaaattgatgttgcatccaaatgcagaaacgaatggtcatactgaatataaacgaatggtacctgatctatagtttcaaatttggaaggtggagtgttatagactgcctttaatctctcagccggaggagcaccatatattctactcatctttttctcaagaagtgtaataacagaatcttctactgcccaaatccccggcttttccccttcttccgacccgaaccaccccgaagattccgccttcattgcctcagaaggagacaagagctcaaaaggcgatgacaaaggcgggttgggacaataagagcatccctttagtccttgaattcctgccccactccgtttcttgaacctcaagtaactcataatccccggtttaagggtaactggtttgcgaccattgttcttcaccaccagagctgtagccatgcttactgggtagagagagacgatatacgttatgtcgagaaccccggccgtacagctaagttcgatctgagaacgttcccaaagatttcatcattgtgtggacaaaatttgatatatatattgaggtattgaatcaatcacctgaagagcatcaatggcgtctgaatcagtatccttgacactccaatcacatcctgagattactgaagaccctcctttaggttcttccccgtttacgataacaacaccaaccccacctctgctctcatcaccatcaactgtgtaaaggacttcctcgaatccctcgtctttccagtatacctttggcttatatgaaagtacatgagcatctgatagactcagttttaatgaacttccatttctgaccttaagctctaccataggaatgttgtttgattccgagaattttatgccttttcgtccgaatttatcttcaagcttttcagtatttattgtctgtgtctgaggagctgaaattgaacttcttacggcttttggttttgggagcaaagaaaaagagataagagaagccattgatggagagtaaggagaggaaaagataagacaaatggtggagagaaaggagaagaaaagataagacaaatgaagtttgtagtggacttagccaccaacgaaagttaatcagaattgtcaagctttattataaacgagcttatcaaattatcattttctgatcataagattttttttttctttttttttataatcataagaagttgtcttgggtcgtccttatgttattgttatcaccacataataagtaaccatgattttgtttaatcttttgtttttgattggtcttcaaattttctgaataactaatatttaaaatagaaaataaattcatcttactacttatagaaaacggatggtccggagcctcggatgcattgctttatcatattttactatcatcgttgaaattgaaatagaagacaattttttttttttttttttttaaattattttttttgaaatagaagacaattgtatatatacatgacaaaatagaccttatattatgtatgtaattagtttctatttgtttttactaataaatttatcattcgttaactcacttaccatttttatttcataatttatcggttaaagtggtcgtaatggattattcacaatgtaagaatgtactcccctaaaccgaaagtgaaacaaaatgtagttcagaccatctcatatgagtttagttcaggttcagtttttgtatataaaggtaatctcgattcaaagggtttaaaactcttaataaaatgtaagtctaaggttctatcgaaattcgtttttctaatatagaaacacttaaccgattaaaccaaaatatgatctgattaattttgtttcgattcggttttgggttgggatcaaatcatcacaaggaattagatcacagatgcaccaaaattttgaaatttttatgtcggtaaccatatgtcccatgaactaatttgtttattagttgttacgaggacaaagactgaacgagcattggcccatgacatgttctctccggagaaatagagccgttataaatccacccacaacgtcatgatacatcattattaaatagtactatcattcatttagcaacgaaactcaccgaaaatatctccaacttttatctctcttttagtttccccaaaaccaaaaagtttacctttttaggtttctctacagtctccacgcgtttcttcttctctctctgtacgcgttttatcagtctccatatctaaggagaggtaatgggtcctctaaaagtttctcatttcccaaatgttagatttatgaaactgttaattttacaattttgggttaaaatctcaccttttcgatctttctcaggtgaaaatcgatgtcgaatctgttggctctcgtcgtcggattcgtaatcgtaattggtcatttgggtattttggtaaatgggttgggtgtgaattggggaacaatg

SEQ ID NO: 5438 - DNA, 3000 bp, Unknown
  misc_feature (1)..( 3000): cDNA_ID_1828698_gDNA_ID_1620790_Annot_ID_50457 3000 nt of promoter + ATG
cttctggattaaacgtacaccacttgttgggtagatacggcacgttttgtgcaccaatcaagaacttactctgtccttgacctgaaagatctataggaaactttggttgcccgtcgaatttaaatattccccaatggcgttcgaacggtcccggtgctatactttttgcatcctcgtcgagtaatccgaacaagtatacctcaatgtaggttggtctcaatggagttcctttgtttgttccaagcctcggtaaaagcccgttgtagaatctgtaagcactgcctgtgaaaaaaccgttttcaaaatcaaaactaaaacacttcataaaggataaaaatccatctaaagaaggtcagatatcaacctgcattagcgtgtttgtcaccctctgttggccaaccaacttctccaacgattattggcatatctccgtgaccaacagctttcaaagacgacaccaaagtatcgaaattggcatcgaaaacgtttgtataatcaataccgttgtcgtttatcggttcagcaccatcgaagaaggcgtagttgagtgggaaatcatcattcccatagagacttaagaaagggtagatgttaattgtgatgggagcattgttcttgccaagaaagtcaacaatctgagtcatttgaccgatgatatcgggacggaatcttcctgcagatggaacgggattgcttgctggtgaatcgtatacatccgcgtttaaagggactgttgctttgacagagtttcctagtccggcttcatttaaagcgttttgaatgttcgcaagtgcagggaatgtgaggtttatgaacgatccattgtatgatttgaggaatggctcattcccaacagctacaaacctgaaacacatccacaagtgattagcttcactgagacatgtaaacacatttttctctaaacatgttctgcattttgacagtactgttaaaagatttgacttttatagatataaatacattttagtggaaacaggttctgcatttgacagtagtgttaaaagatatttgatttcataatcagacaacacagatttcaccagacattgaaaatcaaccctaaacatccaatcttcagaaacaaacatatatagctagacacattttgtctatagacataactcactcatggttatgcatttggcaatgtcataaactaaacaaccatgggtttatgaggtttcgacaaacaaacacaaagaatgttaattttgacgtttagacaaacactacaaccaatcaataacaataacattgagacagaacagagaggaagagagacaaactcacgtgatattgacaccaccatcgaagttataacgagtgacattcttacgaacccaatctttggctcggtcgtaactagtcataaccttaagctgatcattgggaatagcgaccatcacttcaagacccgatccagcgagtgcacccatggttgtctcgtccgcatcaaaaagcttaactttgttgatgttattgtctttaagcatctgaaccactgtctttggaggtagcttatgtgtagccattgttccccaattcacacccaacccatttaccaaaatacccaaatgaccaattacgattacgaatccgacgacgagagccaacagattcgacatcgattttcacctgagaaagatcgaaaaggtgagattttaacccaaaattgtaaaattaacagtttcataaatctaacatttgggaaatgagaaacttttagaggacccattacctctccttagatatggagactgataaaacgcgtacagagagagaagaagaaacgcgtggagactgtagagaaacctaaaaaggtaaactttttggttttggggaaactaaaagagagataaaagttggagatattttcggtgagtttcgttgctaaatgaatgatagtactatttaataatgatgtatcatgacgttgtgggtggatttataacggctctatttctccggagagaacatgtcatgggccaatgctcgttcagtctttgtcctcgtaacaactaataaacaaattagttcatgggacatatggttaccgacataaaaatttcaaaattttggtgcatctgtgatctaattccttgtgatgatttgatcccaacccaaaaccgaatcgaaacaaaattaatcagatcatattttggtttaatcggttaagtgtttctatattagaaaaacgaatttcgatagaaccttagacttacattttattaagagttttaaaccctttgaatcgagattacctttatatacaaaaactgaacctgaactaaactcatatgagatggtctgaactacattttgtttcactttcggtttaggggagtacattcttacattgtgaataatccattacgaccactttaaccgataaattatgaaataaaaatggtaagtgagttaacgaatgataaatttattagtaaaaacaaatagaaactaattacatacataatataaggtctattttgtcatgtatatatacaattgtcttctatttcaaaaaaaataatttaaaaaaaaaaaaaaaaaaaattgtcttctatttcaatttcaacgatgatagtaaaatatgataaagcaatgcatccgaggctccggaccatccgttttctataagtagtaagatgaatttattttctattttaaatattagttattcagaaaatttgaagaccaatcaaaaacaaaagattaaacaaaatcatggttacttattatgtggtgataacaataacataaggacgacccaagacaacttcttatgattataaaaaaaaagaaaaaaaaaatcttatgatcagaaaatgataatttgataagctcgtttataataaagcttgacaattctgattaactttcgttggtggctaagtccactacaaacttcatttgtcttatcttttcttctcctttctctccaccatttgtcttatcttttcctctccttactctccatca

SEQ ID NO: 5439 - DNA, 3000 bp, Unknown
  misc_feature (1)..( 3000): cDNA_ID_1828690_gDNA_ID_1620790_Annot_ID_50459 3000 nt of promoter + ATG
tccttgtccgctggttttaatgtgagttggattttattatgacacctttgctgctttgcacaacaacaaaaatatatattattatttttatgacaccaaaatataatttaacgattaactattattttctataactaaataagaacgaatttgtcaaatggtaggtaaaagttaaaaagtaataactttaatagattatatttttttggtcgtaactttaatagaatttaggatcatattccttttgaaatagatttaaataaattttagttttgattttgattttgttctttcaatatttgtatattacgaaacataatatttttcccgtaatatgtatttctcttttatttatgtgaactaatttatcatcctaaatctaaaattacaaccttcaatatgttttatttataaattagatgttcatatagaaaataacatgttaagaaaagaaaaacttgtgaaatgtgaaatcttccaaaatttagttaagttatatcgttgatttatacttatttgtttccaaaattttggcatgagcttttaaattatcttgagttaatttttggctcagtcttttatccaaactttgttaacaatctttgtttttagccttgaattggtcaaaacattcaggattttcaacttttcacagcacattgttccagttatggataagataacatcaatttttcttatcaaacagttacatgaactttgttaatactgggtcttgtgttgaagttgaggtcagaaaatatatgattccaaacagtggttgtgtgtcgatgatcaaacatggaatcttcatgcatgccatcagtgaaacgtttttgcttagttttgtcatgtcctggagggaggccacaaagcttggcgagtgacgaagttgaatcgtaaaggaaatgttaacgtcgacatgtatactaatgcaaaattcattttattttctttgcagaaagaaatgttgctcctctatcccttacttttccgtcgtatctaaataaccaaacactactccgttccttctactctcttttacatctcaacaaacacattattatcaacacaaaaacaaaaatgaaaaatgtttggtcctagactctcaatgcaatttgaagtacatggctaacaaatatttcaatctaatccaaaatagaagtccaaatgcattcaaaagcctcaaactccaacctataattactaacccttttcactggccatctcacatcactaatctcttcaaacatctcattaccatcatctaagaccggaaacatagattccggtagactccaatcaagtgaggttgagatcatactctccttcatccacgggaactcaaaaactcccaaactctcttcattactcccacttctcttctcttccatcttgttttctacattgttggctctcacatgttgtcttttcttgctcttcttagtatgctcgtcatttttcttgcgtttgtggcttgtagacgaaccctccatcgataaagaaacgtgagatgatgagatttggagtgaattgagaattaaatttataaatggccaatgatgaaaaagtgggaggggaggagagggagtcacgccttcttacccgtatgtatctgtcatttagcattttaaaagcaaaccaaccaaatccttttgtgttgttttcgtgttttccttcttttacgttctcatttctctctctcccaaccacacaagcaaattataaaacgtattgagatatatatcaaggatgaggtggacattaagaaacaaatggctatttttagtttctttaatttcactcactgcccttcaaacactgatcttcacttatgataactaaatggaaatagaacacaaattattcttagttaatatgacaattaagtatcttaaaaccaatttatgttgttctaaacccttgttaaaaataataatgagttgtgtcgtatactataacgattgtgagtttcaatcatgaaaagacaataaaggaagaaaacttctatgcttgaaattcacataattgccatacattttttataataatttaatcgttttatgcggttttatgacctaaagatatagtttcacttctagtattgtcgtgtgtcttacgtctttacatgtcgagaacgtggaaaatgcaaaaaaagaagaagcaaaacagcgcattggacatgtacttaagagatttgacatttgttgaagtaccaaattgaatgatcttttttttttgaaacattgataattgaatgtcaaatctcttaagtataaaagacatgtcaatttggcggcaaacttgtgcaaaggaagaagttggcctaaaagattgattttgggtcgccctcatctaacctcatctgtggttgacctcagcacacacccacatggtcgaccaccaaggtaacttcataaatcataaccaagcctgttgtacaagctaaaatcttaattgagaaccgtgctacgagcgactgcaataattgtctagactatgacatagcggtttagatatgtcacagtttttaccacttttgactcttatcgtctctatgttttcattagggatgtgcattttgaccgaacctagccaaactgaaccaaacctagccaaactgaactgaaccgaattaactgaactcaaaccgaaccaaaccaaaccataatttacactaaacatttagttatgtccctatttaaaccgatcaaaccgagaactgacatctagtattatcaaaataaaacatttccaagaatttagtaagatatttgacttttttggtttgtttaatttagtggtgagaattagaagttaattattttattttgaacttattggtccaccttgtttttcgatgataaatgtttctctagccaaaggtttattggttcatgtttgtgtttaaatttagctaatgccttcataatgtctccatatactacactttgatgtcttagattcatattactacaaaagaacttatgaatccgagaaatg

SEQ ID NO: 5440 - DNA, 3000 bp, Unknown
  misc_feature (1)..( 3000): cDNA_ID_2166029_gDNA_ID_1620790_Annot_ID_50460 3000 nt of promoter + ATG
tagggacataactaaatgtttagtgtaaattatggtttggtttggttcggtttgagttcagttaattcggttcagttcagtttggctaggtttggttcagtttggctaggttcggtcaaaatgcacatccctaatgaaaacatagagacgataagagtcaaaagtggtaaaaactgtgacatatctaaaccgctatgtcatagtctagacaattattgcagtcgctcgtagcacggttctcaattaagattttagcttgtacaacaggcttggttatgatttatgaagttaccttggtggtcgaccatgtgggtgtgtgctgaggtcaaccacagatgaggttagatgagggcgacccaaaatcaatcttttaggccaacttcttcctttgcacaagtttgccgccaaattgacatgtcttttatacttaagagatttgacattcaattatcaatgtttcaaaaaaaaaagatcattcaatttggtacttcaacaaatgtcaaatctcttaagtacatgtccaatgcgctgttttgcttcttctttttttgcattttccacgttctcgacatgtaaagacgtaagacacacgacaatactagaagtgaaactatatctttaggtcataaaaccgcataaaacgattaaattattataaaaaatgtatggcaattatgtgaatttcaagcatagaagttttcttcctttattgtcttttcatgattgaaactcacaatcgttatagtatacgacacaactcattattatttttaacaagggtttagaacaacataaattggttttaagatacttaattgtcatattaactaagaataatttgtgttctatttccatttagttatcataagtgaagatcagtgtttgaagggcagtgagtgaaattaaagaaactaaaaatagccatttgtttcttaatgtccacctcatccttgatatatatctcaatacgttttataatttgcttgtgtggttgggagagagagaaatgagaacgtaaaagaaggaaaacacgaaaacaacacaaaaggatttggttggtttgcttttaaaatgctaaatgacagatacatacgggtaagaaggcgtgactccctctcctcccctcccactttttcatcattggccatttataaatttaattctcaattcactccaaatctcatcatctcacgtttctttatcgatggagggttcgtctacaagccacaaacgcaagaaaaatgacgagcatactaagaagagcaagaaaagacaacatgtgagagccaacaatgtagaaaacaagatggaagagaagagaagtgggagtaatgaagagagtttgggagtttttgagttcccgtggatgaaggagagtatgatctcaacctcacttgattggagtctaccggaatctatgtttccggtcttagatgatggtaatgagatgtttgaagagattagtgatgtgagatggccagtgaaaagggttagtaattataggttggagtttgaggcttttgaatgcatttggacttctattttggattagattgaaatatttgttagccatgtacttcaaattgcattgagagtctaggaccaaacatttttcatttttgtttttgtgttgataataatgtgtttgttgagatgtaaaagagagtagaaggaacggagtagtgtttggttatttagatacgacggaaaagtaagggatagaggagcaacatttctttctgcaaagaaaataaaatgaattttgcattagtatacatgtcgacgttaacatttcctttacgattcaacttcgtcactcgccaagctttgtggcctccctccaggacatgacaaaactaagcaaaaacgtttcactgatggcatgcatgaagattccatgtttgatcatcgacacacaaccactgtttggaatcatatattttctgacctcaacttcaacacaagacccagtattaacaaagttcatgtaactgtttgataagaaaaattgatgttatcttatccataactggaacaatgtgctgtgaaaagttgaaaatcctgaatgttttgaccaattcaaggctaaaaacaaagattgttaacaaagtttggataaaagactgagccaaaaattaactcaagataatttaaaagctcatgccaaaattttggaaacaaataagtataaatcaacgatataacttaactaaattttggaagatttcacatttcacaagtttttcttttcttaacatgttattttctatatgaacatctaatttataaataaaacatattgaaggttgtaattttagatttaggatgataaattagttcacataaataaaagagaaatacatattacgggaaaaatattatgtttcgtaatatacaaatattgaaagaacaaaatcaaaatcaaaactaaaatttatttaaatctatttcaaaaggaatatgatcctaaattctattaaagttacgaccaaaaaaatataatctattaaagttattactttttaacttttacctaccatttgacaaattcgttcttatttagttatagaaaataatagttaatcgttaaattatattttggtgtcataaaaataataatatatatttttgttgttgtgcaaagcagcaaaggtgtcataataaaatccaactcacattaaaaccagcggacaaggagttaaattcaccgtactacacggtctgagctgattgcgtgttctcttaaaactccagttcaccgacgaacaacgaagtatcgtggaatccatttcatgggccgaagatttctcacttctcttcagtgtataacttctctagttctctgtgttcttgtatatatgcacaccccatgttcgatgaaattacgaaaccatgtaatcgttatcaaatcctcatctattttcttaaatgttgcaggaatctgggaaagtaatcgtttttggcttaattctgatttgggttcttacttatatagtcaac

SEQ ID NO: 5441 - DNA, 3000 bp, Unknown
  misc_feature (1)..( 3000): cDNA_ID_1828626_gDNA_ID_1620790_Annot_ID_168269 3000 nt of promoter + ATG
atagaaaatttaatattatcataaatgtaaagaacttgctaatcaagttatgatttttgtataaataatcctattagctaatgaataaatagagaaaacctgtattattgctaaagtttcctccaaacttatcagacaccaatcgatgatgtataatataccatttttcataacgtgattctattatttttaccattcacaatatttatcatacatttatatttgattttcatgtgtatgttatatttgatgcatgtggaaaaaataattcaaaattaaaaaaactacaaaacgtttttcttattatatcacaattatttaacaaaaaaaagttttgagctattttgtttataatgtttttatgcttttcaatcctacatttcactatcagaaaaatgaggccaagttataaaaataaaaataaaaactaaacccaataagcccattaaggcccataagtcaatacagcaaaaacagctcatctttgctaaaacgtagattactgatttaatctaccggaatcgaaaggcaataccaaacttccggtgaaccggaatcggatccatttgacttgccgtagaaattaggaaattgattacagtgttcttcgagaatggagaagaaggagatggagaagttgtgccaaaggtgcaaacaaagctacacagatctttcaaacgaaacttcctcttgccgttttcatccttccttcttcgtttgtcgtcgtcacgatgaccagaaaaggttatgtctcctacaaaccctaaatctattcactaatgaagaatctcacatcccaagcagcttgattcgctaatttataatggcaaagcacaaattgttgagatgggttttgaaagccatccactttattgtattaaggttctggatctatagctaatttagttagataccttagattctttgtagccaataattttgaagtgatagatgatcatgatctcagtttaatggctatttgtgggtcaaaggtcatgttttggttgatttgaaactagctcttagccttctttgcagataattagctactgttgtatttgccttgcccatttcaaactctttaggcataatcatgaagctgtttaatgattgtggtcactcttaaacgtcgaatactcttaaccactgaggataaaaaattatctcgacaagttttcaagctgtctagtggcctacactttgttctgctagttgaaaaaatggtttagtcgacggttaatagcataaataaagagtggtgaaaaatacagtttagagatttatcatctgattctatgttgcgtgttttatcttggtaataaactttggactaggaaggaacgtaggtgtctctgttccgttattggctcctttggttatttacttacttcctctgtttgtgattctctctgttccatgcattgtagttacccacatagcatagacttaactatcttttgttgagcttttatcgttatgtgcaacgaatgagtttattttggtgtttatggttgttggttttggcattcatattcttgctggtacctgatatttgttatttcattttaattttaaggtgtttcgaaactgaatatatatttattccaaaccatgtttaatcgacttgagtatgatgcatctgtttgatttctactttttactaagaagtggaattaactagaacttgttttttttaatcaataaatgaaggtactatgaattgaaaccagatgatccaccgtatgctgccaagttctatgattgttgcggggcagaggatcctaatgcaccaggttgtgtcacaaaccctcacatttcatatgatgactgatgtatgagtgagagctctcataagcctttttttttccataaaaacatcatgtaaataatcttaaattattgtagccttcttaggagtaaaagacttagcttgtgatctctctgctgggtactgtcttgaaccacttcttgcattgcacacagctacagagtgagctgttgtgttacagcttttgtcggttttgtgaataggagtgtcagaatcatttgacgtgagaaaattccggaacgactaacgattttatgtttatttgtaaggaatgttcttgtttctatggttgctttaaaaagagtcaaaactttatattctttttatgaacaccaacaacaaaaatctaaatcagacatataggttaattaactaatgcaagtaaatgtggaaaaatttacaaaacaaatttcagaagatctagaagtaatcttgagacagtacttatgagaaataatcttgcactatcatccctcttttctatgaacaccaagatttctgatgcacttataatttcttattttgtgtcaacaatagatatccaaacaaaggtagagaaaacatttgaatgtggacaaattataattatattaataaattgactgtctttaaagtttaaactaagtttagcagatctcattaagagaaaaaaaaaatcaacatgattgagtagagcacatgaagtccacatgacacaactccaagatctcaaactctctggtcttaaatcagatcgttagagagatttattctcacctccattattaaataaagccaacttgttttggtccacttcactcacagcttttattattcttcttttttcttttgtcatcataatatattactccccaaaaaaaaaaaaagcaaaagcggtgagaaagaaaggagagagagagggtgaccactatggagacagcgcaacccattactcattattagtctctcctaccattcttttgcctaaagttcaagactttgtgttcttctaacaagacccttaatcgtaagttcaagactttgtgctgttgtagtcctgtaagaagaagaagaagaagaccatgaaatcgatctgacttctcgcagcaatgctgaggatttagctgcatttattactctttttttgtcaattcaatttctcttttctttgaagctcttctcttgcaacaaca

SEQ ID NO: 5442 - DNA, 3000 bp, Unknown
  misc_feature (1)..( 3000): cDNA_ID_2166060_gDNA_ID_1620790_Annot_ID_168268 3000 nt of promoter + ATG
caagaaaagtataaatagttagtcattttgagctttttctttgaagatatttttcagcaaggtaatgctatacactcttatcaagctctcattatcggtaatgctatacactcttatctagctctcattatctttcgttgcaaacaacatcataccctctaatctagatattcagtagtcagtattatcaatattggtgcatataacaatggataaatatgccatattcatctatacagaaattaaattaggtgtaacactggtaccaagcttagttcttaaagtttataattatcactactgcaagggataaatgaacttagaagaggaaaatgagtagcaactagcaagataacgatgcgatgctggaaggaaaggaatggttacagtagtttgaaataaatacctttatctgctgaaggcatagggaaatgaactcccatacgccagaatgcgtaaaggaatgctgacaagaataagaaagccccaacagaggcacgctcccttcttacacctgaaatgttattttaacttgaaaaaattacagacagttcacacaaaatgctgtaatatgcggcagcgaacaataaagtgatgctttctcaaattcatttatctccatctaattgaactcatgagtgtttataaaagaagcaacaaagccagagataaggatcaagatttttcaagatataagatcaaaatgatgggccaaagactgtttatacacagctgcacagaagtgttctcaaagaaatctcagttgagtagcaattatataacaaaaatagtttcaggagctcctaagaaacttgcaatgaattaaccaattatagtgattaccttctaaacaagaagtgataagagcaaagaaaattcacatatgaaataaggcttaccactattacgaagcatcaaatagcaatggtaatacggcaacatgaaaaccagaagaagtatcaaacaaaaaagatccaccttccagtttatcatccttgccctgcaaaatcatcaaaagatcggtccaaggcttaaaactctaaattaatattccaactaaacaattgctacataatgccatgaattccccctccaatataagtattacgtacaatgacaaacacctcaaaagctcaatgatataagcatctagtatcaagtatcaaatttccacatgacataaaggaataaacaagagaagctagctaccacacagtttatatactcgattacattacacatacaccaaaaaaattgtcaagtaaaaaaattcttaagacaataactccatcaatctacactcaatctcaaaatcattgccaattaggtaagaagtcaacaaaattaagcaattgcaaacaaaggaggaccaagtaagtaacacaatctagaagacaacaaataagtaaagtttccaaaaacctccaatgccagaaaacaccaaaactagctaaatatcaaaaactacagagtggattactcgagaaaagacttactctctagagagaacaggtatgatctcgaacaaaacgagctgcaatagattacaagagaaagcgaagacgacactgaaaatgatttgaaccaaagctcgtttctcttcatactctttgtataatctccgattaagaaaccataaacctgcccatcctaagagacttagtgaagctatcaccaccgtgccttcgtatatcgcccatccgtaactcatcgtcgccaaattccagatctctcttacttctcgagaaaaaacctcagatctgcaaaaacctcatggcgattcaacaccagagcttctgttgtacgattcgattcgaatttgatcatttatgaaacaattaaaaaaaaagtatttaagaataccttatttatttttggttagggtttatttggtttaaactctaatcaacaacaacctcatcaacttcatcatcaccaccaccaccatgcgactcaactcgaactcgcagagaggaaggcgttattaaacgctaaccaaccattgagctacggagtaatgtgaaagaaactgcacaacaatagtgtttctatcctttttttttgtttataggttttggcgtctagtctagtgttgatgataattttaactccattttccgacatgttttcttatctggtcgattgatttttttgtttttctttcacttttacatatatacacgaaaaatgatcgattcattaaaattgttgtttagaaggcttgtccaatcttacacgtgttaccatatataaatttgcgggaagtgggaagggaaagatcgggatatcgatagttcatgataaatcttataattacgggatcaagataaatattttttttatcattaataaaaaattaatatttgtgtacattttcttattgttagatagaaaatttaatattatcataaatgtaaagaacttgctaatcaagttatgatttttgtataaataatcctattagctaatgaataaatagagaaaacctgtattattgctaaagtttcctccaaacttatcagacaccaatcgatgatgtataatataccatttttcataacgtgattctattatttttaccattcacaatatttatcatacatttatatttgattttcatgtgtatgttatatttgatgcatgtggaaaaaataattcaaaattaaaaaaactacaaaacgtttttcttattatatcacaattatttaacaaaaaaaagttttgagctattttgtttataatgtttttatgcttttcaatcctacatttcactatcagaaaaatgaggccaagttataaaaataaaaataaaaactaaacccaataagcccattaaggcccataagtcaatacagcaaaaacagctcatctttgctaaaacgtagattactgatttaatctaccggaatcgaaaggcaataccaaacttccggtgaaccggaatcggatccatttgacttgccgtagaaattaggaaattgattacagtgttcttcgaga

SEQ ID NO: 5443 - DNA, 3000 bp, Unknown
  misc_feature (1)..( 3000): cDNA_ID_2166050_gDNA_ID_1620790_Annot_ID_168266 3000 nt of promoter + ATG
gaatccatggcttcttcattcatctgaagattcttcaatttccgtttctgactactagattttcacttgattcgcattttgatttggttttgattcatcacgattcttcaattttgcttatcattatgagatgatatagatctttctcatttcttcgaaattcgttgtagatttctttgtgtgttacttcattcatctgaatatggcttcaatttccgattctagcttctagatttgcacttgattcacatttcgataaggttttgcttcataacgattctgtttcttacgaatttgcttaatctaatgagatgctacagatcttaacttttgcaatgaaatttatggcagattcgaattctgcaacaacaatgacaattagcaacggagatgtcaaatctgaaacctgcaacaatggctcttctgagaagaaaccattcaggatcttcgttggttacgatccacgagaagatcttgcctaccaagtttgtcatcattcaatcacaaaaagatcttcaatccctgtagagatcacaccaattattcaatcagatcttcgaaagaaaggtctgtattggagagaaagaggtcagttagagagcactgagttctctttctctcgtttcttgactcctcacttgtcagattaccaaggttgggctatgttcgtcgactgtgatttcctctaccttgctgatatcaaggaactcactgatttgatcgatgataaatatgcgatcatgtgtgttcaacatgattatactcctaaggagactactaagatggatggtgcggttcaaactgtgtacccgaggaagaactggtcttcaatggtgctttacaactgtggacaccctaagaacaagactttgagccctgagattgttaatactcagactggtgcgtttctccataggttccagtggcttgaggatgaagagattgggtctattccttttgtgtggaactttcttgaagggcacaatagggttgttgagaaagatcccaccacgcagcctaaagcggtgcattatactcgtggagggccttggtttgatgcttggaaggattgcgagtttgcggatctttggcttaatgagatggaagagtacaacaaagagaacaagaaggaagctgataacgcaaagtagaaagaaagaagtaagaggtatgttgttacttaccaacacgagtagtgaacttcctttacatagtgttggctttgtagagccagggatcattagtcttgtggagggctatggagttttttttaatttcattgaattcgttaaatcattcgcaaacactattagtacctatattgaggtcatatggtataataaccctattcgtttgtttatttgttgtgttttgtacctttgatggtattttatttgtataattgatatgtgaatttatgtagcatttctttttaattgatctataatgagcagtagctcaacatatttaaaacatggatggatgagtaatgatcattagctagcaaccttccagatgatcagcggctgtaacaaggtagactcgccttcgtggacgagtaactaccgttgtaatgggacttgtacatgtacttactgataattacctaactaaacgagactcagtgctagaatatgagcataaatcctcatattgaggaatcactaatcatttttatactatttacctttcacatcgtattcttattcattttgatccttttttggtatcaaactaacaatgttgagttattcagtttttcattctgattatctcttttcttcatcttctaatctagtactgatcaatagaaagcctttctcattttgatttgttactctatcctgcgaatatcttacccctaaatgttacccatcccgataaaaaaaaattacattgatacggactttatatattcacacccaccatcactatgcatcatattaactcataataaatgttgtcgaaatcctcttctgtgagtttgtaatgcacaactacaaatcttcaagtggataaaaacacgttactatgtttgtatgtgatttcaaatattataaattagtaggtgatacaattattactttatcttacaacattaataataggtatctatgtttatttttattttcttaaaacttgtaatttatatagtttttataaagtattaggccgcagattggtctttttctaaatggattcaaccatttgaaattgatgcgtgtgatatgctaatccacaatatccaaaaaaaattccttctaaaattgtgactttaaaattttgactggttttgttaagagtaacgttgaagaggaaggggaaggaaaagtcaataatgaaagaaaatagtttcttcatttttggatttaaatggtgagcatggttagaagaaaagaaaattatcaaaggaaacaatatctatatattacccaactatttatcagtcaaaaaaaaagaattgtttccaccctaccaaaaaaaaaaaaaaatattgtttccaacatattttttcttttttctgaataatccatttttgaccggacaaacagttgggtagtcagattaacttttgtactttaccattttaatctttctctaacctactcatccgtaatagaacggtgtccacgaggctcatagtcctacaagcatgtgatagttgtcacaattaccatattaagctctctttgcttacttcacttcttctatcaatatttgtttgccactgacttttcactaaattacaaaactaaaatgatggaagaaaaagaaaagttaaacaaaaaaaaaggagaaaaatcaaagtgataagtggatgtagacgattggccctttccccaagacctgtggcaacagaaagttttgtggctctaaagttaagaaaaatggtccaatgttatatatccaaagtttgatctcacacagtcacactgtaacaataatcaaataatccctgacttcgtcacgtttctttgtatctccaacgtccaataaatg

SEQ ID NO: 5444 - DNA, 3000 bp, Unknown
  misc_feature (1)..( 3000): cDNA_ID_3077043_gDNA_ID_1620790_Annot_ID_168256 3000 nt of promoter + ATG
cagatagagtgacacgaatttagcttagctaatcaaatcctcacattccttatcttaaataaccttcgaaaaaagtgtgatccacatgtctgtataaaacgaaccgattagattgtgacaacaatacattccaacaatttatccatcacttttccatcctccaaaatttttgcagtaaaatctcttttcactttcaaatcaattatgtcacatcccaccgtagaacaactacatgctttccatgcacaagaaagagagatattctctaaactagttcaaaaactccgaagaccaccagctgagtcacttcttgtcatggccacatggctttggtttgaagactttggcttcggaaacattttctccatcatcacggtttttagcgatctactcattgtagatctcgctaacgaggctgtcttgtgctttcggtgccttgaatctgaccagcccccaaatgatgtcagtcagatccctctcaccgagagattcatgaaaaatgacatatcccttcaaataatccacaatcatcgatacactgccattacgggaataaagaactttttaaccactatttgttctagaatattctctgatatccttcaacgagttcttccatcttcatcatcctcattcatcaccaatctccgccaccctctcatcattcccggtttccctcatccaacttttgggagcatcaacgtattgcctaatatcgttgctagggataatcttccaaacgcaaattcatttctttttcctcatggtctttggggctggaacgctaaccatgtcgcgactgataaagaacggacggtatttctaacgttttctcgtggttttcccgtgtcacatgctgaggtgattcatctcttcaccgagatatatggagaagattgtgtcgaaagcgtttacatgccagaggacggtggaaattcctccaatgacaacacaaattgcaatggtcatcagcaacaaccactattcgcgaagatggtcttggactcggttgttaccgtagatcgtatactcagcggccaggaaaaacaaaagtataagatcaatggaaagcatatttgggctcgtaagttcaagaataataaagacggtcttatctaattaaataaagtcataaggatttttagtttctagtttttcaatttgctggtgtcaaatcccttatcttatattgtagtctaataattagaaaccatatgtaacgtttcgacgatggtatcttcacttaatttgacgggaatgtgtttcacttaagtttgaggtttgaggtgactttagatatccaatatatttcacatttcttttaagcaagagtggtactcaatatttttatgcactaccatatctctaatgttttctcaacataaaatataattcacacgtttaaaataaatagcttttgatcaaccaagcttctaacgatactacgctgatttgggggaaatcaccatcatcgtcaccgtcactgtcaccgtcggttcctcctttgaatgaattttagtaggatccctttgatgtcattgacaaccgccatcatcatcgtctctattaccaccgttgatgctgccacgagcaccactgacgttaaaaccaccaggactaccaccacaacaaccactatcaccactaacaaagagaccaagttttttcataaactaccttccatgtttaattactatagtttgaatatagagtgctagtttcttaatttattaataaaaaaatggtagtcttgcacaaatttttcttctttataaagaaagatatcacaaaattttatcaattaaatttattgaataaaacaaaagattttctctcttctattgtttacctttctttttagtaagtaattaagtctaaatgtgcaagaaatccacagataataaattcaaagagataaactttgatgttgttagaaatggaggataatcatacaatagacggatcggtttctcgagtaattgtttttttattaaacggattataccaaatttagaccgattttcaccaataatcaaatcaaacagaaccgaaccaaattaccttcattaattggaaaaaaatcgaatttagccaaaaataaccaagttaaccggatttttttaaaatgaatacagagattatcgacagtggaaaaaggaaaagaactcgaaaagaagaccataaacgcagaaccataagcatacacagacgaatgttaagcgattagttttaacacatttcataggtcttttaaatgtatattatcgagtctttgatatcgagaacatatagttttcgatatcttttagtgtttttggatttgtggacctgctggggttaaaagaggtgtgttggaagagaaatgaagccaaatgagtcaagtgaagtaattggagatgcagagcagtgcaaaagcgtcatcactaattagtttggccgcctctgatagaagacttcctaccgatagatctttctcaactttgtacacaagatagagtaggatataatctctttattgatcaaagtatgataacaaagtataacaatcaaggcacatcaaatcaatttataaaccctagtcacgtttcaagaatccaaataggaaatacacaataaatattgtcttgtagagattgcaaatagttgttaagacgaagaacaaactatttttatttattacgtgggtcatattcaaaattgaataaatgtaaatttactgtaaatgatgcacttttggataaatcctgacaaaaactagatttatatcgttcataaacctttcacatatcagccattgcaaccatatgaagttttgaaaataagcttgtaggtgatttttgggaggatttactcacatgactaaattgggcccatgagtgaaagtgaagcccatttgtaaaataaatgtcacactacacacaaaaaccctaaaaatcatttcagtcttctcaaggtttttgaaatttctatcttccatttccatctgatgaatctctgacg

SEQ ID NO: 5445 - DNA, 3000 bp, Unknown
  misc_feature (1)..( 3000): cDNA_ID_2992645_gDNA_ID_1620790_Annot_ID_168253 3000 nt of promoter + ATG
tgacacatggtgttccaacttccaagccactttcatggctataaacttgaaagactgtacattctggataataagatgggtcatgtccatctcttatttatgccttggagccgaagttgagccgcacaagagattgaatgagcttcagccatttctttctcagtagaactttgataaggcattattttagtgtagtttaagcatagacatagatttgttgggaattgttgctttgtttgacagcttaccaactgagttggattttgaaaggaaactaggggaaactggtaaatttctgctaaataatgaaggaactcgattgttttttattccaaacttgtgcagctttcatgtcgtcccctctgccataccctttagacagcttctgttcttgcttttgactctgtttagagcctcttgcttgttgtagattgattttattttgtgactatggctacattatggttcaaagtagtgctgcgcctgcctagcatattcaatgggtaaaaaatccagagtcatcttcatgtttaaactggtccaaaagctgcaaagagcaacacttctcctgtagttgtattcttcagatggtaatgattaagataaacttggtaggcttgagttgtcttgtacttttagatttgtagtgatgtaccaaatctgaggtttaggcgtggaagctttgaccgtgtatcagggaaggtgttgaagaacaagaccatagattaattgtcaggttgtttctgatgcagagaaacttgaaaggataagaacaatcaagaatagaagcagatcttgtttagttcatgcttgttttgttgtcctaaggagagataaacactggttttgttaattcatttcagtcgtaaatttttacatcaaatctctcatcttgtaactcttttgtttcaattacttccccaaccatagagtttgagtaaatcagaaaaaaatagtattatccaaccgttcaaccaatccgtgcgttgtttctatattttcgtagcagttgagttataaacacatttattatggtgacaatatgagaagcttaacttgaatcagaattcacccacataactgcaagagtcacaagagaagcatagattgaagtaggcagcttctgcacaactttgccaactccagggacaccttccgtggccttcttcgtcgcaatagccacagtgggagcaacaatcaaagctatgatcaaaccctgactaaccacgttaaacgtctcagccgtaatctgctcaataaacttcacaaactcttccctatcaagttctccatccaagttgatatcacagtcctgttacaagaacatcacacaaccattatgaccactcaagttgcctagaccgaaaagaaatagtaacattatctgatttttcaacctattcttccaaaatcagagtccagatgatttcaagtgtagtgttacaaacagtggttaatactaaacgtttaaagctaaacgcaatcgccaaaagaacatccgtttctgctttaaaaattgcattttgactttttctttacacaaataaccacaaacgcaaaagaagtaattcagcgtttgcgttttaaaagcgtttcaaggaagtgaaagtaccgtcataatgctattgactagatccttagaaggtggatcgaaatgaggaccaggcaatctcttgtttatgtcactgacaagattacacaacaagacaaaaattgtcagagattaaacataaaagtttctaaatctgtaaattaacactaaaaaaatgttatggaaccaaaagattttacttgtaaacgagaagaacagcgatgtataactcttcaaacgtaagattggctcttccggtttgcatcttgaaccgatcgaaaacacgatcacatatcgcttgtacctgcttatgtctccactctttacctgcaatttaacattgccatatacatattatacataacaaaagaagcaattttattacatatgcacaattacttgaccataaaactgattataaatgaaccaatgtgagaaactgaaaacaattttacaaacctcggagcttgttaaagacttgtcccatggcgatggataatcttcttctcgtctgattgattgcacaaaaatgattttttttttttttaatatgtggatctgagtgggggtggaggcgtgagcgtgacgaatttgggccaatttatatgttggtcaacggcccatttatttgcgcaagctaatgaatcatgggctcaaatgggccttaatcgttaatggtgaagaaatgtaaatgggagagagaaggcagcgaaagcgaaacaagagacgtagctgaataccacagaaacatggagccagtatctgcttccaccaatcccatctcttctttccatatctccatttttttttatatctcctaattatcatattcgtttttttcactataatctaaacttctccaattgttgaaaccattttatatttatctcttcttattttctgcatggtggtttgaattaggccaccaaaaaactcttggataaaaaaaaaactgagaaacagaaaaaagaaaaaacaaaacacacattctcgatttgtctgtgccacacacactctcttgcacattcttgtctcgacaatactctcaggtgcgttattggctttgctctttaagatcttactcaaaatctctgtctttggaatctatccatagatgcaaaatttgattttgaagtgattcttcatcttcttaattgggtttcaatggattagtcaaatttgggtagtaatgattggcttcgagctcagaactagaataaagtacaattcttttgctggattacgttattaacttttgtaattttcaatacccacaagttgatattgattctttgtgtctgaaattgtgttatgatatctaaagtattgatttttgttagcagaatacgatcttgaagagcaaagattgttcctttattgatgaattgagtgcaaaagagtgttatata

SEQ ID NO: 5446 - DNA, 3000 bp, Unknown
  misc_feature (1)..( 3000): cDNA_ID_2166029_gDNA_ID_1620790_Annot_ID_168247 3000 nt of promoter + ATG
tgtttttgggcttcgatttaagtttggtttgttcattcgggcttttaaagtccatggataatggattcacttttaatgttggaatttgtgtgtgttttttggtgggaagaatttgtgtgttaaaaaaactagatctaagacaaaatataattaggggttttctcctgtcttctctctccccaaacctttcagagaggagacaccatcgttcatcctttttgattccggtttgtccggatttgtacatattctcgtctctgtgcgagataaataaagttccgactttagatcggatttccttaccggcaaagtctggtttagatctcttttacaactgcgatgtcgaagccctctgttttacttccaaatctcgtctgatctctctaatcttttgtggaattatatcttcgtcacttatttttgctcatgtcataggagcaaagaacagattacatcaattctcgatgtagtcagtggtggagcctccctggagatggtgatgttcagcgaatttcgaaacagtttggaattgggatccacagaaggaaagaggacgttcaccgcttcagagctgatcggtggtggctcatcggagtttttagcggtttccggcgaactaacggcggagcttgcatctgacgcgtggcaatgtgaagaccacgtatcatatacgtgtccaaccctaaatcaactatactttaattgtattttatttctctgtttgatttagttttgggcctggcctattaatttccatatgtaatcctctttggaccttctgtaatctgcccaatttgggctttatcaatcaaaatggccgacaaaaaataaataaaaaattgtgtgttaaaaatgataaattctaaacaaaaattagacaacaacactcacttaaatcacatcaaacaacatataaacggttataaatatgtatattattgagttaaaagttatagatttatgtctgtatagttagatattagaaaatacactaaaaatacactttcttaagatcacttaaaacggcttaaatccatttaataacacatgcatattaattttttacaaaaaaaaaacacaaaataatttttaaaccaatcatgcatacgtgtttgcggtccactatttttttctaagtaaatcccatcaatttttgcaatccatgttcgtttttgacgacatcgccgcttagaagctcctctatatgctttccataagatatgatgatattgaccttgtcttaaaagacacttccatattgttcttttgcttacatgctcgccgaaactaaattcatacttaccattgaataagacatcgtggacggatatagtgttgtctttagatgtgcaattaactttgagaatactattgggagcaagttcatttcgaaattctaatgtgttatccttgcaaccccatggtactactgtccaactttcatttaaaccaaaatatatggaaatgactattagaaaaacaatgagatggttcatttctcggattcataagttcttttgtagtaatatgaatctaagacatcaaagtgtagtatatggagacattatgaaggcattagctaaatttaaacacaaacatgaaccaataaacctttggctagagaaacatttatcatcgaaaaacaaggtggaccaataagttcaaaataaaataattaacttctaattctcaccactaaattaaacaaaccaaaaaagtcaaatatcttactaaattcttggaaatgttttattttgataatactagatgtcagttctcggtttgatcggtttaaatagggacataactaaatgtttagtgtaaattatggtttggtttggttcggtttgagttcagttaattcggttcagttcagtttggctaggtttggttcagtttggctaggttcggtcaaaatgcacatccctaatgaaaacatagagacgataagagtcaaaagtggtaaaaactgtgacatatctaaaccgctatgtcatagtctagacaattattgcagtcgctcgtagcacggttctcaattaagattttagcttgtacaacaggcttggttatgatttatgaagttaccttggtggtcgaccatgtgggtgtgtgctgaggtcaaccacagatgaggttagatgagggcgacccaaaatcaatcttttaggccaacttcttcctttgcacaagtttgccgccaaattgacatgtcttttatacttaagagatttgacattcaattatcaatgtttcaaaaaaaaaagatcattcaatttggtacttcaacaaatgtcaaatctcttaagtacatgtccaatgcgctgttttgcttcttctttttttgcattttccacgttctcgacatgtaaagacgtaagacacacgacaatactagaagtgaaactatatctttaggtcataaaaccgcataaaacgattaaattattataaaaaatgtatggcaattatgtgaatttcaagcatagaagttttcttcctttattgtcttttcatgattgaaactcacaatcgttatagtatacgacacaactcattattatttttaacaagggtttagaacaacataaattggttttaagatacttaattgtcatattaactaagaataatttgtgttctatttccatttagttatcataagtgaagatcagtgtttgaagggcagtgagtgaaattaaagaaactaaaaatagccatttgtttcttaatgtccacctcatccttgatatatatctcaatacgttttataatttgcttgtgtggttgggagagagagaaatgagaacgtaaaagaaggaaaacacgaaaacaacacaaaaggatttggttggtttgcttttaaaatgctaaatgacagatacatacgggtaagaaggcgtgactccctctcctcccctcccactttttcatcattggccatttataaatttaattctcaattcactccaaatctcatcatctcacgtttctttatcg

SEQ ID NO: 5447 - DNA, 3000 bp, Unknown
  misc_feature (1)..( 3000): cDNA_ID_3077049_gDNA_ID_1620790_Annot_ID_168246 3000 nt of promoter + ATG
gtaataactttaatagattatatttttttggtcgtaactttaatagaatttaggatcatattccttttgaaatagatttaaataaattttagttttgattttgattttgttctttcaatatttgtatattacgaaacataatatttttcccgtaatatgtatttctcttttatttatgtgaactaatttatcatcctaaatctaaaattacaaccttcaatatgttttatttataaattagatgttcatatagaaaataacatgttaagaaaagaaaaacttgtgaaatgtgaaatcttccaaaatttagttaagttatatcgttgatttatacttatttgtttccaaaattttggcatgagcttttaaattatcttgagttaatttttggctcagtcttttatccaaactttgttaacaatctttgtttttagccttgaattggtcaaaacattcaggattttcaacttttcacagcacattgttccagttatggataagataacatcaatttttcttatcaaacagttacatgaactttgttaatactgggtcttgtgttgaagttgaggtcagaaaatatatgattccaaacagtggttgtgtgtcgatgatcaaacatggaatcttcatgcatgccatcagtgaaacgtttttgcttagttttgtcatgtcctggagggaggccacaaagcttggcgagtgacgaagttgaatcgtaaaggaaatgttaacgtcgacatgtatactaatgcaaaattcattttattttctttgcagaaagaaatgttgctcctctatcccttacttttccgtcgtatctaaataaccaaacactactccgttccttctactctcttttacatctcaacaaacacattattatcaacacaaaaacaaaaatgaaaaatgtttggtcctagactctcaatgcaatttgaagtacatggctaacaaatatttcaatctaatccaaaatagaagtccaaatgcattcaaaagcctcaaactccaacctataattactaacccttttcactggccatctcacatcactaatctcttcaaacatctcattaccatcatctaagaccggaaacatagattccggtagactccaatcaagtgaggttgagatcatactctccttcatccacgggaactcaaaaactcccaaactctcttcattactcccacttctcttctcttccatcttgttttctacattgttggctctcacatgttgtcttttcttgctcttcttagtatgctcgtcatttttcttgcgtttgtggcttgtagacgaaccctccatcgataaagaaacgtgagatgatgagatttggagtgaattgagaattaaatttataaatggccaatgatgaaaaagtgggaggggaggagagggagtcacgccttcttacccgtatgtatctgtcatttagcattttaaaagcaaaccaaccaaatccttttgtgttgttttcgtgttttccttcttttacgttctcatttctctctctcccaaccacacaagcaaattataaaacgtattgagatatatatcaaggatgaggtggacattaagaaacaaatggctatttttagtttctttaatttcactcactgcccttcaaacactgatcttcacttatgataactaaatggaaatagaacacaaattattcttagttaatatgacaattaagtatcttaaaaccaatttatgttgttctaaacccttgttaaaaataataatgagttgtgtcgtatactataacgattgtgagtttcaatcatgaaaagacaataaaggaagaaaacttctatgcttgaaattcacataattgccatacattttttataataatttaatcgttttatgcggttttatgacctaaagatatagtttcacttctagtattgtcgtgtgtcttacgtctttacatgtcgagaacgtggaaaatgcaaaaaaagaagaagcaaaacagcgcattggacatgtacttaagagatttgacatttgttgaagtaccaaattgaatgatcttttttttttgaaacattgataattgaatgtcaaatctcttaagtataaaagacatgtcaatttggcggcaaacttgtgcaaaggaagaagttggcctaaaagattgattttgggtcgccctcatctaacctcatctgtggttgacctcagcacacacccacatggtcgaccaccaaggtaacttcataaatcataaccaagcctgttgtacaagctaaaatcttaattgagaaccgtgctacgagcgactgcaataattgtctagactatgacatagcggtttagatatgtcacagtttttaccacttttgactcttatcgtctctatgttttcattagggatgtgcattttgaccgaacctagccaaactgaaccaaacctagccaaactgaactgaaccgaattaactgaactcaaaccgaaccaaaccaaaccataatttacactaaacatttagttatgtccctatttaaaccgatcaaaccgagaactgacatctagtattatcaaaataaaacatttccaagaatttagtaagatatttgacttttttggtttgtttaatttagtggtgagaattagaagttaattattttattttgaacttattggtccaccttgtttttcgatgataaatgtttctctagccaaaggtttattggttcatgtttgtgtttaaatttagctaatgccttcataatgtctccatatactacactttgatgtcttagattcatattactacaaaagaacttatgaatccgagaaatgaaccatctcattgtttttctaatagtcatttccatatattttggtttaaatgaaagttggacagtagtaccatggggttgcaaggataacacattagaatttcgaaatgaacttgctcccaatagtattctcaaagttaattgcacatctaaagacaacactatatccgtccacgatg

SEQ ID NO: 5448 - DNA, 3000 bp, Unknown; identical to SEQ ID NO: 5438
  misc_feature (1)..( 3000): cDNA_ID_2166021_gDNA_ID_1620790_Annot_ID_168244 3000 nt of promoter + ATG

SEQ ID NO: 5449 - DNA, 3000 bp, Unknown
  misc_feature (1)..( 3000): cDNA_ID_2107069_gDNA_ID_1620790_Annot_ID_168243 3000 nt of promoter + ATG
cagattctattgagttcatagttagcattagaaaatcttccttaagcaataaacagagagagaaaattatatataagatatagaagttaattgaaatagtttttggattgaaagttttgtgtaagacatcgtagataaaacaaaacttaaaagtaacatgttacatccacacattgagactctatatcaagattcaacatctaccaaaatagttttttttttttgcatcttgatgttgtatttggataaacagttgttttttgcttctttttctttctgagtttgctagaaaatctgaaaaaaaaacttatgaaattatgatattgatgatttaagttacgcttaaattatagcgttaaaatacagttttatcaccaatatagagttttacaatttttggaccaattttggtgagaatacataattccgctagcgtcaaaccgaaattctgatattttgtgtcaagatgcgattcataaatttttggaaattattaatttacaaaatgtatgatttattaatatatattttagtactaaatgagttggaaattccttttggtatttttattttgttttttgcatccaaaacttttttttttttctttttttttatgtaattggttttcattcgagatgcaacttggaacatatataccaaattgatgttgcatccaaatgcagaaacgaatggtcatactgaatataaacgaatggtacctgatctatagtttcaaatttggaaggtggagtgttatagactgcctttaatctctcagccggaggagcaccatatattctactcatctttttctcaagaagtgtaataacagaatcttctactgcccaaatccccggcttttccccttcttccgacccgaaccaccccgaagattccgccttcattgcctcagaaggagacaagagctcaaaaggcgatgacaaaggcgggttgggacaataagagcatccctttagtccttgaattcctgccccactccgtttcttgaacctcaagtaactcataatccccggtttaagggtaactggtttgcgaccattgttcttcaccaccagagctgtagccatgcttactgggtagagagagacgatatacgttatgtcgagaaccccggccgtacagctaagttcgatctgagaacgttcccaaagatttcatcattgtgtggacaaaatttgatatatatattgaggtattgaatcaatcacctgaagagcatcaatggcgtctgaatcagtatccttgacactccaatcacatcctgagattactgaagaccctcctttaggttcttccccgtttacgataacaacaccaaccccacctctgctctcatcaccatcaactgtgtaaaggacttcctcgaatccctcgtctttccagtatacctttggcttatatgaaagtacatgagcatctgatagactcagttttaatgaacttccatttctgaccttaagctctaccataggaatgttgtttgattccgagaattttatgccttttcgtccgaatttatcttcaagcttttcagtatttattgtctgtgtctgaggagctgaaattgaacttcttacggcttttggttttgggagcaaagaaaaagagataagagaagccattgatggagagtaaggagaggaaaagataagacaaatggtggagagaaaggagaagaaaagataagacaaatgaagtttgtagtggacttagccaccaacgaaagttaatcagaattgtcaagctttattataaacgagcttatcaaattatcattttctgatcataagattttttttttctttttttttataatcataagaagttgtcttgggtcgtccttatgttattgttatcaccacataataagtaaccatgattttgtttaatcttttgtttttgattggtcttcaaattttctgaataactaatatttaaaatagaaaataaattcatcttactacttatagaaaacggatggtccggagcctcggatgcattgctttatcatattttactatcatcgttgaaattgaaatagaagacaattttttttttttttttttttaaattattttttttgaaatagaagacaattgtatatatacatgacaaaatagaccttatattatgtatgtaattagtttctatttgtttttactaataaatttatcattcgttaactcacttaccatttttatttcataatttatcggttaaagtggtcgtaatggattattcacaatgtaagaatgtactcccctaaaccgaaagtgaaacaaaatgtagttcagaccatctcatatgagtttagttcaggttcagtttttgtatataaaggtaatctcgattcaaagggtttaaaactcttaataaaatgtaagtctaaggttctatcgaaattcgtttttctaatatagaaacacttaaccgattaaaccaaaatatgatctgattaattttgtttcgattcggttttgggttgggatcaaatcatcacaaggaattagatcacagatgcaccaaaattttgaaatttttatgtcggtaaccatatgtcccatgaactaatttgtttattagttgttacgaggacaaagactgaacgagcattggcccatgacatgttctctccggagaaatagagccgttataaatccacccacaacgtcatgatacatcattattaaatagtactatcattcatttagcaacgaaactcaccgaaaatatctccaacttttatctctcttttagtttccccaaaaccaaaaagtttacctttttaggtttctctacagtctccacgcgtttcttcttctctctctgtacgcgttttatcagtctccatatctaaggagaggtaatgggtcctctaaaagtttctcatttcccaaatgttagatttatgaaactgttaattttacaattttgggttaaaatctcaccttttcgatctttctcaggtgaaaatcgatg

SEQ ID NO: 5450 - DNA, 3000 bp, Unknown; identical to SEQ ID NO: 5436
  misc_feature (1)..( 3000): cDNA_ID_2166275_gDNA_ID_1620790_Annot_ID_168242 3000 nt of promoter + ATG

SEQ ID NO: 5451 - DNA, 3000 bp, Unknown; identical to SEQ ID NO: 5435
  misc_feature (1)..( 3000): cDNA_ID_3077053_gDNA_ID_1620790_Annot_ID_168241 3000 nt of promoter + ATG

SEQ ID NO: 5452 - DNA, 3000 bp, Unknown; identical to SEQ ID NO: 5434
  misc_feature (1)..( 3000): cDNA_ID_1842723_gDNA_ID_1620790_Annot_ID_168240 3000 nt of promoter + ATG

SEQ ID NO: 5453 - DNA, 3000 bp, Unknown; identical to SEQ ID NO: 5433
  misc_feature (1)..( 3000): cDNA_ID_1828706_gDNA_ID_1620790_Annot_ID_168239 3000 nt of promoter + ATG

SEQ ID NO: 5454 - DNA, 3000 bp, Unknown; identical to SEQ ID NO: 5445
  misc_feature (1)..( 3000): cDNA_ID_2992645_gDNA_ID_1620790_Annot_ID_50465 3000 nt of promoter + ATG

SEQ ID NO: 5455 - DNA, 3000 bp, Unknown; identical to SEQ ID NO: 5444
  misc_feature (1)..( 3000): cDNA_ID_1828666_gDNA_ID_1620790_Annot_ID_50467 3000 nt of promoter + ATG

SEQ ID NO: 5456 - DNA, 3000 bp, Unknown
  misc_feature (1)..( 3000): cDNA_ID_1828642_gDNA_ID_1620790_Annot_ID_50475 3000 nt of promoter + ATG
agaatagtacattacttatcctaagtaattgacatcttttaaattttttgaaaacttctcaattctaaagtttccacatctacgatatttcagttttgggtcaaagtcttcatatgtctttaaaggaaagatcttgaattcattagaagaaaatagaaatgataataaagaaaaggtagtataaatctcaatagcacgtaattgatgatgtcatgaaaatccatgatagctgttgtttgtactttcacacgtagagctaaataaacctcgtgacttgtgagatgcaacaaacatggcacaaaattgttttacttgatttccccaaatttcaaaatagatttttatttcgttaaactaaaaaataaattattgtagatgtacagattatattttattatataaagtaagatttttaaaataaattaaaaagttagttttatatattctatattattattttttataatatttaaattttaaataaaaactcacatatttttaaaaatatttagtattctaattcttatctcaatttatttattttttaaatttttaaatatttctttttgttgtttaaactttaaaataattaagccatacacgtgtatcattattatataaacacgaaaagaaggaagaagacgcaaagaacaaaccagtgaaggaaaaatggagatatggttacttatcttgggctctctcttcctctctctccttctcaatctcctcttctttcgcctccgtgactcctcctctcttccgttaccacctgaccctaactatttccctttcattggaaccatccaatggctccggcaaggcttaggtggactcaacaactatctccgctccgtccaccaccgtctcggtcccatcatcacccttcgcatcacttcccgcccctctatattcgtcgccgatcgttctcttgctcaccaggctctcgttttgaacggtgccgttttcgccgatcgtccaccggcagctccgatcagtaagattatttcgagtaaccaacataacatcagctcttgtttatatggagccacgtggcgtcttcttcgccggaatctcacttctgagattcttcacccctcgcgcgtgagatcttactctcacgcgcggcgttgggttcttgagattctttttgatcgatttggtaaaaacagaggagaagaaccgattgttgttgttgatcatcttcactatgcgatgtttgcgcttcttgttctcatgtgttttggagataagcttgatgagaagcaaatcaaacaagtggaatatgttcagagacgacagcttcttggcttctcgagattcaatattctcaatctctggcctaagtttactaaattgattttgcgaaagagatgggaagagtttttccagatgcggagagagcagcatgacgttttgcttccgttgattcgtgctcggagaaagattgttgaagagagaaagaatagatcatcagaggaagaagaagacaacaaagagtatgtacaatcatacgttgatactctgcttgagctggagcttccagatgagaagaggaagctgaacgaggatgagattgtgagtttgtgttcggagtttctcaacggtgggactgatacaacggccaccgcgttgcaatggatcatggcgaacttggtgaaaaacccggatattcagaagaggttatacgaggagatcaaaagcgtagttggggaagaagcaaatgaagtggaggaagaagacgcgcaaaagatgccgtatctagaggcagtggtgatggagggtctccggagacatcctccgggacattttgtgctcccccacagtgtcactgaggacactgtgttaggaggatacaaagtgccgaagaatgggacaattaatttcatggtggcagagatagggagggatccaaaagtgtgggaggaaccaatggcgtttaagccagagaggtttatggaagaagcggtggacataaccggaagcagagggataaagatgatgccgttcggagcgggtagaaggatttgtccagggattgggctagcgatgctgcatctggagtactatgtggcgaatatggtgagggagtttgactggaaggaggtccaaggtcatgaagtggacttgacggagaagctcgagtttaccgtagtcatgaagcatccgcttaaggcccttgctgttcctaggagaagtcactagttgtctacttcttaaacttcagtttagtattcaccaaagactaggtgatgtatgaagaattgaagttatgggcattttgttagctgaagtcaactatggaactatcttttttattaaagtacattttgtaccttggaataaatgatagaaacaacaatccttttattttgtattaaaaggaatcttttatgacgagtgtttttacaagaaaggtacataggtctagaaaagtgtgggatttctagtgtttagtgactagatgatttagaaaagtgtgggattttgatggttgttgatacttttgttgggagaaatcgaaagagtaaaagcatttgtgatacaacataaaacaatcataaaaaaacaagattagagtttaagaagcacacatgtaaaatgacttgatatagagtgaaatcatgttcctctccttccatacctcatagatgactatgtgacatcatatcatatatcttgagtacctttgtaagttagaaatgagataaatttaacgaggacatcaacccaattgctgatgatcaactttggttcagtttcaattcgaaccaaagttaatttgctgatgaataattttactagttaatcttcttcaaatctaatgagatttattaaatgcgaaaatacgacatcttcacaagaaggaataataacttccccgtaggtcttactaaagaattcaaacaatttcattctccctctttaccgttccaaactaaattgaaatcaaatcctcaaaattgagactgacagtcagagatttccaaaacaaacaaaaaa

SEQ ID NO: 5457 - DNA, 3000 bp, Unknown
  misc_feature (1)..( 3000): cDNA_ID_1828630_gDNA_ID_1620790_Annot_ID_50478 3000 nt of promoter + ATG
ttggtgttcatagaaaagagggatgatagtgcaagattatttctcataagtactgtctcaagattacttctagatcttctgaaatttgttttgtaaatttttccacatttacttgcattagttaattaacctatatgtctgatttagatttttgttgttggtgttcataaaaagaatataaagttttgactctttttaaagcaaccatagaaacaagaacattccttacaaataaacataaaatcgttagtcgttccggaattttctcacgtcaaatgattctgacactcctattcacaaaaccgacaaaagctgtaacacaacagctcactctgtagctgtgtgcaatgcaagaagtggttcaagacagtacccagcagagagatcacaagctaagtcttttactcctaagaaggctacaataatttaagattatttacatgatgtttttatggaaaaaaaaaggcttatgagagctctcactcatacatcagtcatcatatgaaatgtgagggtttgtgacacaacctggtgcattaggatcctctgccccgcaacaatcatagaacttggcagcatacggtggatcatctggtttcaattcatagtaccttcatttattgattaaaaaaaacaagttctagttaattccacttcttagtaaaaagtagaaatcaaacagatgcatcatactcaagtcgattaaacatggtttggaataaatatatattcagtttcgaaacaccttaaaattaaaatgaaataacaaatatcaggtaccagcaagaatatgaatgccaaaaccaacaaccataaacaccaaaataaactcattcgttgcacataacgataaaagctcaacaaaagatagttaagtctatgctatgtgggtaactacaatgcatggaacagagagaatcacaaacagaggaagtaagtaaataaccaaaggagccaataacggaacagagacacctacgttccttcctagtccaaagtttattaccaagataaaacacgcaacatagaatcagatgataaatctctaaactgtatttttcaccactctttatttatgctattaaccgtcgactaaaccattttttcaactagcagaacaaagtgtaggccactagacagcttgaaaacttgtcgagataattttttatcctcagtggttaagagtattcgacgtttaagagtgaccacaatcattaaacagcttcatgattatgcctaaagagtttgaaatgggcaaggcaaatacaacagtagctaattatctgcaaagaaggctaagagctagtttcaaatcaaccaaaacatgacctttgacccacaaatagccattaaactgagatcatgatcatctatcacttcaaaattattggctacaaagaatctaaggtatctaactaaattagctatagatccagaaccttaatacaataaagtggatggctttcaaaacccatctcaacaatttgtgctttgccattataaattagcgaatcaagctgcttgggatgtgagattcttcattagtgaatagatttagggtttgtaggagacataaccttttctggtcatcgtgacgacgacaaacgaagaaggaaggatgaaaacggcaagaggaagtttcgtttgaaagatctgtgtagctttgtttgcacctttggcacaacttctccatctccttcttctccattctcgaagaacactgtaatcaatttcctaatttctacggcaagtcaaatggatccgattccggttcaccggaagtttggtattgcctttcgattccggtagattaaatcagtaatctacgttttagcaaagatgagctgtttttgctgtattgacttatgggccttaatgggcttattgggtttagtttttatttttatttttataacttggcctcatttttctgatagtgaaatgtaggattgaaaagcataaaaacattataaacaaaatagctcaaaacttttttttgttaaataattgtgatataataagaaaaacgttttgtagtttttttaattttgaattattttttccacatgcatcaaatataacatacacatgaaaatcaaatataaatgtatgataaatattgtgaatggtaaaaataatagaatcacgttatgaaaaatggtatattatacatcatcgattggtgtctgataagtttggaggaaactttagcaataatacaggttttctctatttattcattagctaataggattatttatacaaaaatcataacttgattagcaagttctttacatttatgataatattaaattttctatctaacaataagaaaatgtacacaaatattaattttttattaatgataaaaaaaatatttatcttgatcccgtaattataagatttatcatgaactatcgatatcccgatctttcccttcccacttcccgcaaatttatatatggtaacacgtgtaagattggacaagccttctaaacaacaattttaatgaatcgatcatttttcgtgtatatatgtaaaagtgaaagaaaaacaaaaaaatcaatcgaccagataagaaaacatgtcggaaaatggagttaaaattatcatcaacactagactagacgccaaaacctataaacaaaaaaaaaggatagaaacactattgttgtgcagtttctttcacattactccgtagctcaatggttggttagcgtttaataacgccttcctctctgcgagttcgagttgagtcgcatggtggtggtggtgatgatgaagttgatgaggttgttgttgattagagtttaaaccaaataaaccctaaccaaaaataaataaggtattcttaaatactttttttttaattgtttcataaatgatcaaattcgaatcgaatcgtacaacagaagctctggtgttgaatcgccatgaggtttttgcagatctgaggttttttctcgagaagtaagagagatctggaatttggcgacgatg

SEQ ID NO: 5458 - DNA, 3000 bp, Unknown; identical to SEQ ID NO: 5441
  misc_feature (1)..( 3000): cDNA_ID_1828626_gDNA_ID_1620790_Annot_ID_50479 3000 nt of promoter + ATG

SEQ ID NO: 5459 - DNA, 3000 bp, Unknown
  misc_feature (1)..( 3000): cDNA_ID_2160091_gDNA_ID_1620791_Annot_ID_168284 3000 nt of promoter + ATG
aacttacactctgttttcttttgagaatggttttttatatgagtgtgcactcaagcagggggagagtattctgatgtgtcgtactctgttccggatgatgtgggagatgaggatgtggaggaagaggacgatgatgatgagttagatgacaacacttaattgcttagtcctggtcattttttttttagttgggcattgtgttagggggagtttgtcactgattgtttttgtgtgtttgtgaaaactccctgatcttgttctttatcggcttcttatcggatcttctgtgtgtttaatgattagtcttatgtatagaaccaagaactcatttctgtttcatgtttaaatggttatgtcttttggcagtagttgcttaaacttgagcctttggtttctatgtttggtatggaatattgcttggcttgtattgtggtctctactcttttgcagattacttgaggtgtcacactcaaataaaaagggggagattgaagaaacagagtgtctgaagttctacaggcgtgtctgaaacaacacagagcagaacagaggaacagaggaagcgggaaagtagcagttgcttttgccagcgtggcatgttgattggagtgaaggaaaggcgtatcgctttagacaaaggagacgaagtcgtcagacataggacgtgtgcctagtgtcaagataatgatgaggagctacacttgaacctgatggataaagtagagcatcctgccttttccgagaaactacataagagaagttttggtctcttattagggttagccactttacttgagaaaagtggaagagaagaaaagttaaatagaacttgttcttgtggtttcattggtgagtgaacaaagagagcacacggctgttgctgtgtttgtgagctgggtagttttaggttttgacaagagcaaatcaggttgttgatgttgcataacactgtccaaacttatctgtgattgatcagtttgaaagttgttctaataaagtgtgtttattggagttgtgatctttatcttgtcaaagtacttaggattcttttacttcatatgttagatataatattttgcttaattgaatatattttacaatgttcataagctataagatcattatatgatgcatacgttttatccaaccatatcttcacgtaaccaacttcttctcaattaccttaactgttcacatgtttatatatctaagcccatatttttaggtgttatacatatatatatttatttactttttgaggattctggaaaattgaaagatatgatacaacagttatacgatatatatattgaatttaaaactttaataattataattttaataatttgaatagacactgtaaatatagttttagtcggacaaaccttactcaacattcaatactaatcatataccaaaacataattgttttatctaatttagagaaaagaaacatgaagctatttattatcattgtggtgaccagtttaaccatctcaaaggtatttgacaaaacacttgtcaccattgaagcaagaaatttgaggaagatggaccgtcatgagcatttcaatgctaatgaagatttcgtggaagcaaaaatgttaaagaaaattgacaataaaaataatctaaataatagatgtataaatgattttgcgcctactaatccaggacataattctggtattgggcatccaaaagttataaacaacaaatttacaaaagattttgcgcctactaatccaggacatagtcctggtattgggcatctaagagttgtaaacaacaaatttacaaatgattttgcgcctactaatccaggaaatagtcccggtattaggcatccatgagttatgaatgtttaaggattgtaaatcttattatataaatcttaaagaaataaaataaaactaacaaaaaaacaaatttatatgtctatatctcaaatgtttttaacttttttttctgaactaaaagaaaaattaacaaatttgtttttatatgtgttattggtcaaataaattaggatgtatttatatttatttgaagaaaaaattagcatgtattaatttttttaaagtcatttaatttatgtgtacaaaatattattttacggttttggtgggaaaacgttggcttacagttgttgcgggaaaacgtgatttttaattttggcggaaaatactttttgtgtgattttggcaagaaaacactttttgtgattttagcgggaaaacgtggttttacggttttgtcgagaaaatgttggtttacggttgtggcggaaaaacgtaattttaatatttaaaccaaaaactgaagttaaatagaataatttagttttactaaggatgactaatagaaaaagaaaaataaatagacttaattggataccaatttatttatgtgaaaccttatttaataaatgagtttagttggcttaatccatttaatctcatttaacttgtttttcctaaattaatttaaatgggtcaaaaactcttactcataaccattaattaaataggatttgcatacccaaattaacatcactagtcctagacaaaaaccaaaatagaaaacaatatttttatccatttttacttttgctcatcgaccaaatttgggcctagtttgctacaagctaacaattgaaaagcctcttaagacacatgaaatagtaacgacgtcgtttactcatgaagcgaaagacggcaaacacgaacgggtttacgtagaccgtcaaacgctcctccgtccgacggagaaaaaacgagacggtgaagaagaagaagaagaagaagaagaagaacgactcaaagatctcatcgatcactctctccaagatctattcacgcatcgtcggaagaattttcgcttccgacgacgtttctctcgtctgattttgtctccgaacatcctacctaatcgtattcggtgctggatttgaatccggtgaactgaatctgacaatttcgttcccggaggtgtttaaaa

SEQ ID NO: 5460 - DNA, 3000 bp, Unknown
  misc_feature (1)..( 3000): cDNA_ID_4255222_gDNA_ID_1620791_Annot_ID_168310 3000 nt of promoter + ATG
aaattgatattgtttatttttgtgatactatgtaagtgctgcaatcaaccatttttcttgtattgtatgaaaatgatttgcctaaaatcatatatcagctaatcaaagagatagatgcatatgtgctaattaattaaacaatacatatgaaattatacctcttatataaaaccatcgacaaagagttgtgatgaatgatgatttctgtatattaatgatttttggtgaaacatataaatgattttataaatatgaatggtttgcaatacaatatgcttttatgaattatagtcgtgataaataaagtaaaagcatatctgagacactaacatatacgatatagtctagaatgtggtaaaagtttttattatccttagcttaacatggccatgcatattattgtgagatgaccacctcatgcgtatgaggtagatagatgaagaattggtaaaaatctatgaattgattttacatgactaacttgaacttgggtgcaacactaatctagatcttggtccaatatacgttctactaaatgagaaacaaaacattaaaacatttgaaacacataatttacaagcaagaggaaaataaaatgttggtaacctaaaccacccaaccttgtgtcaacgactcaacgtacacaaatacaattcctcttggctttaatctattatattacacattcctaagacaataataaatattttctttaaaacggaaacagaccgaccaaataaacgaaataataaatctcatacaatgcgatccatttgctatggcctcttgtgacgtatttgaagttcatttaacacagacggtagaaatttattgtcttcttcatggcttacctaatactattttaaaatagatatctttcattgcttaacaaatttataccattcttcttttattcggcacaaatctatgttttgctatcatttgctttgttcggatacaaatgtaaaagagatagttatgtagtaaactaaatgtagtaaacttttaaataagaaaattatgaaataaactcaaatcagcattttcttgatactttctaatagtcttaaatatacacaagaacaaaacataagtatataaccataaattgaagttagctaaagagaacataaatctaaagatggtaaaggaataatatttcttgatttggcctgcgaatatattgagaaaaaagtttccaacaagttaaatgtatcttatataaagcattaagaatggtatatattaatttaaatataacctagaaaaactatgcaaaagatttgtttgggtttgaagattatccacttaaatttggcaattaaattcaagaaactattggtaaattatatatgccaaaaactaaactggcaaaaaatattgaaatctccggagataaccgaaaaacctaagttttatcgattaaatctaatcatattctctagattttctctgaaattaaaaattattctgatgtctataaaaaatcacaaattccatataaaatttcctgtaatcatatatttttggtttggttaaaatttttttttttccaaaacttgaaataaaactttgtataataatactatgcaatagatttgttcgggttagaagattatccatctaaatttagcaactaaattcaaaaaacaattgataacataatatatctctgtaaactatatatgccaacataaaaaatatttttttctgcaaaataaactggcaaaaattattgaaatcttcgaaaatgaccgaaaaaccgaagttttatcgattaaatcttgtcatattctctagatcttctctctgaaataaaaattgttttgatgtctataaaaaatcacaaattccatataaaatttctacagtattcaattttttttttgttttggtaaataaaaaaacttggttctaaaactggaaataaaacttgaaataaaactttgtataatactacaatgagaagcattgggaaataatatagcggaaaaaacaagagtggggggatgaaatgaggtagctgaggaacaagtacggcgcctcctaacaaaaagggatcgaaaaaaaacaatggaggtgtggagtgtggcggaggcagagaccacgtgctctctcttctcttcttctccttcatcttcttcctctcttcatcatctcccattattaactcttctgaccccactttccttctcctcttctaactccaacctaccctcttctctcttccctctcttaaaaccctttctctctccctcattctcttccatgtcctcctctctgttattctttagctaaacacccacaattctggccttctctgatgcctctttaagccaatttgtatctctgcttccttacaaggtttaaagttttctgcttttgctgattttgttatttgggtgttttaaagttttgatttttatggtttagcaatcggaatttggacttgtttttgtgattttttacttgttgttggagttgggttttgttgagtttttgttatttgggtgttttaaagttttgatttttatggtttagcaatgagaattttgcacttgtttttgtgattttaacttgttgttgaagttgggttttgttgagttttcgacttcaatattgtagaattttagtgggtttggggagtttataatcattagttctgagatctctcagatttctaaaggaactcattattattgggtaatgatgctttcttacttgcaagatctttgcttatgattgcgttttgctttttctatactctttttttcttcatgtgattacgcaaaagcattgctgtcatctttgttaattccaccttgtaatctgaagcatctttgtttgttagattaagcaaccagattaggaattgttttaatattcctgttatgttctttcaagtcattttggtagatagcatcagtttctttgtaaagtgattcagtatgtgtttatggctgttttgtagatatatctgaagcttaaagggcagtgaca

SEQ ID NO: 5461 - DNA, 3000 bp, Unknown
  misc_feature (1)..( 3000): cDNA_ID_3077079_gDNA_ID_1620791_Annot_ID_168307 3000 nt of promoter + ATG
ttatatgtttacaaaacaacttcttctttttttagataagtaaggatttatagcaacggaaaaaaattaaaataagatttttttttgaagaaaattatttacagatctttgactagtttccaacatttgattgagatagtttaattccaataaaaaattgaagaaaattatttacagatttttgactagtttccgaacatttgattgagatagtttaattccaattaaaaaaatttagaagttgacttacaatgaaagaacccaaagaagtgaatttttatggatcaatatcaaaccaattaaccagattggctcgaccaaaataaaggacactgagagggtgtattggaccttacattttgaatgaattgaattttagtgacttttagctcaataagaccatttataacacaagtttttagctcaatcaaatagaaacagaaacaacaaacttaattcgtcattgctcataaaaaccataataaccatcacaaattatttttccacaatccataatccaaaataaaagaagatgattcaacttattaaatacttaaaaaaaaacagaaaaaacccctaagctaagatgtaaagaaaagaagaaaccatcacaacagctatgaatagtttggatactaataaaatcccgctactagatattgatggtgacggtgacggtgacggggaagctgccctaggtgatgaagcggtcgatgatgagacagcctttaccggtgatgaagcagccaccaccggtgatgagtggctaacagccggtgatgagcggctagttggtggtgatgagtgactaactggcggtgatgagtgactaaccggcggggatgagtgcctgacgggcggtggtgagtggctaaccgccggtgatgaaggggttatggccggtgactttgcggaagatggtgaagtcgtaggtgactctaccggtggagaaactgcatggacatggttaattaataaaatactaaaatatatggccttgaatgttttctatattttataagagtttttggtttttgtttttcaaaattttcgttcatgattttagttttctaattctcctaaaattttctcaatcaacattatttttctcaaaaatcaaaaaccaattttttgaattttttaaacaaaaatctaaaactaaaatctaaatcgaaaaactgaatcgaaaatcagcatccattcaggggctatattacatttcacgagaattaattttattaaaaacataaaaatatattataaattcataacattattattcatatgatagatttgaatcttacctggtgttgatgcagccggagtagatacatcttcaaattaaataacaaaacaatgaattaatattaatccacattaaataaacgaataaataataatgtgaccaaaagagaaaaatatataccacaattaggatcaatagggacgttgcaaattttaggcatggcaagagcttttgtatcatcaagtacgaatcccatttcacgactactctctaacgcagagcaaagacacttagggctatagttaagaacggttttgaccccaacacaacatgttttggtcgggcttggatccgttgatccgacggttaagaaggagagacaatcaaccatgctgtatatgacgctggaacagtcggtggagtttgatggttgcggtgttggagccatcgacggtggctgtgacggtgatccaaagtcggctgcatccgatagtgatgatgagagtaatagtacaatagatagaagaacaaaggatggcttcattttgtttttggtttggttagtggttctcttgtttttctattaggttttctttaggagcttgtaacgtcgtgggaaggtttatatatgaaatgtgaagtgtgttctctcaagatgattttttttttttgagagttttcggtagatttataaagatttggttttatccattcgttacattgttatatcttctagtttaaacctttgaaattctgttgcttcaaaaaaaaaaaaaaactcgttagctaattttcgggattcgagtgtatttcaataaaataattaataaattaagataaataacaataatctctgcagtaagttttagtaaataattactcttagtctttactttagaacatgtgaggataaaaaattgatttttcatgtctcctttgtaatttagatatttaaatcttaacggttaactactagattaattttagtttagaacgtttattaataagaatttttgagtataaatataattatttgaattttaaaagatttttgtttatttaagtgcatctatattattatttaagaagtacgtttaatgagatacgcatgaagttggaagaaataacaaatttgtcattgggttaaaaattttatttcatgaaaaatccgtttcaaaacacttggatcctttctatccggttttaaaaagtcgggttcttacgtctaatcctggccattgaattgaattgttattaactgttcaaatttgtagtttcaccctaaaaacacgcggatcctttttatcctgttttaagaagtcggattctccggtctaatcctggccattgaattgatttattattaccgttctattttatcgttccacataatatttcaggcaacgaatcgcattaattttattttattcattgcatatattcgtttatagctttcgaatatatcacttatccataattatagctaatcaaatatatagtttggatcttcatttggaattatcataaattttaaatactatttcttaatttaaataactacttttacggtaaaagctaaacatttttttatacttatgggattcatcatattcactaaacttgaattccacgaataaaatcttgtgctcatattttttgacctaaaaaattattcttataaatccggacgtctcatttaaatctaatcactcaacttaaccttatacattcatttctaaatttctacaaaaatg

SEQ ID NO: 5462 - DNA, 3000 bp, Unknown
  misc_feature (1)..( 3000): cDNA_ID_3077109_gDNA_ID_1620791_Annot_ID_168287 3000 nt of promoter + ATG
tattgatgtttcaaatcttcattcactcatttcagactagcaaagtcgtgtaaaaatcttgagaatctcgaagtaagagggagtttaggataaagcaataaagttataattagttgatgataatgtactataattagctagcataaatcttattcatcatatttaatttctaaatctatatttagcgagttctgtatttatttgttatatattcaagaatattaatggagaaggttgttctcaagttatctttgatctataaattccagaagttacaagattctgcaaaaagtaagtttattctaacaagaacattatcagtttaccttccaaaataacaatactcacagctactggattggttattatcaagcattagtcaataaattataagagagacgagagaaagagattaccatttcttgcatgtgctgattatattagagttataaaatcaaccgatcagagatcctgaaattgaacaagaccacgcgagtgagaacatgaggacgaaacatattataaagaaaattccaactagagattcttataacataatatttaaacgaagtggttgaaaaattagaaaccaaagattgaactaagcagatctcttacaactaaagtcaagtagtctaggaaagcttttccctgtcgttgcaacgacctctcctccctagattggatgctcttctccttcaattaaagtgttttacctcgaggtcatccgaaatcttctcctaattggttggcatgttttgatctacttactgtggtatgcggtcatcgcgtaataatcgtgtgcaccaaattacttttaaatttgtcaatgctttgatttgggaggctgaactaactgtccgaaattgaataacaagccctttcgccaatcaaattcccatcgagcttctgtaatgcctcagtttgatctccttcaacctccattatcgacttttcttctctgtttcatcgattcttcatctcagcttcatgaaatccgtacatgattactctccttgggccatatcttttcttctacctactgttggggttttttgattcaaaattggttctcctttgaagtgtgttgggctacttagctattggcctatgcaacattttaattctcatgtttttagtagaatgtcgtttatcccaaaaaacatagcagactaaaatattttacatttcatattagaattgctatgttataatgtttttaaaattggaattgtttttaataacattttttaaaacaggttgttttaggatgttttaaatatatattgtaattgtttaacataaatatttatttttaaacataatataaatatttattatatccagccagattaattatttcgaataatataattaatttgtttcatgaaaaacaacgtttttattttaatcaaactattatgtgattgtgtgaaccatttaacttaaattatatgtcttttaaataaaaaaattatttaaaaaaaaagaaacaaatgatctttaattctataagacgagattatatggcatgacgggttttggtaaatattaataagagatggtatactactggttgttttggtataattaacaatcaaaatacaattatacaatcttacaaaagaaaacaaacaattaaacaattatacgagacaaagttatatggtaagacgggttttagtcgatattaatacaatacggtatacaacagatgaaatactagaattaacaattaaaatacaattatataatcttgaaaaaagaaaacaaattatattaacaaaataaatacaacttttaaatttagttataaagaaattaacctgcggtgtaccgcgggtcatatcctagtattagaacgttttagtagtcctatgatataagcacctaacagagcatgaaaaaggacttattacataatttagaaaagctataaaggggctctaacaaagcattttgttaatgctatggtgtaatgctctatcatagcatgccgaaaaaacgctatcgtatatgggaagtctaccataacaggggcataacacaacgtttatgaaaacgttattgatgacatataatagctcttctctcatgctaataatgttgatattttttgtagtgttattaagtataatcgcactttagcacgccgttactagaggaaagacacacttgatcctatcaagctacaagatattgacgattgtaatgagtggttggtaggatgaatggatggggaatcttctggtgagttaacagaactggtttttgatgatagtgatttgacatgggaaatggtaagccaagtatctgaaaagctaatgagtctaactattgtactaaaggcaaaagaggactagcatcgtcttcaagtagaactgaaaagggaagaatacagcctcatgctccattccaactccaagaacatcttagagcacgtcttcaactccaatggctttgattgatgaggatgatcaaattgaagaggatttcgaaaaagaagataaggataatgaattgtgtgtggaagatgatgaggaagagttttagagtttcagactcaaagttttatctttgtcggattggattctgtttgttttcatttttatgtttcagagtttcaggctcacggtttagcttttgttggatttgattttcttttttcacacttatggtttaagtttttcttgaattttctttttcagacttttggtttaagttattgtttggattttctttgttatctcttttttagactcacaaattgttctaaaatggctttatgtatcaatgaatacaactaagctattgttttttaagttgcacctcatacggcaaaggctctaaggctcatgcgcctagactcgaggctcaaacaagcacctcaacgccttacctcaccttgtgctatttaaaacacagtttaagcctaccttgaaatagtcaaagttgttcatcagggacaatcgagtgagagtgatatattacaatacaatg

SEQ ID NO: 5463 - DNA, 3000 bp, Unknown
  misc_feature (1)..( 3000): cDNA_ID_3077095_gDNA_ID_1620791_Annot_ID_168296 3000 nt of promoter + ATG
taacttagacatttttttgtatgtgcaggttggaataattattatagaactatcattttttaatgcttcctttattgtatgtagtttattaatatttctttttagttttttgtttataattatgagtttgaacaaatttatgtttgtcttattaatttgtcaaattttataattaattttacaagttactaaagtacacgaaaaaccacacatactatgtgtacaagtacatatactaaatatataattacgtacacaaaagtacatatcagttctataataaattcattagtatacatgtttaaatgataccaatactaaattcataaacttttaaaattagaatacatataaatatttaaagacaaacaaaatacaagttgaagagactatatatcctaaatatacaattatgtacacaaagggacacatcaattatataataaattcaataatatacatatttaaatgataccaataatatattgataaactttttaaataatagaagcaaatatttacagacaaactaaatatattaaattcgtaatatatacataattgagatttgatgagtgattaaagcatggataccgtgcgtagcacaggtactgacctagttatatgtttaaaatagtaaaacatatatcacctttcattataattttctctcgtcatcttcaatgattcacttgtcgtctcctttgattcactcgtagtctcccgacatctactctctttcacctaatattggttcacatataatatattcgactatgaattagttttcgagatatatcgtatctacttttgctttcctatctttcaatacttgaataggttgtatgattttttatattaaagtgaacacaaaaaaaaaaaatctagaaaaatgtttgtcaccatgtttctttgatcatctaacatttttctataaataacaaatctcatatatggacttacttctattcaccaacatcggatttcaacgtcaatttttacactttatctggaccgttcaaatacaaaattattcatgacgatttgcagtgacacgaagaagatgatacataaaacattttcagaaacgacgaagacgatagatttgcatttaatcgatgctactgaaaaagaaattatcaatggagaatagtgatcggacgaagaagacgatggattttatttccgcatggaggagatgatgagccatttgccgacaacaatttctgattcattattttttgaatctacaattaaaaaaaaattgtaatgaaacaaatatttctttcaaggcctgcctaaagcctaactcattattttgtgacactcataatttaaaaaaataaacgttgcattattgggcctaactcattattcggtgaccctcattaaaaatatacaaattgcattattggcccaaacacactttgcccatttagtaaacaacagtttaaattaacttcaataaaaatttgtaagtataatatatctatcaacatgttgaacactatatataaaatacaaaattcagttagattttactgattttgttttggaatttataaaattatgaccggcgaattaaatataaacctcttgtgacattacaaaattaaataaattcattcacacactaattcatatacattccaaaaaaataaaattacatttccacaaatacaattcatcattctttcagaaaatttcatgaaatgaaacgtaaatccctttattattaaaagggaagtacaaattaaaaaaatggtcaaatttcgcctcaatttcaatttcaattttggattttgttcattgttaatcataattgtcaagggtaatttagtaataaatttttattaaatattataggatccgcgtgttaatgactcggatgggttaggagtaattactcttaatcatggattcaagttcctaatcgggtttagcatccatattatgcaatcttaaccttttaacaatttttgtatatttacctcatttttggtatctaaatatgagcatattcgatccctaaaactgcacattcgatcatatactgcctaatcgctcgaagattgaataatttattctcttaaatctaatactaaccataaccaactcttcaatattcaccatttatctaaatatagtcaatcattcaattatattccaaattcgaatatatattgttcatggtatctttggatttactaatctacatatacatttttgcagccactttgtgaaataaatcctcaagttgagacttatttacagtggctgccactgacatttaataattatttttgataattagaaagtaaatctttaaattaaatatttgacatttaactatcttcccaaagactctctacattaactacacgattagttactaaaataaaacttccaaaatatttaacattatttaaaaattacaaaattatcatttttgatattgcttttttgcatgactataacaattcgattatacgcatcaatccacagagatatttgatagcagttaattattacaaaattacaaaatatttagacaatgattcataaacatatcataaataagttcaacattaataaaataaataggtttttttacgggacggattggcgggacgggtttggcaggatgttacttaataacaattgtaaactataaaataaattttttttatagatagatacaatttgtaaacttttatatatactaacttaaaaaaatatttattgtccccgcggtataccgcgggttaaaaatctagttaatacacatatttaaacacattaaaatacattcttctaatcactaaataacaactaaccaatacaaaatcccaatcattatttataaaggattaaataaaaaatattttttgtaaattatgaatataaaacataatcaaatacttaataaaaaaatcatataaaaccgaggcctgcggtgaaccgctggttgaatcctagtttaattacaaagtaaacatg

SEQ ID NO: 5464 - DNA, 3000 bp, Unknown
  misc_feature (1)..( 3000): cDNA_ID_2160140_gDNA_ID_1620791_Annot_ID_168299 3000 nt of promoter + ATG
tgaatgattgactatatttagataaatggtgaatattgaagagttggttatggttagtattagatttaagagaataaattattcaatcttcgagcgattaggcagtatatgatcgaatgtgcagttttagggatcgaatatgctcatatttagataccaaaaatgaggtaaatatacaaaaattgttaaaaggttaagattgcataatatggatgctaaacccgattaggaacttgaatccatgattaagagtaattactcctaacccatccgagtcattaacacgcggatcctataatatttaataaaaatttattactaaattacccttgacaattatgattaacaatgaacaaaatccaaaattgaaattgaaattgaggcgaaatttgaccatttttttaatttgtacttcccttttaataataaagggatttacgtttcatttcatgaaattttctgaaagaatgatgaattgtatttgtggaaatgtaattttatttttttggaatgtatatgaattagtgtgtgaatgaatttatttaattttgtaatgtcacaagaggtttatatttaattcgccggtcataattttataaattccaaaacaaaatcagtaaaatctaactgaattttgtattttatatatagtgttcaacatgttgatagatatattatacttacaaatttttattgaagttaatttaaactgttgtttactaaatgggcaaagtgtgtttgggccaataatgcaatttgtatatttttaatgagggtcaccgaataatgagttaggcccaataatgcaacgtttatttttttaaattatgagtgtcacaaaataatgagttaggctttaggcaggccttgaaagaaatatttgtttcattacaatttttttttaattgtagattcaaaaaataatgaatcagaaattgttgtcggcaaatggctcatcatctcctccatgcggaaataaaatccatcgtcttcttcgtccgatcactattctccattgataatttctttttcagtagcatcgattaaatgcaaatctatcgtcttcgtcgtttctgaaaatgttttatgtatcatcttcttcgtgtcactgcaaatcgtcatgaataattttgtatttgaacggtccagataaagtgtaaaaattgacgttgaaatccgatgttggtgaatagaagtaagtccatatatgagatttgttatttatagaaaaatgttagatgatcaaagaaacatggtgacaaacatttttctagattttttttttttgtgttcactttaatataaaaaatcatacaacctattcaagtattgaaagataggaaagcaaaagtagatacgatatatctcgaaaactaattcatagtcgaatatattatatgtgaaccaatattaggtgaaagagagtagatgtcgggagactacgagtgaatcaaaggagacgacaagtgaatcattgaagatgacgagagaaaattataatgaaaggtgatatatgttttactattttaaacatataactaggtcagtacctgtgctacgcacggtatccatgctttaatcactcatcaaatctcaattatgtatatattacgaatttaatatatttagtttgtctgtaaatatttgcttctattatttaaaaagtttatcaatatattattggtatcatttaaatatgtatattattgaatttattatataattgatgtgtccctttgtgtacataattgtatatttaggatatatagtctcttcaacttgtattttgtttgtctttaaatatttatatgtattctaattttaaaagtttatgaatttagtattggtatcatttaaacatgtatactaatgaatttattatagaactgatatgtacttttgtgtacgtaattatatatttagtatatgtacttgtacacatagtatgtgtggtttttcgtgtactttagtaacttgtaaaattaattataaaatttgacaaattaataagacaaacataaatttgttcaaactcataattataaacaaaaaactaaaaagaaatattaataaactacatacaataaaggaagcattaaaaaatgatagttctataataattattccaacctgcacatacaaaaaaatgtctaagttagtatttcataaaattgtatagaataattactatgttaaagtaatcataataaataatttatacatgtaggattaatctactaaaggttttggaatatttatttgaaaacaacatttgtgtttcttttttctgttttcctttactgcctataataagaaccttcaaccctccttttgatttcactctagacataacgacatataactgtctatttgagaaaataggcttcggaaaatatatatcaatattggctaatgattggccttggcttttattgatcgtcatagcaaatgcaacagataaaggaaactgcctccatcgcattttaaagggttgactatgctacattacccaaactataccgattcttcagtatacaccataaactttttgcttcttttttatacatcataaacaattatttgcctctattaaacatcacaattatatcacaattatagattctcttttaatagcaatatagtgattctaaattgtgatttgatttagtaaaccgatatttgcgtttagaaaactatgattagaataagtaaacccaaaaccactttttttttttcttgcatgaataaaaagggagaaaaaaaataaaacccacgtttaaaacccatcttcttcttctacgtatctaaaatcacaaacttagggtttctctcttcctctcaatttctctggtatggtcttttctctctctttggtttcatagtttctttctatctttggtttcatatagcttctctctcactggttttgtaggttcataattttttttaagtttcgtaatcaacgaaaaagacatggatgacatataacccgacattgac

SEQ ID NO: 5465 - DNA, 3000 bp, Unknown
  misc_feature (1)..( 3000): cDNA_ID_3077087_gDNA_ID_1620791_Annot_ID_168303 3000 nt of promoter + ATG
agtgggaggcaacccactggtttgatttttcttttccctttcttttattttcttttatttttgctttatttttcccgctttctctggatttgaatgccactggggacagtgtcgtttaagtctgggggagatttttactaatgatgcttttatttttgtttcttattttgcagttcatttggttatttctttcctttctttaagaaaaaaaaaaaaaaaaacgttttctttagtttagttaggaatcatgatctatatttctcatgtttattgcctgattgatgagtgctgcaggttcgattcaatccaactattggaaaatctagatggcaaaccaacatacttgaggatatcctagtttccaactcaaccactaaggctggagctaatctcactgctcttccttttacctcttcaaacggttagtattcatagatcttgacttcttgttcatacctgatattgagaccagtgtgataaaaagaatatgttcctctccccttataagaaaatagtaataatgagagattgagacaactttgagatagtgtataggggtaggaatgttttctatgaccccattattatacattatttggaatgatcaattacaaaggttggaaaatgccgagggtgttgatccagtatgcgagttcccctttgcttactctctaaaaagaataagtctgggggagagaaagaacaccgaaaaagaaaaaaaaaatataaagaatggtcaatttatcatggtatagtacatgaatgagtctagaaggatcttgaatgttggcttgtttgatgagacccgacgatgaaagcctggtgggtatagttgtggaacttaggtatggaatctagaatattgtgtaagcttgtagagaagtacatgttgggagttcctttgttttcaaaacctcttccacggattcggcttttctgttttgcttgagggtaagcaaaagctaagtctgggggagttgatataacccgattttcaccgattttatctatgttttaggtataggattttgagtttttatgttatttctcgagtctttttagtgtcttttcaggtattctatgcagtgggacaacaatggagataaggagacattttggagcaaaagctaaggaaaatgaagctaaggacgattttggtccaggaatcagcgaggagtgtcgatcgacacactcatggtgtcgatcgacaccagtttcggtccagcaaaaaccctagacgctatcgagtttacagaaggtcaagtttgccccaggagacttccctatttgcattattagtcactggacgtttttagggtctatacatattgtttttagacttaagtttcttttatcaagttcttttcaaaccctattgtgagagacataagctattcatccattgttcttgagagattcattccaatttttaatacaatgaagagatcccttatttccccttctctatttactgtgtttatgctttcacacttaatcatgttgtttgcttcatccaatatgtctgagaagtctgcttgttaggaatagagtttctcattagggattcatatggtttagtagattgccctttgctaggtgtaacgcccgtgaaccggaaaatcggttagagtttgtttttaaatcatccggttaaattggttgggttaattggaaaccctagagtgtgcctataaaagaaggaaaactcgaacttagggatttagttagccacttttcgttttataaaggagaaaaagatagagaaagagaaggagcagaatcgttatggtttggaagaattcagtttcgtcatatcaaatcgtggtaaaaagtaacgaaatttggtagagttattcccaagtcgtttatcgttattctccagtttacagaactggatttggataaatattggttgagttatttgctgtttagtgagacacgttttctcagacgcgaattaggaccagcatggattgaaactgggatcgtggtctcgtctgttttccgatcggaacgatattttgtgggaagcttcgtgacgtctaaggctagcgtttcaacacagggatttaatagttaacggttagtttatattttagggtttcgtctttgagactgtttgtttctgtctttcatgtccagtttgtttcaaaagttgtttttggttgtgacttgttgtaggacgtttctggactgtttcagacgcaaggagagtctctcctagatttaattattgttagaatcaatttgttaaggtgagtgcgtgaccatggccttatctgagcgattgggttgtgtgatttgttttgtgtgatgatatgtaggtgtggtgaatgtgttttggtgaattgttcagtgactggtttgtttgtgtggtatttgtgattatgccgcttttatttgcttgtgtgtatatctcgtagatgggaggatcgcctcactaagtatttgtgataatacttacgcatctctttctttttgatgcaggtaaagataaagtgtgatcgtggaatcatggcaagaaagagaggatgatctagaaactcatttgatttatttttgtgttttggttattggaacccggttaggattgttagttattcttggttttgttggtcgaattatttatttattcataaaatagtatttttgacttgcggttcaattgttggtttattggttgtttaattagatatttatgggaatatttaattatgtttaaaaaaaatgggtcgggttgtttcaatttggtatcagagcgatcacggttttaggatgtgtagaataattaattgatgaattattttttctgatgattgatgtgggatgagttagggcgttagcataatgaggattgattatggagtgtttagtcaattgtgtttgttggagtcctagcatcatcttctctgagccttaaatgagattccacggtaagttgtttgtgatatatttgtttgttttagtttcttagccatttgttcttgagtagcgcagatg

SEQ ID NO: 5466 - DNA, 3000 bp, Unknown
  misc_feature (1)..( 3000): cDNA_ID_2160125_gDNA_ID_1620791_Annot_ID_168295 3000 nt of promoter + ATG
ttgatccagtcaagaaatatgcacagcctgtgccacttaaacatggtagttggaggtgtaactattgtcataaagtcacaaatggtggagttaaaggtgcaaaacagcatattcttggaggttttaggaatgttactcaatgttctctagttcctcctattatgagggaagaaataaaagattccatgcttaagaaaactgaaattaaagccactactcaaatgatgccacccccagccacttcatatgacgattatggtgaagaagaagaagcagctgaagttttgggaaatgaaagaagacagccacctgtgaagaaacaaaaaggtctaatggacatgtttgtttgtccaactcttcctaatgtattgaaaggtagaaaagacaatagaataaataattgtggagtgtgtgataagaaacttaggcatatagcatgtagtgctattgcgaggtggttctttgatgcaaaactttcctttaatgcaattaactatgatagttttaaggaggctttaagccaccaatcatttatgaactaagagtacctttattgaagaaagaagtcattgaaacagagaaaaagttggtggagcacaagtcagaatgggcaattaaaggttgtttaataatgtctaatagatggcgagattctattgtacaaaagacattgtcaactttcttgttaactcgccaaagggatcaattttcatcaaatcaattgatatttcaacagttctgaaagatgctaacatgttgtacgatcacctggatcttatggtggatgaagttggggaagctaatgttgtcaaagtggtaatcgacaacgcatcaaactatgtgaaagctagtgtgtttaaaatcttttaaatttagctttatgagtttggttttttcatagctgcttctaactcgttttgtgtttcatttatgttctaggccaactatcaatggcaaaccgacctcatttgtattggacgccttgtgctgctcattgcatatacctcatgcttgaggatataggaaagatttcggaagtgaagactgttatcacacaatgcatcttcaagaatgattatatctatggtcacacttcccttgtgaatatgatgagaaaaattcacaagcgatggaaatctgcaaagatcggctgtaacacggtttgctacgtctttcacacaattgggcagtatcataagcagagaaaaaacttgaggaattctgcgacttctcaagaatgggcagattccaaatggcaaaaggaaataggagcaaggactgtgaagaggatcattatgcaagacagtttctggcacaaggatggttgacggagagaagaaaccagctacgagatacatctatgaagcaatggataaggctaaagtggccattgttaaaaccttcaatggtaaaaaagacaaatacaaagattcatttgaaattatcgataagcactgagattgtcaactccatcagcctttgcctgatggctacttcttgaatccgaaatttcagtataatccagagtctggagtgcattgtgaagaggttgggagaggtctatctacacatttgataggttggttcttgctgttgcaactcaagataggttaagcgacgaactagaatagtttaagagtgcttatggactctttgggattccaatggtaataagtcaaaagaaaaaagcaatcaccagctacgtggtggtctgcgtatggaggcacaacaccaacacttagagactttgcaatattcttcgtctcacgtgtagtgcgactggttttgagagaaattggagtgtgttttcacatctccataccaaggaaaggaatccaattggctcaagaactgcttaatgacattgtgtttacgctacaacaaatatccacattgatagcacaccaccaaagctcattttccgtaaatgttatgaaaaatgaaattttattttagatattgtataatagcattgaaacaacgctaagatataatttcactaaggggaaaactaaatcacttattccgccactacttagcccaaaatatttagttaagtgccaatacttgtgaaaaaaacacaataactttgagcgaagaaaaaaaagctctcgaggagcaactatcttcttctccatctatcaatgatgtctctaatctgctcctccaccgcctccgccgctatggctggaccatctccccaaacctcctccttcccctcagccacctcctccctccacctctaattttttcgaccaagctcacccaaaccctaaattacctgaacttttatcacttatgccacttttttgaaaaaactgatctggactgccatcagttaatctgaatgccaccgaaaatgtgatataccagttgtacccttaatgagttaattaaaaaaatgaaaaagaaattcaaaagctaaataaagaatcgagatcctccgttctctctcctcttcgtcgtcgtgttcttcttctttggtcgacgttcatcttcttcgtcggccaccatcgattccggccgccgccgacttgaaatccggcgtaaaagccaacgaattaggtcagtttcttctcatatttcctttgacattggtgtattgtgattttagattgggattttgaattctatataattcccagattcaatttgatagtttgatgattggtttgcaaagtaaagagtaatcgattagaggttgccgaaacgttatttgaggtgatgagcaaaggaatgtaggttgaatgtgagttgaatttgaatttcgagatttcatattaaagatttggggggtttgtgtttgcaaagtttagattaaccaattagtttaacgaataggtatgtattaacattggaaatcaattgaaaggtaacgaattaggttcagtagaatcgagtgcgacgagagattgatttcaacgtatgataagagtacatgtggtataactattaaaatgtttgattggagttgacctggttgtattttcaggagcgatg

SEQ ID NO: 5467 - DNA, 3000 bp, Unknown
  misc_feature (1)..( 3000): cDNA_ID_3077184_gDNA_ID_1620792_Annot_ID_168315 3000 nt of promoter + ATG
cctattggtcactcaactcttcttatttgaccaacgccaaaaaggaaaatgtttttcacaaaaacatctttattctaacaaaaattacttttgtggttatcattactaagtatttttggtcgaacgaaacttgtaatcatatagaaactcaaaccagcttcatcctggtataattcttgaagttcactgtcgttgcaagaacccaaccggtgatgtgggagttcaacaactaagaaattgtcatggaattcaacgataatttcatcaattaccaaaggagataatggaatgtctattctcatatatacctaaatataaactagaatattattatgatattcaagtatatggagtagctacatttcgttgatgtggccaactatgtggatggattgcaaaaaagatgtgatttactttaccagacattacaataaaccaccaagatttgtgcttcaatggatggtgaaggatcctaataacccctttaaatataaaacattataaactgttagacacgttttttcagaattaactaatagtaatgtaagttgattttgtgtttcatgtcattatgaagtaagtcattagagctaggacactgttctaatttcgtgttgaacgtctcataactacatatagtttaatgcttttaaagtagtcctcaacaattatcatagactgtttaaaccaaaccgaccgaaccaataattttagtttttggtttcaatttggttcaaagttataaaccactcagtgaaattctaaattgatttttgttctcggttatatggtttagcacatcaaaactgaacaatttttttgttcagtttagaaaaaaccatataaaaaaaatcctagatttctaatcatcatttcaccttccttattttctaatctcttgtcttcagcttgagatcctccttcttcgttcttttcttatctttttattcaccattgttttttttgaatctttttattcggtgttatgatatttttagcgaaaaccctaaaatttgacgagtttgagtttgttatataacttggactttgattgtattggaattacccaattattttattgatttactgttgactttagcctattattcaaaccaaattataaaaagtctgttattttataattgattttaaatcttataaccaaacctaaaaatcaagttccaaaaacaaaaccaaatcaaaattttattcggtttaatttgggcagaattttaaaaaatcgaaaaaacgaaaaaccaaaacaattgaaccaattaaactgattaaattgaatgcctattgttactttaaacaataatacaatatcatattaagatcaatgagactttgaccatcttcatattcactttcaaaagattttcttcactcatcttcattttcaactactaaataaagattttctcttattttattttcctctatacttagaaatctctatttttagtttacattaacatttagaattctccattttaaaggttggagaaaaacccaactccaaaatagagttattctaatttgaaagaaaattgaacatatttaagagcatcttcaactcatgtttttttttttttaattttgaacttggatttcccaccaatccatttctctgtttcttttaattctataacgaatattttaaatatatattatatttagttattaatttttgttatgagcctctatttattattattataacttcaacccaactattttaatttaaaagataagaaacaaattaccatatttatttttaatctgatcatttattgtataaaaattacattacacaatattaataaagaatttaaaacatagaaaatatgtcttcattctccatttacttctagaaaacaaaactttcatcaaacacgacaacgcttcaaaaaatcacctcatttttatttctaaaataatattgacataaatttgatttatatgaaaaaccaaaatataccaaatctgaataaattaatatcctctttactaaatatgccaaagtcaaagatatttttactttataaacctctcctattatgcaaaaaaccaaattttatttcttacaattcagcaaaattaaaattccttgcctaaaaattaaaaatcatcaaatttgaaattacttttaaaattattactcacgtgataataataatattaaagctgaagaaaggcaaaattcagaaaaaatcgtttttttttttttttgccaggcttctctcactctccttcgccgcggaatcgtctctcggagccgcgaaaggactcttagggttaaagattcttccccaaatctccttctctcttcctcagctgatttcgactccgatcaattttctaggtttcgattcatctccgttactaatttcgtcttttataccgttttgttcgtttttctagggtttaagatcgattcttctgttttttttctgtcaccggaagagcttagaacttttctggtgatttgattgaatttgatgaatatggtttgctatttattaagagttttcgaagttgagattccgtagcgtgtttattgattatgatcacatctttacctgttttcttttccgtttcttgtggagttggagtagttaaagacatgattctcctcttgattttgatataaagtgtccatctttacgaattttcagagatttagtcaagaatttcgtcttaggcaaaagctatattgcggtttcattgtttctcctgaagtcgtagtcttaagatttctacatgatttgaacgagttttattggcgtggtgaaattttcttagtgccgtccatgaaagtttgcttctttagggttttgtatgaaatatttcttctatagactcgaaaaagtgttgagttttgtctcagtgcttgatgatcaaaggttgtttttgcatgcagctgatatagctaaatataagctgatacttttattggttccaggtgtttgaaggcatttgaaaggatgggagacaatg

SEQ ID NO: 5468 - DNA, 3000 bp, Unknown
  misc_feature (1)..( 3000): cDNA_ID_3077143_gDNA_ID_1620792_Annot_ID_168341 3000 nt of promoter + ATG
tttattcctattttgatttcttttagttactagtaagggtattatgtataataaactacaagtaaaagatatttcctaaatatacttttctaatgataaaaagatgccttttttcatcaaagttctaccctttcccacctcatttaatgttcttgttcttcttgtaaattttgtttataataggaggctccataatttccttatataacgtttccataataagttcagtcaaacatttatatttactttatctaataccttacccataaaaaaaatatgctattcctattattgattttctcttcttgacatcataatatatatgtatataacaagttaagtcaaacatttatattactttatctaataccttacccaaaaaaaaatatgctattcctattattgattttctcttcttgacatcataatctatatgtatataaataacatagtgttttcagtcttgaggaaacaaaactaataaaatcataaaatgtctacaagagttaggattgctcttgttatgaatgtcttccttttttggttctcaccagccctaattcgttcggatccaaatatggtgcctctaagaaccttcaaggtcagttttgaaacaaaagaaattagttcaagtgttcaacatcatcgtatatagtcggatatgtcatgaacggagttcaacatctgtttgtttgttttttatttaaaatagtgatcgtttttttttttgtcattggcagatacgtgaaaatgtaacatatgactgcattaacatttataagcaaccaggacttgatcatcccttgctcaaaaaccataaaattcaggttcatgaacgtttcataaatttctctcctatggacattttactcttataaaaattgaattgaatttgactatacaatttattttttgaaaagatgaaaccatcagtttcaagacatgaattaaggaatcaaacagacaacactaaaacatataagaataaaatgggatgtccagatggaaccgttcctatattaagaaattcaaaagaatatattaccaatgcacaacttttcgccgagaagtattttcatccgctatcaagcgaaagtcctggatcacatgtaagcattcaattttttcttaattccttagttataataatttttatatgtatatttcaagtattatttatgtatatatttgtcactataaccggtttttggtaggttgctggagtaaggtcacaaaatggtccatatcatggtgtagatgcttcatttagtatacataaattaaacatcgaaagagatcaggcctcatatgctcaattatatgtaggcagtggtttgaaccatcagatcaattttatccaagcaggttggatggtaagctttacatttttgtattgttttttttgtttgctttatcaactcattaattctctaggtagagtcttaaagtatatcgaattttttttttagataaatccaagtatatttggcgatggaggtgtttggtcatatggattttggaaggtgtgcatgtgaaagaaattatttatggtttatatataagcaaaaatcgttaaatccaatatcatgtaaattttaaatataatttttctagggtgaaaatggaaatggatgttataatacggcatgtccagggtttgttcaagtatcacaggaggttcccatagcccagcccttggaccagccaaaggaagatttgttgcattactccatccatcaggtaatttttcaagatttaaatattttatgtttttcatttttaaatattttatgctatttcattcttcaatttttaatttttttattatgattattttcttatacacaaaaaggataaacaaacaggaaactggtggattacaaaactgatagcaaatgcacctaacatagatgtcggatattggccaaaagaattatttaacctaataggtaatggtgcaaatatggtgggagttggaggtgcagttcaagcttctcatcaaggtccaagtcctccgatgggtaatggtaaatttccgattggagacccaaaggaatcagcaatgtttacaaatattgaagtcttgaattccaactatgaacaacgtcgaatcgattcttttcctatggagaagttgctagatagccccaaatgttatggaataaataccgataaaataaaactactcggttttgcttttaattatggtggtgcgggaggagaattttgtggagtttgacatttgccaatgtaatctttttaaatcgccatttaataaacttattctaaattaataaatatgaaattgttatatatacagttctcttagcgtagggtgaatgtgagaccagataagtgttataatgagaaacataaatgtttgagctgaagtgaagtcctaatctactgagaagtataaataggtctttaggtcattgagagagagtgcgagacattgagagtgtgagaggtgttaagagagaaagctattcatagtataaacttgtattagttgttctgtgagtgataacagagtagtgcagagcaatcctaagtactagtgaaggatattaggtgtattgcttgtagactcttgttgtaaaaacaccatctgtttttagtggattccgaggagagtttcggcccagacgtagctaccctcaagggagtgaactgggtaaacaaagtctcgtgtgttctctgttttgtttctctgtttcttcaaagtcttgttcttcttacaaacactgttgctcgagttttcttaagtacatcgttcttctctgtcttagctctgttcttggttgttttgagtcacattctagaggaaagtccacgcctttagcttggtgaaatctcaacatatgtataattagaaatcgaactaacttgcttgattaaaagttttaaacacatctaaaattcttattcattttggtcgatcgatcgtaattctttccccgtttgatctttggttaagagtctttcgttttatttatg

SEQ ID NO: 5469 - DNA, 3000 bp, Unknown
  misc_feature (1)..( 3000): cDNA_ID_3077592_gDNA_ID_1620792_Annot_ID_168351 3000 nt of promoter + ATG
aaaattacgcaatatttgaaaagtaagaattattgctattaaaaaatcttgatacgattcaaaaaaaattatataaaaaatacggtttttaattatttaaattttcagcatctttacacaaaaaagaaaagaattcattctcatgttcaaaactatctattttgttaactttgtttttgaattatgcaattttaaatatatttcctaataatactagggatgtttgatcttaaaataaaaacaatttggtcttagtcatcaaattttaattttttttgggtttttttttgccgtctatatttattatttattgcaaattatgagaactgtttcatatacaattctacccagaacaatttttacgactcttattagatctacgagagatgatatctccttcttcttctccatgcttttgatagacatattcaatgatcctctttacgtagaatcttgacgaacggctataattgtacatcgttggagatctcatgtacatttacctccattaatctgcaaatttgttaataaatcttagtatctgggactcgaacctcaaattttttggtataaaaacattaataaacctttcgtcaatcaaagggatttccaaaatcacgcaatatccctacctaaactggaaactccgacccaaaatcaaacaaaaatttgaattcaacatccctacctaatactacgtatattatatgaatacaacgtacctcaaatagtattttgtctttaccaatataaattatataattataacggacctactaatatatatacaaaaaaaggttatcgatatctcttctctgtacaagagatcgagtcatgaggaaatgggcccgtaaaagagtaaaagaaatgtacaatgaagaggagacaaagcatgatcctgccttttgctttgatctcttcttttttgtatgggttccactacgttcgttacccatgccccacccacgttttcgacggttcctcgtctttttttggttcttctctcactcttattatacacttgtttatcttttttagattcaacattttaaatagtgattgttgtttgttcgaacttgggtcttataagtcctaatcaacatttaattggatccattagaaacagttctttcattggagctacgtgttacgtttttctgatatatgataaatattacaaataagactagccattttagattttcaaccgtaagtatgtgtagaaatacacggttttaaatttataatcaacaaggtagtagaaaagatagatagtccacactagatatgagtaaaatatatacatcaagtcatattatataaggtgggaactatttgtggttttattataatcgttagaacgatatctcgaatttatttagctcaaaaacaaatatcactagaaaactactacatcaaaatcaataccatttcttacaaaacaatatggcatattgatagaagaatgtacaaatcttcgatgccataaacagtcgcatcagaacagttgcatgaccgtgaccatgcgaagtagtgtacatcctcatcctcacgttcgaatgaacgttctcgtaaatcgttcctacaacacatatccctaaagagagagcaacacatcctgtttgtttaatgattcggccactaaaataaacgtgtagttaagaccaaaaacgtaaagcacacctgattagaatattgatctctaagagtaaagaacgcatatattggtggttttggcggagctaaattccaaaaaccgaacataagacaggtagttagaaatgattttagagtatttgtttttaaaaatgaaatcctttagaaaatgcaatttcttgggacgataagaatgagaagaagacacgattctgaatttttctgaggccaacttcatggccgactttggaaaccgcattcttagccactgaacggcgcccttaataccatagactattctcaattttgttattaaaaatacagccaagaaacaaaccaaaaaagagcacgaagaagacaaaagacttaaaaaaaagtttcaaaaggaagagatttgtgggtgtaacacatgccacgataaacgattctcctagtaatagtatctgtccaccgatgatctaaacgaccaatttggcatttcccagttactatcataattaatcatatttgtcacgtagattcagatgtaagattactaaaaaacatctcaattattttcacaatcttagacttaagtgtttatagcatgtggataagggatcatgatcataagtttatagttatgtttagtgttttgtttttggtagttttagtttcaggcggttttgaaacactttttccgatccgacctatactcattttattttttttgttttatttacaatttaatttacagattagacattaacacatattttcaatttctcaaaattatccaaaatattcatatcttaaagatgtgaaaatttatcagaattagtgaattcgaagtgtaatttagacgatttaaactatccgaatccgatcaaaactatacgattaaaactatccgaatccgagccaaaacggtatttagtaaatttaatattttattccgtatatttctagcaatatatttaaatactcctgcccattacctgtttatacgcaattacctctaatcatctacaaacctgtcccaattggacacttctggcttccccagtcacagcctaaacagagcttgactcaataaacagcaaatataattgcatcaaaacaatactttttttttacaaattttttattccggaagtaaccccaaatggtcaataaggttccaaatctctgaaaaggaatgaggtcacaaccccacgtgggataccaactagccacagtggcacacactcgtaatatatagaaacctccaaggtcattttcatagttctatccccttataagcaatagccacaactctctttgctaattacattttacactcatctcgttctctcttccgtcaat

SEQ ID NO: 5470 - DNA, 3000 bp, Unknown
  misc_feature (1)..( 3000): cDNA_ID_3077139_gDNA_ID_1620792_Annot_ID_168342 3000 nt of promoter + ATG
ttgggcttgagaacactaatatcttagcaattacaatgtctggaagaagaattgggtagaaatggttttgtagagaaaaatatggaaaataaatcaacggggaaaatgtgaacatctttgttttaaaggttttcaataatgtaataagtgtaagtaattagataattgtttattcagcaatggattaaagtctgattagagagggatagtaatgtttataatttcagggaacgtacaacagaaggaagtgtggaaaaaacggtatagagcaataatatttaaaaaaacattctggagtttcatgaaagatctcttctcatcatgaccatggttggctacatcggaagattgaacatctatgttgtgtagtaaccggggtcaatggtgtttattcttgttcagattcagatgagattattagatttctgcgcccttttaaatgtcgattgctagaatcttttggaacagctgtctgggcggatttcctaacaacagcaagagacataattaggcactattttctacccttatacaaacgacaacgtttacacattgtttgaaccataatcgaaatcacctgctaagtcggcgttttgttattgtctccccaggaatttcagaggcctcaccatcagtaatagtctgtggacggtagacatttttgcaaatatgaaatcaaaaattgattgaatttagtcagcgttgggattttcgtcagctccttcttcatttttttgtttgtttaagtttgtataagtttgtatcgtccgtagtttcaggtaatagaagtcgagtttttttcgccttaacctttctggtgccttgaactttagaaacatttttttcattatgtgtcctaggagaagagattatggaaattaatatcaataatgaacacttttagtgaaacaatgttgttagttttaaatgaacctggcagatgtttgtcctatggggaaatcatcttcatatttcttgaaaagtggagacgtatgaggaggggtttgaaagggttttgaaacatggttgacatttattttcttcagtttttataatgatagttctactttctatagacctaaatttaattggcatcagtttaacgtctccaacaccggatggctaacgtctccaagatgttccgggcaaggcagggaccacttgccgttgatggacgacaaagatttagatagagggacgtttccaaaacgtctcgagcaaaaactggcgtctctataaagtaatgacgttttaagaatcaagtgataatattggtagtacgttctaacatgtcaaatcaaagtggagaaaatttatgatgaagttatgtctttttattatatttttaacatctatttcatttattaatttggaatcatgtacaagaattgatactttaagagtacattgctactaagcaaatcaaaatacatatccacaaatacataaccaatcattcaaaagaatgatggagaagtgaatttccacgatgtatcgataccgaagccttgctcgcaaacaaattatgaaatctgtttctttccctatctatcgttcatgggagaaactccatagtcgactaatactcaatatcttttcttatattgattcgtctattatccgtgaacttgttatttctggatcccacattcgccgatcgatataccatatatatcctaggaatttttactcaatcccttccattgatcgggattgtggacattggacattcatgaaaattcaaaagacttttcacggagagaacaagatgaatcataaaaccaacaaactccaatgaacttgaatgaatagcctctccattcggaggaaatggctagaaacaaaatcgtctccgctttctaacagcaaggtcccaaatcgagactttatgaacaaagtgcttgaaaggatgcaaaataataccttctgatttcgaatttggtaatggcttgacatgaaaattgtgatcgaattttcaaagattttagccaagaatttcgtcttgtcaaaagcaatattgcggttttattgtgtctcttgcaagtcgtagacttaagatttctacacgatttgaacgagtgttgttggcatggtgaaattttattagtgccgtccatgaaagtttattttttagggtttttgaatgaaaaaaatcttcaacagactcggaaaagtgttgagtattgtctcggtgtttgataagtcattgttccaaaacgacgttaagaaaatgacgtatcttaccgttttgttgtagggtcacaataatatttttggggtacttaattgatctcaaaatatcttgatctatagtcagttaaatgtctaaagatttctatttcgaatttcatatatcaaaaactgacattatgaagacttttattacgacattaaattgaataatatgtcatttaatcattcaaataattgaaaagttggcaagacttaaaaccccataagtctttttgacttcttgttcttcttcactctcctcttacgtctcactccatttcttccgaaatctctcacgacctctcccttaatttgcaccaaagaaagcttcttccatcgtattttaaaagtaagttctcccattataattcttatacttctttcgttgatttctgaagaaatttttgtgttcctgatttttaaatttttggtattggtcaagttgattaatgctaaactctgagcctccttctgtttattaatattttcgttgatttctttgattacattctatatattgagtattgatgtttttttttaaagtatgaaatataaaaattatttcttctatatttatgtatatggatttctgaagttgtgtgtcgatcacgttaactcttatgtatcaattaataatatgatgttaaaaaatggtgtattaatgtatagacaatattttcactagaaggataaaaagtttatcaagtcgtttattgattgagtggtttactttggattaaggaaacaaagaagttatttacatccatg

SEQ ID NO: 5471 - DNA, 3000 bp, Unknown
  misc_feature (1)..( 3000): cDNA_ID_2150666_gDNA_ID_1620792_Annot_ID_168340 3000 nt of promoter + ATG
aagatctctacgagtactcgaattaacgaacggatcttgcttagaatgtcgaaacttgacgaagaagcagtaaaggataaggtcgagatgggttccaagggatcgatatcgacaaggttttgcaagtcctccttgcagagcttgaacacaaactcttagggttaagagtcctcctatctaggctttacgctaagctctcttaaaactctttattcaatgatcaaaaactaatcaattctacaacgctaagattctttaaataagaatagagaaaccaaaatcctaatctaaaaacatatatgtatatactagttaaaagcccatataaaactaaaatcccatataacataggtgacgctgcatcacatagtatatacactttaaatgttcaaagcaaattgacccccctaacaaagcattgcctctgccctgttctcaggcttatcgtcactcatttggggaacaaagtaatcaaagatgagatgctttcagattcaaaagagaagaaaaaagtattaatcctaaggataatactgtcaccacaagactcaaagcatccattcactctaaaaaggcgtcagtttgtggtgcgaatgtgctatgctatgacagtaaataaaagtcagggaaaaactttgaatagagtggcattgtatatgccaaatccagtgttctgccacaatcaactctacgttggtttgtcaattgtcacttcgccaaacagtttgagagtcctagacacatctaaacagaagcaagatatatatgtgacgaacatagtttacagagaaggttttaatggtctaccagcaaccgcaagtaagagaatcacagaaacaatagacaaaacaataacgagtttgatgttcaatatacttttcgaaacttgagacaaagaaactaactattctctatatactcttatgcaggtgaaagaagtgacatagaaaacaaactaacaaagtaacaaacactttgagaaactgattaaacaaccaatgagatatattgaagaaagtgagaaagtggaaagtggaaacaaattaacgaagtaacttctttttttggacatataaactatgaagtatggaaagtggaaactatcgcctatactcgcaacaatatcttgccatctccccatttatgaaaattaactttttcaatcaaaatttacaaaaataaattcaaatgtaaattctaaaatactcaaaaagctatcagattcaattttatactcacgtaaaactcatcaattgttttttctaccacctgaatcattatagaaataaaataggtaataactgatataagtacacattacgatatcgtgaaggattcaagtttctacaaccaaaaataaaagaaatggcccaagaagaggtatagctgtacatgtataagttcatcaaatcgttaataacacctctcatcctctattctttttcttattctgcctcttattctcatcccaaattgctgcttaaatcaccatcgtgaacatatgaatttctcagacaagcaaaagcaccaaagaaacccaatgaaaaatacataaatacactttggaaagctgatttataaacatacactaatgtaggtacacaaccatttaatttgttattcaaatcaacaatatggtttattcaacacaaataattgaacatgcaaactaataacggtttccaacattcaaatatcattagctaggtgaatagcaagatttccaacaaaagaagtgtaaaacgccagacaaagcagcaccaaagctaactatttttcaaatgctttaatattttctccactatgtatgatatattcgttacaagtttttcagcagctatttctgaatatatcatccatgaaaaatatgcaggtagtaacaacataatccacccatctcccttctattcctgagtttttatcaacaatttataaccaaaacaaaaaaaacatgaatcactaaattttgttatatacttacgactttcctgtagctgctactagatcaaattccacactcacagacatattaaacaaaacatgtcagaagctgcacttcatgataaagatagattgatctctctcttccccaaatatcatcaattgttaacaacatccaccaaataaaatgactttacttaaattatattttaataatggtattttatgtaatatttaatatattaaaattatttacttacataaattatatatttttattattttatatattttcaattaatagtgaagatatatatataatctatatagtgaaaaatcaaaatattaatatctataagagttaatatataatatttataaaatgaacaattaaatttgatatagatatatatatatatatataatattaatcaatattttcagaaaatagttaatttcatcttttagaatttgttttgtaatcttcaagatctatattaaaagattttatgaaaatataataaaataattactacttcaattgattattttgaaatacaattatatttattcctattttgatttcttttagttactagtaagggtattatgtataataaactacaagtaaaagatatttcctaaatatacttttctaatgataaaaagatgccttttttcatcaaagttctaccctttcccacctcatttaatgttcttgttcttcttgtaaattttgtttataataggaggctccataatttccttatataacgtttccataataagttcagtcaaacatttatatttactttatctaataccttacccataaaaaaaatatgctattcctattattgattttctcttcttgacatcataatatatatgtatataacaagttaagtcaaacatttatattactttatctaataccttacccaaaaaaaaatatgctattcctattattgattttctcttcttgacatcataatctatatgtatataaataacatagtgttttcagtcttgaggaaacaaaactaataaaatcataaa

SEQ ID NO: 5472 - DNA, 3000 bp, Unknown
  misc_feature (1)..( 3000): cDNA_ID_3077156_gDNA_ID_1620792_Annot_ID_168325 3000 nt of promoter + ATG
cacttctcagcttttgtataagctcagccctaacctccaacggtttatatgtccgaggatgaccatggtcgttgacgctccaatcaacgtgcgtgaccgtagcggatacacacccttgtgggtctcgcatgttaaggagagtagggaagtaatgttcttcggggtaacatatgtcttctcttacgcatgacttgttaaacttggaccatatctccacgtcactcaccaccatcagcgcatgggctcgtgtcaacgtccagaactgtgatcctattcggaactcctcgggtggtacctcggggaacatcgcgtagggtccacgcgctgcccacctttcgtaccaccctggttcgtctttgagaatttcgatgaagctctttgtggaggagactagtgtcttgtaagtgaagttaaaggagtgcaaaggaatgcaagaaggggagagaaggataaacatgtaattagacgggtcctcgagaagcgcatgggctagtaaacgacgtgcggctgagatgagggttggggtgtgcctgtaagccggttttgaggatggtatgatccggttttgaaatgtgccgtgagaacccggtttgtgtttttgagtcgggtctacatggacgtagacattgtaaagagacttgtgatgagagctttggttgaaaaaaagctcccaaagtggtgcaagtggaagagagttcgttgttaagaacatgaaagctagttttttgggaaatttaggtgaagggtttgggttggctttagaagcttgacgaaggagtaactcatcgtgatccagtggctgagatgtaattacttgaggagatgtgaggttattattgggattttgtattattaagaccgccggctgagtgacggccacagtgatggctagtcgaggactcgtcacggtcatgatgacacctaagggcacgcagacgagtagaatgaaatataaggccaacatttttacgttaaatgacttttttttaccatctcacaatgtatcatctagtttagctatgaatattaagagttaggatttataagctattttattttgataacattttcggtttctgacaagaaaaagggaaacgtagatggtatgggtttcacattgtttgtatgataagaagcattatttgttttgtggtctttttatggcccatttggttaccaaaacgtgatccttggttcttgttacatacttgatactccttacgatgctttattcacattttatcttctccatccttttataaatttgattgttttttcttcgaatatgaatcattcgaacctacaatcacaaacgtgtataaccatcaaagatcgaaaaagataaggtattacaaaagagagaatctaaagttaagtatatgatttgttgtgtgtcttcaaattcaagtttgtcagatttaaacagtctataagaaaattgtaatattgtaagttgaaaccataaatatagttcgatttttgttaatatgcatgcaactctgaaaccctactgtagttcgagatctatttgtggtgaaagttttaactttgtttgatttttttttttttttgcttggaagaatctgcatcggtagacaacgtacctacactacgactaagctagaccactaaagcctctttggattcgtataagatcaaagtatactcgattttgatgggatcattggaccaccaatgggccgaccatgtgaggtttaaattgtttctaagcccaagaaacatcgaatgatcaacaagaaattgatttgtggattttcataacacttcattaccggaacaagtgcgacctcaatgacacataaaccctaactctcactatttaagcactaattttcactatttatcattgaaagagaaagagaaataaaaaaaaaagctaaactaagaagaatgacgagcatgaccaatctttcagcatgaaatctagaaactgattccttgcttgaagtttaagtttcttagattgacatcattgagcgcatcagtgcgatccacttgcaaaatttggaacgatttatccaaaactaaaactttttgtaaagcaaggaagcagtttttagatttcatgctgatggattctagggttttatcaatgaaaatacatctctatgaaatccgtaatgacgaggaaacttcgtttatccatacataattaaagcaagtaagtatgctcaaccaccgcgacattttggagattaatattgttcaaatacggattacacgttttctcaccatagtaaaatggtaatgaaattttgtggtatttagtattttacgagatctcatgggtcaaattatcattttttggtgaagtttggtgaccgtttcaaagatatcacacgttttttctgtatgtggtttctaaattattcacatggagttaatgatcttaatcctactaaactttacaaacagagatttcacaactttaatttctccaacaacttaggaaaacatgtggaggttaacaaaataagaagaaaaaaacaagcaagaaaacaagggacaccttattttcactaagtctctttaccatttcttagtatttgactttgacaagttcttgaccaatactaccactctacactatatttgaatcctctctagaatggatttttcattactctaaaatatatctataatagaatttcgattagattttttcttttatataacttttatcttctctaaaactaacttcttccacacgttatgacacacttattccccaagctaaacttagtaaatgcctaccttgttaaatcctctgtattataggtggaaatctcttcttcattcgtcgccctcctctgtctaaaacaccaatctaatctttctcttcccttcacactttttgccaaaacgttttcttatatacacacaaaaaaaaaactcaaatttgtggagaatcgtttactcttttcttcttgtatatctcttgccctaattctaattacagatttttccgtagagacgatg

SEQ ID NO: 5473 - DNA, 3000 bp, Unknown
  misc_feature (1)..( 3000): cDNA_ID_2150625_gDNA_ID_1620792_Annot_ID_168329 3000 nt of promoter + ATG
cctattcgaacttgctgagtttaaaattttgtttactgcagctggaatgcaacatatgagagcttgttgggtatgaacaagcggttttctcgtccaataccactccctgtaagcatttttttctcagcaagtttacacattctataaacatgattaaggatttgatgatttaataataaactgtggcaggaaatggtggattttttggtggatgtgtgggagcaagaaggcttgtatgattgatttgcaactctttaaacttaatttagtttcatcttttcttttatgtgtgtaatcaaaagaagaacttggatttttagacttggcttcctgaaagtaaaaaaacgatttagacctttttttttggtctttgtgtaataatcatttttttacacacggaattgtattattatgacaaagtggttcagctattttctaagtgatttctcaagaaaaaattccaaatcaattgtttcatcttttcgtttatgtgtgtaatcaaaagaagaaaaaaaaatcggaacttagaatgttagactttggtttcttgaaagtaaaacacaaggaacaaaaaaaaaaaaatcgttttttttttgttttttgtgtaataatcactttgttacgtcgatttttgttacactcagaattgtattatagggaccaagtggttcggctattttctaagttggtcggtgatatgtatttagttagaatttggattatataaaccgatggtatgataaagttaagatctgattatgactttttggatgttatgtacggtacattgtacctataagatggttaatggtgtgctacaaaattcgaccaaattcaattatccgcgagaaagtgaattctttttcgaattgaagacttctgactatattatcaagatgacttttattttcatgtctacaacgtcattttcagcttcatcctttgttgtcgtcgctggattgaagaataacttaaacataaatacgtaagctttattgatattattgattgattggcaacaacaaatcaaacacgatgaatgagaaatatatgtacaattgcatgtaatgtatttttttcgtaatgtaacttattaagcgcaatgtgtgttttcgaaaacgtaagctataaaaactgcaacgaaataatcaataggatcaaagatattctcctttggaaaaattcaaaatttcgaaaaagtgtgcgatatttcgacttatgtgctataagttgtaacgaatctccgtttattgtagatatataccatttttcgacattatatgttatagattatgttgttatatcattgctctactagctagtactatgatttttcttccttacacctcttaaacaaatcaatttggtgtgttaacacttggtgatttgctagaatctgttagaatagacatgaataatacataacagccatcatatcgaatgggcgtgttatgattcattacaactagaataatacacgttaaagattggttaattcactcaaatggcggttttgagttagaagtccaaaacttattatgatttataatcaattaatcaaactaatttagtaaaacaatgagacgttcatttttagagtgctacttcttattttcaataaaaccctcgacattcgttttagtatctcaaacaaacaaataatttatgtctgtcgcaatcatgttatacgaataattcttctttcaatcttaaaataaataaaaattcaacgaacttaacctcccacggtttcgtcaacaatttttatcaaacaaaaaaaagaatggtgtgtcaacaatgcatgtactcgaacctttttgcttccttcaatgtattcagccacttttgtcaacttttaactctcactttcattgcattcagacaattatatatattctttgctttccttttgaaacctcaccactgtcaccagcatttgcatttatttttctgacaacttgtaaaattatgacgcaacaagtgatcatcataatatacatatgtatcaaaatatcaagtaaccaagaccataacatagaatttcaagtgcatgacacaaaactattgcttagaggtttttgtttggaaaactaaatattccgttagttttgtgttggacgttttgggtgtgattggtaacatgagttaccatgtgttacgacgtgtacatatatcaccgttattgacacattaatattaaaatgaacttgaaaataagataaatcttatgaattttatctagaaagagtctcatactctcatggaaagttgaattctttaattatcaatattaataataatttaaatataaatgatgtttttatatataataaaccatattcaaaagtatatatataaaatcacatgtacatataactctgaatatatcttacaatatacactatttcaaatttttagtagatataaaacaaaagtttttacttttttttttcatttcttaaattacgttagaaaatttagttttctatcactttatggaaacgtaattagaagcttggagtgaaaaaaaaaaacataatgaatgttgagaaaaaaacacaaatatttaatggtgttttttcataattaatattaaatagtgttttaagaagaaaatccaaaaaattatcatatccaccacactattaaatatgtcaaacgaaacacaaatcaaaagctaagatcttttgaaaagacatctaaaatatacaattaacattggatttggactatgttatccatcatcccctacatcattaaaaatacatgttactatatacgcaacacttgctcttaatcctcaaataaactattgcccatgttgctactagtggatcatcctttttaaaaatcgacatctctcaaatgtttttgtcaacaatgcatgtattctcttccttcaatgtattcagtctttttcgtcaaaccacatttcaaaactttacgaatttatttttataataatgtttttgatatgtttcattataaattaaaaatatg

SEQ ID NO: 5474 - DNA, 3000 bp, Unknown
  misc_feature (1)..( 3000): cDNA_ID_2150660_gDNA_ID_1620792_Annot_ID_168338 3000 nt of promoter + ATG
tccatctcttgatctcttcacgtcattcaccggccagctcgagctccggtgaaatcatgatgatttgtttttgctgctagcttcctcttcacgtaccaaaagagcatgaagaggaagcaaccaaccacaagtagggcaaagatgcctagcaagatcaggtagaactgtcctggtgagatatgatccgtaacatttggtccgtccatctacaaagacatatacaaaaaaattaatattaggctaatggattacccctttgatatttaggtgggggtattggacgcatgaatttgatatactttaatagaatcttaaattctagtgttattcaattagacatttcacaaattcttttaaattcttgtgttatttaacttgctcatttcttaattctattaattgcaattgttattaactttttcggtagttttgtgtgacaacgttacttcacaagaatttaatagaaaaatttgtctcaaatggtttatgcatgggttcacacacaagaggtatagcgatggtaggtgtttttgtttcaagttcatttcggtaatcttttaattttgcctttttttttaatttacttatgttttgctcatatttgtcataatgttttttttactttaatttccttaattataaaaaactaacaaaaaataatcaaaaattacatatcttaattttacatgagttattggtcaattagattttgacatgtatgaaaatatttattttaaaatattttttagcatggatattaaccaattacaattaatattgaaattcaaaatagcaatataaatgacttaccattgattgaattagataaaaattgtatttatcgtaataataaaatatttctattcgtaaaatcaaaatacaaaaacctacctaataaatgtaaaattttaattatatttgaatcactaataaccctagtggaagatattttaaattaagagaaaatcctaaaaatagcattaaagcaagttttactgacaataatagcacatattccataaacttccaaaaatagcactacttgacttactataaagtttttgttctaaaattataatcactaattttgtttttcaataatatcacaaatttttatataaaatctgtttaaccaaaataattagaaataaatttaaaatattatatttgggttctttatttccaattgtgggtatatatttgaaccatttaaaaaaacaattttattcattttaatattagtttatggtattatatttgggttccctatttccaatttagggtatatttttgattcaatttaatattacattagtggttgctctcatttttatttttttatcttatattttagttaagtttaattgaactttatagtactatttgtgaaatttaaaaatattgtgctaattttggaagaaaaactttttttggtgctatttttgtcaattgccctttaattaatggcatgttgacatcgagttttgcttatgaagttttacctaggtcttttggtttcgcctcgtattcattattgtgcattatcagacaccaaagatggagctagtcatttattaattactttgaaagtatctaaataaaaataaatacgagaaatacacatatttttcccgcatttttttttgacgagaaatagatttacaagggatttttaaagggttttataagatttacaagagattttaaaagggttttaaaatatttacgagagattttaaaaaggttttaaaagatttacaagggattttaaaatggttttaaaagatttacaaggaattttaaaggactttaaaagatttacaaaggttttttaaagatttttaaagtgtttaaaattgttttaaaagggtattaaaatatttataaggaattttaaaggactttaaaagatttacaaagttttttaaaaagatttttaaagtgttttaaaagatttacaagtgattttataaggttttaaaggatttacaagagatttttaaagggtttaaaaatgttttaaaagatatacaagggtttttagaagatttttaaagaatttacaagaagaccctttaaaaactcttttaaaatcccttgtaaatcttttaaaacccctttaaaatctcttataaatattttaaaagcattttaaaatcccttgtaaatcttttaaaatacttttaaaccctttaaaaatctttaaaaaacctttgtaaatcttttaaaaccctttaaaatctcttgtaaatattttaaaacctttttaaatcccttgtaaatcttttaaaacccttttaaaatccaatgtaaatcttttaaaatcccttgtaaatctatttcccgccaaaataaatttacaaggatttttaaaagcatttttttgactgagaaaatttttgtgacaaaaaaaagatttggtgaattttttttttttggttggaattttgttttttggcaggaaaaataaatttggcggaaaaatttcagtttccaattacatgttcctattaaatgagggtaatttggtcattctgtttaagggaaagagtatttttaaaaatggacaacacaaaagggtattgttgcaaaaaggtagtaaaaaagggtagttttgcaaatctccaatgacactatagttttaaaccacaatagactaattgctttattcaatataatttagacatgagttctaactaaaattcaatttaataagatacatatagtttccatataagttatcttctatacttttatgatcgtctttactattatgaaaataaatttccatataatatttttctgagtaaataaataaaaatatttgtttgacacaggtcaaaatctgagatcgataaatttgacatgtgtcacgatactaattttgaaaaccgtactttataataaaagtgtaacatagtaattgagcggaaccttaattacagacgagaatacaagatctctacgagtactcgaattaacgaacggatcttgcttaga

SEQ ID NO: 5475 - DNA, 3000 bp, Unknown
  misc_feature (1)..( 3000): cDNA_ID_2150649_gDNA_ID_1620792_Annot_ID_168335 3000 nt of promoter + ATG
aggtgatcatcaatcctagtttcagacatcagttttggtctctacagttatggaatagttttccttgtaagttgtctgtctatcttttacctgtaactgttgttagtgtcaggtgcttccaaagaagtgccatctcatggaaaattgtatcaaccaaaacacaattttgactcattgagatttgtccttcacagtaaaaaaatgttatagatttttgtagactcattaataaaagcaagtgttcatgcgccattgtatatttatttagttttggttaccaagtgatgttccagtggtaattacattccattgggcccaaataaacttcacaataaacaaatatgaaaaaccttttgtttcttgttcaagaaactcgacctaagcaataccagattctctaaaacaatacaaactgggttttctctcttatgccaaccttttcctgtcttgagtgaaaagcctagttgatacccatttaaacaaagatctataaagacaaaatttgttgaaaacttggctttccattaacaagtaattatttctttcacaatatcatactaaagatgaattatacgtatatttgtcgtaaataaacggagcgatatatcatagagaaatatcctaaaatagcactcaaacaagtttaatggacaattaaaataacattgtccacaaatttgtaaaattagctttagtgaatttactcagtaactattttataattatataaattaacaaaattaattacaatttgaaatcacgattaatttacaaacaatcgtgtgaaacgtcaatcgaatgttaataactttatattagttttttactatgaatttgtgtttttttagagttttagagattgtgtgttaaatttagtaacaaacttactttcatgctatttatgagaattgcatatttctagaccaattttttattattataattcatataattattcttgaattatttatgtgctatttgtgagaattaccaatttctagaccaatattttattattattcatataattaaacgtttattgaattattttagctctaaaaaatataatgaaatttagaattgttatagaaactttaaatgactcaaaactgatctttgtttttttgtcaaccacacattaattaaaaactgatctttgttaaacatctaaatattgaaaaacaaaaggattaccaccgcacctatcctgcatcgtcttgtaccatttgcattcatcagagccattatatattcatgtggctgtcacatccttatatacatttcaacttataaatttaattttgtacgtttagcagatgttggtgaattcatttattcaagcttaaggtttaactcgttcttgtctcctttaggttcataacatttaatggacaacaactactccaaatatccgtggactttaccacgcgacgcaccgacaattctctagccttttcattaattgatcagtaaaaacacttctataattttaattattctcagaaattttaaccggtagtaacataaacgtagatgatcgaaaaagatgaaatcgaggtctctgttttgtgtcgaattaatagatctataagaaatcaaacaatgaaaattaaatagatgaatgaaatatgttttgacgacgttttcacgtcactgtttaagttatctgttagtaaaatttgatagcatttaatttgaattgctatgtaactcggaataaattcgacggcaagaggtgtgggatgtgatcagtcttctaattaagtgtaatctttacaaaaaatcagtatgagttaatacaggtttataaatagaaagacatctacagtaaaacctctataaattaataatgttgggactgcaaaattttattaatttagaaagattttaatttatcgataaattaatatttattaatttatagagagattttcgtaatttagtaacttttcaaaaatttctataaaatttttttcattatagaaaatatctttcaaaaatcaattacaagtaaataataatatcatgtttagaaaacaacaccaaaagtttttgataaagtaaaatactataactaaatttaaataagaataaatacaaattttaagcaaaaaaatattagaattatatttcaaaataatttcttacatataatgtatatatagttgatatatttataaaattattaatttatgatattgatgggaccatatatttacataagattttttaaaaagttattatcttattaatttatcgatttgtgtcactttttacactgatcccaactcgggactggaagaatttattaatttatagaggttattaatttatcgagtattaatttatagaggtttaactgtatatgaataattgaatacacatgggacatcattatagttaccttagtacgattttatgcatttggttaccaaaatccactaggcttcgtaattggttgtgggtcagtgtccattcgatagtttgcattagcgataaacacttaaaacagtaaaacgtgatctatttttaaacaataacatttcttcttatcaaatattcacataattaatgaagaaaagagacgaattgataggcaataagaaatatgatcacttggtaccattgtatgcatggtatgaactgacatcaagtatttgtacgttgtagggtaattattaacattgtagaatgacaagtatgatcaaatggaaaaggattagttatatgtagcaaaactagtatttgtacttggactatcttgtcatgtagttttcctaacgctatatataatccaataaccccatgacacggaagagataggggacatacaataaatatcagtagagaggacgtgggaaaagcagagagttaagtgagtagttggagatagaaagatcagagacgaggaatctctctcccactctcactttctctcctattcttagttcgtgtcagaaacacacagagaaattaagaaccctaatttaaaacagaaga

SEQ ID NO: 5476 - DNA, 3000 bp, Unknown
  misc_feature (1)..( 3000): cDNA_ID_3076908_gDNA_ID_1620793_Annot_ID_50482 3000 nt of promoter + ATG
gaattggtctgcttttcagtgaatttcaaagatattctaatgattgttaacaaaaggcttttcgattgagtgtggttttataaactgctaaggagaattttggtatcaaagttagatacccctacacggctagtgatgaagaagacaacactaagaaaaccctgtgaattgtgaaaaagatttgttacctgcattattgttccatcactatctcacaacataaaatgtgtaagaataataacaaaacgtcttgcgtctccaatctccaaagctaaccaaaaaaaacaatcagaagaagaggaggaaagaggagtagagacgccaatagatctcacggactctcacctattgttaaaataacgccaataatttgttagtacgagatctagtaatagtagttttatttaaatacaaaaccctgtgaaagagatttgttaacttcaaaattgtacttttatttaaatactaaactgcagtaatagtggaaagactgaacaagagatcaaagtaagaatcagagcttaaacgagattatgagaaatatgagaacatgagacctgcacgattgaatgatgatgagacatgaaagggtttcggttcctttttttttacataccttaaatgttgtctactttttttttttttttcaccaaattcttatattaaaattaaaaagatacatgaagattagttttcatcggacaaacccgaataacaaacccgaataacaagtttgaaaattgaaaagttgaccaaacataactcaaacatagagacactagctgaagtaagtttgataggagaccatgagacgtttcgaaactaactaacacaagcatgcccatgagagaaatcgtaaacaacacaaaaacctcgactggtaagaaaatagtcaccgtaactagtgacattaaaacgaaattcaaaccatcaaacgtggttctaggttggaaacaacgtggatttgccttagacgcagacatagagacgtcggagaagtattcggtaaacaagcttcgctgacgatgggtgagatccaaatcaaaaaatgtggtactgaatcgggagtgaaatgggcctacaggagaagtatccggcgtaagcagagggaacccggaaaagtattcggtgaactgttgagagatgaaacgggaaaaggcaaaaggttggcaaagggagagacaaatgtatcccaagacgatgaaggcagatgatgagcgttgcacaatattaaggcagaccaaaataatatgcgtacaacccaataatcttaacgagcctttacgaaatctagaagttcccaagatgggacaagcccaatttaaagtcttcttccaaaaatgtgaagtgaggatttgacctaatccaagcgaggccaagaacaagaggcggcgacagttgacggaggtgacaaggtcatcgaccacaaagattaagagagggcaaagatcactagaaagaggagacgaggagacaacaaccatcagcttcacacataagagtcgattctcgtggctggggaaggagaggagaacagattcaacaacgaagtagccgctggttcttccaataggaggtggagcatgtcgggccggtgggccaaagatcttcagaaaagagatgccaccagatctgcactcgacgagatgcaacaacgagatggaaaatgatgagaggcggaaagacgggatacaaacttgaaaatttcgggacaaaacgcgtttggattcttcgggagatgagcagagaatcaaaaagaagacaacgtccgacgccgacgagccatagctacaccagcgtcgaaagacagaagtttttgaagtgtttcgagaatagcgtctgggagagtttcaacttttatggttaatggtctttttttttattatacctcttttataaggttttttaaagatttcttttttaataagtttttttttggttttaaaaggttttaaaagttaccataaagatgactaggggtccaaacctccataagcccgcatatacatcaaggagcatttttgaaaaagatatttttataaatattttatggtaaaagacgtttttgaaaaaagtaccgtgaaaaggcatttctcaaaatattacaaacttataatcattaaataatttcttttagtattttagtaaattttattcattgacttttaataaatccatgccaccacatcaatgtgtttgctttttttgatcgattgataaagaagactcggaaaaaactctttttttttggattttccatttgcataatttttagattatccaattaatatacaaattatctgccatttggaattatacttatattaataactatcgtccaattttaaatttcatttgctctacaaacttgaaaaaaaaaacttgaatatataaccctaaaagtagagttcaaatgtgagcatccacattagttatttttttcagtgtctattgatgattatttttaaatatcaaagaataaaaaagcaaaagaaagaaatatagatgtctttaaaatgaaaattatgtttttctagaactatttgagacatctatttttgaaatgtctttacttttaatattattttatgtgaaaacatctgaaaagttgttagaatgagaatggtctaatattttcaactgcacgcttatgtaattgaaacgtcaccacagcgccaaatgctctataaataattaaatatgaaatcgtcacaacacaaagccacaacacaaagccacaaaacaatctctatcttatccatctaattttctttggtcatcactatcttatccatctctccctctctaattcatcaggacagagcataagaattgaaggtaatcctacggatctcggcttctatgatgttgcaatattgtagaagaaactctttaaattctcgaatactttaattttaactatatgtgttcttaaactaagaatcaaagtaagtgatcaaattcaaaattgtactcttttttttctgtgtaggtagcaaa

SEQ ID NO: 5477 - DNA, 3000 bp, Unknown
  misc_feature (1)..( 3000): cDNA_ID_1840419_gDNA_ID_1620793_Annot_ID_50484 3000 nt of promoter + ATG
tggagaatatttcaataataaaaccatttctgactagaattaatataaatcaatagaaggacgtaaacatcactcaaaaaatgatgatcgatattagaagaaactgtagtgggtaccaagaaaattaaacatacttgtcgtcggcacaaaatattttggattgtgaaactataatgccttgttttagaaagatgtgagagaatataaaaaaacttatgtgttattcaattatagagagatgaaattcaccatataaaacttacatgtgttatcatcagtaattacaattatacacatcaagaaaatttctatatttttctaactaggaaaattgtacttcaactgttgatttcatcattgatctagaatatctaattacttttactatcgtacatattaaaatcggagatatgatgaatcgaaaagattaaaactatataaatttttatttttgtaaactttcctacatggacatacattatactaaaattatataatatgtaatgtatgatcgtgcatgtttaaaattcagcgtttcacacgtgtagtttgggacaacttcggcgtttttttggttgagtaagatgacatgtggctcgacattcataactattgtgaataaaataaattgatttatgtaatgattggacacatttgatgaagtggtttcttgaaaataagactttggatggatgcagtgtggacaaaccggtataatttgtttgcggtttagtttatctggcagacaaaaaaccgttgcagaccaagtttatttgtatgtaaaaatggtctgcagatggtccgttgcggttttcttctattttttttagatcactacgaactataattaataaataataaataaaaaacggtatgatccgttgacggttttatccgccccaaccgccataaccattcaaatcctaaataaaaacggttttgataatataagaaccagcccaaagatgaagttatatatgtgactatgttaacacacatttatagtatgagttaacctagacctatttgcgtctcacttcttattaaatgctaaaaatttaccaaaaggacgctattcatcacaattaagtttaaatctctaaattaattgatcgtttaagtttttaaccaaactcaaataaataaaaaaatatacgataacttttattgtgacgatcgaatatactaccatcaaattttataccaaatttctgtttcgtagcatgtacgaaaattttcactccaaaaaaaatctaaaaattatatttaccaaaaactgtgatttcagaaaattatgtgattttaaagaaccagtgatttctcaaattatattatatgaaatgattattattattttaaaaaggtgaaagggtgaagcaaaaaaatagtgtgcataaacaaataagctaatttgttttctggtacttaggtcttttaaatccatataaataaattcttaaaagattgttttatttcaaatctttaacctaaaattgtaactttaaattcatgattaaattttttgttttcaataatttctcgtaacttcattacataaaacgagaaggatttataataggtaaaggcgtgaagcaaaaaataattgtataaataaataagttaaatttgtttcatagtgccataaaattacactaacatctgaacgtgaaacgcacgcgcttcttcatatcatagatacgttgcgtcttaaaacacaacacgtagcaactctttttaaaaaggaaaaatacatttattattcccaacaataaaaaaaatcaaacacagtcgaagaaggcaacgacctttcgcagccgtcagatcttaataaatacagtcgccactaaaatttaacgacatagatcgaaccatgacgacctactttctttaattaattttctgtcgtgacctaatcttctatttgttgtttcattagtcacttacttttatatttattctttcttaggtctatgtggaccaaagtgattggaaaagaaaaaaaaatacatttttgtcaaccataactaaattatcttattttctcaaatgcactgtttattatgtagcgtactgatttattaaatacttttgctttctatggttaatttatgatgtcggatttttatctttcccccaataataatatcactatagaagaaagtttacaaattcttagttaaatcaaaaaagattttatcagttgatttgattatacgaggtgacatcaatttttgtcttctttaacaaaaaaaatcaatttttgttttctttaacaaaaaaaatcaatttttgtcttactttttaattagcatttagaaaaatatttaacaaataaaagttctcataagcgatttttaaaaaaatgttttgtttttactatctttcagtttttttttttaaattaattttctaaaaaaacacatatattaaaaaacatattaaaactaattataaacatattatcttttgtgatttatatttttttataattctaaaccaatgatattcaattatttatcttaaaattaaaaatttatcaataataactaataaataatgtatagaaaatttaaaaattattttttttaaaacaatttttttcctctaaaaaattaaataataaggaatagagaaggaatatttttttatctaataaattccatataataattcaattatattgataaataggttgcaaaaaataagaaagaataaatatgagaataaatggtcatctctcgatctctcagctctgtgcaactctgaacacacccacacatatatactcagatacatacatacacaccacaaaaaccaattattttccaattttaagaaaagtttctgtgtctttttttttttttttggtgataattgaaacatatgaaacaatcgtcgtcatagaagcagcagagattcaccttctttctttatctttccctctcagaaacaggaaacaaaattcaaaaagaacaaaaaaaaaaaggtcaaaccaaaacg

SEQ ID NO: 5478 - DNA, 3000 bp, Unknown
  misc_feature (1)..( 3000): cDNA_ID_3077180_gDNA_ID_1620793_Annot_ID_168391 3000 nt of promoter + ATG
ttagccattttgacacccctacatattgtatacaagtctaacttacaataataattgtagagtctattttctacagcgagtttgctaacacaatactattatcaaataccttcgattatgaaaaaaaaacattacttataataatattaaaacgtaaagttttaaaattaaactattcttgatatttttgcaatatagtttttcttctttggatttattatatgttacgtaatcgttgaagctttttttttttgaatggtgacaaaaatatcaattttcaatcaaccaaaaatgaaaatatcaatttccattataactttcaaaaagttttgagttccacagtacctatttatatacattcttcgtaaatgtcaaaacaaatcattgtagtcacacttcaacgtctttcactgaattataatcgatttgtggctatgtaaaacaatattaaaacagctgactaaaccgaaaataaaaccttacctattttgtgtatacttttttaaacaaaaaaaataatttgaaaactatgactaagggtccgaatagtgactgcgttttgtggtgtgggagaagtgtggtgcggttcaaatagtaacgaaaatacatatatatatatatatatatatatatatagaaattttgatactgttacaatactgttgcagtgcggttttgtgtacggtctatatcaccatttatagcctaatttaagtgataaaaaaccagaaaagatggcggctaaaaagctagaaaaagagtgactgtaaaaaaatttattttcacatatagattttagcaagaagactgcgacccaaatctaaacaggctgacacataattgtgttgaagtcacgctccctcacagctgggaacattatcattcatcaccaccatgtgcatttatgtgctcatcatcaatttttacattttatatcgtcaagtaaacattattaataagaaaataatgaattatctagttaattatacaaaaatacagtaagttgttttgttcaaagtcagcaaagtcgaacccatatttggctgcggaaacttcatgcgtttttgtcgcaattgccacataacgttggaagattatttcatagtcaatggacgaagttggaagttaatttgtaaaattttaccaagagcaacgaaaactataatatgtcggtaaaggcaatgatttgtaatgacaacttccacatatattgcatagtcatatattaggttacatcaaattttgtaatgactatggaactatggcgtgactaatccgttgttggacacgtacaaatgaacaaaatttggaggatagtcatatatgatataaaaaaaaaagattgttgccaatatgatacatttcactggatttatagattgtgacatccttttaccgacttatgaactacatatttttgtattttgttgtatcagtatgttaggggtcctacgttgacaacaaaatattttcatacgtctaacaaagcaaaaaatgtatttataatatgtaaacacgtcgatggttcgccgacctttcaaaccgaaagaagttgatagcactattatgaagaccgattaattaagtttgaatcggaatttgaattctaaaaagccggtttatttaaatgattaaaatgcaacctacgtcgtacttagttgattatagtttaatatgtttatggtagtcacaaaaattgtctaattagtcgcatttttatgaattcttttttctttccttgttggacaagggatgcttaactattattattcgtagggttttatgttcagagacaatgtttccaaacgattcatctacatttgacagtagaaaatcaaaatatcacaacaaaacgtgtgctttttgctttgtagctagactgtgaattagcattttcttaagttttattaattttaaaactgtgaaaggaagctaaaagtctaaaaccatatgccaccaaaatgatcctattataacttactgaatttaaacatgcattataaaccataattttgtaattgatctaaaaataaaataataattattcctctttgaagttgttacgttttggttttggtttctttatgttaaatttgatttgcttctcgaagtttgaagacaacttttacctctaaaatgactcttaaattctatgttttttgttgaaaaatatagtttgattccaattaaagtttagatatattgcgatgtattttaaatctagttatgattgatattaattttttgaatctagttatggttgatattattttactaagtacattattatcatttctttttacaaactgtattccgacacttaattttcacggtatgttttataagagaaaatatccgcaaaacatattacagagtagaataaatcctttctcctttatatttatattatttaatacttaactctatcaaaatatcctcaacatttataaatatgaaaaacaaaatcagtagtcagtgaacataaaaaaaattatcgaaaattttacgatgagtaaagatcctctctttatttctcaagtaaagcaataatcagaaaaagctaaattgagttatcaaaagcagtttatctaacaaatgttaattaactttttctggtttaatattattgttcactaaccatgcataatcgtataacaacaaaaataatctcattggtaccattacatcaaataataaatagcgggaagataaacatagaaaaagtgataaaacaatctgcttcaagaaaaagataccccagtggacgactagggtcaatgaaaatgaaaacagagacaaatggcaattcgtaattattcacatttatttcagggtactttcgtaaatccccaacctgaccgtttctcgaatctgattacgtggcagtcatcacaaatgcccacaaaagcacttcgctgaaactcaatctcagtcgttagatcagaatccaattcttttcaatacggcaagttgagatccccaaacccatcatgtgtaacc

SEQ ID NO: 5479 - DNA, 3000 bp, Unknown; identical to SEQ ID NO: 5467
  misc_feature (1)..( 3000): cDNA_ID_3077184_gDNA_ID_1620793_Annot_ID_168388 3000 nt of promoter + ATG

SEQ ID NO: 5480 - DNA, 3000 bp, Unknown
  misc_feature (1)..( 3000): cDNA_ID_3077188_gDNA_ID_1620793_Annot_ID_168387 3000 nt of promoter + ATG
cgtatctctcttttgcagaatctttcgaggcagctcgtggatcatgtaaatgtgaccgatccgccaacccgaaggttgtgccagtcaaacatgcttcaatcaggatccctcttggagagtttaggcatttcactcctggagcttggccgtgccaccatgatgcttcgtttgggacaaacacctgtgcgtattcttttgctacatattgtggatctaaatcttgcaatttttattattgatgcattagtttgcatatgattttgttcacagaatatgatacacccatacatctatatgacacttgttatgttacatgtcaggatgatgctgttgttgatgctggacctgcagtgttcatatcccctacagggcgaaatcccttgccggtctatctatttgttactttctttcaccattaccagtgtgtccacttgtcctgctcaccttacctttgtgttacctttaacttttgtagtcacactcctctcggctgggcacgagtattggaagcttacaagcaggaaccgcacattctaacccctttgcgggacaatcacttgcctctgccccaagaaatattgagataagaatacgtacaggtaagaatacgtacaggtgctattcatatccgtaatttcgaagtattaactgttctttcctgctatatattgaaaaacttcatattaagttcctttttttaatcttatatctggattcatcttggtgatgtgttatattaggatcttgggtgcccgccagtgggaccaaccagagagaggaaagtactacacaacaaacccctgggcagacaatcccttctacacccagcagcactactgatcctgccccctcaacgagaggtccatctgaacctcttcgaaatcctgtggccttagttatacctgttgttgctcgatatcagcagatatctcttggtggacgtagctctactggattggatggtgtacatcagcctgttactgaatcttctaggcagccacagagcgtcggtactccaggaagagaaggttagttctaatataacttccctacactattgtactgatttatttgttgaattgtcgataagagaaaacttcacgtctgttaccttttattactgggttgtctcatattatgtttgatttgatgtttcccttggttgttttggcttcaatcttcttagacctggtagatgatgtgttacctaaacgcaggatatgtcataaatctttgcttctatgaaatatgtaggtgatagcagtgcttctcctggcggtcggggtttgtctgaattgagaaacagaatccatcagtttttgaggcccttatctcgtcgagaaaaccaagccgggagcacggagtctcagggtgcagcaaatccctctgccacagcgtccacagaaacaaacgaagcagttgcaaatgcacaagtagagccagcaactacgacagatgaagggaatttcatatcgagtgttcttcagcagatcatgccgtttatatctcaaaacgtagcctcctcaagctcaggtgaagctgctacaggcagaggcagcaatagtagacaagcctcttcgagagaggcagaggtaccattgttttcaccttttaacatgttacttatttagttatttccttagaagccttatgcaacatgctaacttgtcatttacttgtggtgaattcgtgttggagtaattagatagtgaaagagattttattatcgtagagctttggttgtgtatagaataatacagatgggtaggagtaaaagtggtaaaccttatcaaatccggtgcttaggggttagtaaaatctgataaatggtaactggtgagaatatacaaatgtgttaatgagtgtcggttgcggataaattcgaggtgcaggaggaggaaggtacagagcgagggaattcaactcggagacctgaaccaccatcacctccagagtcaaaacgtcagagggtaaatatgaagatccatttggtttatgattcatttggtttgtgtttcatttggtttgtgtttacttaaacatgtgatgatgtttatgcagagagagtgagagattgttggagcaaaagcgaagagtggagaagcacactttttgaagaacgatagtctttttttttttttcttttcacttgtggtaatttattctgagcttttgattgttcgttcaaatggtattggtggtgttagccaaaagatctccatttttttctttttttatctccactgccaacattttcagagtttgtactcgaataataaacataagtgcatatacatagattagtactgaattatataggggaggctaaagcatgagagtcaaaagtgaagtttggtagccaaataatagactttgtgtttaaggaccacaaggacaagtttctccaatggaacacttaagcttaatgtttacaataaatgtggtcgaggttaactcttcggtggacaaaaaaattggttttgagcatttttaacttgcaggttaatttgtcattctaacagagctccgagcaacattcctacgaaagcaaaaaccacaactttgcgacaaataccctgaaacggaaacaaggatattattacctttggtaaatagtaagatctcagttgttttgatgactttttgtttgtgtattttcaagatcttgtaattccctcaacgtattgcaattttagagcatgaaccttgtattatataccaaaccaaaataatattggttggcactcttatagaaccgaactaaaccgaaaaacttaagaaacccgaaatgttttaacttttagtaaaaatagtaaaatttcatcaaacagggaacaaaattaaagagagtaaaagcaatttagaacttataaaaaggaaagccatttcttcggcatcctcttcaccaactggcataagcagaagaagaagaagaagacaacgacgacgactttgaagaagaacaaactcttccttcaatctcaatctctctctcagatg

SEQ ID NO: 5481 - DNA, 3000 bp, Unknown
  misc_feature (1)..( 3000): cDNA_ID_2150531_gDNA_ID_1620793_Annot_ID_168386 3000 nt of promoter + ATG
aaaagtccaaattaaatcaaaagatgttcaaagttgcaagagcgtcacagtatttggcgatcaccggtgctggtatcgaagacatcaagctttccaagaagtcatgggtgtttccatggcaatcttgcaccgtcttcgacgtttctccggtgaactatactttcaaagtccaagccatgagcgcagagaagcttccttttgttcttcccgctgtttttacgattggtcctcgcgttgatgacgatgacgcgctgattttgtatgctaggttgatttctcctcatgataaagattcaaatcatgtccatgagcttgttgaaggtgttattgaaggagagactcgtgttcttgctgcttccatgactatggaagagatctttaaaggtaaaccccaaatttagggttttagatgttaagtttattggtgaatatgaggatgttaaggtagatttaatttatgtagatatttttcggatttgattggtgacataaagttgtagtaagactagggttttgtataatgatttggctaagtctctttaaataaatgtcagtttgattggttataactaagacatattttgtgaaagttttggttaaaagagtttttgattttatgtatttgaagggacaaaggagtttaagaaggaggtgtttgataaggttcaactagaattaaaccagtttggtcttgtgatatacaatgccaatgtgaagcagctcgttgatgtgcctggacatgaatacttctcttacttgggtcagaagactcaaatggaagcagcaaatcaggctaggatcgatgtctctgaggccaagatgaagggagagatcggtgccaaggaacggactggtcttactctccagaacgcagccaaaattgacgctgagtcaaagatcatatcgatgcagaggcaaggagaaggaacaaaagaagaaatcaaagtgaggactgaggttaaagtgtttgagaatcagaaggaggctgatgtagctaaggccaatgccgagcttgcgatgaaaaaagctgcttggactaaggatgctcaggtggctgaggttgaagcaaccaaggccgtggctttgagagaagctgagcttcagactcaggtcgagaaaatgaacgctttgactcgaacagagaagctcaaggctgagttccttagcaaagctagtgttgagtatgaaaccaaggttcaagaagcaaattgggaactatacaacaagcagaaacaagcagaggcggttctatacgagaaacaaaagcaagccgaggcacagaaagcgcaagcggatgcggctttctactcaaagcagaaagaagcagagggacttgttgccttagctagtgcgcaagggacttatctaagaaccctcttagacgctgttcagaatgactattcttgtcttagagacttcttgatgattaacaatggtatttatcaagagatcgctaagactaatgcgatggcggttagagacttgcagcccaagattagtgtttggaaccatggtggagaacagggtggtggtagtgggaatgctatgaaggatatagctggactttacaagatgttgcctccggttcttgatacggtttatgagcagactgggatgcagccacctgcttggatcggtactctacgtggtgcggaaccgaagcaagtgactcgcagctaagagaatagtggcatggtttggtcgtttacttgtggttgaagatacatccatgcgaatgtaattttttattattttaatcctgttggaggacttggcttattcttgtgtgtgttttgaagtgtgttattgatattcttaattgaatcgtattcgtatatgttgaaaataaattaaaatgaggaataaccaaaaccagagaattatttcatttttatatattggagtcttgaactatttcaaattcaaagaacgatagctcgtcctttcgggaacaaccaaaatcaacgccctccgatatgtgggctaaataggagaaaactggttcggatggtggctagaaaataaaattttgcggttttggcggaaaaacacatcatgagaatggaaggtgttatgcgcatagtctgatgggaggtgatctagccactgactgactgactaagaattgtgttatgcgtgtagtctagcggaaggtgaaaggtaggaatagtcatttggagaattaggacgcgcttgggtcatcgaccaggacaggagcagctagctactagctgactatctgaagtcttcttcatgtgtagtttcttggaagtgggttgaagttttatcttattaggaatttgcaaaaagtctccgatcctattttattctaaaatatcatatgtcatagtcaaacaagtttgaagagattttggcaaactcaacgtcttattatcaaaatgaaaattgtaatgtatataagcttggtcatggtcaacatttaatataagatgtaactatatgctatacgtaaacatccgagattaggatctacatctattggtttaatgaattatgatttattttgtttggtttatatatggtgtacttatatactatagtttaccctaccaaaaagaaaaatatactatagtttaaaagattttgaattttatgtatttgctgtatcgtgtacatacatttttatttttttttgctaaaccgtgttcatacatataaatcttgaattttatcaaagacaatttcatcaaattttaacaaatatgattttttttgcaatacaattcagcttgacaaaatctaaatagaaagtcaagaatgaaacattcttcacaatcatcctttttttttgtgatatatacaagtttgtgaaatttctttaacatttctctaacagtgacagacaaagtcttgtaacatgtcaacgactatatgtaatatataaacacttctcacgaaacaaaaaaacaagtacagctactcattcttcgtctccaaaatcattttggcgaaaagcaatcaaatccttagatcctagac

SEQ ID NO: 5482 - DNA, 3000 bp, Unknown
  misc_feature (1)..( 3000): cDNA_ID_2150527_gDNA_ID_1620793_Annot_ID_168385 3000 nt of promoter + ATG
aaaaattaaactttgatgacaaccggagctacaaacctctccggtgaagaatctttgccgtcgccgccgtcatcgaaattaagactatagtttttcagatcataagtgaaatcaacatctctcctcatcttcttcctgccactactaaaacttcttataaagtttttccactttggtcccgcgattttctcagaaatctcttttagccccttaagtttctcacttccccaattccctcttctttcttcctgcaaacaaccactccagccaccgcgactgcgagactcgtcgtctcctctccgccaccgggtgaaactgaaactacgaaagtacccacatccacaaaacgcagccgtttcttcataatcatcggagagcagattctctctatcagtggccatgataataaaaaacaaaacagcgagtttttgattaaaggaagagactcgatactatatataggtgaatgagtttaggacacgtggcgtgtcgaccgttgggtgatagtagtgatggggtatgttgttggactgttatgagaagagtgtgacagtgatgtgagaggagcgggattaggattcgctggctaatgatgaaagacagctgtgaaggcgggagcgaaacggttgctttcttttctcttttgtctttaaggataattatgaaacgatttattgatatgactaaatattaaaactttaaacaaattagaggatatctgaaaaagtgaaaagtgattacaattattattttaagaactggttgttgatgatgatgatgataataactgatagatatttttattttgatactatatatatatatatatatatattggtttcattttcatatatataagagagaaattttgaccaaaaaaatatgattctaaaaacgttgaattaccaaatatttgtactagtttggaatgaaattccatatttttagaattttgatatcaatttgcatcttcttgtttaggtgaattcttgtagtattgatttacatataaaatcccatataaaattccctacataacatttgaatctcgttaggtaatttttagattttcatcaatattgactactattaaataacacattattttcttgacaaaaaaaaaatgaaattactaagacaataacaccctgcatttggccatttactatcaaatatcgaatatttctagattataagttgattgaaattctatagaaatttatcatctaataactaactacatcatattggtttataaggttttattagctgaaaattatagttaaaaacaacgaataaagtagtactttcaatgatgaaaaaaaaaaagtagtactttcaatattgcaataagtaagattaaaaagtgtttaagtaagacaaaaaaagaaaaaggtaaccactaaccagcctggaaactgatgattagccgtggattaaaaagcaaaactggtgtttagagatttgctaaaccaaaccaaaccaactcacaatattataaaaaggctgtcccatgttgcctaaactaatctcattattataacgatgactcactgatcacccaataatcattatgtttttgtcctaatcatcataacaaagattgcattatgaaaagtttttgtttaattaattactcgatccaatctagagtacgcagttctatctctgatgtagcatgagatagattcaaacaagacttgactaagctgatcattagtccaaccatttcaagtgatatcttcagtttttgaggcttttagatgggcctaactagtccaacaatttcagtgatacctgcaatttgggttttgatatctttcacttatagatgtttcataaaaaatccaaatcttttttactaattacaattattatatattcaataaaatcatgcagttctatttcatgaatatttaagcatagagactcatgtatttttcttagaaaatattggcaaaatgagaaaagttaggatttaaatggtatgagaagatttgtaactaaatataaaataaaatattttagtacgtatgacctctagaaagaaaaaaagtcaacaaaattaaattcataaaccgcgtggagagaaaataaaggaagatcataacaaaacaaatcaaaaaatttgctaaatataatatccgacacatctatatatacatttttgcagccactttgtaaaataaatcatggagttgagatttatttacagcggctgccactagcatttaataattgtttttgataattagaaagaaaatcttctaattaaatatttgacatttaacaatcttcccaaaatctctctaccttacctacacgattaattactaaaataaaacttccaaaatatttaatattatttaattacttcaaaattatcatttttgatattgcttttctacatgattataatcatcaatccgtatagatatttgatagcatttaattactacaaaattacaaaatatttagacaataattcataaacatatcataaataagatcaacattaataaaataaatgagttttttttagaggacaggttggcagggtttggcaggacgttacttaataacaattgtaaactataaaataaaaacattttataatatacacaatttacaaacttttatatatattattttaaaaaataaattgttctcgcggtgtaccgcgggttaaaatttagtatgattgtaaattacaaaacttaccaatttaaccacttaaaccaaaaaccaaaaagagaaaaaaaaaatcattaaaaaagagtaatttaaggattccatatttaacttcaaaataaacctaaagtacctcgccgccaataggcgatggcttcaaatatgtagtttcttggaaatgcgttgattttttctgtaagactaagtcttcgtacataacgcacgactatatatatataataagtccttaagaactcaaaacaaagtcttctaaatcatttgggcgaaaagtccaaattaaatcaaaag

SEQ ID NO: 5483 - DNA, 3000 bp, Unknown
  misc_feature (1)..( 3000): cDNA_ID_2150519_gDNA_ID_1620793_Annot_ID_168383 3000 nt of promoter + ATG
ctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatggtatataaatttcagatttttttgttctataattttataattaacgatttcataattatacttagcacaaattttaataatacacaccgacttaggtttcttgatttttgaaatcttaaaatattaaaatcaagatttgtgtttttagggataaacaagactaaaatcccaaaaaaagagcttatgatataataatggtcatgatgatgaagaaaatacaaattttgttctttgtgtttattgtgtgtttgattaatgttttttttatggtgtagacacattatgtgttgctactgtgttcatttaaagagcaattgcaacaacatgtgcgtgttcatgcaatggaagctgtgatggcttgttgggagattgagcagtctcttcaaagcttaacaggtgagaaaatgaatcctgtgattagctcatgaatccaatagttagttttatgacattgacaagttttgtgttttattggtgagattaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacaggtaataatcaacaaacttgttctttgaactagttcatgaactaacaatgtagagggctttgtcttgttgatgaaaagggttacaaggagaagatagtagacataagagaggagatattaaggaagagaagagctgggaagttaccaggagataccacctctgttctcaaagcttggtggcaatctcattccaaatggccttaccctactgtgagttcactcatctaacatctctttataacttcttcaagttcattcattgagccataaccaaatattggtttgtaggaggaagataaggcgaggttggtgcaagagacaggtttgcagctaaaacagataaacaattggttcatcaatcagagaaagaggaactggcatagcaatccatcttcttccactgtattgaagaacaaacgcaaaaggtattattatactttaatatagtcttgtaacataaccgaaaaacttatggatcggactcaaagaagactgaaacttttgtttgtctgatgaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttggattatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgtttaatgttttttgtttgtttgtctgcatgagttttttttttatgaaccatcagataatcatcatcatcatccataatatatcttgtgaataaagatagtgagagaggagaacattgggatgcacaagttttcttaatctactagtatatgttacgcattgaccaggtgcatatgttaatttgtatcgcaccacttggttagcttaatctatgtgactattatacagtatatgtttcgcattaaccgtacttaacccatcttatgattcttatccgcttagttcgtagtatttattgcgatgtcacattccaactcgtgatattggcttgataagtaaaagacattatacatggtagatgacgacaaaaaataaaacataccccatcttacataacgtagcttgctgcgtacttttgtaattgtaataatttgaaacgtgttcttttttctagtcaaaattgtttgtttatcctcatcttgttgtttcgtttgtcacgtttgtgatagccacaagttactgtaagttttcggcgagatttttctatcgatcacggagagattctgcacacattaacaaagataattagagtgtccttaagtattttggtcgcctctctattagaggaccatacaaagttcaaagactagtctcatgagaagcccattagtacattagattaaatctaggaaagtagattcatataagtagttttgtaatgaacatcaaagttgttaacttagagaattgtcatttggattgtataaatggtttgataaacgaagtctaacattagtatgtgttagtcttctaaattcaaataataatcggagttttggtctcttggacgatgcttcacagtgatattcaaaagtttaccgttatcacccaccaactagagaagccaaattaggtcttttaccaactgtagggtaaagaactgtcttcatgtaatcattataaccaccaccatcttgttatgctttgtttcttcttcaaattgcagctttcaatatacaacccggtttacgttctggtttacactttagacgtttcaatttacaaaattgggccgattgacagatattggacctggcccatcaatctaaaaatgcgctattttgaatcaaagacctatttaaatcttccgacgacgactccgttcacatagcagaaacagtggcgacaaaccctatcacggagccaacccgcattttcctctagctttcgcaccgcctctcgctctctcgccccaccggttcgtctctgacattttgtgcttgatttggccgttacaaaattctgattgctagttcatgagattcctttttgacaggtgacataaag

SEQ ID NO: 5484 - DNA, 3000 bp, Unknown; identical to SEQ ID NO: 5477
  misc_feature (1)..( 3000): cDNA_ID_1840419_gDNA_ID_1620793_Annot_ID_168382 3000 nt of promoter + ATG

SEQ ID NO: 5485 - DNA, 3000 bp, Unknown
  misc_feature (1)..( 3000): cDNA_ID_3077200_gDNA_ID_1620793_Annot_ID_168380 3000 nt of promoter + ATG
catcaggacctggtgaactttcagcattaatggaaaagacagcattatagatttcttgttctgtaattttctgagtgagatcatgattcatatcttgtgtaactttcgtttgaaaaccttccaagactgaatccatatttgcaggataagaagaggtgaacagatcctcaaaaaactgttctgctatttttcctttttccttattgagagtgtgctcaataccattttcatccaccagaaaactcaagcagtttttaattctattagcttttacagaggcctgaaaaaacttagaattcttatccccaccagccatccatttatccctacttttcaatctccagaaagattcctcctctctaaaggcaatacccaactgattttgaataacagaaatcttgttccaacacggaaattggtaactcttttcttcatccaattcaaaccttaatctcttaattcgattctcagcattataatccttcccttttttccaatgactaatagatttcctacagtcaaccagtcgatgcatagaagaagaattatgagaagaaatattacctatccatgctttgtgaataacgtcttggtattgagggtcttcagcaaatcttttatcaaatctaaaagttcctcggaaaagctcctgatcattgacaaatttcaccaaaaccggtctgtgatctgatccaagcttctccaaaaaccattgatgtgaattaggaaacaaagaaaaccactgtgaatttccaaaacagcgatctaatttacattgaatccattctccatttcttttccctccccaagtgaaactattcccagttctgcccagttcatgcatatcacaggttgataacatattcttgaagtcctgaaaggaggattctactctagatgggccacctatcttctccttattagacaagatatcattaaaatcccctatcagactccaagctgccattcgattcacaccaatgttactgattttatccagaagcaagtgtctgagattctgccttggattaccataaacacaagagataaaccatctcttacatccttgagatatttccaaatccagcaaatttttgtcttcataaagaaactctatatgaagatgttgtttccaaaatattgataatccaccactctttccttccggttcaatagtatgaaagtaatcataacccaaccacctaaaaactttcaaaataaacaggtcagaattcatggtctccatgaggaacaagatgtcagggaaatattcctttttcatttctctcaagtgccgaattgtccaagggttcctcagtccttggcaattccaactaaggatgccttattgatactgcggtggttcttgaggaaccaccgtaatgagagactttactgtactatcagatctttccgagtctgcaattttcttattccttttgatagcagaagcaaactcaatattaagactaacctctttctcttttataccagcgaaagaatcttgcctcttgtgaactaaaggagcttttctttttcttggattcttctgcttaatacttaatccagatgaaccagactcattaaacccaaagaggaatcctttagatgtaggatagtccagattaccagaaggatgactagatctttttggatcaccagtctcatggtttggaatatcatttacctccggcaatattgaatattcttggtgagtggagatagacgataactttgtaggaacaatcatctctcctggtttcagtaagcatttctttccaaaaagaaaacctgagtctacactcctatgatcttcctctgaatctctagtgtttcctacagtagcaaaggggcaaacacttttctcatgagtgagacgttgacaaaggaaacatcttttccgaatcctttcaaaatcaaaagacactgatatcatttcacccgatgggagcagaacttccttaaagttacgcaaaggatttcgaacatcaaggagcacctgaaccctaatatagtcttgtgcttgagatttttccaaatctagttccacagtcatcactttcccaacacaacctacgatttctttgatagtatcttctgtgtagtagtttatcgggatatttctgagtcgaatccaaactggaagaaacaagagtgaatcaacagaaggtttttccacccaacgctccatcaagacacatcactcatcctgagtccatactccagtttttaagatttcaattaaatcatcttctgatttgaaaaagaattgaaatctctcttgggataaagcaacacctcttacccttgaatacaatctccaaattctaggcatgtctaatatccaattagacatcctttggtgagacggattcaaaaacctgcccactatactgcagttatttctttcaatggagcaaaactgtgcttgattagacaatatcagagggctatcatcgttaattgacatttcttttatcgcttgatctaaatccatggtcatctccactactagaagaagaaagtactttcctgatacaaaaacttgatgaaacagctatgccgacagaaaacggggatatcttcggttcttggctcctctcaattatcaaaggaatgatgttgagggagaagttcttatgcccaaagcaaacgggacggcttaattaacggcaagggagaagttcttcaatagagctactatgaaagagaagagagaaaacctcttgttttttaccgagggaaatctaaacaagtcaaaatttgaataagactaaagtattaattgcttctgtcccacttaattctcccacatcttcacacgtactaatatattatacatatatatcaactaaataaaaatatcacaaataaagaactaaaacaaataaaaacgaactttaataaaatcccatatcttgtttctctctctctctcaaagttagtatctcagtacctttacgctttgtttgtctctatcttcttcctgatattcagaga

SEQ ID NO: 5486 - DNA, 3000 bp, Unknown
  misc_feature (1)..( 3000): cDNA_ID_3077207_gDNA_ID_1620793_Annot_ID_168376 3000 nt of promoter + ATG
ttcaaactaactgatctgaaatgtgtatgctaacatataagtaactagaatgcaacgcacaaaactatatgttcgcggttaaaaaaaacaaaactatatgttagaaccgagaaagtatatattatatgagtgtgattatttaaaataatttttaaaatagattgattttggtatatatagttaatttacagctgaatgaaagaaaaggacatgaatcacaatcaaaaccatttcatcacccatgtttatctatgtcgttttgggtcccatgtcacgcgtttacgacctaggccctactcatatttattcataattcttgtctgattttcccataactttgtatgtagtcccaaaacactaattgttaaatgttttccttttttatggttaaagataattgtatatattcgagtttctcattatctccaagtcgacaaaaaaaaaaaaacaattaagataagttatataatatgagtcaccaaacatatgatgagcctctatgctataaagacaaacaatctagacataattaacgaatgatctagttgttaaattcatattataagagttgcaaaaccgtagcacattttgtgtgtgtaaatctgacaaatttgcttcaattacaatttataaggatgataccttgtttaatctattttttaatgaacattgtgtatttattttgttgttgttcattgccatgcatttgggagatagatattgaatactttttctctttcagaggtatggtactagttgaaacttggaagattagtcatcactactcacacgtgccaaaatagtagcaaagagacaaaatcctcaatgcaacttaaaataaaaacagtctttgttatagctagctagcttctcaccctcacatgctttgctatattgtttgatcgaccaatacaattaaaccacgtatgaaacaaagaatagttacctaagtaaaagcgaatatgttagacatatcaaaattatttttgtttaattaaaattacagttgtagtaatgttgttatttcaaaggtacatatatatttccattatgtaacttgctgatattagcattcagtaccatccttcttttactacaccaccgagagagataagttactttcttttttttcgttttcttatggacatggatgcaaatatacagacaaaaaaaagcatatgttgaataattattagggttaagaatgattattagtagggtgaaaatgatcaattatttgataaaaagttaatgaccttctctagttgtttttcttgtcgtcataattgcggtctaggattctttcatcaatttgatactggattgaactaataatatttggcacttgttattttgatgtatccattctacctacacactcttttgcccaacatattcttctattacctcttattccaattataattgactctaaaaggatatagtctcaattggagattattttttttttaaatatgcgtgcgactgaatatgatcgacataacctttacttttatttgatgaaactttgtcgaacaaaagataaattggcaaacaaaaacatccatatataaacccaaataagaagtggttactatgtgacattccctatacaattaacatatactactatctaaaaattgtagataagtttatgcaatattatactaattccctctccaagtttcagtaatgggcataatcacatatttattaattattaaacctatgtttttaattgaaaaataatgtattagagttttttttttaataggtcgcagactcgtaggtaaactgtacactcagaaatcatgggtatgatgacaatacattaaggtttgtttcaataataacaatacaaaataatattaaagaagggaaaagagaagatgataatcgaagatggttttgggtgtttgattgagtcattatcaaaggctcacatgggtgaagaatggtgatgaaagagtctcgctagttatcaaactatatattttccaattatttatcgttattattaattagttggggaaaaatttggcagtatctatgatatagagacatgttgtgatgatcaaacccatgtgaaaataggtacagtgggtttgaagtttcaccgcagccaaatctctttggatccaacttgttcacaatgggaaaattaaaataattgataaatatatatgctatatacgtagggttgttattatatttagagctatttattagttttatcttaaaaataccccataacttaggatattataactataattgtctaagtataatatgtgtaacttgggacaaaaggaaaagaaaaaggtttggattaaattatcttaggtttgatttctaaaccgttttaattaatttatatttgttgataaaaaattagcttttgttacagaaataaattcatatgaaactattgaacatttgtaattttgtattctaacaaaaactgtgataagtttgttaattcataatttaaattctattttaacttttagataaattacgataatactttccaaaaaatatctctaaataaaaaaaacacttttccgacagtttagcatgtagtttcgaagctttcaattttcactataatatgtgacagaattagataatccatttgcccatgtcgcagcaacttcgaatacaacaaatgaagtaaatttaagaatactttaagttaaataaattaatataactctctctctcacatcaaacaaaatccatgagattttctgagtcgtattggtaatggtgtgggtccaatttaggaccaaattgattgccagtttattgccaaagaaaattttaacacaaaaacatttctctctctcatgaagctaaagccaacactacttatatagctacccttcactcttccaaaaacgctccttcactctcatcattctttcttctttcaaaacatttccacaaacacaccaaactcacctgaaaccctatttccatttaccattcacactaatg

SEQ ID NO: 5487 - DNA, 3000 bp, Unknown
  misc_feature (1)..( 3000): cDNA_ID_3077216_gDNA_ID_1620793_Annot_ID_168373 3000 nt of promoter + ATG
tgatgtatttttatatgtttatggtattcatttctagctcatgctatgcttgtcaagttgcctttgatcaagtgtgtattctaaatagttttttttttcacatcaaagaaaatcttacacttaacaatgtcttaatgatttaaattagtttacttaaggatttactaatcgtgcttgtgcgtgatgggggagatatgaaaactttttttcacattctttgccaaagaatcattggtttatctatttctaaaactatttttttttttcagttataaccgtcactcttaaaaaagatgattcttcaccacagtccatagatatgtaaaataaaaaaaaaatctcgcggaaatatatgtttattgtactgaaaaacatatacatctttatcaaatatatttgtaacgatacatttttctgaaaaaatttagtgaaatgttttatatatttttttctttataatcttggtacatatatgttcagactctgccactatataatagtatatatcctcatatacgtgaattgtttcctctctcataattcgaatatatattcattcaaatacactgcatgtttgcgttaaatacctcaagtgcattacttatctatctatttcgataaaaacaaatatgcaatggggccaattttacgttcaaatattaaatgggaatatgagaagtttttctgtcgtctaccataaatccgtaaactcgaatgtttgtcttgatgcattattgtaagatatataccatgatacataaatgtaagagtgggcaccaatctgaattagactcatttggcgatctaaggttccttttttgtcgccaagttttaaagtttttaatttctaaggttctaaaataagttacaagataatgtaatttaaatgacgaagcaattactattgcagatagttccagtgttattattaaccaggttctatttcatgctatgcaagtgcgattttttttttgtttatttaacattgtaaattttgattaagaaaaatgttagctagaaacacgcgctgtggagagcagaaaaatgtttgcataatttttggttcgctcgctagtttacataataatgattaaggatagactaatagttggcaagtgttttagtatttacaagtttcgtcattatgtggattattaattagagcctaagtttttcaggccaagtttcgagactttggtgtgtttggccatttatccaacgttttacctaaatttgatgatacgtttaaaaataaaattttaaagctgcatccactaatacaattgccccaactatacatacatactttcagtttttggactaaagcccaatagctaataggccgaaatcaaaaccaaacacatgctaaaaatattttgtacgtaacgcattatgtctaattgtatgtcaactaaaatttaatctaaaattattcgagtaatcaaatgtgtaccggtttagtattggttaatattggtttagtcattgtatataagacaagagcctctcatgcaataagattggattaagaagaataacacatatatatccaccgcttcttcttcgtttatcacttccaacaacgagactgtatctgtaaaacgcatatatgagccgttgtagataatggtattgattacgtaataactcttgttcttttttctttttttctgctgaagcaaaatccacaccaagttaaattccttttcttcggaaaaaaatctttttcaagggagttgaatccatcacttccacttaggagatttatcataggaacaacaccacattttttcttgtgtttctctttattagttcttcttaggcatgtacacagttttggtaaatatttggacatgattaatcgtaaagctgtgtgggttcaatgtatctggtctgaaactatgatatttcaactatttcgtagcattgcattaaccttaaaaaaagtcgtacaagatttgtttggacatatgtttcaatagatatatttgacttcattacaaatgaacttatcttcaaagcattccacgcagctacatacttggacgcagtccacgcagccacatctcctacgtctcttcttaaattctcacttcccaaaaaaagttataattcacttctacaaaatataaagtctctcccacagtgtaaactcttcctccacaaattttaaaggtaattttgtggatctctcgctctctagatatttctgatcatattctcttataaatatatttaattattagtaaatgttttctccagtcattcaattcaggaatgtattcttgtcttggcttacagagtgatggctcttctttgttttagatttgtcattttcttaattaattgattgaatgaatactctaaaatcttagtattatgtggaatgaatacactaatctttcaataatggaaggttcattgtttgttttagtgaaacttttacctctgagattattagatatttttttgaatattttttgttttgttttcaagacatgtttaaatagtaaacaatatttggattaaataagtagatacaaaatgtgataattaggaaaattcaaaaatttagaaatatagagtaagttgattttctcaattaagtttaccatcataaattgtcaacgaaaaacaataattaccgttcctaaaaaattgatcatcgtgaaatctaaatcctccatcaataaacatattgttttattaaaacactaaaagtctactaattttggtaaataaatcaaccaaattaacatataagagcatttccctcaaggttttttaggtgcgtttgtacaatataagtagacaattcaaaaatagtgaacaccataaacaagccaacaaacaaagtataaatttcggaagactatataagcagatagttcaaataagtctgaatgcttttaaaactatccccattactttgagccagtcaaagcctaattaactttatatactctcttctttttatttttaccataggaagacaaaatg

SEQ ID NO: 5488 - DNA, 3000 bp, Unknown; identical to SEQ ID NO: 5416
  misc_feature (1)..( 3000): cDNA_ID_2147947_gDNA_ID_1620793_Annot_ID_168366 3000 nt of promoter + ATG

SEQ ID NO: 5489 - DNA, 2835 bp, Unknown
  misc_feature (1)..( 2835): cDNA_ID_3076908_gDNA_ID_1620793_Annot_ID_168365 3000 nt of promoter + ATG
gaattcttttcgtaagtaatatgaacctctcactttgtaatatactttcattcttcacatgttgcataaattttaaaaatatgtactctttgattattacagaatattcttaacgctggaatagacacttctgcacaagttatgacatgggtgatgacatatttgatttcaaacccaagagttatgaagaaagcgcaagccgaggtgagagaagttataaaaaacaaagacgatatcattgaggaagatatagaacgactcgaatatctgaaaatggtagttaaagaaacgtttagggtattaccgctcgttccacttctaattccaagagaggcttcaaaagatgtaaagattggaggttatgacattccaaagaaaacatggatccatgtcaacatatgggctattcataggaatccaaacgtttggaaagatccagaagctttcatccccgagaggtttatggataaccagattgattataagggtttgaactttgagtttttgccgtttggtagcggaaggagaatgtgccctggtatagggatgggtatggctttggtacacttgactcttatcaatcttctttaccgatttgattggaagcttccggaaggaatggaggtagaagatgttgatcttgaagaatcatatggacttgtctgtcctaagaaagttccacttcagcttatcccggtccttacccaatggagttgattttatattttcatagttctaaatgtaacccttaagaagtatcctaaagttcttatccttatcactagatgagtatccacgctatgttgcgtttgtttttaatattcgtttttctaaatttcatatttatggaattatgtgtagacattagattattaaagacttatgttgagaaagttaactacaatgctaccatatgaaatgaacattaaaaaatagctgaaagaagtaatgtaaaacggttttttgaagtgttatgtgtctttacatttagcatgatgtacgtatcttatgttttttttggattgaggagaggcattatcatagttcgattatgcaatgtagcattgggagattttcaaaactgccgatatagaagccactacttcattttactgtttcgtgcaaaaacaagtacattcccagatgtcgtttacactctagctactgtatgatatcttgataatcatcaattgtcgatttacaaatgagcaatataatatgcacgagacacaacaatggttgatgactaaacttcagagaactttgaatccacttgtagttgtagagtatatttgcatattcaggaacttatatatatatatatatatatatatatatatatatatatatatatgtataaactaaggaaatactacataaatatattttctttttgagtttaactacatgaataagtaaaatatttacaaaacatacctggagttattctacaatggccagtaaaaaacattaaaaaaaaacttacacaaatccaatatatttatagaaatatcttattcataaaatatcataaaaagaatagcttaaaagatactaatagaaaaacatttcaaactttaagtttatgaagttttttatttataattagttagtgtttctaaataaaaaaaatgttgaaaaaacataaactttcatatttggaacgaaacaaacataaaatttaaaatgccatgtcaaaagcaattgtttttattgttttaaatttgaaaattcatgttgttttggatattattttttcatttctaaatcattcaaggagtgtatttgattattttggtggattttagaattggtctgcttttcagtgaatttcaaagatattctaatgattgttaacaaaaggcttttcgattgagtgtggttttataaactgctaaggagaattttggtatcaaagttagatacccctacacggctagtgatgaagaagacaacactaagaaaaccctgtgaattgtgaaaaagatttgttacctgcattattgttccatcactatctcacaacataaaatgtgtaagaataataacaaaacgtcttgcgtctccaatctccaaagctaaccaaaaaaaacaatcagaagaagaggaggaaagaggagtagagacgccaatagatctcacggactctcacctattgttaaaataacgccaataatttgttagtacgagatctagtaatagtagttttatttaaatacaaaaccctgtgaaagagatttgttaacttcaaaattgtacttttatttaaatactaaactgcagtaatagtggaaagactgaacaagagatcaaagtaagaatcagagcttaaacgagattatgagaaatatgagaacatgagacctgcacgattgaatgatgatgagacatgaaagggtttcggttcctttttttttacataccttaaatgttgtctactttttttttttttttcaccaaattcttatattaaaattaaaaagatacatgaagattagttttcatcggacaaacccgaataacaaacccgaataacaagtttgaaaattgaaaagttgaccaaacataactcaaacatagagacactagctgaagtaagtttgataggagaccatgagacgtttcgaaactaactaacacaagcatgcccatgagagaaatcgtaaacaacacaaaaacctcgactggtaagaaaatagtcaccgtaactagtgacattaaaacgaaattcaaaccatcaaacgtggttctaggttggaaacaacgtggatttgccttagacgcagacatagagacgtcggagaagtattcggtaaacaagcttcgctgacgatg

SEQ ID NO: 5490 - DNA, 3000 bp, Unknown
  misc_feature (1)..( 3000): cDNA_ID_1393884_gDNA_ID_1620794_Annot_ID_50487 3000 nt of promoter + ATG
aacattcaatgcatatgtcatattcatcagctgaattataaacatctaaatttatttaatgtttgatttagcatatccatattcctttctccataaactaatgcaatttgaataatctatgcagaggaatcttgaatccaaaagacggccatacaatacaagtctaaacgtggcctaccacaaactatcaccgacaaaagttattttataaaatcaaagcaaccattaaacttaaaactgacacgagatgttaatgaaaattttatattgatcatgcactgcgtcgtgtttacttttgtatgaactctcaaactttaaatctgtcaggaatgagaaactatagtctcgatacgaaattgtcaataaagcttcatattattttattcgaagtctcggtaaagatagtaattttataaatataatcagaaacggtaattttaagttataattttagaaacgggtagttcgaaataacgatttaccttattaaacatattaaaaatattaaattattgaattgtgaaagattttatgttaacatgatgttaatgtattgagtatctttgtgaaagaaaagtataagttagtccaatactgatctcataataaccgtgcagattttatagtctcatatataatcatataagcgactgtttttacattaatgtatttgtacttttatgagtgtcaacatggtctaacttcaattaatgtgtcttgcatcggactaggattagcatgacttggcagttcaagccgcaaagacgcaaaggacaccctaaacattaaatcctaacccattccaccatatgaatgagggtattgtagactaacacatatgttcttaaagtataagatatatacacattaagttaagttttctattttgaatatttttagtattatgtataaattaacaaaattattaaaaaaaactatactattgttatataaatgatgtgatgattttctttttacaaataaaagaaagatgactggaaatataattatcaaataaaaatttatgtaaatactaaaatattatatcataaattaatatgaagaaattatagatatttagaaattgaatatacagtaaattaaatattcaaaatattttatatttgtgatattatctaagactatgtatagtttagttgatgtttataatattaactcgctgatttcataaaaaataattatattatctgatcaagtaaaataatatgaaaatgttttgatcaatttgaactacttatagtattttcaatgttttcttttatataaactatttatactattttattaagttaataataatatttgttttttccgatctaattgtacattcaaaaagatcgatttagatgaaaccaaattaatattatcaaaaaaaatcatgtgtgctactctttcgtcgttttattagtttggacctcatataatatgtttttgaaacaccatttattttcattgccgatgtaaaataataatctggttgggtaatatatcttcattcaaaaaacaaaacaaaaaactaaatttggttaattatatgaatgatgtgataattcattttattattatataaggatcaataaataagaaagaagaaatataatgatcaaaactaaaaaaatatgatataattggatatcaattctttcttattcaattttgattgtcttctaattactttctgaattaattattagtgaaacataccaagggaatttaaattcttgaaatttaatacttatctaaaatatttttataccaatttcttatatttaattatatctatttggtgattacaattgtttctttaatgtatacatgagaaaactaaatataaattacatttcatgtcattttaaaattttcttagatactcttttcaaagttttcctcaattaaaagtattagattctagcagattttatatttatttttaagaactttatattcataatcatttcatttagtttttcctacattcatatatttttttggttgtcaccaatcaaaacctctgttagagtggaatcaagaaactatattccattcaatgattgtaaaatcctagacaacatcatattgttagaagaaattggcagataaattatattgatttatagataaagacaatactaagagaatagtatcatgaatgtttaactaaataaaaatgtcagtaaaaaaaaaaaaaaccaaaaaacgccaaattaggatgcaaatgtctaaatgaacggtgtggccaaagacttggtcttatctttctctctcacccactcattacaattttaaccacagtaaaaaaaaaaaaaaacagaaaatccatatctcaactcaaatccacatttctatttttactttcttcttaccttacgtttgtcttttgcggatattctccaaaaaataatccttttagattactttcctctttttttttttttttttctttcgcgtgtgattattaactcgaggtaatttctctaatcccagttaatatcacacgcggaatatcaaagatctgattttttgtaaacattgtaccaaaatcatcagaagattataagtggagtctttcgaagaagaacaaatttggtaaacatatcttttgatcctatttccttattctgggaatctacaaattccttcaacgtaacaatttgaccattgggtgttgttttgtttctctcaattttttttttttttgtatattcttcaaaatctgctaatataataaaaaaaacgtgttgagctgttaccactttgttctctctctctttgtcttttaaatttcttcaattttcatactctctaattatctcgggaacagagtttttttctcagttctcttcattacatgattacatcttctcttctctttttgttattacagtaacacgcgtctccatcaatcttctagctggcaatgagatccattctttagcttctttcttctctgttttttcttttttgaagaaaaaaaaaatg

SEQ ID NO: 5491 - DNA, 3000 bp, Unknown; identical to SEQ ID NO: 5490
  misc_feature (1)..( 3000): cDNA_ID_1393884_gDNA_ID_1620794_Annot_ID_168404 3000 nt of promoter + ATG

SEQ ID NO: 5492 - DNA, 3000 bp, Unknown
  misc_feature (1)..( 3000): cDNA_ID_3077243_gDNA_ID_1620794_Annot_ID_168421 3000 nt of promoter + ATG
aagaactctgaaaaagactgaaaacaacccaatactaaagattcaacaactgaagtcacaaccaacctaaacagccacaaaatccggtcacaaattacaacaattattcaaattggcattgaagcaaaaagggtctaagaaactcaccaaaaatctcaaattgattatggattcggtttctaattctcaggggctttaaaacacatatatatatatacgatacattagggttaaaaaaacaaggattcaaattgccaacaacttcccttcagtttcgggaaagataaactcgaattctctcattttttacgtttttgcactttaatcctctgatttttctctatttacagattccgcccagatttttgaatctctcagaaatcccctgaaaccagacagtttcaaaacgctcaatttaacccaaaatctgatcctatattttcttttaattttggatgttacaaaatcttacaaatttatgcaactgtattccattgtaaatatgatttatttcaaaattatctatgaaactgtatatatatagataaactaacaatgaaagaatatcataattattctaaaacgtaaatgttaacccaattataggtaaattaaaattttcaagagaaactgttacaaatgttcttacattgataccctttttaaaacaataccccaaaacatttctcgacaatcattttctcgtcaacaaattcagaaaaagtttcctgccaaaaacattctaacaatcccccccccccaaatcattcttgacaaaaaatttaccaccaaaaaataatgatcccataaattttgtgggaaatgtgattccaggaagtttagcgggatctggatttacaaggccattaaaagggttttaataaaaattacatgggttttataaggtttttaaaatatttataagggtttaaaaatatttacaactgttttaaaaagattcctaaaatattttatacaggattttaaagatatttacaaaggttttgaaggttttgaaggttgttcttaaaaggtttaagagaattgctggtatctttgtatctttgctggtatagaagattttaacaagatttacaagggtttaaaaaaaaattataagggtttaaaattgatatataatagttttaaaagatttatatatatttttaaaaaatagtttataaggattttctaattttttatcaaaacaattatgcgatttaattttctcattatgttcacttaataaataaagtgtaacttagtcatttaagacataaagaaaggtataactaaaaatggacaagaagagagggtattcttgaaaggaacgtttttggatagaattaactgaatttgtataatatttccaaatattcttttcaaataatgtttttaaaaatataactaaatatgctgaaaacaaattacttattttattatcaatataaaaatcaatatcatatcaccaatgtttaaatataattgaaaaggtaagatagaatttgctgtgattttattttgacttcaaatctataataagaaattaagtggaaggattgtgctatatttcatctttgactaggaaaaacaatttaatgtatatttgtgttattatctatatataactagtgtaattataggcaaaatcaaaaagagaaagttcagagaatatcataaaatgactactactatgaaaacttttgtcgcatttgttttgactgtcttttttattatgtcttctgctcattgtcgtactacaactggtggtagtccgggtaattggttattgttatatttatattatttaactatggacatgtttttgttttttgttaatgattattgattattgttaataaaacagggtatggaataggggggcgtacaaaaacatgctttacaccagctttatgtatttatcgtggagtccatgggtgcgatagttattgtaaaactaaaaattttgattacggctattgtagacaagaacattgttgttgtgttaattactaagatgaaataatttactaagtttattggtatctgattaagaaaataaatcgatagttcacattttgtttttaatacttttagacagcggaataaataaactttaccgaatcgaagtaagtttgatttttaagcaataacattttgcaatttaaccataatttataattaaatttaaatgtaacagaaaaaatggaaatgtaaaataaatggaaattcgatccaatacataccattaaaaggatgctgacccacaagagtgaagtaagcggatttcggctcaaagtcatgtttattcaataaagtcatatcactgatcgttttgcatagaataggccatgcatgttgtagtcaccaagagtcacggcacgagcattcgcaactattagacgtggaacattgttaccatgtgggccaacgactctgtttaccttgtatgccaccaatgttgtgttgtgggtgtcgtttgccaccaatgttgtgttgatagacaccaacggtcgtttgccaccaatgttgtgttgatagacaccaacggtgtgttgttcgacaacgagatttccagtttatctgtcttgtggttgctggtcaaccaccaaaattgtctcaaggataagaacccgttgttatcaagttgttgtcctgctttatcgtagacactaccatcatcatccctcaaaaatcctttatcctatatatcaaacaaaaccctatatatcgccacctaaacgatcgatcataactcccccacccttttaattagctctttaaacccaactagaaacctactctagcatggttaaggaactcatccaagtaaggtttaataaactcataagaacatgatgaataagaactgaataggtgatataaccgtatatttactgattttagctagctatgttttaggtatatgattttgagtctttatgttttttctcgaatctttttagtttcttttcaggtattctatgcaatgggacaaca

SEQ ID NO: 5493 - DNA, 3000 bp, Unknown
  misc_feature (1)..( 3000): cDNA_ID_2151143_gDNA_ID_1620794_Annot_ID_168415 3000 nt of promoter + ATG
ggaacataattggcacaaggaaagcatcttgtgggagttgtcttactggaatgacctcaatcttcgacataatattgatgtgatgcatactgagaagaattttcttgacgacatcatgaacactctcatgagtgttaaggataaatcaaaagataatatcatgtcaagattagatattgaaattttttgttctcgatcagacttacatattgatagtcagggtaaagctccatttccagcgtatgcattaaccgaagaagccaaaaagagtttattgtcatgtgtgaaacatgaggttaaattcccagatggttattcttcagatttggctacttgtgtagacatggagaatgaaaagttttcaggcatgaagagtcatgattgtcatgtttttatggagagaatactgccattttatctttgctggactccttgaccggaatgtccaccttgcattatcaggtacaataaatgttgtttaagttgccacacttttttaaacctctgatttaacttaaacatatatatatatatatatattttagggattggagcatttttccgggacttatgttcgagaactttacagaaaagtcgggttcaaattctcaaacagaacatagttttaataatctgtaacttggaaaagatctttccaccatcattttttgatgttatggaacacctacctatccatctcccatacgaacctgaattgggtggccctgtccaatatcggtggatgtacccatttgagaggtttttcaaaaagtttaaaggaaaagcaaagaacaaaagatatgcggcaggatcaattgttgagtcatatatcaatgacgagattgcttatttttcagagtactactttgccgatcatatacaaacaaaatcaaggtaaatataattatttattttacgatgcgcaagctatactttagaattaaaatcaattacatggatcaggttaacaagattcgatgaaggagaagttcatgtatatcatgtccctggagtacctaacatatttatgcacgtcggccgtccaagtggtgaactgcacgtggaatggctttcagagaaagactaccaaagcgcacacgcatatgttttaagaaattgtgactattttcaaccacttgagaggtattttaaatcactccttaatttaaaattttcattatgataagtttgatttatttatctttggttgtaaatatagtatgttcgaggattttctttttgtgaaatatccaaccttgtccgaaaaagaactctacgcgaaaagagctaaaaaatattatcaatgggttaaagaatatgtaagtctacatcattttagtaatttttaaaagtgatcatttaaattatgttgatattgttattgtttatttattatgtaggtaacatattggaaccctacttctccatttcctacttgggttcaagagattgtgcatgggcctttgaacaaggttaaaacttggccaatgtatttcacacgaggatatttgtttcatacgaaaaatcatggcgttagacgaaaaacatgtaactatggggtatgtgttaaaagagaaaattacgtggattcatctgatgaagcggatttctacggtaccttatatgatatcatagaacttcagtatgagggcatcgtcaatttgaaaatcacactttttaagtataagtggtatgatcctgtgattggtagaggcactcggcgaagccatggtggtgttgtagacgttctatcatctaggaaatacaataaatacgagccgttcattctaggtacataattaagaatacataaggttctctgttaattattaaataactttgtatttttattaatatgtataacttgtgtatgcagcatcccacgcagatcaagtttgttatattccgtatccatatacaaagaaaccaaaaagcatttggctaaatgttttaaaagttaatcctcggggaaacatttatggagaatatgaaaacaatgatccgactcttttgcaaacaaaaaatgatgaagctgtgttgctgactacaattgaagatctggtattagacaatccggtagaaagcttaaacccaatcatactcgattacgatgtcggagatgctgaaccagaagatgaattccgatgtaatttatcgtcttcaaacgatgatgaagtcgaagatgatgaagagtactaaatgtgtgctttatatgtatattaattttcctatttatatgaaatttttttgtttaagaatatatcatataatgtttaattatttgaataaatattacagaaaccttataattatcatgaatatttataattataattaatttgttgggctgtcggcatcccaagcccaagcccaaacccaataaaattaacgacggcaatacgactaatagacgatggacgtttaatgatattgggcttttaaatttcgagcccaaacccaaaagaattaacgactataatacgattaacttgcgacagacgttttatttgttgggcttagtaattccgaagcccaaacctaataatgttaacgacgatattacgactaacatgcgagacaccattaatttgttgtgcttttaaattccgaagcccaaacccaataaaaattaacgactattcaacgactattcggcgacaattgtctttattgttgggctttcatatttcgcggcccaaacccaaaaaaattagtgacgaaaatacgactacgttgcgactacctgtataaaaaaaaccctaattcgatcgattcacttctcatttcatccaaacaaaactcttcttcttcgatcttcttcttcaacttcttcttcttcgatcttcttctacaacttcttcttcgatccatttcatctcatatctacctaaacccagtcgagttcttcacctcttcttcttctcagatctgattcgaatcgaatcatcttctctttcttcgatcgtcctctttcttcgatctcttcgtctctcttcaacc

SEQ ID NO: 5494 - DNA, 375 bp, Unknown
  misc_feature (1)..( 375): cDNA_ID_3088971_gDNA_ID_1620795_Annot_ID_50495 3000 nt of promoter + ATG
agataagaactgggtggagttgaagggtaaatttgtaatccatggttcgccatcgagagtaatactataccttgaaggtccacctccacgagctgacattcttctcaacagtttagttgttcaacatgctaaaaggaatcgtccatcgcctcctcctttctacgaggtttagtccctttaccaactaaactaaatgacactagactgatggttcttatggggatactaatctgttttgtttggcagaatcctggtttcggagtcaatatagtcgaaaacagtgaagttttagatgggggaactaaaccatggttcactctagggaactgcaagttgagtgttggacaaggcgctccgcgcactctgcctccaatg

SEQ ID NO: 5495 - DNA, 3000 bp, Unknown
  misc_feature (1)..( 3000): cDNA_ID_3077329_gDNA_ID_1620795_Annot_ID_168435 3000 nt of promoter + ATG
ctccttttgtagcgcgcatctctcgggggacttgtattttctgtctggcccaatgcttctctctctctctacctctctcacatgcaaatcagcaatgacaacagtctaaagtctttcctttctttttctttttttgtcaacaagtgaaacactaaaccaaacgtcttttcttcttctgttttcttataatatgttttgtattttcggtgtgtgattagtgatctttggatggtataagaagtctgtgctttgtagtttttatgaatcgggtaagagagagataccaaagtggaaaaaatagacagttaaaccattgtatggctatttaaatttaacttggtaatttgttagtttttgaggcaaaaaaaaagattccgcttgtagtgcgtagggtagttgatgatcaggatcttaggacataaactcgcataagttctaggttaggtttgattgaaaacaaaacagattacttggacttttaagttttgttccatgtgtttcatctgaagtaataagtttgcacaaattattaccaaatagtctgcccatgtccgaattagttgggtttaacttggaacaataatgccaataaaaagacgataaaaaaggtaatggaccaataaataaattaaaaatagttaaaaaaattgagttatttgtcttaataaaaattaaatatcagaactattttctattcttaattcaactttataaaaacttttttaaaagaaaaaaaatctatacaaagttttcctgcaaatatagaaaacattttctaaaataaattgttgtatgttttgaaaagacaaagaattttagcagtattttgagtattatacctattttgttttttggactagagtattatactaaaatcaataagttggatacttgattttgtttttcttttttcctttttgatggttttgtttcatatttctatcttgtgtttcatataataaggacatctattttaatttttacaatttatcacatttactaataatgttcttaagaaaccaacaattattgaaccactattttgttactgtgcagtcatttattttctttttctcttacttaattgtctattctttaccacctaaacacttattgccaacccactaaaagataataaaaatttgttttcttagttatcttatgcgtattttgagtctaattagtcaatacatgttctatctgtaagaaatgggctatatagagtagtattaaaaaaaaaactaaatcatttttagggtgattaaagatacatttatatttcgtattttatctttaaaatatcagtttgtaagatctaggaaaaattgataatgacaataaatatgcatgtttttatataaaatagcaaagataaaatttatgttggtaatgtttaacatttgtcaaaagaactgtaaatactttcaaaataacgatttttttattggaaaaattgaacctttatacctcagaaaaaacaaaaacaatataattccacatatgaaatattgctccctatataactgtgggcaacaataatatatgaatttaattttttaaattaatacataatttttactgtagatgatttatgttaattaaaggagatggttggttggtggtcttttcaaaaatggaataatcacagtttctaactgttaataagaatgcaataaagttctaaaagatactaattcaacaataacatcaactagatatgttttatctaggttgtcaatttcttttgttcagtttaataatcattttatataaacaaaatcacaatatccttatgaatgtaaaatctttaaaatagtcttaggttttcaactttctaccatcactgtaatttaaattcaagttttcataattcaaaaaaataagttatgaaaacaatgattattttcctaaaattatatttagcgtgaaaatcgccaaaatgtcaatacataaaaattaaaaaaaaactgaaattcaatttctacatatatttacttataagtagatctatcgatctgtttaggtacttaataataaaaaatattttggttcaccgctaaaaataaactaaaatgttcacctccttttattcatgctaataagaatttaccatctaatcaaaaacttaaacttatttaactattaaaattcatatgtcaccaaaacaaaattatgtatcagtttggattgatagaattagaatttagattttataattaaataaaattatatatcagtttaggtttattaaagtgtggttagaaattaaattttataataaaataaatttatttatttattagataacaggttttgattgataaaataaaatagggtgaacaaaatagttaattgtgacaatttagataaaaacccgaaacataaaacctacacgaacacagatgatgattatagatagacacatgcacgcacgtgggctgaagcaggaggaacagtaataggtgtagtcagtcatttttttcacttcattgcactgccaaatcttttgatcactgttaatcgttgaataaaaacatccaacgcataagtcaatcccctactctcacttccactgcctctctttctttctttctttttttttcgttttccactcattaaccattacttactgactcgtagttctattttggccatttattaccgtcagttcttgtaacctggccaatttgcaaatatgtactttatttctagatttgattagcttatcatctccttttattttcttaacatttgaccattgattgaaaatgattgataagtagctatgttgtatttagagattagtttaattagtgtatctcttgagtgttttattgcaggtttagataacctcatacaagtcgttacatagttatgagtaaatgagtttattaataaatttagagaacaatctatgcctaccggtgaatttttatataataaattgaatgttttattttattgttataattgactttctaatctaaaagatagaattct

SEQ ID NO: 5496 - DNA, 3000 bp, Unknown
  misc_feature (1)..( 3000): cDNA_ID_3077307_gDNA_ID_1620795_Annot_ID_168445 3000 nt of promoter + ATG
catctttctcttgatcatcaaaccaatgtactaaacacatggacatcagatgatccaagttctatgttaggtggaaaacgttcaaactgaattggtggaatggtttgattctcttgaaagatgattagggaaagatttaaaggaatccataaccttgtttggtttggttgttaaaaagataagagaaagatttttcagcttgaagttatgtgatttaaactgtgtttttcagcttgaagttatgttgttaaatagatgcggttttagaagcttcaagttagggtagggtgttaagttaaagctctttgatattgatcacagagagcaataaatcacatagagcttttacttacacttaacctaccaagcattcaataaaatagaccataactatgataatacttttacccaatgtaaaccactccaaaatacactagttaacatgcatttatcacagttaaaaaacagttagcttttattgcttagaccaattcagagaaattttgagcgcaataactaagagagagcttttaaaagcttcaagttagtattaggtgttagaatttttttttttttttttttttttttgatcaaaggtgttagaattttatttaaccatagagaacaaatactttcttctaagcatttaaaatattaatgtaatgctatctcaactcaaaaatatattgcatttaaacagagaaacaaataaactaatcaaaagcagacaacaaataatcaaaaccggacatcaaataatcaaaagcagacatcaactaatcaaaagcagacatcaaataatcacatatcaaaagcaaaatcaacaaatcaaactcagacaacaactactagatgaattaaagaaggctcagttctaccttcgtgttatcaagaaatagtgcaatctgtagagcgtggtaagggccaggacagacaggatatcagaaatgtacttctgcaaacatagcaaatgtaatttttaagccataccaatataagaattgttaataacttgaaatcaatgatgacataccttgagattagaatcagccattgtttcatgaaacgctttaagagttacatactggggacgcagaaactttagtggtttgggaactgaagtcattgaacttgttaaagctcggatttcctgcctacaaaaccaaaaaaaaattaaaaactccaacaagggtagaacacaaggagcagaaaagaaagaaaaactttataaattatgagcttcaaagacagtaatctgaaaacccgaagctaatcaagtcaagaattacctcatactctcaagagcagccttctgcaagtccggattaggatcctgaaccatctcaacatagagcttaaggttctgctttagttccaaatcctcttaagactacaatcacaacccaatgtaagtcgagtcattagtcctgtgaacatatataaaaaaaaaaactctcctcacagcacaagttagcaactttttaatccggctatactaatgacgaacaaaacattcactttgaacatgcttattgttttgtttttgtatatctccttatgctttgtaaaaccacgtacaatactgtaattgatatgttctcgtaataagaaaagaatacgaacccacttagtcttcataattagattcatcatatcgaatcaaagatgaaaagatttattacaaaaataaaccaaattaaaaccgataaataagtttttttctactatagacacaacattccaattgccatggtgattgaacaaccataggaaaaaacgattatcatcttcatttcttctctctttgttcttttccatcctctctttgttcatttccatcttcatcattctaacttcctctttgtaacgcccgtgaaccggaaaatcagttagagtttgtttttaaatcatccggtttaattgattgggttaattggaaaccttagagtatgcctataaaagaagtaaactcgaaattagggctttggttagccacttttcgttttataaaggagaaaaagagagaaaaggagaacgagcagaatcgttagggtttgggagaaatcagtttcgtcatatcaaatcgtggtaaaaggtaacgaaatttggcagagttattcccaagtcctttatcgttattctccaatttacagaattggatttggattcaaattggttgagttattcgcagtttcgtgagacacgttttctcagacgcgaattaggaccagcggagattgaaactgagatcgtggtctcgtctgttttccgatcggcacgagattttgtggtcagctttgtgacgtctgcagctaggatttcaccggagagattgaatagttaacggttagtttgtatttgagggtttcgtctttgagactgcttgtttctggtttttcctgtccagtttgcttcaaggttgcttttggttgtggactttttgtaggacgtttctggactgtttcagacgcaaggagagtctctcctgggtttaattgctattagaatcaatttgttaaggtgagtgcgtgaccatgagcttatctgagcgatagggttgtgtgatttgttttgtgtgatgatatgtaggtgtggtgaatgtgttttggatgaattgttcaatgactggtttgtttgtattgtattcgtgattatacctttttatttgcttgtgtgtatagctcgtagatgggaggatcgcctcactaagtatttatgataatacttacgcatctcattgtgttgttgatacaggtaaagataaagtgtgatcgtggaatcatggcaaggaagagaggatgatctaggaactcgtttgttttatttttggtgtttttggttattggaacccggttaggattgttagttattcttggttttgttggtcgaattatttatttattcattaaatagtatttttgacttgtggtttaattgttattctattggttggtttaattagatatttatggaaatatttaattattttttttaaaaaaa

SEQ ID NO: 5497 - DNA, 3000 bp, Unknown
  misc_feature (1)..( 3000): cDNA_ID_3077285_gDNA_ID_1620795_Annot_ID_168461 3000 nt of promoter + ATG
tttttagcaaccttttattctagatttttatactttcgagataagctattcataaattggatccctgtttccagagttcattatagattttaatatagtgaagagatcttttctaactcttttcttcttattgattttttttatgctttcttattcaaacatgtcttgttattcaatgatcatgtatgagtagtctgcttgttagggttagggtttctaaatagggttatagatgatttagtagatcgcccatctattaggatatctgtaagattttttatctttggttattctaagtgctagttctagagtacctaactagaacttgataaataataggtctgcccaaaaaggcatctattaccagaactactatttgatgagccgagtttataggtgtgtaaacccgattagcatgcatgtttaggattagggatttgccaagcaaacgctgagaatctttagctttattcatagggagtaatgccaagttaatgctgggatattctataatagttgtttgagattaagaacggttcgataacatcctagcaactattagatctactaatcatctgttttctgagaataccctaagcctaacgttttaattatcttattttagaaccccataatctactatcgcttgttgctttctttaattatcttacctttgtctagcttgatctcgatacttatgtctattttgtgaacaaaagagctttgtcgaattcgacccttaaaaactaacgatctctttttttgagggagtaagcttaaggtcaatttgatccatatcatcttcgtataaaatgacgtactaaataatggttggtagtagtgaaagactatccaagaaatcattcaaaattccgcgatagtcattccattgaatgtaagttcactaattttacatagaggacatcttgaagacattcccgaaaatccaccatgtgaagattctgaagatcatgataccgatcttgagatgacggattcaaaaagttccaaagaagaataagaccattacagagaggattattctcttgggaatttatgttttactagattgataacccgtgcttcgctcgggtgttggtaccggatcccgcaccgatagtccaggacaaaccaaagattgccatgtaagaagaaaagggacccacatgaagcacaacttggaatgagtcccgaagttgggtgaagaatgttgtgaggtgatcacgtcgcgagatagagacgaggccgatatgagagcagtttggtttagatatgttggggcgagtgttaaagcccatgaacgtcaaagtcaattcaaattcaaacattgaggcattaagtctgaagcagaagcattaagattagataccacattcttgtataaataatgaaggtcttgaaccatgtaatatacacacgcaattctcctagcaattatactatagccattttttatatcaatccaaaagctctttacatccgatttttgtcctcaagattaacccttctcaaaaattaagtaaatatttgagtgtgtgaatccgacatccattttttttattacaagtaaacatgcaatttgagactcttttttgtgactctttttatggtcgcaactatttgcgacgttgtaaatactactttgtgactatataacgaccgacacgacatcaacgcaaaatcgtcgcaaatgtacgactccattatatagtcgaagaatggtcataaataagcgacgtttgtacgattcatttgcaacgtagtagaaatacaatttgtttttttttgaagtttcacaattgtcacaaaagagttttaaagttgtggctgttttgcctcgttttagccactctttgagaaattgcaatataagaatctagaatgattaatatgttaagtaaccatattttaccaattatttgaggtaatatacgtatagattctttctatttattttttattttacatgttttaaagcaaatctttttgaacaccaaatcatatacaagatatgttacataagcttttcaaagaaaggttaataccttatatatgttggaaaacaaacttatgaaataatctttgtatctcctacaaagaatgatatacatcataattggactgtaactgattcaaaatactcattattaatgtaattagatcttaaaattaagaaatcttaaatcttggcttgtgactcctatgcttacgtcgcaacgaagtggctcttttgcgacgactttgccattctttagcgactcctcgagatttaaattttacagtttgataatttagaatgattaatgttaactagcaaccattttggcattgatttgagctaataaattgatagattcttctttaatatattagttttacatgttttagactaaatctttgtaaaagccaaatcatgtagaagatgttacataagtttttaaaataaatgtttctaatctatgtaagtttcaaaacaaacttaaccaatgattattttcctcttaaaacggaatctatacttcagaaatggtctgttagtgatcataaacacttataactaatgtatttacatcttaaccttcagaaatgttaaataattgtttgtgactcatatcggtggtcacaaaatagcgacgtgtttgccactaccttacgacgaatttggtgacaaacattgagaccaaattgcgactattgtatttacgcgaaaatatttttagggttttgattaggcggtaaattatccctcgtgttttttcgtttgtgactaagttaagactaatgttttttgctttgtgacgactttgcgactccttttattttattactaaccactgaaaagtcactttcctcattttctctatctcgaattctcgacactaagaatttctctggggtttctctcctcaaactcgatctgattcttttgttctagggttttcactcaattggatctttctcaatctcctctctctcaatttgattattttgttctccgtg

SEQ ID NO: 5498 - DNA, 3000 bp, Unknown
  misc_feature (1)..( 3000): cDNA_ID_3077303_gDNA_ID_1620795_Annot_ID_168448 3000 nt of promoter + ATG
cacatgagtcagaaaacaaaatatgaccacatgaaaagctttataaaagtttgtgacatcatttattagttaacaatacctcagtacccaatatcaatatcaatatcattatgattagtttactaaaaacaatgtttagccaatatcaatatcaatattataacagtttgtgacatcgtttattaattaacaatacattagtacccaatatcaataacaatatcattacaattagtcaactaaaaataatgtttagtgtgtactatgtagattaaatggtttattttctttttcataaatggtaaagaataaagcttttgagtttggtatgaataatggaaatattgaagtaaattgaaaatccttttaattgatgatattctttggttttgttatcaatggaaaaaattgatatacaatgattttatggttaaaatagacataataattaaatgataaaatacttgcagtttgaagcataactaattaccttgaaatccttgattcaccacatatccgataacaccagggtaatccctccaatcccgaaacccatcctaagtatataaaaaaactagtcttattattataaagagaaactaaaattcttaagagaaactaaataaattcgatcctaagttgtctcctcctccagcaagtagtatatgttcttgaaccaaattggatctgcaataacagcttcaagcttaaatcaaagtcactatataagggtttttatgacatgttggcgattccttctatgttgcctccatctccaatgatgatgtaaccagagcattttgatctttcattggagtactcattccatcagtgatattgtactgaatgttggacacacgctctgatcgctcgtaggcattaacatgaccagcaaagatcatatcgactttgtttttgatgaaccatggctcgaacttaactctcatgctctcaccttccatatagtaataattgttgttgttgtaccatggaacgtgaaccagaacaatcagccacgaagtctctgatcggttaactttctcgagctcatccaagagccaggagttctacggtgtgtatttgtctatggtaaagtgtcacaaaagaaaaacattaacattgtaatatagagtaaaatataataaagtgtgagtcttagatcgtaccataagctgagtaagaggagagtacgatgatgcaagtcgaggcttgtttgattgagtaccaaagtggagatgtactctatgaggctctgtaaggaacgtggtagcggttcttgtacgacttgaagggttgagtctccccctacaagcggatttaatgttttaacactaaacctaaaaaagtttgaaaataaatatacagagtggatcttactatgctctaagcgtaatgcaactcgtggttccctgcagcccaaatccaaggctgatgctcggcgcttggttccacaaacctgccgtgattaccattttatttggtcttggttaggatggtcatcaacataagacaaatctccaccaaaaagcaccactaggccttttggattcgacatgtagttgtacaatttatggtttagagacatagatttgtccaagatcacctaaaaaaaaagttaaggttactgatattaggttcaaaacatttaaatcatagttgaaacttgaaactcaaagcctattcactaaaataaaaaacactcttctacgacctctaatatatcaaatatagcaagtcatatttgttaatacataatagtataatcgtgaagtaataacgttcatattgatttttacaagtttagaaatatatgcagtcctggaataaattggagtagtagaacgagaaacattaaagcacttattgaagacgagtctttaatatctcttaataactcttagaaaatctttgtaattttttaatcttaaaataattaaattatatttaattttcaacataaatccttaaaatccctaacatgactctgttgaaactatgaatctgtggactatatacctataacaccaaatgtgtaggaaacatctggaccaacttttggaggagtcatgaagttgaattgtctagtggagctaccagttccaactttatggaaatatttagttttttacttagaaggaaaaagagaggttactttacttacaaatttatatatatatacatatatatatatatattacttgggatatagtcaaataaatttataataactcaagcccttttattgtggcatgatgaagataaccatatgtgtaatcaaagtatctataggacaaagttgtcgctataacattcttattatcactacaatcactactggcaattcaatatgtaatgacattagaacaatatttatttaatggcgttacccacgagatgatcacaccttgaccatcatgatctccttacattatgtgaacatgagaaagaaccaagaatgaaagctccaagtgatgaaagaaacaaataatatgtaaacgtgattttataaagaaaaactggaatcacttgctctggagcgttatagtggtaggaggggaaaatgttttgagtggcatttcttcagatggttccgatactcggacataggcactgtgactccagcttggctaacgacaaaaatgcttaataatgcaaccacaaagcatacaagtgctaagtgattcaaccccatttcgtgtttagaaaattctaatagattctgctttgtaaatgataatttttacgacgggatcgatgtgaaatgcaaggtatatgcttttgacgatgattttatttgaaagaaaataagttagaaaagtattctaagaattattcctctttttcattttcaaacaaaaaaaatcagagagaatcatacagttttttaattttttctcccaacaactattcttattataattttatgaaaactaattaaaaaatatttgaagagcctcaaagagaatatatattcatagaaacaaaaaaggagataagatc

SEQ ID NO: 5499 - DNA, 3000 bp, Unknown
  misc_feature (1)..( 3000): cDNA_ID_3077329_gDNA_ID_1620795_Annot_ID_168436 3000 nt of promoter + ATG
aataagaatttaccatctaatcaaaaacttaaacttatttaactattaaaattcatatgtcaccaaaacaaaattatgtatcagtttggattgatagaattagaatttagattttataattaaataaaattatatatcagtttaggtttattaaagtgtggttagaaattaaattttataataaaataaatttatttatttattagataacaggttttgattgataaaataaaatagggtgaacaaaatagttaattgtgacaatttagataaaaacccgaaacataaaacctacacgaacacagatgatgattatagatagacacatgcacgcacgtgggctgaagcaggaggaacagtaataggtgtagtcagtcatttttttcacttcattgcactgccaaatcttttgatcactgttaatcgttgaataaaaacatccaacgcataagtcaatcccctactctcacttccactgcctctctttctttctttctttttttttcgttttccactcattaaccattacttactgactcgtagttctattttggccatttattaccgtcagttcttgtaacctggccaatttgcaaatatgtactttatttctagatttgattagcttatcatctccttttattttcttaacatttgaccattgattgaaaatgattgataagtagctatgttgtatttagagattagtttaattagtgtatctcttgagtgttttattgcaggtttagataacctcatacaagtcgttacatagttatgagtaaatgagtttattaataaatttagagaacaatctatgcctaccggtgaatttttatataataaattgaatgttttattttattgttataattgactttctaatctaaaagatagaattctatgaaattgtacacacttttgaaaacaattttttttttaatagaaaattataagaaattagatccatatggttatgggtattataatatttttatttatatatatatatatatatatatatatatatattcttcttgcatgaccatattaatgagaatattgggatcagagacttatttatagtgtgtttttagtctattgcacttgtgttttggaatattatgatatttaattcaaagatgtacccttaatgaatgatcttttatgatgtcaatgtttcagcatcttatactgaaacagaaaataagaggaggtcttaaaggaaaagaaaacatttcgaatgcaaaaatttaacctttaacattttcgattttttttaatgaaattctaataatattggttctaagcagctgattttatttttttaatagtaagaaataatatatgtatacatatatatttaaatatttactatcaaaatttccggcatagcaagtcataatttgtaagaaatcttacattttgttgtttacaaactctcacaagtcacaatgtaagtttcggtctagtgcagtgatgaggtaaacaaaaaaaaaaatctatcgatgagccaactttttgatctagagccctaggatttgacgatttatatataaataaaaccctaggattttcgtttctttttgtataaaaatgaattcataggcactctatacgtctcatgaatcatgaaatataaatcgagattaaatagaaaattgaatgttgaccgtggaacagaacaagtgttgaaagaagtgtgtttgcagcatggtcttatcatagagccaatagttggaaattagcagaatatcgtataatatccactatcctgtaaagcatttttataattccttttttttttctcggtttctaatgtaatcttctatccgataacaaatattcggatagtgtgatctctccactaatatacatacgaaattacgaaaactaaaattataatttcatcgatttgattaaactccaaaaacatccaagtcttgcatcaaatatgtacatttctatcatattgtttataattctttttttgttatccgtaagttttaggcagaaacccgtacagtgaaaccgaggaccagaacaagataaacgtagtcccctctcctaagtatagaattataatgtgacacatgatcacaatttgttgaacgaactctatgttcaaccactagactacaaattcttgggtttatatcgtattagaagtatatataaatcatacatattttttttaaaacttttttcttgactattcttttaagaaaaaaaaacatttcattactagaaaatagtacaaaatatatcattcaacctagcaagaaaccatagcctgaagtagccgcgaagacctagttgcttaaacactgagtggttcatcttaattcgaatattataaaccacattttaattaagtaaattacttagtcttgttctaatgtataaaatagcctatgagaggaaaacagaagagagaagcctttgccttatctcttgtcccttctctcttacctttattttaattttcaaatatttctttttgctcccaaagcaaacgacgtcttgtcaatccactcaagccacccaacttcttcattattgttaatctctctctctctctctttctctcttcttctctctttctcttttttttttttttattttcttctcttccatgtcacttccttgacgaattctatatacctagttcgttttttcttcctcaaatatatctttttcaatttatttggtttttctttgggtgcaacttcacctcacaaaattttctctctttttttatattaatttgagttaggcctttttgatttcatagatgagtcgtctagtcgtctggatttgatgtggttatagtcttacagagacctttgattgaaataagaacaaaagcaagaatacatacatcctcttcatcttacacccatccttttttatttttctagggttttatttttttttaatttattttttttctttgatttttatattctctctctctctcaaatctttactcatctgggt

SEQ ID NO: 5500 - DNA, 3000 bp, Unknown; identical to SEQ ID NO: 5499
  misc_feature (1)..( 3000): cDNA_ID_3077329_gDNA_ID_1620795_Annot_ID_50496 3000 nt of promoter + ATG

SEQ ID NO: 5501 - DNA, 3000 bp, Unknown
  misc_feature (1)..( 3000): cDNA_ID_2150917_gDNA_ID_1620796_Annot_ID_168474 3000 nt of promoter + ATG
ctataaagtttaggagattgttaagaccaaattacccttaataattttgaatagcaaagaataaaatccaaatttgaaatcaaaattgaggccaaattagacaaaatttcaatttgtacttcccttttaataataaagggatatcttgtttcattaaatttgtaaggactaaacatataattaggaagttgactaaggatttttcaacccagaatccttactaaaaatgtatatatggataactaaatttaaatacatctttcttcaatatattttcttattttacatttttataaaaaaaattaatataagactcgtaaattttaaaaatatcagtcaatgagataggtattgtgattaaatggctattgtacttaaagatgaagtaataataaatttggaaagattaataatcaattattttatttttttacaaatttaataaaatagaaatttatatttttatactttttatattatttagtgacaaaatatttagaaaactttctatattttcaaattttctttaattttcatatattgtttttttccattttacaaaaaatctaaaaaatagaagataataataatttcataaatgaagtcattatcctaataaggttttcgatctactaattccctattgagaatctctaaaagccaacaagaaaactactcaaatatgctcataaaagagcaaaacatgtttaaagtagaaatcaatgtaggaaacaagaagagaatagagtttagaatgttcttcttaagagggagctccctaggggtttagcttccatgaacaagtaagcataaagggtaaagaaaattatcaaaagttaggtctaaacaatgaactttaaaatctatatataagtttctaaaaccgtgcaaggacttcttcaaaaataaggagaagttttggggccaatttggatatatttaaaacttcaataagttgcgaaattgaattgccgtcagatattggtgtcccttgacactaggggtggtgtcgattgacacctacgcaaatttacgtctccagattgcttttgcatcataagttctctgttttgatccagaatgttccataatctcaaaatgcatcccaaacatgtaaagacctgaaaaagactataaaagagtctagaaataacaaaaaaactctaaaaaccagtattttcacgcccggtccgaccggttgaaccgtgacccgaacatttttttggtttgggtttagtgctaaaacctgacgggtgtgggttttaaaaattctcttgattttggaataaaatatgggattttagactttattcaatcatttgtagaaattttttcagttcttaaactcatttgatgttctagattttgatgaagacttcacaatgccgctttaaaaaatgaatcgaatggtgagtgagacacgcgatattagttgtgtgaattcacgatgttttattaatttatttccgtcattggtgatcttctagtatatttgttacggtattagacatttagttggatttacaaaatttaatcactttattattattgtttggtataaaggattttgtattttcattcattctgtaacgcccgtgaaccggaaaatcggttagggtttgtatataaaacatccggtttaatcggttggattaattagaaaccctatagtgtgcctataaaagaaaaaaactcgaaattagtgctttagttatccacttttcgttttataaaggagaaaaagtcagagaaagagaagaaccagaatcgttagggtttgggaggaaacgttttcgacatatcaaatctttgtaaaaggtaacgaaatttggtagggttattcccaagtcttttatagttattatccagtttatagaagttgttttggattaaaattggttgagttattcgcagtttcgtgagacacgttttttcagacgcgaattaggaccagcggggattgtaactgcgatcgtagtctcatatggtttccgatcggcacgagtttttgtgggaagcgttgtgatgtgtaaggctagcgtttcaccggagggatttaataattaacggttagtttgtattttagggtttcatctttgagactgtttgtttttgtttttcatgtacagtttgcttcaaaggttgcttttagttgtgacatgttgtaggacgtttctgaactgtttcagacgcaaggagagtctctcctgggtttaattgttattggaataattttgttaaggtgagtgcgtgagcatgagcttatctgagcgaataggttgtatgttttgttttgtgtgatgatatgtcggtgtggtaaatgtgttttgagtgaattgttcgatgattggtttgtttgtgttgtatttgtgattataccgttttatttgcttgtgtgtatagctcgtagatgggaggatcgcctcactaaatatttatgataatacttacgcatctcattgtattgttgatgcaggtaaagataaagtgtgatcgtggtatcatggcaaggaagagaggatgatctaggaactcgtttggtttacttttatgttttggttattggaacaggttagggttgtgttaggattgttagtcattcttggttttgttggttgaattatttgtttattcataaaatagtttttgtgacttgcggtttaattgttgctttattggttggtttaattagatatttatgggaatatttaattatgtttaaaaaaaatgggtcgggttgtttcaatttggtataagagcgatcacaattctaggatgtgtagaaaaattaattgatgaattattttcttgatgattgatgtgggatgagctaggatgttagcatactaaggtttgattatggagtgtttagtcaattgtgtgttgttggaggcctaccatcatcttctccgaaccttaaatgaaattccacgataagttctttgtgatatattcgtttgttctagtttcttaaccttttgtacctgagtagcgcagatg

SEQ ID NO: 5502 - DNA, 3000 bp, Unknown
  misc_feature (1)..( 3000): cDNA_ID_3077368_gDNA_ID_1620796_Annot_ID_168487 3000 nt of promoter + ATG
agtaagcttccatggaaggagaaggggaagggctaaggagaagtccatggaagaagaaaaactccggaggtgaaagaagaaaaggaaggtgattatgttgccctcgcttcaaagctgtcaatgaagccctccaagttaaacgcaaaagtggaactcatgggccgagttttcaaggaaccgtcgagacctttgtgatccatggccaaatcttgagaatggtaatcggatatcccagtccgagtgtgatccaagaatgcttgacccgaaccaaatcaaaatgacttgatccacgagagtggtttccacagctaacagaagtaagaagaaatccgatttggaaggaaagaatcggatggatttggaggattcatcggtcaagagatcgagttgaatcacccgaccaagactctatggtcgagagctagggacttgaagattttcgaggaaaagatgattaattttgtctaagtatttggagtggtaaagtgggcgaataagggttgcgttatttatagaagtgaaggaaacttggagccgaatccattcgggcgagtcatgcaagtcaaataaagcaaacttggtgaccaagtcggctcgcgtggagctgaagagaatagactaggatcccaagtcccttggtcggacaccatgcaaaatgcttgccatttgtcattgccacacggccgaattcacttccatgtgcgagtgattggaacgcgcattgccaagtgtcgatgggcttgagctaagtatcttaggactctaactcttgccaaacgaccagaccctctatataaaccaccctcctcacttccgaacattcctcttgagaatcaaaaaacgacttagaagttttcgagagtttttagtgagtcttagtgagcgtttttgaaagttctaatgagagttttcgcgagaggttttagaggagattaagagacgtttcaaggagatggcggaggaagatcttgaggagaaagtcgagtttgtgagtttgcgcccaccttttcttgttgcattttcatgctagggtttcatcattttcgaatttggttgcatgttgataagctatgcccttaatgcatgtagagcacttagaaacctcatcgttcatcttttccatgcatgtcaaaaatccgactaagttaaatgaatctcatatagaactcatcacccttcatgcttgtctttgttattcataatccggcaaggttgtgtgttgcatgtagatttctagggcttgcttgtttatgtgtttcttgcttgtttggttgtgttgcatgttttgtttcttttctttgtatgtgagtcttgtaagtcctgcttgactgtcgccatctcgaatccatggcggatgagagatgtgcattgtttgagtgtctaggtgatcgtggatgcggaatccatggatcatagattgagtctagtttagggtgcttgccattttctgcttgtgtgtgtggagccttcgagccttggtcccaaagggaacgctcgttggttagcctcggaacctaggtcgagggtgcatgacgatgcattgtggacttatctgtatccagtgtgggtttaatagagtcggacttattggtatcctatgtaggttgagtcagacttattggtatcgtgtgtgggttcatagagtatgatcttgttggtatcctgtgtgggttcaacaagtggttggtcaggttgacggatccatgtaggagaacttaacttctgacgttttgtgtgaggaggaatggagcacagggcccacatgttgagtataggttgagtctaggtcgagtctaggatagatcgagtcttgtccagtttgtgtgtcttgtgtgtttctttgcttcctcatgtttctctgatccctgttacattctttctttcttgcttgcttttgttcgttagccctctaggatagaactgcattagttggcttagagttgccataggttgtgtgctgcatggtcccgcctcactgagtaatgctagattactcatgattctacttttctttcaggcgcccgtagtctcggctgtcaagagggaagacgaacgcaaggcctccggattaggttattattttttcttagttgctttagtaaaacctgattttgtatttttacgagttttatatgcggatctgtttactaatcgtttgtttttggtaggttttattcgaatatcatttaagtacaattgttttacaaatgcggatggtttgagatgatacaaggctttgtctaagccggacaacactaggttcgccgcaatggttggcaagcctacgcggagaatctggtggagagaggaccatatgcaatttggccgagggcttggaaccctaggactttggcgagttgcgactggttctttccaatttgtgatgccacccgggacggtcatggccaggctcgggggcgttacaagcgtgtgcggcgaaggtgcggccagaagttggccacatcatcgaccagctttaggcgacaagcaggtgggtaagcttcttcagtgttttatggctgaggatcggttatgtcgggccgccataatcatgcggatgccgatcggccacatagctgtttctggttggccgacaagtaggtagtgactcagggccggctgtcgccacctcagcatccctaggacggctgtcgccacctcagcatccccaggacggctgtcaacaaatggattgcgctgggtgtctctagcggtgactcgaggccatgtgtcgccaagaggggcacgactaggggcgaggcaccgatgatgtagtagcttgataaaccgacctaaaaccctataaatactgtcgacctcattaggaaacctccacccaaaattcgctctaagttagcatagatgagaaaacccgcaaaaagttctgattcggaagtcggtaagttttccgaccttagttagtgttagtaaccgccgattagtccttaattgagtaagattatcatttgatagataaccaagtaggagaaggaaccaatg

SEQ ID NO: 5503 - DNA, 3000 bp, Unknown
  misc_feature (1)..( 3000): cDNA_ID_3077357_gDNA_ID_1620796_Annot_ID_168491 3000 nt of promoter + ATG
agtctttaccgttttatcaaattctaaaaagaaacaaagaattccttgggatgagaaatgtgaagaagcttttgggtagcttaaagcgtacctaaccactccacctgtattgtccaaacctgaactggatgagaggctctatttttacgtttcaatgtcgaatcatgcagtaagtggagtcctaatctgggaggatcacaacgaacaaaagccgatttactacataagcaagtcaatgacagatccataaactagatacacaatgatggagaagctcacatttgcggtggtgacttcagcccgtaagctacgtctatattttcaatcccaccctatcgaagagttaactaaccagccacttcgaacaatacttcacagcccaagtcagtctgaacagttggtgaagtgggcagtggagctcactgaatataatataaagttcaaaagccaagtcagcatgaaggccaaggttttagctgatttcctaaccgaactaagtacttggtgcgccagaacaaccggagagtcagacttggaaattgcatgtagacggatcttcatcaagacaaggattcggagtgggaatcaagttggagtcacccacatcggaaattcttgaacagtcattccgtctactatttagtgcttctaataatgaggcagagtatgaagccttaattgcccgacttcggctggcacaaggaattggagctgaagaagtggttgcttattgtgactcgcaattagtagttaaccagttcaatgtagactatgaggccaaagactcaagaatcgaagcatatcttgaggtagttaaagatctttctaaaagtttcaagaagtttgaactggttcgaatacctcgaaaagagaatacaccggcgaatgcactcgccatattagcatcaactttggatcctgagttataaagaatcattccagtcgaatgcatctcggagtggagcattaaagacaaaaaggaaactctcgtcattacagatctcgagcagcgacacgtgcccatggtagaattactgatataacactgtttttactgatttatctatgttttagatttaggattttgagtcttttagttatttctcgagtctttttagagtcttttcaggtattctatgaggagggacaacaatggaaatgaggagacattttggagcaaaagctaaggagaaggaagctaaggatgatttcagttccatattcagagagagtgtccatctacacactcctggtgtcgatcgacaccagtttcggcctagtaaagaccatgacgtttacaagtttataaaagtgcaaatttgccccaaaagacttccctatttgcattattagtccctgaatgttttataagacatatatatagatttagaggtcattgtttagacctaagttattttctaccaaatttccaaagagacataagctattcatccctattttcagagattcattcaattcccaatagagtgaagagatcctttcatactctaatcttattttctgtgtttatgctttcttacttaattatgttgcttgtttcaatcaatatgtctgagtagtttgcctgttaggaatagggtttctcattagggattcatatggtttagtatattcgctccccttgctaggttatctttagaattgttcatctttaattgttcttaatgctagatctagagtaattaactagatcttgaatctaaacaatagatatacctgcaataggtatatgtagatggattattatttgatgagcctggtttatagttgtgtaataagaatcggcctatctactaaggtgaacaatcgaactcgtttagaatgcatgtttaagttgaagatctctcggcttctccggttattcttaactataggcatagggagttttgcggaatgtcactggttattccataattagagtttgagtttaagaatggttcgataacaacctagctatcattagatgtactaaccaatagtttcctgagaataccctactcctatctctttatttaatcgttacacaaccttcaatctgctgtcttcttactttgtttactttttatttcaatcatttcatgctagcttaatcttgacatttgattcattgtatgaacaaaagaactttgaggaaattcgacccttaaatactgaacccgatctctttttggaaagagtaggtttaaggcaatttgaaccatatcaaatttggcgcagttgccaaagttcttggtaatcaccattgagtttagtttagagatttcgtctagtttttacttttattttgttactcacgcgtttcttgttttcttcttttctgtgtttcaggtgtatgtctaggcaaacaaagagcacacaatagaaggagttgatcaacttgtcagttcttaacttgggaaaactcgaacgtaccaacagcaaaattcagagattagcaatggctaacagagtcatcagagctgatgaggaaggagtttgagagatgaggatgggcaagcctaaaatgaggctggtcaaagattggatgatcatggactcatcgaccctgaggacgccaatgaggatcagccgcgcctcaatgcgcaattagctgtcagagacgctgcagggctcggtgtcgagcgacaccaactgggtgtcgatcgacaccttcatgaccagaacgcagatgcgattggtgtcgaacaacacaacagaggtgtcgatcgacaccaaccccagattcctatagctattcctcctgttacggatccacatcgtactcttggggatttcaacatgtcggacttattctatgattatcgatcagcgattgtatccccacctttccagaagaacgactatgagctaaagcttggctactttgctttagttggccagcatcctttccatggcttgtctcatgagcagccaatggaccacatcaagcgttttgaggaactcgttttgaggaactcgttttgagcatcagagctaatg

SEQ ID NO: 5504 - DNA, 3000 bp, Unknown
  misc_feature (1)..( 3000): cDNA_ID_3077345_gDNA_ID_1620796_Annot_ID_168500 3000 nt of promoter + ATG
aaaaccaaggtcctgctgctcctgatgctgaaatgaaacagatggtacaaccgctgctacaaggacaagcatctagctccatggaatttactaagtagttatctgaattgcaccataacctggactgcagctacaatgacctgaatgctaaagtggaggcattgaataccaaagtcagatacttggaagaacaatcagcatatacctctgcacctaaagttacaggacttcctgggaagtcaatacagaatccaaaggagtacgcaactgctcacgccatcactatctactatgatcgagagctgccaagtcaacctgtccctgacttaatccctagggacagtgatgttcaagaaggggagccttctactcagactgaggtctctgttgttgaattcaacaattctgatggttttggcgatctcattcaatccacctcggaagagaaagcaaccataattgagaggatggtaaaacgtttcaaacctactccattaccctcacgtgctcttccatggaaattgaggaaagcatggatggagagatacaagtctgttgtagcaaaacagctagacgagattgaagcagtgatgccactgatggaagttctcaacttgattcctgatcctcacaaagatgtgagaaatctaatactggaaaggatcaagatgtatcacgattcaaatgatgaatgtgatgctactccatctcgtgctactgaaaagaggattgttcaagaaaagttagaagatcctggatcttttactctaccatgttccattggtgaattagctttcagggattgcatgtgcgatctcggagcctatgtcagcttaatgcgactctttgtggcaagaaggttggaatttattcagtacagaccttgtgacctgactttgatccttgcggataggtcttcacgaaaacccttcggcatgttgaaagatctaccagtcatgattaatggagtggaagtgcctacagacttcgtggtgctggatatggaagaagagcataaggatcccctaatctcgtactttacgcgactgcgctactgatcgcagcgaaagaagagaggtcgagtatcctcagagcggtgctggccgccacagagctgatgaggtcgagtacccacctgctcgagctgatacagaacagggcggctcgtctatggcctgggagcaatcacaggcagccattgacgaccaactgataacactagattttaacctttttaagcccttgcttttcatgcatttagtttagtttcatgtcttttttcatgcattcttagtctcttttccttcttttgcacattttgcattgcattgcctagcatacttgcatttggagtgttttgcaggtgaattaggtacttttggactcaacttggaggtttctaagacaagggatggacaaactcgagttcgggggacctaaggaaggatttgaagtttactcggcctatgtactcggctggaggccgagtggagcacacgtgaaaaacaaggagcctactcgaccaaggcactcggctaaaggccgagtggtgcacttaaggaagaagagaagccacttgaccaagccactcggccaagagccgagctatgtgaccaagaccaagccactcggcttttctactcggcctagggccgagcgctcctgcgccgactttcctattttgtcttattcccaattagggcaacctaggattgtgtataaatagatctcttatgtttttacccaaaatatctttgttttgtcttctggatattagggttcttagatttcttttgcattttctggttgttgtgttgagaatttggatttcatttcttctggaaacttgtttatctcattgagatctatcatttgttaagtttataatgatttctgggttttatgaattttctgggttttgttctatgatgttcttcattgttcttgagtagtcttcttcagagttcttgaggatgggttaggtttaggtggattcctcttttctttagctagctaagtttataaatgcatgattcccttctgttttaggagttcttaatgctattttctttctgatcaattgaaaattgatttcagactttctccacctaataagtgtttgatgaaatgtctgaaccaactaatttcagagatttgtagattctagcccaagacattggatgtttagactgcttattgactttaatagattggtgtttaaagcctgctttattatgtttcatcaatgaaaattgagattaggaagttctaaagttatgagaatcattgtcacgaaagtggattgatttggttttgaatctattgtctagggatagcttgattgagtttgttagttagctaatggattgaggagtccactaagaccaattaccccattcttaagagctctgtttcgtttatttgtgcaaaactcatatttttagtactctgttcgtctcgtgcaaaattggtgtttttagtattgtactcgacctgtttactcgtttgctcgaccgagtgctttacctagtgcttggtttactttccgcttttgctgtttgagttctttattttctgcttagtgtagttttgtttctgaatttgatttgcatgttaacctgttgcttaggtttagtagaaacacaccaaacctattcacacttggcttgacttagtattctttgatcgtatcctgattgatagcaattacacccatttggattgacaccttacatgttgcaatgacataagatgcatttagggaattgacacaccgaaaacccttgtatcaatttggcgccgttgccatttgggtgtttttcttgttacatttagaatttctgagttattaagatcaagttctatttctttctttctggttactcacttgtttcttcatttgcttgtttttgttttgcaggtactcttactctactagcacgtcgagtataagcgtcgagtatcatcaaaactggattactcatttcaaatctggtcgta

SEQ ID NO: 5505 - DNA, 3000 bp, Unknown
  misc_feature (1)..( 3000): cDNA_ID_3408947_gDNA_ID_1620797_Annot_ID_168504 3000 nt of promoter + ATG
tctttacctaatggaaagggcttgttcaactgaggaaccaaaatcttgcaaagcaggtgcgagtggaccttgtccgactgggtcaagtggggaaccgggatatcgaattaaagctataccgccaaggtaggaatcagtgaaccgagctgtggcgaatatgtagtaagaccggtaaattccaaccgggtcggttttggcagtgacaagaatagagtatgattggcctacgtggatgtccaggctcgagtaaacacgtttttgaacatacgtaccctctgtctcaactagaagcatatcgtggtcttggattctgaagtttaagcatgttttgagacccacgtttgatattcttagcctatatgttttgcctgtgattatatatagacaacataaaaagaacatttgtgtgtaaactacattattaaagatataatgtaatatttttaaaagaagaaaaaaactcacctggttcaaatgcaaagaaggtctcttcagggccacgcccgttaaaaagaataccatcaggatttggcaaactgtgaccagcgtcaagtgaagctctcataaccttacaccaaaatttggaaaccaagtgttaattatgcaaatcaagcaaaacatcttttacaatgaaactaataacacattcaataaatgggcaagataaaactcaataaccaaaatgattatgatctacaaaattagtttttttatatataaaaaggatagtattggaatgtaggtttgatgataatacggtaatttatcaaagaaacatactgtatggtcgagataaaaccaatctccaatcaagatgtcgtattcttcgtcgggcttagggaatgggactgggacaagttctgggggatagattctaatagcaccgtatcctccggcagctttctgaagtagaagggtcggaaaataaaagtaacttccaatttgatccttcacctgaaaacggtacgtccaatttgtccccggtagtatgggacagtttgtccctcgaactccatcttgccacgagttcttccgcaattgcaatccattcctttaatttacatagaggtttaataacaattattcctaaaattaacccaaaacaaaaagttgaaaatatataccaagtcatgaggaagggttcgggcaaattgttgaaaatgttaacgacaatgatatcgtttgctgttgcattaaggatcggtccagggaacatgtcgttgatcactataacctatagattttttttttggtgaatactataacctatagattgatcatgcatctgaaatttcatataagatagctaaaaccatattattgtaacaaataaaaacatattcaaatgaaaatggttacctgcttgttgcctccaagaatgaaacgttgagaatacgagacgacccattgatacgatgagattggtgcaaacgcatagctcaactccaagatgaccaaagagatcagaaccaacacctcgacaaagacatgtctcatcgcgaaaagagtgatttaagaaattttaagatgcttgtgatgtgaaaaagaggtgttagaggcaagacgtagctacatatttttctttggaacaatatattaattagacgacaactattgttactctgtttggagttaacgtttgttttgtgctatgttttttgaatatgatcgaaaagttcatgcaatctgcatttccaacctaatttatgggcagcacatttgtgcttttgttaaaatttgctgggcttattcattatactaaaccatgcataaaggcccattaaatatcttattgtaatgtgacggacgaaaaaaaaaacgtgagggaggacgatggcaattgcttacgatatattgtaaagtggatgtgacctgtctgtctacacaatattacaaagatggtcgctattactcctacaaaaaataatacaacgcaaaacaattattgaaaaattattcatcacttttgtatctttcaaactttcacagttcacaccacctaaaaaacagtaaaaagtaacaacattatcactttccacaacaaaatatctaacaactttgagtatacagaaatgtacatagtacatacgtataagcaaaatgaattttgtttctccttttttttcctggtgtatatcgttgcaaacttgcaattgatcaataaaacgcaaagatattatattgaacaaataaataatttttatatagccaagatattatatggatcctcattcctcaaatataataatttacatggcccgcgattatcatgaaagacgttgaaacgtccactaatcgtacctagttgttctgaaaatgaaatgatgattttataaatgatatggttttagacttttgaagttcttcatcacttattgttagatgaaacaacaacgttgcattcaaatctcaaattcctataaatcacagataaaaaagtaattttgttttacacgtctacgtggttacaaatcctaatcacgtaactaaacagtaaagttaaagaatcttgaaaaataaagatctactttacgttttgtagatatttttaattaaaagtgaacgtcaaaaggtaattggatattttcgttaaaatgttatcaatcaaactcggacaacaattagtggtaatttaactatttaaaaaccagactaacccattatcgtatagtgctaattatgaactatgaaccgattaaacaacaaaatttactatataaaatcatcaggtgcttttcttaatctcaacggttaaaaaaaataaccaattagatgtgtccacgtaagcaggcgtaccataagctaccaaccaacacatacaccagattctcaccaacagaggaaaaaagcttctactataaagcacacatcttcttcttcatctctctttcgctctcagaatcctcttttaagtctctgtttcataaataaaactaataaagaagaagaagaaaacagagcaattaaagtccttaaatcttcttcttctccaattcaatg

SEQ ID NO: 5506 - DNA, 3000 bp, Unknown
  misc_feature (1)..( 3000): cDNA_ID_2113928_gDNA_ID_1620797_Annot_ID_168509 3000 nt of promoter + ATG
atggaaacaaaagaaaattaaaagagatcacaggttggcaattagctatataacagctgttaatgcgaataacaacacttcacagctgtcttacgaactcacttctctatcactttttcttaattttctttcctttttaatacatttcagcaaataaaggttacgtccatttttgaatctaataaataaaaaagtgttctatctctaaattattggccatcgagatatctaaacgacaaattttgttataggaaatgactacttgttatgatttaggattcatatcgtcgtctgttctcttaggttatgaattctgaatttctgatacttattctcgattgtattacatatatatatatatatatatatatatgaccctgattagtatataaactgacaaactgttaccataaaaattaaatgatattttttgataaagtttgattaaaactaatgttactattgataaagtaaactattaactatgtatatactgaaaataatgtaagttgggtgcaaatattgatttgacttaacataaagttcaatgaaacgactaccatgtccataagtatgatattatatgccagccatgataatggaagtgacattttcatgcataaagaaacatgcatgctcctcagtttttttagttttttgatttgttaaataaaaaggctatggtgtagacttcgtgaagaatgtgtgttaagtgtgcgtgcgggcgggatggggtttggagtcgataaggttggtgaaaaagccaaacactgaaaacagactatccgtgatattgacctctctctttcttcacctttccagtttttgtctattatttcgaaacgtcaatttgtataatttgtaacattttacatctactctactactgtctattatttcgaaacgtcgatttgtttctattgatattattgggtaaacattttttttctttttagagaatagttaaaaatgttataacataaccaagtgaacctaactttttatcgactcatatgaacctaagcatgatttcgactctaataataacaacgtccaaacatatcatagaaattagtttacatttgtatataactatatatatatatatatatatatatatatatatatatatatatcaattcaaagaaacaataatttcggtgttggagcccaatttgcttgttgcctagctaggggtaattagatagggacaatgcgtaaatttactctctcttttcttttgggttcagttcctattattgaaacaaaaattacatccaaaatggatataggagttgtgaccgtatgggttgtcgaatggttgtgttatatacttatatgttatttgctaaacaaagttcatctagaacctccaattcaaagccagaaatcagttaaaaatcaatatttgctaaaatgttgattcggatcattcattcatttttataaaaaggaaaaaaattaatcggttctggttaacggtccaaaaatattatgtagattaaatatatataacttttcggtactaaaaaaaaaagattaaacaaccaagagtggaaacgaaaagaaaaacaacaaagaaaagatcatggaccataagaaaaatactagtaatacttaaaaccaaacataaagattgatctagaaatcggtttaaaataaaaataaaaaagaggaaattagataaagacgaagagtgggtcataactcataagaagaagtgcaagctgtgaaatgaagcattcgcaaaaaggaccactcacgtctacttcctctcatccttcttgtctcaaccacatcaactctcttttttagctccatttttgtcattaattaattaaccatacttacaattttaatgtccttccattttctatttttgtttcttaatttcctcaaattattgtgatggattcccaagacaacggagatcaacacaaaataaaacttgaaattgagcattattgacatcatccatccataaccatatagttttggtctttcaaaattgtggtgttttccattttttcgcagatcacatacatcgtatgaagagcgttcatatttcaaaaccggaacaagaagtcattgtatacgtcaagatattagtttatgttataatataacaatctcataaaaaaaaactcactatggaagtcaaaagtcaatcgttcaacttacttattatatttacatatatcaatgaatcaggattttttggtagaaccaaaacttaccaaacccaagcgacccaaactaataatagagtttaggtctaagtacatcatagaagtcaatacaattgtacagtaatacattggcttttagtctacttctatctaaagcaagattcacataaacattgaatttcatacaatttaataagtaaaaattcgttggaaaaaaagttataccgaatccattgatcaaagttaaaacaagagaccacacataatacaaccttatttcccccaccaaaatattctcatctccgcatactcacaacttttatacgcaccaccaaccgacccattttgaaaaagagaaaataaaccacaaaaacacacataaataatatgctgataacaatgtcttaaaaatctatttaccatttctagtaatcaatatctattgcaaaaaatatttataagaatacaaatgaaaaatgataaaatacaaatgatttctcaattacctaaaaaatataaaaatgtcttactttattttcagccactgttggaaagtacttgcaatcatatcgtattttgaattataaaactcagaaacaattattttccctgaaaagttaaaacttttaataagatatttataaaataaaaagaatagtctagaccgaaaatggggtcggttgtccatccaaaggagtgctataaatagaaccctccaagttctcattaggacacaacaactaaaaccacatttatcattacagtctgatttgagctaagttctctcatcataaactctccttggagaatc

SEQ ID NO: 5507 - DNA, 3000 bp, Unknown
  misc_feature (1)..( 3000): cDNA_ID_2990351_gDNA_ID_1620797_Annot_ID_168508 3000 nt of promoter + ATG
aagacgaatatgatgaagaagaagaacaagtttacgaatcttgatcttacaacacaaaccaaaagatgaaaaaacacagaagtcacatctctatctcttttattgaaatctctattcctactattaccactatatatatatatacatgtatcaagttgaagaatctgggaaatgtgtttgtttgtttgttactttatctttgtggttctctcttattgtattttgcaacttagtttcttcttttcttctcattgcctttataataaagagtctgtccacgtatctccctctttagccttttatttcatagtattcaaaaaaacgattcttagaatcctttcagtttatagtatagacaaccaaaacattggaaacttggttgcatattcgttacaaaatcctgctatttctgctatataattatcaccccaaaaaaaggtttatcaaaaactacttaaattgataagaagagatgaatctattaaaaagcttcttagatcgaatcaaacctagtcttctttgtcttgcttgagcagctacttggactttatttggcactctctgaaaaccctcctctgctgctggaagaaggttcagatcaaagccacgtcgttccaagttatccattcgcaacgacgccgtttcaacatccctcacattgaccgtacgatcaaccgcaaaaaacggtagttgttgatcgtatcttatgggctgggctattaaaccagcttgctccctaagtaaacctgtctccgcctgtatctccacagaatattatcaaaacggaaacaaatatcaaaaatgctaaacatttttttatacaaaagggaaaacaaaaaataaaaaggtaacaatgaacacctcgaggactgaagaactctgatttttcctacaaaattcttcttctaaaccctttttaatctgtcgtttatatcaaaaacaaacacaaaaaacaattactcaataccaaatttaccacataatgaattttacacagatacaaattagaaaaatttaagaacaaacacaagaaaaacaagtctctgtttaaactgagaaaaattaagacttacgatttgagaattggttttcttggcctcaccggttaagcacgaagaactcgaattacttcccatatcgccgacatcagccatacacggcagcgattttatcaccggttccggcggatgcaggtgagaagaagaagaagacctctttttagtgcgaccccatttatgtaacacaggagaatcagaagagaatatgacaggatgtgaaagttgcaataagatagaagaaatttcgtagtcaatgctatcgaaaaaatcatctctcttcttgcctttgccgtcacggtgatcttccattgataaactctgtgtcttcttcttcttcgacattgaatgaagagagacacgaatgaatagtcttctcttcttcccggcttgaaacgattgggttaatgagataaatctttctcagaagattttgtttgtttttatttttcatataataatttgatgggtctaagcttatgacacgtgtcagtacatttttttggttaaattttcttttctcgtcttttgtttcttattttttttattttcgagtttcttgttttcgtcgtaactacctttttggccaactaatttcagtcaattttggaagtaaaaaaataggattaatccccaatatgtcatgtaaaaaaatacaaaaaattatttttatttctgatattttttcgactttcatatcttttttttatggtataatattaatttccatccaaattgggctttggcaatgggttacaacaaaaatcaatggtggtctctttctttctccaaacttagcaaaactcacacaagactttgttctgatgaagcaaaccaatgttgaatgttatgagcttaacaagtttggtaagagaggtgtgttgagtttttcttaattagtttttatgtttggagtttttgactcaccaagtttcatttgattgttcagtggcaaatgacttgaggatgaaaagaaaacaattctgatttctgactatattagagataatcatcaacaccactagaggaaagattaggagaacaagaacctcataaaataggggaaagtgggattgtatttagatattggaaagagtttagctgtattattaaaaacaaatcgattattgaaataattgcatcaatcaaatctaaaacttcctataacctatatttttataattaaagctctaatttttatttcatctactgtttaatcttaattactattatcgcacgtatattccaaatcaaattcttgaagatcaaaactgattctgcaaagatttggggagtgttagtggattgatcacctcagtacattttaagagcactatactaaattaataattaccactctaactaatataatcattttgtggaatctgatacagtctaaaatcagaaaacaagatatttacatagccgtagaaacaatcattttacaacacataaaattatgcaagaaaaaaatacaaataattatgaatcaatactacacaatccaattataatcgtttaacaattcattacaaatattttgaaatgaacttacattaagtttgaagaaaacctattcaataaagtttctctatgaatacaaagagacaaattaaaccagagtcgttggcttaccacgaatctaatttccacctaaacatacttaacaatccacgtgtcaccgtcataaagtgttaaaacttttggacttttttgttctgtaagaaaaaaggagtgatttttagcaatgggtgcgttaccaatttctccagtttcccactccacatccaaaaaaacagtgtaataataatcataatcacctgatcaatctcttacataaaagctacagatctggttttatacaatcatcaccgcaccaagttcctaaaggtttcgactttactgtttctattttcggaaagagagtgcaagattgaaatcgaag

SEQ ID NO: 5508 - DNA, 3000 bp, Unknown
  misc_feature (1)..( 3000): cDNA_ID_2164296_gDNA_ID_1620797_Annot_ID_168535 3000 nt of promoter + ATG
gatttttgtttttgtttttattttttgtcctacaaacgcatttcaataatgatttttctttgacatctaatattgtctgaaaactataaattgttttctttttgatatttttacgtattgtttccgatgcatatcgtttttgataaccatattttatggagcgaacccaaattaatggttgatgatataggtgattggcaaagtgaacacaaaaacatgtaaagactttgaaacaaattgaatactttaaatttaaattcacatttgagtgatttgagagagttaaaaatctctaagaactattccaagaaaactcacattgccttcattttgtacgtttgtttctctaaatccaataagtatgccttttttataaagcgacaaaaatacttcacagccaagattttaaagtacttgcttggttcataaagaagcatttgctcaccaaaaacaattaaatacgcaaatccttacaacatgcataactcattttttttttttttttgtcaatcgcacatctcatcttcaaggattagctagtaatataggtaagagactttatcttgagaaattggttgtgtattaattggctcgtcgataccgaagatttgatcaaatctagctatgagaattggagaagtaaaatcttactctcgtgacctgcttattatgaatatgcatgagaagtcgtcaacgattggcaatacaaggtggaatagactcgtaaattttgaaataaatataattcacaagttaaatttgagatcatgcgatggcaaaaattaggatatgaaaattggtaatcagttttgaagtaatgcgagtgttattaagagtttaaggtatgtgggttggtcgtcgattacaaatatgaaatatctttaaatatttttcaaactttgaatagaccatatacttatatactgtacatgcacaacatttaggataaagaaaaggcgaaccatcagagatataaactttaaaattaaataccaaatgcgcctaattatgattataaaatgcaaattgcgccgctaattcccgcgattccacgtgatcaaagaaactagagtgggtctgcctgcttcggctctaatgagggtacaaggtatgactgaataagtaaatcctttagtgatttaaattttaaattcgcagatttatgtacgaccaattacgtgatagtataaaatatttaattagttggtataattaatagtagctagtttaagataaaccactaacggtttttatgtactcttaactattctcatgtttatgcaattatgtgtgtgtacatatttatagttttaatttgtaaaacgagcaaaataagctaaataaccctcatatcccgtttagttatatatttttccaaaatttgaaactatatagtactgtattaacgtgaaagctaagttttctacttcgattggaataagctaaaaacctttaaaaaaaaaaaaaaaaaaaaaaaaaaaaaaaagctaaaaacctgaatacagaaataatacattatattcatgtattagtttgggtaaagatggaagacgatcacatcccttcgtcggctaataataatgactcgtgacctagaactagactagggatcgctgtccagcaaaaatcccttaaaacaaaccacatagttttttttttgtttttttttcacacaccacatagttttcttatagttcatattcaaaaagtgtttaagtttctacgatcgccctcttcatgtcgattcaatgttaataccacgtatttctgattagacgaataaataacaaaattatcaaaaaaggaaaaattaacgcacgaaggcgtcgttgaaaaagttatgtcattgaaagtctaatcgccgtgattaagcggtaaacctcacgatgagaccgtccgtgacgataaaatgtcaaaggaatgtgacgttagactatccttttcattttttctcagatttcattttttttttcctttttctttatttcagacttttatctttgccttttttgttttctcaaacttcccatatataatttcatcacaaaatagataaaccgaagtaaaaagataaacggtggggagggttttgcgggggagggacgagtggagaaaaactccctgttctaacacgtggcactctattcaccattgataaaaattaacactatgagcttaaaaagcgagctattttctattttctagtttagttttaaaagaaacaacattttcgctaagaaatttcttttaattaacacatcttaaatttttaaaatctactaaaacgaaaacgagtcattattaaattcgatacgttggttcggcgtaatatattttatactccttcatgcatattgttttgaatcctaaaaccatcgattagatatataatttgcatctgtggacaaaaaaatgacttcctacatagtaaagaaaacaacgcgtcatttaatttttatcatcttacatgtattaattagattgtaataagggattatgaaaatacctatgaaaaatgtagagaataagcatatatacatattaatggaatggaatgattactctaacaaaattacttaaaaaatgtcacctatctatttatccatattcctttttttttctttttttttcaacaatagtttgagtgatatttatgtgatggggattcactcaaactggaagataactgtagtgaagtgcccaaagcaaaagatcttcatgggactctctatgtcttaaaaactttttttctctctctctctctcttaatccaccgagtaaatccagcaaacttccactttcagagatcaaacttgagttatcttaagtgatgaagaaagactaattccatggcggcgtttgcagtttcttaagcttcctcatcatctaccgtcaatctttatagcaaagaaaaggaaatcaaatcaagatttacccttttctttgatttctctttgtggtgtgttgggtgtgtgatgttgattaccactggggaaagaa

SEQ ID NO: 5509 - DNA, 3000 bp, Unknown
  misc_feature (1)..( 3000): cDNA_ID_3077457_gDNA_ID_1620797_Annot_ID_168532 3000 nt of promoter + ATG
actgtgatgacactttcctcgcttcagatcagactattggcgtaagcgattacgtattaatttcaacaacatatatagtaagaattagaatttggattattatgcactttttacacactataaaactctaagttttagtttaattatcagctttttagtaatggtccctgtatacgtttcatgcttcaaaaaaaatatgtcaaataatgtggggcatattcattatacgttaaattaatgaaactcgcatagtggtccagcaaaatcaataaattcgttttaataaagaacattattattaaatcgctgttaagagtcgagaggtttccatattgtcctccccaccatctgcccattccgatccaactaatttccttattatattctacaaatatataaatactttaataaccaatgggatagttgttaacttctatcaacgtgaaattattttgacacaaatattatttggtttcactaaatttgtttaatttcaataatattgtgggagtagatgacctagagtaggagtttaagtgtggagcttcgaacaacgtacgagagacacggcggaccaaacgagccacgtgttgtctctcttctttgcccatcccttcttctaccttctttgaacgtcaaattcttataggttgaaatttagtttcaatgttcaaaacagaaaataatgaattaagaacataatccagcctaccagaaataatatcaaaacaaatttgccgttcatattaaaatgtttttcgccatgattatccacttgataaaatgtagtacatgagatgagactatgaagtgggacccgtctgctccctagctcacatcaaaagttataactattctactaaagtaatcttgcgttagacgctgttcacatggatgctgtattatgcgctcaaatattaatatcgaatttaagtttaaagaactgtctaaaaaactccacactgctgcactgaatctcgatttgaaatatctttgtatcaaacatgttaattactgattggcacatgtttctttattattgttttgaaaaataaaaatctacattaacttgactgatataacatttagtaacattagaactgcgggagatatatgattacaaagatcattttcaatctgagtattttcaatcattttcataccatagaaacatttataaattcttgattaaccactgcaacaatgcaacattggatcgagcttccacgactaaaagggtatttctatggactatggggactcctattatagatatttagggggcatatacatggattcttaaaagagaattacaactttcaaatcattatcatattccaatatgggttcaaagtttctttaagcatacgcctttagttaattggagaatcttttattctttaatatatataatgctttttcagggatataatgtagtaatttacaagatacagttctactagatttcactcctgaaaaagtaaactttataatctttggttgttacttgatagtggttctagattttgaaacttatccttattccttaatattttatatatctatacgaaccaattaatatctttttacttttaagaaaccatgtaaggttttatcatactaaaaagaaaaatctagttttgtctccatttgctagctaggttttcccctgttttaagactagaaaatatacgtagctaacaaatctgtataaaaaccaaaaaaaagtattaagaatcaagccgaactaaatgacatttgattttcattccatttatatatatttgaactgataaaattataactgaaattaataagcattattgggcatctaattatttatttattttgactgaacaatctttcagaattcaagatagaaataaaagcaaaataaaaataaaatgactagagaaatgtaattctaatttgtcataaaaggaaaccactgagacattatctgtttaattattgatgtagaaggaaagactcccactagtcccacttggttcgatacccgcgcttcagccttcacaccatccacgtccagtgcaaaattcttcgggcttccactatataatcttctaaacaaagataacacaataaaatataacaagatgatatattcaaatataatcttatccgatcctctattttggagttggcgtgcgtgactgcatgccatgaagtataatatagatggaaatttgaataaacatgagatcaatcggctaaaagcaaggttgtgttatatcgatcatcttaattctgatgtaaatgttttgacataagcgtacgtataggtatgatactagtaaaaatacaagtttaaacctgtctgattgttcacatttcttaagttaaattagtcaatcgaaaagtgaagttttaaagagttaatgttgtttacattcgatggtatataagtgagttttccatcatttttagtttcattatgaaaacattgtctacttcaattttttgtttccaagttaggagaattaaacagaaaatttttcattgctactatttaagttctatttattttgtttttttgaatgctatcaaacaatcgaatggaatgccaataaatttatttgaatatatcattcttatttttttttgctggaaaatataattagtttacattgaggaactaccgaactatcatgggcataattacttctcatcagtcaagctctcattatatcgctgtgttttattaatccaacaaagtaataattaattattttttttacttcatggacatctcatataaaacaagaaataattttctaggaataaaaaagaaaagaaaaagagagatataattaaacaaaaaaaaaaagatatgatttgagaaacaagaaagaaggaaaaaagaggagctgatattacataagtaccctcttacattactactccataagaagatctcacatcttctctcctatcattttcaactaccaccatctctatctctctcttaatcgatcgatg

SEQ ID NO: 5510 - DNA, 3000 bp, Unknown
  misc_feature (1)..( 3000): cDNA_ID_3077467_gDNA_ID_1620797_Annot_ID_168527 3000 nt of promoter + ATG
aaaaggaggatattaagttaattaaagggtaataagagacttaattattagtggataataaaaggtattgtttcaaataaagctccaaattacttttagcaaacatttttggatgagctggtcgatggactggcttaacattgacgtacttgtatactcaatgtaaggactaaggactaatcatttcccaatataaattgatgctaattattacatgattacttttgtgtcgttaactaatcaaggtccattttcgttattaaaaataaattaaaaaaatattgtaacacgtactataaaattcttaatgcttgaagtccgaaattaggactaaagttattcgccctcatacgtcactgcgtacttgttcattcgctccataacaaatatcatttctaccaaaacccgttttatatgattaattttcatcctataattgcaatgcaaggctgtgtcctttgcttctcttttaacttaaattatcttatagctttttgcctcttttgttttcattctactacaacccatgaggtaaccaaatctagtgttacacaaacttatttaatcatcataaataattatgatatcttttgacaaaaccttcttgattttattattagtaacaagttgaacgaccatttccagtattggcatatatttattataaagatcccattagaatatacataattttttctgaccatggttagttttacgaattataatgagatttgaaagtttcaccaaattggatttgagtctgatgctgtggatgggttttaaaaagttgtgcctaacacttatgttatcaatagatgaaacatgatctaaacaataccaaaaaagtgaaaaaatatatttctaatttatatatattcacaacacaatagacatatacataatgaaataattacgtagatctaaacagtttcatatctccattagcgagtttgtattagagttttcactgattgtacaaatttatgttgtcggagccatgaacagaaacaaaacatttatatgaatatatatttaaaatacgaggggagatagagacgtggcgaaatctgataaggagttagagatgccgaaagacgtttgcctaaacaaatccaaagtataatcctgattagcatatcttaatgcttttgttaacctaaacattgcatgtgcatttctatgtcttcactcttcttcaaacttaaaataaagcactgatatataaaacttaaaaattatttaactcgacataaaaatgaaagctaaatctatgaagcaaataaataaaaactaaagattccaaataggcttttataaagtacaatagctaactattaaccgaacttatgtttttgtgttttactcgtcatgatatgataaaattttgttataaacagtttttaaaaaaaaagtgtacatgtgagtggagaatgacaaatttcactcgtaaaaagctacattttacttaattttaagaaacattgaggaaacaaaactttaatcaggttcatcccttctgcttgtagctaatcactgcctaatacgtaacattcactgtgtacaacggagcgccgtcacttatttgtttccttctttttctggtaacacctaaacctttggactgagaaagagggtcacaagtcggtcaacgcgatttttaatttgtttgaccactcttactgaattagctggcacgccacgtcatcttctgacgctgacatgtcagcgttaaacacacgtccacatcgacgttattcagcgcctagtagacgttttccactgaagctatcaaattaattatttacaacatttatttatttctaatcacaaaatatagaatttaacaacatttatttctatttataactgaaacatattgatgtacttaaaatttaacaataaaaacgtataatgatcgactaaggatttataaggatattgttgcttcaacaaatgacattatacaaagatttttatttgatgtgatttgtgtcctattgaaaacaaattaagcgattaatttattgtttgatcccatataatatactcatttcctcaatttgtgcgtgcatgttaatgcaatttggtgcatggaggcagaaagagacaatccactgccgattcatagcatacgatcgactctcttgtaattatatctttatggagaaaaattaaataattgagttcgattcattataaccaataataataaaaatttgcagaagcattaatgaagatttgcttaggaagataaaattaaatgagaagatccttaaaacgtaacaagtggggtgagaacgtaacgtcgcatgggggggatgcatccataacatgcatttggacccacctttgtttatttcaatttttttttttaatactatttattcaatatttagatttgaaatagggcaattcaatcatctatatcaaactataatttcagtatgaaacatatatgtatatatatatatatgagtattcgacttaaataatatgataagcgaatagtatatcataaggttattatcatgccacatgcggaaaatgtgatatgtaggagtgataggaactcaaggtgtggacagtggatcattgatcaacgattttttttttttttttgtagttcaacaatttttaggcgatgaaataaatttctcacagtacttaaataatctaattgcaatgcaataagggttatagtatacttacaaactatacaatgtaattaaaagaacataatctattagtagacataatctgaaaagtttaaggataagagtaatgagtatatcagattagaccgacagtaacaatgctgatactggttaatcatgcatttggtcacatgaaaatgtacgatacagagataattaaatgtacacatttatcatcagatttacctttttcgcaatataaaatagaaaattctgttggctgcttattgctaagaaatttttgataataataactggagatggggacattcgctcacatggaagc

SEQ ID NO: 5511 - DNA, 3000 bp, Unknown
  misc_feature (1)..( 3000): cDNA_ID_3077471_gDNA_ID_1620797_Annot_ID_168526 3000 nt of promoter + ATG
aacgtctttcggcatctctaactccttatcagatttcgccacgtctctatctcccctcgtattttaaatatatattcatataaatgttttgtttctgttcatggctccgacaacataaatttgtacaatcagtgaaaactctaatacaaactcgctaatggagatatgaaactgtttagatctacgtaattatttcattatgtatatgtctattgtgttgtgaatatatataaattagaaatatattttttcacttttttggtattgtttagatcatgtttcatctattgataacataagtgttaggcacaactttttaaaacccatccacagcatcagactcaaatccaatttggtgaaactttcaaatctcattataattcgtaaaactaaccatggtcagaaaaaattatgtatattctaatgggatctttataataaatatatgccaatactggaaatggtcgttcaacttgttactaataataaaatcaagaaggttttgtcaaaagatatcataattatttatgatgattaaataagtttgtgtaacactagatttggttacctcatgggttgtagtagaatgaaaacaaaagaggcaaaaagctataagataatttaagttaaaagagaagcaaaggacacagccttgcattgcaattataggatgaaaattaatcatataaaacgggttttggtagaaatgatatttgttatggagcgaatgaacaagtacgcagtgacgtatgagggcgaataactttagtcctaatttcggacttcaagcattaagaattttatagtacgtgttacaatatttttttaatttatttttaataacgaaaatggaccttgattagttaacgacacaaaagtaatcatgtaataattagcatcaatttatattgggaaatgattagtccttagtccttacattgagtatacaagtacgtcaatgttaagccagtccatcgaccagctcatccaaaaatgtttgctaaaagtaatttggagctttatttgaaacaataccttttattatccactaataattaagtctcttattaccctttaattaacttaatatcctcctttttcgtataaattattgagtaacatgtcagcgccacaacactcgcaacttttatttagaagtgtataggtaaaattgaaagctattattatcaaaaaggggtaaagatactgatgaatttcgagaaacccgtacagtaagagagtgcccataaaaagccatgcatttagtcatattttcagcttcaaatcatcaactgcaaaattgctcgaattaactagatgtgaactaatatttctttattcttattgttatatgattggggtcagaaagttatcgaatcgttgttgtggacgaaatatgtatgaatgtatctcataatctcatatgattgggactgtggatttcaatgacaccgccaatatatcacatgaatcacacaagtagtcgttgatccttatactatattcaccaatcaccataaccttcattgtcaaatcattttaataataacattacattttaaataataaaaaatagtaatactccggtatggacgtatatggctgtgagttttttgaaccacttgatataaacagcagtactaatcattggattgagagcatctgcattcgcagagaatatatgatcatccaataatattattgagaaatatatgactcctctaggaccagtggaccagtgaaaagaaaaacaaaatataataacatcttctatcatttttctcgcaattaagctagagaagttcaaacaatttcaaagagagattcattaagtcaaagtcttagagatgtgatagtatggtacacgttagtttggagtcgtataacgcaatcattgtttttaaatcataaccaagagattggtaatgatgattatacattaattcttggctattggggcagttaggcacatgacatgaatgcaagtagaaacactgtaaggcatagtaaagatgaaggatctaactgtaattacgggtagttgtggaatataatggccgaatacttagaaaatatcatttggaattaaacgtaacaatcaagaaatggtatagctagtagcttttatgttggtcattagcagaatcactaaacataaaattgtgattgtgcaccattgaggtttagacctttatatgaacaattgaactaaacttaccaaagcgaaacctttatatgtcaatgatagggtcgtcactatcaagaaacgttattgggaagtaggacttatagttacatcaaatatcaaatacaatcatattctgtttaaaatatagcaactctaaccaatactccatactatgcttagaataaaacttaaccacattttaaaatacctaaacaatctcatgatcatgatcatgagaagatcttgagtgtccttatatttgttttatatgatatcatatcaaatatgtctgcatcacgatatatgtttgctttctctacgtttctaagatttatgtttcttgaattcttgggaagaacttgcatatgtgtttttatgatgtggctgctacaatgggcttctgggcctgttttaactggactgtagagtccattcatgatcaatagaggcccgaatataagtctactcattttaaaaccattacttaaaccataagaaaacactaaccttaaaacacacaagatttggaccaataataatcgaaaacgcagatcgccacgtatgctaatcttatccttaatcaaatatggaccgtcgaaatggcctttaatcggacgtctataaactactctcccgttaatctcccaaaattaaccgacctaataattcacctcatcactataaattcactaatctgcttcacttttctcaaaatcaaaacaacaacattcaaaagctattagcgattcttcttctctctgattcaatcttcttcatagtttctaagctctcaagttcttgacgaagcaatg

SEQ ID NO: 5512 - DNA, 3000 bp, Unknown
  misc_feature (1)..( 3000): cDNA_ID_4254705_gDNA_ID_1620797_Annot_ID_168521 3000 nt of promoter + ATG
aagaaaaaaatcttgtcataacctactttttatctttcttctttttacttcaatatttttactttatttgatagtaatttttcataaaaaaattaccacataatcaaattaatctttaaaacttttatgtgagtctaaaaagtctaaatttagttatatttcgaaaatacgtaacactttttttttaatctcaatccgacggtgtacacgatagtgtaaaaaatggtgtacaaatagtagtgtacgacgataatgtaagaagtaatgtataatattaatgtgagaagtgatataccatatatgatagtgtacgtcaccgtacaaacgaaaatatatagttgtgtacaactacctaatatgatggtgtacaaagatgtgtaaaatatagtgtatataggtatacataaaacgactagataataggtcacaccatacaccgcctcgtgcgccgtctacaatattgtacaccttcctattttgtacaccacatacataaagagagaacaatttttgtcaagtgataatgtccaaaacgatgtttataaaatagtgtacgaatttggtatataaagaagtgtacaaacattagtgtacactacgtagaaatgtataaatattacttcaaatttaatggtatgtatcatcatatttcaatttaatggtgtacatgatggtgtacacaatcatatttagtattacctatagtttacattactatcatgtttgtattaatcttatgaacaataattacttcaatttataaatatgagacaaatcgatgtatttaatgatttatgagatattataataatttttttgtatatgataatctggtgtacaaatgttagtgtacaaaactatgtttaaaatactggtgtacgaatacatgagattgatgatatataaatataaaagtcattataatattaaaaaaaaaagttatttttaaaagtatatttaaaaaaaataaaataaaaataaaaataaagaggaaatgttttaaagaaaagtggtcccatatattttttctcttatctcttaatataaaggcattttagtatttgatatatattttgtcttgtagtttattacacaaatcctctatctcacaaaaagtaaaaaaagtgtttatttctctaatttaaaaaaaaactacctagtttgtaaattatgtttgaaaaagtgtctacttttctaataaacccttaattttaaatcctgtatatgaattgattatgcaaataattaaaacttaagcttagtaaacagtgatatatctcaagttaaataactacggtcaatactgagaacttttctcggttaggattaattagcattatgaagacgtggaaccgacctgaaatgtactaatattaaatgttaattgtcgtcgaaggaacaatttctatgattgaatattaacattatacgcgagcggttgaataattctgctgattgtttagtcattttgttcgtgaaatgatgctttgtcaacatcaaacattataatgataaattgataaccataattgtaattaagcaagtcaatgttctgattatctcatacgtgtaatttcttttgatatttactttttaagtactccaccgtcaccacaaaaatccagtgaatcgtaaatacaaggtttatacaagttctatacatgacacgaataacaaatatgacaaacaaatgcgttgggcgtgtttaaaagtgtactttttcaaactataaacccgtgtttataaataaatttgatgtagaaagaagatttttattctgtctcgttggtccaactgtccttccagataaatattctaagcaacaaagaaaagttttataatgatcaagatcgccaaaatatatcccagaataaatcaattatttcgtcgaaaaatataattaattgttttaatacatttgaccatttgcatataaatctaaaaccatgtccaaaagctgctctaattaagtatatatatgttttttttttcctcatattacaaactgtaaagaaataagaatctctgcactggacagtttatgtttgcatgtgtacatatacataatacatcgaaacgtatataaaacaaaagcgaccaagatgtttgttttctattgtttattctctaattcatatgagctgtatatatatgatgcagatttgatttactctattctcaattacatttttattctgttatcgtatgatttatatagataatctagctatgtgtgttgtcaatctgtccaaataatatctttgagggaatgcattcgtttatacatgtgtacaaatatagatatccaccaaattcaatgattgatccaccgttgacaattacataattcattcatgaaactatgaacacacaggatatgtttcactctcatttctttgctttataattttcttattattatttggccatacctcagttttttatggacgtaacatgaacatcgatattatgaatctgatgattgaccgttaaaattcattgcatcaactctttacaagcttacactcattgcatcaaccgtacgttaacattcttataattttttaattcattgtttcaggttgtcaacgtcaatcttattttcgcagtaatatttaccatcatattctttcctcaacagaaacataaacattctatcacgctgcataataattcctaaatacatcacaccaaaactagtggttaataagcgacataaccaagatgaacctataagctagcaaaccacaaacttgggttttatcttctgatgtttgggcctttcctctaagcccaataaagtaatctagcatcaccaaaactgagagaacccacccacacgtttgagcatttttttaaaaaaactatttttaaccgccgttattattgttttactcccgtaaaaaaaaaaaaatctatctccctctcacaatctctcctaacaaatactacaatttggtaacagatctcatcggagcaacagtcatcaaagagccaatg

SEQ ID NO: 5513 - DNA, 3000 bp, Unknown
  misc_feature (1)..( 3000): cDNA_ID_2724473_gDNA_ID_1620797_Annot_ID_168519 3000 nt of promoter + ATG
gagaaatccatagttctttgggatatgtccggagaataagttggaactgagatttaagtacttaagactaaccaagctgctgaaaccttccggtacgacgccgccgagcaagttgtttccaagagcaaccacttgaagatccggtaaaccaaatagttcgactggtaactgaccagagattctctgtttacttatatccaaaacctgaagcttcattaatccgctaatgctaaccggtatccgacccgttaacccgcatccacttatgttgagaacactcaagcttttcagatcacccacattggacggaacttcgccggagaatctgttgaaactgagattaaggatggtaagattagctagctttgttatctccgacggtattgctccggtgagatgattttcattgagattcaatgtctcgagtccgtacaagctgagaagatccgatggaatccgacccgagaacccgtttcttccaagagatatcgttgtcaggctccgtaactgacttagaaaacccggaatctgacccgagaacttgtttccttcgaaatcaacgactcttaacgatttgcaattacggatactcgtcggaatttctccaacaagtgaattgttagctactctcagctcctgaagcgccatcaagttcccaactttagccgtaacaccaccggagaaaccgtttccagaaatatccaaaaccactaaagaggtcaaatcagtcaaccacgcgggaaaatcgccattaatgcgattctcgtgaatgtcgagaatctccaaattagggttcacgcaagctgcatttgacggcttagctattcccgtgaagttattaactcctaattgaatgattcgcatggaggaattgtaacctgaataaccacatagaagactaaccggaactgtaccggtaaatgaattctccgataatgaaatcacctgcaggcttcgaatcgtgcctaaagtaaccggaattaaaccggtgaggtgattaccggttacgctgaagtgtataagcgatgaacagttggctaatgcggatggtattgtgccttgtaattggtttgagtctagccagagatactcgaggtcttgtagttgtcccaatgtagccgggatctcaccggagaagtggttgaacgagaggttgatgagctggagagatgaatccgctgagaaattcgccggaatcttaccggatattgcattggaagacaaatcgacgtaacgaaggctcttcgagactgtgacgtcggatagatttccggtgagtgagttgtgagcagcgttgaggacctggaggtttcgtagattcagtatctccggtggaaaatcgccggagaaggagttgtagtgaagataaagagctctaaggaagacacaacgagagagagacgaaggaacggcgccgtttatgtcgttggtgtgaagacttagtttacggagctgagtcaactcaccgagtcgaggactgaggtggccggtgaggtggagacgaggaagacgaagctcacggacacggccggagaagcaagaaacgccgtgccagtcgcatggagctgatggagatgattgattccaggactcgagagctcctagagggtcgtggagagagagtttgaaagatgtgagtgcttgagtctctgatgagatggcggaggtgtggtggaatctggagaagaagattgcggcgaagtgaaggaagaaaatgaccgttgcggccattagagtggagaaaggaaagatttttatttgcagagaagaattagtgtttcgtctataatataagagaggagcgtaaaggagggagagtgtaacgacatcgttttggattccactatatggaactcttgggatggtgtgaatttttgttgttccccaaaagtaaattatataaagatgtatttgattattaaaaaatggttacctagtgcttatatctacaagatgtagattaaattcattgatcatgtctcaccaagcaacgtaaatatcatcaaaacactatgagaaaatatcttacatgcaatatggttttgtgtatgtaagtatacatgtgcgtgtatgacagtatctgcattatgttcgtagctaccaatcttgtgacaaatgttacgaccaactctgcatctctcatggctggtaaatcagaaactaccaaatcgtacatatttctcactaaaaggatattcatagcatctcatatatggttagattatgaattattatgattttcaatattcaaagcttactctttctaaaaatcgaaatccactaatcaaaatgtttttcattctatgttaaggttcctggttattagttaaggttcctggttcacccatagttcatgcaaagcaaaaggggaatttataattttataacaaaattgttttatttacagtactattagtcactatgagacatatggataatgtagacaaatagattataagaaaaatgtataacaaagacttattataccactaatctcacaaagaaagattaaacaaaaggatattttaatccaagaatcataatttctgccggaatagatggaccacaagaactagacataaagccgaaagagactagtttaatcaagtacaacaagtccttcgtgttctcttttctttgattcaaatcttgttaagtgtcatataatttgagctaagaaatcgaacacaaatccgttgtagtctagctggtcaggatactcggctctcacccgagagacccgggttcgagtcccggcaacggagtttctttttattttattttttgataaatgggcttccgacaaagcccatattttggtttgtcttaagcccgattactgtttcattaatccgatttttgctttctcatccattaggaaaaaacccaataaatgtgcacttcgtgaccttaaccgccgtcggcaaacaccgttggttttttactttcttgttcctttgtgtcgccggagatatatatcttcgacatcggtgaagaatg

SEQ ID NO: 5514 - DNA, 3000 bp, Unknown
  misc_feature (1)..( 3000): cDNA_ID_3077403_gDNA_ID_1620797_Annot_ID_168518 3000 nt of promoter + ATG
acatttcttcattgtacaatgctgttttgttcaccaaacatgttgagagaacatcatgacatggatattgtaattgtgaaagaaaaccaccagagttcaatcaaatgtttcttcttgtacttacctagtaaccatgtctacctcgtcaagcacattgattcagtttgtaatactaaatctatcctcttgcgttatggaatcagctttccttgacctcaaagcagttaccatgtccgacaaagcgcctgccattttccccaatgctgctggatcaaatatggctcggtctcaaagaggtctttgaatccggttcactcttcctttttctatccaccaaatgtgtgtttgcttgcgctacaattggtgatgatacattgtctgttgccaatgactcttctgaaccctcaaagttaattgattacttactgttgaagttaagcatatcatcttttttaatttgatttaatatttttcttcataggcatagtggcccatatttaacctcacataatcaaagtttttaaaattattattaaaaatccaaattgaaaactttaatgctaaatctacataataataggaaaaacaagttgaatgtttggaatcgcttacgactaatgctggatccaaaatccggttagttttcatatcattatgtaaatttaatatccaaacaaataaaaacattaaagaaaagttttttaaattctgaaaaaaagaaaaacaaaatcaaaatcttaaaaagtatttttaaaaatccgaatgaaaaacttgaatgctagatctacataataatatgaaaacaagttgaatgtttggaattgctaacggctaatgctggatccaaaatccggttaatttttctatcattttttttttggtaggctattttctatcattatataaagttagcatcctaataaaataaaaaacaaatataaaagattaaaatccgaaaaaacaaaatcaaaattttaaaaacaatttttaaaaatctcaattaataatttgaatgctaaatctatataataatagaaaaacaggtcgaatgtttggaatcgctaatgacgaatgctggatccaaaatccagttaattttttttttatcattatataaagttagcatccaaataaataaataaaaagacaaacaaaagagaaaaaaaaaaaaaatccgaaaagaaacaaaatcaaagttttaaaaaattatttttaaaaatttaaattgaaaacttgaatgctaaatctacataataatatgaaaacaaattaaatatttggaatcgctaacggctaatgctggatccaaaatccggttagtttcgtatcattatataaatttaacatctaaaaaataaaattaaaattaaaattaaaaacaaacacaaaatatatcaaaatctttattagaaaaaaaaaaaggaaattaagaatcaacgaacctgactcatggtggactaaatggattatgactctctcggcatgactcatggattgttgtttactaaagcccattcgttgtaatctgaagcccatcgattcttccttgacttgggccgaaactgcaatttttgatgatgaagaagatctcgcttttcaggtctgaaactctgaaccaccaaaaccccagatcttgtcgtcactttcactcgcgattctctttgtgacgattatattttgccgaaagtttagatgcatccagtttttgcgtcacgtcaaactagtttctggaactcaaagtaatcttcctccataattagcccgcgatcgtgaaaaattgatcaaacacgagagacctctttcgacatgacgttggtacagtacggcaatgtatatgggtcataaatttcacggtcacgatagatcagcgatcctttttgtaaaacagtcgcagagaaagagaataatttttttagggtttagaagaaggagttatgatttcttaaggaaggaaggaaaagatgaatatttatgacgagagaggttcacgcaacaaaaaggaaacatcagattgttgttttccttttttcatgtttggacttataagaaaaaaggaaattaatcaagtttacaacggtcttatttttctaactgcaaaagagtacgtgttagaattttattatacaacggtctatttttcacgcgcctacgcgcatcatccttgccgtatcttctctcgaagcttcccatccaaattcagcttcttccgctgccagttccactttgatgaaaaataaaagcccaggcccaataaccccaaattcttttttaatttgatttaatattttttcttcgtaggcatagtggcccatatttaacctcacaatagaggatacaccaggatcgaagcctggcttgataagataatggcaacaacaatgaaccaccactcgcccaattgttccttcttaacgtgtaaagtttgttgttcccataagtaaaaatattcatatataactaaatattcaattttatattttgagctaaaaaaataattttattatttagcaatttattgtttttttttatcatattatatttacttattaatgtggacaactaattaaattatagagcgaccgacaattgtgacagtgacactggagttggactcggctcaatttaaaggggtagttcagtaatcatacctcacattactacactcttgattaatatataaaaccaaatcagtttttaaaaataagggaaaatcctaataaaggagaagaaaaacagatctgaaatcccgcttgatactccaccgactttaaactactggtttttgtttgatttaagtatagtgttaatgactcctctctccaccttcctttgattctacctatcacttcccttgccgttgctccatcttcatcactagtcactatacaccaatcttagatccgggaagctaatttctcttctccgatcggtgaatgcagttacattgacctcggatctaaccaagctcttctggtttccagctctctggaattcaaaaaa

SEQ ID NO: 5515 - DNA, 3000 bp, Unknown
  misc_feature (1)..( 3000): cDNA_ID_3077409_gDNA_ID_1620797_Annot_ID_168516 3000 nt of promoter + ATG
tttgtgacaaactcaagaagatacctctctagatacaaaatggtgttactgtgcctaatgtattattcgtttaccatgttataaaatgcacgtgtgatttggggtatgaaaagttggcaaaacggtttaaatatatggaaaaaatagagacaattgtgtccccatttcatatagtcataatactttatactgttcatatccattagtagaatttgcatcacctttgaagtactttactgtatcacgttccatcttctaaagcaaacttctactgtaaaagtttacagtaaaaccatagtcatatgcctaaaggaattgccatgaaagtgttgaatacattgtgatcatacagtatatatgaaaagcatgcggactattttgatactagaaaccttgtaacaactacaatgtatttcttttcaaacactcattctaaaatcaaataaattgtagaaaataagatgtgagaaaatgattctggttttggtctttaccacctataattgtgttatcttttgtttgttatgttgctgttttggttagaagtagagtccaaattaggagttcgcatcagtttggctcatagagaatcaaacaaattggtgaaaaaagaagaagaagagattctagctgacactcttttgtttcacactgaatcatacaacaagcttcatatcaattaatgcaattgattgagtagatagatatacaacaactatcattcaaaaatggtccctaatttttatagtaaattcatcaatcattcggttgcatccttcttcaattattgatttctctacacaactcattaatttatgaagttctgcattcgttattgataaatttggtaatttgtacgtacacatacaatgccatattggataggccatctctagaatttttgtaaatatttatgtgtttttccacacaatgatgatatgtcacgacttgtagccgtgtggtcctctggttatgtatcatttttgtgtaactcctttaattttattatttactttgcagagtgttctttttttctttaattctttttcttttgggataaaatgtaatattgacctactagtgtaatttttttgaattttaaaattaaagatttaggtaggagatgtcagagcgggttaatccgtcccatttaacctaatttacaacaaattgcgatactttgcgagttttgacggatcattccatcgaagacctcgatattcaaacatcattctaaatcctactcaaatttcaattgtctcttgtactcatgtatttcatgtatgagaattatttcactgtctgaatgggttatggatactactgatcataaccatatcgcaaacccattttcaaacatctaagattataatcctaatcagatgtatacggagcaccactagatttaagagaatggggacataagctggtaaagaattgggccaccattaaacgtgtgaaagaagaatttgggtttaggcccatatcaagctagattctcatgatacttggttaaaaagcaacctttttatttttctccgaagcaatttacatttgagattcatgatttattcatagtaacgactaaaagaaagaagatgatgcatagttagttagtacagtgtgttttccccaatagtttcccacgagtcaggcttaacgttttcctctcgaatgactctacgtacctcatttagtgacttcgttttctttcaccttaagaattggatcatcgagtttaggtattgttgtctctttcttttcctgttcacaaatagaaaaacgagcaagattttttattgaagttcactcacaagtcaaatgttaaaatgaaacagagaagagtagagaggtgaagaaataaatatacctcagccttagattttggtgttgattgttctgtgatatactgtaagatctcaaagaatttggtctgcccttggttgattgctttttggagatatatcattgccatatccttagctctagtctttaccttcaccaagttgcggtcaatttcattttcatgctttgctatatatggcctgaagaaagaatcgtaaacgtatgttgttccctgaaatgatataacacataggtaataaaaattagagaaaaagtcagttgaatcaaaagatatataagatattacttactttagtctttggaaaccagagataaatgaagaaagccaacttcgcctcgctatacattggtaaccttcaagacaacatgaaaacataagaatactaatatacaatactgtaaaactctttgttttctaagtaatataaacagcctaccaagaaacaagagcatcaccaattctttcgaaaatcgtcaaagcagctacaataatcctgcaaagatgttttgagtggaaggaagcaagatttatataggaacctaaaaaggttatagataaaggatagaatgtatgcatataccaatactggcaccagaactgaagttgttgaatttcaggcttgttgagttcgaccgttttgaagcactcataagcaggatatgcatatccaaacaccattctgtcaataaatagaaagattcattacttagtttgattgaaagaaatgtgtgttttataaaattaaaagaagagatcaataacatacaaaagccctcttgtcagaaacgatccaatcattgtgatcacctgctaaaacgtttaaaaaaaacaaaagaatctgcttgtcagaattaaattctcgaccccgattcattgaaatgattatatcatccaaaatacaaaaagacagagacaaaacaatcaactaaacaatattgatgcatgccttcaaacgattacacttcctaaaggctaatatgaagaagaagatattaacggtttaagcgattgaacaataacacataccttatcagaaaaacggtttcggcgaaaaaggaatgagaagaatgatttcgaacgaattatagacgacggttacgtacgatagtgacttgcgaatggagaaacaaaag

SEQ ID NO: 5516 - DNA, 3000 bp, Unknown
  misc_feature (1)..( 3000): cDNA_ID_3077412_gDNA_ID_1620797_Annot_ID_168512 3000 nt of promoter + ATG
ttaatgagttgtgtagagaaatcaataattgaagaaggatgcaaccgaatgattgatgaatttactataaaaattagggaccatttttgaatgatagttgttgtatatctatctactcaatcaattgcattaattgatatgaagcttgttgtatgattcagtgtgaaacaaaagagtgtcagctagaatctcttcttcttcttttttcaccaatttgtttgattctctatgagccaaactgatgcgaactcctaatttggactctacttctaaccaaaacagcaacataacaaacaaaagataacacaattataggtggtaaagaccaaaaccagaatcattttctcacatcttattttctacaatttatttgattttagaatgagtgtttgaaaagaaatacattgtagttgttacaaggtttctagtatcaaaatagtccgcatgcttttcatatatactgtatgatcacaatgtattcaacactttcatggcaattcctttaggcatatgactatggttttactgtaaacttttacagtagaagtttgctttagaagatggaacgtgatacagtaaagtacttcaaaggtgatgcaaattctactaatggatatgaacagtataaagtattatgactatatgaaatggggacacaattgtctctattttttccatatatttaaaccgttttgccaacttttcataccccaaatcacacgtgcattttataacatggtaaacgaataatacattaggcacagtaacaccattttgtatctagagaggtatcttcttgagtttgtcacaaaaatatctgaaatcttacaaaaatttcaaaacatatctgagaaaattcatggaaaagatacgatttatattcaaaataactgtgtacaatacgaagttctctttctctctctctgtcggtgttttagaaatcagctatcgttcgtggctctaatatttaatggcatattcaaagcacttgaagttatacaaattgggaattggaaggtttctctttactgcaatacaagatgggcaataccaatattaaatttatatcgattttgaagttataaatggaaaaaactattaatcacaagccaatactaaccggccacgttgtcagtagagactcttttaacatgcagtaggattaaattttctgtcagtcgaataaattccattgtcaccggactaacaatagtattttaaatgttacgtacgtaaacaattactactttacttttcgttttttgaaattcaaacttgtttatgaatcaaacatattctcaagatctcgcgcttcgtttcttcttttgtctcaatgaacataacatatttaacaaaattttaaacgaaatgactttataacaatctctggtgatttttataaccaaagtttaaaacaaaagagaaggacaaatgtggaacacgacaagtgagaaggccaaagcgactgcgtgataaatccaagtattgcggcgaatgtgaaggtcttagaattttacatatagtcaacgatcaaccttaaaatcgtagtttcttttgattgctacaaattttcaccctaaatatgattaatttacttttatgttattgatgatgaatgattaatataattactcgaaattgtgtgttgtgtttgaacgcaattaccacaatctaaaaatatacaagctcacttgagttatcacattaaaaatgttcttcccataatgtcgacatttattacacattaaattattatttatttagtgcattaaactgttttttatgataatcagtatattaataaatgaatttacacccatacttttttacacaaacttcaagtgtaactccacctctatttactgtactgagattagtttatgacaccctatcctaattactttgaaaaaaatagtctatcaatatgaagtaatacattgcataaatctgaaatacttacatacaaactgagaccaaaaactattgaagtaaaaatgatataaatgtaccaaactatttaggaaacaaggaattaagagcattgaaattttcaaatcgagacaaatagaacatttggaatccgtaatcacagttccaaatacgaagtttccaaagaccttgtctggtgtttaacgtgtaatcttgttctgttaaaaaaatacttttgaccatacatatcaacaacatcatttttagaattattattattattatatttttgatgtactaattaattccatttcttttcttgttgtcttgcttgcattcatggaatctccaaactttgatttttaaaactaattatttctgtcatcaaacttgttttaatggtgaacttatacatttttattatgtagtaacgactattaataaagagattccattcaaagttttgagtataataaccaaacaaatcaatactaccaatataaacatcagtgacgttgactaattccgcctttaagaaggtcaaactgtaatggaagattatagatgaagcagttaaagcacatacaaagccaaccaagctcgtccaaaaaaattaacttcaagatcttctaactaatttataatcatcaaaaaagtaatttactatctatccaaaatccataattaaatactgttttttcttttgaggaaaatccacaactaacaaagcaagcaaccagatgccaaaattaattagaaagatatttttctctgacaaaacaagatatctgaatatagttaaattagtaccctattttctattaaaagattataattttaataaattcgaacgacaagaatattaatcagaagggtaagaaagtaaaactgtaaaataaagaattaaagaaagatagagcccactactttaatcttcttccctccttattacccatcttggatccatcttcgatttcaacacctaaaaataaaagcttataattaaagaaccataaagacgaacacaaaagaaactctcacattctcaagagtttctttcttctttcaatg

SEQ ID NO: 5517 - DNA, 3000 bp, Unknown
  misc_feature (1)..( 3000): cDNA_ID_2164222_gDNA_ID_1620797_Annot_ID_168510 3000 nt of promoter + ATG
gcgtgtgtagcacggtgcaggctttcgaggaggccgaggctgtgtcacagagcgtgcgggacttgctgctacaggtgcaactgtgtgcctccgggtacgtacggaaactacgacaagtgccagtgctacgctagcctcaccacccacggtggacgccgcaagtgcccataagaagaaacaaagctcttaattgctgcggataatgggacgatgtcgttttgttagtatttactttggcgtatatatgtggatcgaataataaacgagaacgtacgttgtcgttgtgagtgtgagtactgtattattaatggttctatttgtttttacttgcaagttttcttgttttgaatttgtttttttcatatttgtatatcgattcgtgcattattgtattatttcaatttgtaataagattatgttacctttgagtggttgtttatcatactttttttctatggtaagaggttttggaaaagtatcgagaatgatatataaagtaattttgatatcgacgcaagatgataactactagactagctgagtataagaatattgatgtatatatttgcggacaattttgaatttattataccattatttaatcacgaccatataaaaataattcttgtttgcgttataatttgtgttaatacgatagagtagacaaatgaagaccgagaacataaataatcatgatcattacggatagaattttggtataagatatttgttaacatcgatatttatttgacagccatataccttattccaaaatttggtccacacatcgaacctattacctatgaatagcatatagcttatataggttcgtgtctaaatgaaaataaaacaaaaatatgactttagcgtatatgaattgatgatagtaaagtttccttaaatctagcaagaggaagtaaactgatttggtaaatcccttgtgaaaactgaaaagttcgttttgttaaaatcatcgttgattcattttggtatttttcaaaaaggaaaaaataaagaactgaaagcccccggcgaggatcgaactcgcggcctttcgcttacgaagcgaacgcaataccactatgctacggaggcttttcgataatctctgacaatcttggcatatttaataaaaagcttatgagaaatgttggggactcgcaagttttgtagcatagtcattgcattttcagaagccaatgttaacagaaggccttttctcacgtttatacgtttaattcgtctactttctaaggttatatctttcttgggccattgttcgttatatgggccttagttgtcacatgagtgggttcttaatttactcaactcgtatttatgagaaaattgtccaagtgaactgataatgaaatttgcacgaaggagagagtccatgcaaaaactgaaaaaagtttgacaaaaactcgaaaaagtgaagccaacataaaaatctttggttagacactaaaacacagtagatgagtagacgtttggcgaaattcacctgacttgtcgatttcaatttgatgacgtggtcaaatgatttaacttacaacaactaataatagccgtcgattttaataaatctccactagttatgagcattcagaaagccatgccgtttcttgagactagaggattaattaaaaaaaacgccgtgacattctctcgtagttattgaagacagccagacgtttgagtagaaagggacccgcccgacccggttaacgaagttgatcataattggtttataaatatggttgcggaaaagtacataagaaattcatcaataattctagtgctcaatatttgaatatatatcactgaagtagatgatgcgttcagaaatattggatgtttagtcttaattaaacgtatatgggtaaaaattgattttaacaaaaaatttaatttggttagccgtttagtcattaaattatttggtgatagattaatttgttcattttattaaacattcgtaagtgaaacattatatactaaaaaatcggaaatgaaaaataaaaataatgcaaagtcgtagtacggattcaaatcatcgtcataggaaacccatgtcgtcctagtacaatttttttcagctctagcttgctgacgtgtctgacacattgattttctaaggaattacgtggcacaaacacttaaaaataatcagacggttctcgtatctccttgattacacaccgttggatcgatgactgaggaagataaaacgaaacagagagagaataagcgttttgttttgtcatattttgtgttttgtcatattttgtgtgacatttacaaaaagcgatcgagtgagtgaagcgacagcttcggattatccgtcttatcggaatgtggaaactttgagaaaatacaagaacaactcatagagagacacacaagagacgtttttttttttatctcttttctctatttgaaatctctgaatagcttctgtgtttttcgatgatttgtactgtgtacgtttttttatcttcttctacttcttcttcttgtgtcagttacatatcaatgtttgatttgattgaagaacagtgactccattaatgaagctttccttatagtaaatgcttttttcgaaaaaaatcaacgatctacattttttttttttgtattcacgggttgaatgtacaaacattaataataataaaaaataatttcttctttaagtcttcttttttttcttttggctttatttgtctcatctcttttatttcacgaagaacctgattcttcgagacacgagaaacgattttataacttttctctcttttttcttttcctcttctttaacgtctttttacttttctctcttttctcttcttcttttgtgtatctatctaacaatcaaagtgtgtgaaaatcgtaagagacctttttttgttttgcagagagatgttgaagaagtgagtttttttttgttcttctctattagtccttcttcacctcttgcttgagtggtgagaaaaaaagaag

SEQ ID NO: 5518 - DNA, 3000 bp, Unknown
  misc_feature (1)..( 3000): cDNA_ID_2105101_gDNA_ID_1620797_Annot_ID_168506 3000 nt of promoter + ATG
aaaaaactaattttgtagatcataatcattttggttattgagttttatcttgcccatttattgaatgtgttattagtttcattgtaaaagatgttttgcttgatttgcataattaacacttggtttccaaattttggtgtaaggttatgagagcttcacttgacgctggtcacagtttgccaaatcctgatggtattctttttaacgggcgtggccctgaagagaccttctttgcatttgaaccaggtgagtttttttcttcttttaaaaatattacattatatctttaataatgtagtttacacacaaatgttctttttatgttgtctatatataatcacaggcaaaacatataggctaagaatatcaaacgtgggtctcaaaacatgcttaaacttcagaatccaagaccacgatatgcttctagttgagacagagggtacgtatgttcaaaaacgtgtttactcgagcctggacatccacgtaggccaatcatactctattcttgtcactgccaaaaccgacccggttggaatttaccggtcttactacatattcgccacagctcggttcactgattcctaccttggcggtatagctttaattcgatatcccggttccccacttgacccagtcggacaaggtccactcgcacctgctttgcaagattttggttcctcagttgaacaagccctttccattaggtaaagaaatactctttttttataccaaagaataaaaacttttatatgaaatatttcgtttagtatttgttcttgactaataaacgttaagtgtacgacacagaatggacctgaacgttggagcagcaagatcgaaccctcaaggttcgtaccactatggacgaataaacgtaaccagaacgataatattacataacgacgttatgttatcgtcgggcaaactacggtatacgattaacggcgtttcgtttgtctaccccgagactccgttaaagctcgttgatcattttcagctaaatgacacgataatccctggcatgttcccggtttatccatccaacaaaacaccgactcttggaacttcagtggtcgatattcattacaaagatttcatccacatcgtgttccagaaccctctatttggattggagagttatcacatcgatggttacaatttcttcgttgtcgggtaaaaattacaatatttaaatcataattatgtgtatgatgattaaattaggtgtactaattttatttgagtttaatgttagatatggatttggagcttggtctgaaagcaaaaaagctggatataacttagtagatgctgtttcacggtcaacagttcaggttaagccatatctaatctcgtaatttaaagtattaaaccagtgattagttttggttaattgattctgtgtgtgtttaggtttatccatattcgtggacagcaatattgatagctatggataatcaaggaatgtggaacgtgagatcacagaaagcagagcaatggtatcttggtcaagagctttatatgagagttaaaggtgaaggagaagaagatccttcgactattccggttagagatgaaaatccgataccgggaaatgtcatccgttgtggcaaagttcgataataattaattgtctgaaataataaaacctagaaaagtctattttaattagcaaaactaaagaacggtttaaaggaatgatcagagagtattaggatctgtgttgatcttagggtttgtggtttgattgcgattcgaatcacttgtgtaattgcagaagacggatggtaatttaaagagatgatcttagggtttgtggtttgattgcgactaaagactactagacgatgccgttttagattttaatgggctcacacagttgttatctgcaaaccggcccaggtctgttttgacttggtgagtgctaacgtgctctataagaagatattgtagccacatacgaacagctaacgtgctcccatttcctctatgttcccttgagtgacatacgttttcacaataagttgggagcaagtaatttaccaagaacaaatatatattttaaaaaatataggatccttttacaagttcaattattgattttgacgttacgtataaacagtagatcgaccatgacataaataaaaatgaaaaaataattggatcaaatctcagatcttactacagtctacatctacctagctacatgtgctatggcattatttgtttttcatgttatcatcaatattgtataaaagatccaaacacaatcagtgtgatgatatttttctatacttttgatcattcaaccgatttcaattattgtgtttgatcgtttacatagaaataggtacatatgcattcaagatctccagatcgtttattacgtcttgctacatgtgctatgtcactaaaacaactaagatactacatgcaaagttactgtattcattacgcattgatcgtcttcttctacgcactattattgaatttttgtttctcgatgttttcagaagtcataacatataatcaagggtggttgtagctagtcgtgatgaaattcgaatagtaaaagattcatcaaatggatcaagatttgaaactagaatgaatgatcgatacttgaaagctatcacacttaaatagttaaatggacgatataattcaacaatatcttaaataacattaatcattcactttgtagaaatttcaatttgacggtgctaacaacaatatgtgacatttttgtttgcagcaaaaaagtcaaatggtaaaaaaaaacatttttttaaaaagagagtatagtaaaaaaaacagaggataaaaaacgaacaaacggttaaagctggcaaagatcccatcttccccacgctgtcaaattttgtcactacttcccaaaaaaaactctcccgcctctctctctccctctcccttcttattctcctccttcttctccttcaccatctccagatcccaaaatcttcatcgatcatcatcatc

SEQ ID NO: 5519 - DNA, 3000 bp, Unknown
  misc_feature (1)..( 3000): cDNA_ID_2164214_gDNA_ID_1620797_Annot_ID_168507 3000 nt of promoter + ATG
ccttcacaatgtctttaagatcagcaatcatcacataactacaaccaatgtatcaacaaacatgacgatgactgaaagcattaatgatttacctcttgacatagtagtagcagaagtcggctagaatgaaggtttggacgatttcagagagaagaaccattataggccagaaaccatatcctaaagcagtcaataaccgccctcgagtgtccaaaacctacaccatcatcacattatcattatatactacacaatcaagctttctagtttggaggacagaaaacaaacctgaaggacccagtgtgcacaactcaagaacctagcgatccccaaagcgaatacgtaatgtgctgtaaatggctccacgatctaagacgacacatgcgttactaatttaaaaagggtaaaggacagggactagtttcaagctttttaaaagtaccttagtgttttgcatgactctaagttgaggaaggactgaaacagcttcaaggtaaacacagaaggcccaagaaatcttattgattatatgatgatgtgttgatgggtgaatgagtactgatagaacaacacatggaataacctgcaaccatatttaaaaactcttcacaactaaacacttcaacaatgaaactcaaagtgattagcaaaggaaatctaacaaaaatgatcacatatggaaactaatggaactaaaggttgctactttataacccttttcaaatatatgattcacattcttcaaaaacacaagttgagattctcgaaaaagaaccaaaaaaggaaagaaagaaagaacaacttacgacgtagtagatagcaaaattgtctttgtcgtccatataactagctttgagcttaaaacggatcatatagataacaaaaagtgtagtcaccaatgtagccgagtcaagtaacgtgtgaatatcaaactccatcacaaaactacaatacagtctcaccgccaaaaacagagctgttagctcttgtgacttgagagataatcctgtcaaaacatatcattcaaagattgcaactttgtacgaattcaatagcatcaaacaaaccctaattcgaaatcgaaacagatcaggggaaaatcaaattcaataatcactaatccactaatcaaaacctaaatctagaaacttcaaaatcaagaaatcgaatataccagcacaagtcctctccttggtgagtttatagataaggacggagattccaagggaatgaacagcttcagcagcgacaaaaagattgtcgtggtcatgaacaatcactctcaacaaaacgagggcagtcatggcggagacaacaccgagaaaacctttaacctttggtggttgccgacgaacccatgtcgtcacggcgtggatcggccttgttgccgccttcatcttcgatttcaatcttgcactctctttccgaaaatagaaacagtaaagtcgaaacctttaggaacttggtgcggtgatgattgtataaaaccagatctgtagcttttatgtaagagattgatcaggtgattatgattattattacactgtttttttggatgtggagtgggaaactggagaaattggtaacgcacccattgctaaaaatcactccttttttcttacagaacaaaaaagtccaaaagttttaacactttatgacggtgacacgtggattgttaagtatgtttaggtggaaattagattcgtggtaagccaacgactctggtttaatttgtctctttgtattcatagagaaactttattgaataggttttcttcaaacttaatgtaagttcatttcaaaatatttgtaatgaattgttaaacgattataattggattgtgtagtattgattcataattatttgtatttttttcttgcataattttatgtgttgtaaaatgattgtttctacggctatgtaaatatcttgttttctgattttagactgtatcagattccacaaaatgattatattagttagagtggtaattattaatttagtatagtgctcttaaaatgtactgaggtgatcaatccactaacactccccaaatctttgcagaatcagttttgatcttcaagaatttgatttggaatatacgtgcgataatagtaattaagattaaacagtagatgaaataaaaattagagctttaattataaaaatataggttataggaagttttagatttgattgatgcaattatttcaataatcgatttgtttttaataatacagctaaactctttccaatatctaaatacaatcccactttcccctattttatgaggttcttgttctcctaatctttcctctagtggtgttgatgattatctctaatatagtcagaaatcagaattgttttcttttcatcctcaagtcatttgccactgaacaatcaaatgaaacttggtgagtcaaaaactccaaacataaaaactaattaagaaaaactcaacacacctctcttaccaaacttgttaagctcataacattcaacattggtttgcttcatcagaacaaagtcttgtgtgagttttgctaagtttggagaaagaaagagaccaccattgatttttgttgtaacccattgccaaagcccaatttggatggaaattaatattataccataaaaaaaagatatgaaagtcgaaaaaatatcagaaataaaaataattttttgtatttttttacatgacatattggggattaatcctatttttttacttccaaaattgactgaaattagttggccaaaaaggtagttacgacgaaaacaagaaactcgaaaataaaaaaaataagaaacaaaagacgagaaaagaaaatttaaccaaaaaaatgtactgacacgtgtcataagcttagacccatcaaattattatatgaaaaataaaaacaaacaaaatcttctgagaaagatttatctcattaacccaatcgtttcaagccgggaagaagagaagactattcattcgtgtctctcttcattcaatg

SEQ ID NO: 5520 - DNA, 3000 bp, Unknown
  misc_feature (1)..( 3000): cDNA_ID_2154004_gDNA_ID_1620799_Annot_ID_168562 3000 nt of promoter + ATG
cattgagcggcgaagaaaagaacatggtcatactaacaaacaatattccctacatttcataatattaaatgttttagataaaagcataaagtttaagaaagtaattaattttgagttttataaattaaaaatacaaattaatatctattaaaaataattagggttcaaaagccgtttaatataatgttttgcatagaaacttgaactgtttcttcaaaacatcatataatatgaaacataaggagtacaacataagaatatatgaaaatgcatagagattggatgaagaacaaaagaaatttacctatgttttacttgtaattcattttttgttttgcttatattttacttactttttttcttaaaaacaatattattattaacaaaatttatattttgtgtaattctagaaaaactataacgtattaacataatcgtaaacaaaatctcttattacaaatacattataagcctacactaaaatatgggattatagttttgacaaagaatgtgatttaccttttctaggaatggaacttggtattgtttttcatttttttagctggaacatagcaaaaagtaatcgaaaataaaattagagagattcttacatagaaataatcaaacaatttacaatcaaaattttaaagaaaccaagtagcatatgtggctagtcatctaattctatatactaaattaatattataatttataacaatgtaatcatttttccttaatttgatatagctattaatttttttttatagtttatagcaagtaatcatttgttacaacaatgtaatctatctaagtctaaattttccaatgaaattaaatgatataatattaatttactgtaaaaaaattgaattagacaaaaagataatcatttatttcaatttgaaaactgtattaaatttcagaaaaaggtaaaccattccaaaaacattaattcattgacaaaaagttaaagagaaaattcgctaaacaatttttaattggtttttcatcttataatttggtattaaatgtaaaatacataattttgtttatagaaataaataaactacataatttattgttgacagtgtatacatttatttagatgtgtttctatataaggtgcaaaataaagaaaatagaaaatcatatatatgaaagttggcaaactctctccatatgagtgacacatcatcacaccagtgagtgtcacatgtcattctaaattaatatcattaaaaaataacaaaacttagtgataaaaattgaaaagtttcacattgcattaaatcatccattaatctcactcttaacaaaatatctttatttataagaaaaaatacaaaaaatcatgttaatgtatcaaacactactttcattttacttttcttattttgctatttttataatagtcattacttgataatgactataattttttgtgtattacaacttagttgtttgctacttaacctttcttagtttagtaattttaacttactcttttctttttattacattttttggtttacatgatatggtttttttgtgtgtttatgataaattggtaacattaataatgacatgcatatttttaagtagtgatcttttgagacgttagatataccaaaaagttcaatatacgacgctttctctaatatggatatatgcaaaggcaaagagaaaaacctaaaactgttgacttaaaagactatttaatttaagctttcttttttctctttcatgggaaaacttttaaagtagatgagtagtttatatatttgttatttaaattatgtcaatccaatatttagccatgagcctatcatgatgtgattggaatactagattaggagagaatacatggaacaagaaattgtttgcttagaatcaagttaggcaactttcaaaccaaataagtagtataattgcataccattgtatcatattgttgatgtaagtatttcatgatagttaaaaaagtttagaaacttggatatatagataagaagatttatacatgaaaaaataataattgatatttaaatcaaaagtgaatctaactatacaaatataattacataaaatgaatataactttattaactacataataacatacacgaaaataacataaattagtaataaaaatagttaaacataattatttttaaacaaatttcaaacaacaacccacgcgtagcgtgggtactcacgtagtaaatacaaatgagcaaaatgctggaaaagtagtcgatgtgtgcacattctggatatgctttggtgtttctgtccatttgttacatggttcttggtgtaaagaagaaatcaagaaatctcttccataacaaagaacaatacatagaatatagttgatcttctcgcaggagctaagctaattggactaaaatggatgtttaaaataaaaggaaactcgtatggaagcatcaacaagtataaagcgagacttgtggctaagtggtatgtgcaaaggcatggtgtagacttcgatgaagttttttactctagtggcccgcatcgggacactatactttattattgcattggcagcctcaagcggatggaagtaaatcatcttgatgtaaaaacggcgttcttgcatggagagttaaagaagctagtgttcacttctcagctagagggtttgtgaccgaagaaagtgaaaataaggtctacagattgaacaaagcattatatggactcagaaaagggcctagggcgtggaataataagctgaacaagatctaaaggaattaagctttgtcaagtgttctaaggaaccttccttgtatcggaagcaagataaggagcatctccttcttttagctatctatgtagatgatctacttgcacatagtctagtcaaagtcaaattatcgagttcaagaaaggaataatctccaagtttgagattagtgattttggtctgctaacatactaccttggcattcaggtgtttcaacacggtgagggtataatg

SEQ ID NO: 5521 - DNA, 3000 bp, Unknown
  misc_feature (1)..( 3000): cDNA_ID_3077517_gDNA_ID_1620799_Annot_ID_168564 3000 nt of promoter + ATG
ctatataacaagcttatataggtaactatgccgcacaaggtcattgacatgcacttccacgaaagagaagaagaagaagatactggtgagagtagatcatcctcaagaacaccgagagggcatttcgtcgtttacgtcggtacgaagaagaagttggaaagattcgtgatccccacaacgtttttgaagagcccttcattccaaaagcttctagacaatgcggccgaggaattcggttacgcggaagctcaccgggacaagattgtattgccttgtgatgtctctactttccgaagtcttgtcatgttcctgacttctcatcaggacaagtcacattaactatatgagcccactactacgtcgtctgaatgataaaatggttatatgttatgtatctcatattgtatgaatatggtttaattcttataatgtacttatatgctaactttattcaactacgaactacgagtgtaagatttttatttatcatatgttgaatattagttcaatgtgcttttgattggtaactttaagactacgtaaaacttatagcagttaggtattttatatcaagcataaaaaaaaaagtcaaataagggacgaactttgaatatagtgacacatgttttatcaacattttttaaaaataagacaaggaaggatttttgttttacatttactctagaggtttcgaaatttatgacaaattaaagaagtgcaatttgtgttgatccaacaaatattgccgaaacacatcggcaactgcgtcgaactcaaaaatcacattcgcttttctacctagaacaactcgagtagccacattcgttcacaggaagaactggacaattaaggttcttacattttggttgatgactttcatgccactacttaatagttatgacctccatgagtaattattttggttccgccattgattgtaagtccacagaaaacttcactgagtttatgtttacttctcctcttccatttagttgagatcatcaatttagctatactcatatggattaacttggactaatcaatcggaagccttttttttttaatgtaatgtcaaattatatttaaaagaaaaatatatacggttttacaacttgtgcataagaattttgaaaaaagaaatcaaaagaattttgaaaattttagagaataattaatcgaaattgtgcaacaaaaggtatctagctccgagattgaatccagtggaataacgttataacgcttgtcacctgaaagtcgaatagctgaaatctgatttcgaatttgtttatccatccatcctgtgatacgctgagccggttgtgaggtttcaccatgtttccggccaatcaatcggaaggcttattatgatttatgaggtaaaaatgttcaaaacctgcttttctccatttgctttataaaaattcgaaaatttattttcttaaattccatttactgtacttcttactgttcatgtaaataaaatattatatgaattaatcaataaaatgataaaatcatgtattaacaggcgagtttctaatttaatgctccatgaatatgttaaatcaatctgtttttattttttatttttgtttttgttgattttcttcttattttgtttatattttttattatatatcaaaatataattgatttgactgacgaatatgacaatcacgctagatcatccacattagttagaacccctcatgggtttctttaaaattaaaagaaaaactatatttatgatctaattataacattacaagtgttaagagagatgcttaatgagagatcattgtatcttccccaaaaaaaacctctctcactcttttctcacagtcacaattctttttctttcttcaataatttaatagaggataccacctccaatggaaatgctctaattagaattttcaaaaagtatcaaatatattaattaagattttacatcattcattttaaaaaaaattatagagtagactttagcaaaaaaaaaacatattactcaccaccatatcattattttcttaaaccaaattctggacaaactctatcaattaaaatacagctacaacactaaccaattaaataacttaaaaagaaaaatcaaactaatttataagacgttgaaacattaaacaagtgcgaaattcttttaaaaaattgtaggtgatggagaccaaacagtaaaaacttacacctcaaatttgaatttaaagtgtttgtgtaaaacagtttttagttttacccccaacaaaatcaaatcaatcaacaacaaaactaatgatgctaaaacctataagagcattcacaactgtggaactctcattttaattattaaaatattataaaataatgaaaagaaagtatggaaagagacaatgggagagaatcgtcaaataaaactctctctagagaaactttgagccatatgagagaacctctactttacagatgttaagattttattggtaaaaaccaattattttaattaaataataaaattataataaaaataatattttttattcaatacatacccatttttgaaaacccaccattgtggatgttctaatgggtttaaatccctttaccaccaaaacgacatcgtttacttaatgactttaaacttagcctaaaacgacatcgttttacgtaatgacttgcatctttctaactgagcagaagccgacaaacgacacacgacgtcaccacaattctcaactttggagctgcagacacaattccggcgacgtttacgattctgacaccgccggtaagggttaaaatggattctgattctgattattgtagattcgttatctaaagattcgaactttctgaacatttcatcgcaaatagctcattcatagaattagagatctctacattgctttgtaataagagatcgatcgttatgtgaatcattgataattcttaaagtctcagacttttaatttcctctttaccaattggaacagaacccacttgtagcaa

SEQ ID NO: 5522 - DNA, 3000 bp, Unknown
  misc_feature (1)..( 3000): cDNA_ID_2154074_gDNA_ID_1620799_Annot_ID_168585 3000 nt of promoter + ATG
ttagaagtatgttgagtgaaagtggtcttgacaagaagttctgggctgaagcagcagcaacctcagtatatctcatcaacagatccccatcatctgctttggaaaacaaaatacctgaagagctgtggacatctgcagttccaagcttatctggactaaaaagatttggatgcattgtgtatgtgcactctcaagaaggaaaattagatccaagggctaagaaaggtgtgtttttgggatatccacagggagtaaagggattcagagtctggatgattgatgaggagaagtgctctataagcagaaacgtcgtgttcagggaagatgtaatgtacaaagacatcttgaacaagttaacctcaggtatgagtcttgaactaccgtttgttactaacaaggttcccagttttgaatgtacaggtcttaacaaggatggtgaacgtttagttcaaggtggagctattgaaaaagagtcagatgaaactctagaactatccaatacagaccaggaagatacaggaacagaaaggattcagagaacccatcagatagccagagacaaaccaaagagacagattgttataccctcaaggttaaaggattatgaaatgaatgaggaaatacttgatgagatagcaggatatgcgtatcttatcacagaagatggaggaaatccagaacccactgatttccaagaagtcctgcaagaccctgacaataagaaatggcttgaagcagcagatgaggagatagaatccctcattaaaaacaagacttggactctagtggacagagacaattctcagaagcctatcgggtgcaaatggatattcaaaagaaaagctggaattgctggagtagaacaaccaaggtttaaggcaagacttgtagctaaaggttatgcgcagaaagaaggaattgacttccaagagattttttcaccagtagtgaaacatgtgtccattcgactcttgttgtcaatggtagttcatctaaacatggaactgcagcaaatggatgtaaagacggctttcttacatggctacttagacgaaaccatttacatggaccagcccgaaggttacattcatgaaaaatatccagataaagtttgtctgctaaaaaggtcattgtatgggttgaagcagtctcccagacaatggaacaacagattcaatgagtttatgcagagaattggatacgagagaagtaagtatgacagttgtgtgtactacaagatcttactaagtggagattacatctatctgttactctacgtggatgatatactcatagcatccaaggacaaggagcaggtatgtgagctaaagactttactgaattctgagtttgaaatgaaggatttaggtgatgctaagaaaatcctaggaatggaaatcacaagagacagacaagctggtactttgactatctcacaagaaggctatctactaaaggtactcaaggactttggaatggaccaagccaagtctgtcaacacacccatgggaattcatttcaaactaaagccagcaaatgatgaagaagtgcagaagcagtctgaagtgatgagggctattccatatcaaagcgtagtaggaagtctgatgtactcgatgattagtacaagaccagacctagcccattcagtaggtctagtttgcaagtttatgagtaagcctctgaaggaacactggcaagctgtaaaatagatactcaggtacattagtggtacattagaccgaaagttgtgttacaagaatgaaggagaatgcattctagaagggtactgcgattctgattatgctgcagacaaaggaagcagaagatctacttcaggagtagtgtttacttttggaggaaatacaataagctggaagtctaacctgcagaaagttgtagctctgtcgagtacagaagctgaatatatggctttaacagatgcagcaaaggaggcaatttggctaaaagggctagtgaacgagttaggtttcacacaaaagacagtgaacattcactgtgattcacaaagtgcaatagcactggctaagaatgcggtatatcatgaaagaactaaacatatagatgttaagtatcacttcatcagagatttggtgaataatggagaagtgcaggttctgaagattgatacagaagacaaccctgcagacatattcactaaggttttaccagtgagcaagtttcaagacgcccttgaattgctcagagtgtctcaaaattaaggtggagcactgctccaagaaaccagctgagtgggtttactcagggagaagaagctgagtgggtttactcagggatttgaagctgaacgagtttgttcaggaaccggagaggaattcaaactaaagcaaagtggcataaagatcaaggtggagatttgaagtttggtgatctatatgttaagtctcaaaaaacactctaagagaatcagaaggtctcagaagtctgttttaggcgagctaaggaggtggcgacatcaggtctggtttaggcgagctaaggaggtggcgacatcagaagtctgttttaggcgagctaaggaaattacgacacgtggagcaatctccttagctcgcccatctctaacggaattatctcttccgagagctcgtcttcttctgtttctttaagtactcatctgttatcttagttctgattattcgatttaaaagtgtattgaatcgagagagagtaagagagagaagagaacaattgtagagagaaagagctcgagtttgagctaagtgtttttagtgaattccggagacatctccggcgagacgtagggttccacatcggagcctgaactcgataaattcccgtgcgtctcttttacgttttttctttgaatccgatctcaaatcaagtcagaacctgaaatcgatccaatttctgaaggttcaaggttcacaacaacaaccatgaatatatcgtaacagagagctctgacattttttatcttcagcaccttcgtcaatg

SEQ ID NO: 5523 - DNA, 3000 bp, Unknown
  misc_feature (1)..( 3000): cDNA_ID_3077483_gDNA_ID_1620799_Annot_ID_168589 3000 nt of promoter + ATG
ttgaatcagacactggtacatctcgtggttcaactggtactaatatattgtttatatttgtaggaggcgatgaagaagaggatccagacgaacctacactttgactatggagagtactatacagcagaccatgagtggagttgcaaaaattcagtatacggtatagtgtttaaaacatcatcgttggagagaataacatatgcggatttaatagataacatctttagaaagattgctctaggtggacagaaaaggaatctgaaattgagttacaagatatctaaagcatggagagagtcttatattgtagataatgaggatgtgttgatatatttaacgtcattggataaagagggacttagacctgttttgcatgtagagttatgcagtgatttggaaagtaataataggctagttccaatagtagagcgaagaagttcatgcggtgtgaattatggggaattggctgccaatgttgtaatggttgcggatgcaaatacatgaattctgagtactaatgaacctattattgaactagaggaacagagtgagacagttagtgaacctattattgaactagaggatcagcgtgagacagttagtgaacctatgatgctagagaatggagttactgaaactgttattgaaccgttgatgctagagtgtggggttaatgaagattctgataatgattatgttagggaaaatatgttcatcttgcacgtccggtacaagaaagtgtggctgccgttgtcaaagaatgggaagatggtattggtgatttagtaggtcaagaatttcgttctaaggaggcagtatgggatttgattaatagagcttcaaaagaggaagtgtttggtgtgaaaactattaaatctgacccgggccgtcttatgttagaatgcagtcaagcatcattgggttgtgattggtatttaagagttacaaatacttcgagcacagatttttggtgtgtgaagaaacacacacaaatacataaatgctctcggtgtccggaggcaactagatatgaaaaactaaaaggcacatcgcaattagtagcagatgtgttgcatgaggactatccgggtcttcttaatactctgaaacctaaacaaataatgagtattggtaaaggaagacttggtttcgattgttcctactccacagctttaagagagaaaaaaaacatgttagtaatgtgcgtgggagccctgaaactagctacaagttattgtttgcttatctgcacattttaaggtctgtgaatcatgggacaataacggaagtggaattggatgcagatgacatgtttaagttcctattcatcgctttgggcgcaagcattgaaaggtttaaggcaatgaggaaagttatagtgatctatgcaacttttctgaaaaccatatatggagggatgttagttattgcaatagctcaggatcctaatcatcatcattaccccattgcgtttggtgtaattgatagcgagaatcatgctagttggaactggtttttcagaaagttgaatttcattataccggatgacccggaattggttttcataagcgacagacatggaagcatcatcaagggagtcgcggatgtgttcccgaaggcatcacatggacattgtgtatgacatttgtctcaaaacattaagaaaaaactggcaggtgacaaagaagaaggtatggccaaatttagggaattaactcatatttatactacgactgagttcaacactagatatgcagaatttaggagaaagcatcctaatgtagccacctatctggatggggcaattgggcttgagaaatgggctaggtgctatttccagggagacaagtacaacatagatactagcaactccgcagagtcaatgaacgccgtgttttcagaagtaaggaagtaccatctgttaccgatgatcgatgcgattttggagaatttttctgagtggttcaacacacatcgcaaagattccgcgtctgcatcgaacacaaggcaagtggtgcctgttgtggagaatatattacacacgcgctgtccaattggtgcaaagctaaatgcaactgaactaaacagcttctgacaagaatacaacgtaattggaaatgacggtttttcttatttggtggacttgaaaaagaatacttgttcttgctgagaatttgatattgacaagtacccgtgcgtccatgctatagctgcagccataaagcgatctaagatggattggaatagccattcaatcttgaatgtaagtatctatggtctatgctcgaagtattacttgatcgagacgtgggcattggcatattacagaacgatttatgtggtgccgcatcaggctcattggttctttcctcctgattatgtggagaaggtcgcaaaaccgccagattacactccaaaaaaaggaaggaatcaagaaacccggtttccatccaaaggtgagaagcgccgaaagaagactaataacaaagctacgcgtggcatcaacttggagaggtggttgcagcctgaaaccaatgatgattgacgttaactcgtcaactagtacaagaagttcaactacgataaagtctttgtgtgtaaatttgtgtttctcggaattgtcaaatattgttcgacaggttcaattaagaacaatcctttgtgtttagatttgtgttttcggaatttttaagcatagttaagttttttagttcaacagaattgccaaacatagttcaacaggttcaactacgaactagtcgttgtttggcaaacctagtacaacaggttcatctgggtcaactatatacacgggtggcatcacaatcaacgcgtcagttgaaatattagcagtgacaggtggcactgcgagtaccaatcgtcgcgtcgtttggaatattatttaagacaggattacaatcgattttacaccattcatatttcatcctatccaaaaaaaagagcccaccccactaataaaggaagtcgtcgtttgtcaac

SEQ ID NO: 5524 - DNA, 2296 bp, Unknown
  misc_feature (1)..( 2296): cDNA_ID_2154105_gDNA_ID_1620799_Annot_ID_168594 3000 nt of promoter + ATG
cttgaaaaacaaaacgagccctttaaacaaaggaggttcaaggaattttaattccagatctaagaattgaaacacaagagagccaatcaaactcaatacaaagaagcctaagagagaaaacataatctacacgagacaccgtagacggacgatgaaactctagacataagccagccaaccaccgttgtggaagccgacggatgccagacggtagccgaccaccaccgttaaaagaaacggacggtgtaagaaaaaaagccggccaaacatcaccataaagacgagcgccgccggacggaaagctggacatccctgctgagaaagctagatgattccagatagattgatggccaacgaacactgaaaagctgtcgttgccggaagaagaaactttgatgacttcctctctgaaaaatagaggtgagagaagagagagaagtccgatgttttgtgtgataaagactcagaaattaacattcaaataaaaaaacttttggtatttctgttatgttatattcattaagttataatatatacatattgtttattctaaaaccgttagactatcaaaaaatcacctatgtacatcttgtaaaatcgtctagaactagactaaaattgcctaggtatttcagacgatagatggaagctttggtgaacactaatgggctttcttggcttatatagttatatattagaaactctttttctaaattttcgatgtggaacctttggtttatacctaacaaacactgcttaatacatccatgtattttattcctttaagcaaatgtttctttcgtgacactctctctcttgtaattgtccttctaaatcaatgtgtattttctctaatgagtaaatagatgattaacatattttccttcaaacttattattattttatattagtaggactatatatgaaaatgacttccgatggaagtgattagttatattgtttttgatgtatcctttttttttgttagagtaacaaatgtagcaatattcgtgaaagttattagaggattcaaatgaagcccaagatagagtcatatgagaagtccattagcccatataactagggttttagttaatagagatttatataaatatgtgtttagaaaatcaatgtaaacaactttgagagttgtttccaactctccctttcatttaatgatatatcaaatctagaatcatttgtgatcttggtgacaaactaaagtctttccctttcctttacttcacattttaataaagctcttaagctatctaatttcaatcttaaatttttctgttaataagctcatttaagcataaaccattgttggttaggtttctcctacaaaagtatattcgattcttcatatacgctctaagcagtctattggtcaaaaatggtttcacctcataatcccacaattattttttgttcttatatctcattgaaattgataaatgttaaaaaaaggtttttcaaattatctgttcagattttttttttttcactggaacgtgttatatgtacgcttttggtgaaagattcgtctttcttttcattctaagcctaaaccctaaattaatgcatatttctctgcccaaaattattaatatattttttttttttttgctaagaatgtaaatatcattagaaatgaaatgtaaggtattacaagagacgcattacctaaattaaattaaccttggcaaaaagaaataaaaacaagattaagataaagagtagttaatcaggaaagattaatggatccaaagtagcataagttgtttacagtgcttcctatgtcttcgagaagtaatagtattgcgcacctcacgatcaatgcaacggaagatgattgacggagggatgtgttgaaggttgtgaaccatgttattcctttgtttccaaatgaaatagacagaagcttgagctgcgactttccggaggagtgacgggccaaaatcattaatatgaacacgtctcatttgaatacccttttcttttagaaagggttaatttatgccatttgtctgatcaacaattttagtccttaagttgactcttttttcttttggtttaacctttagttgacttgcttattagcatcacaatttaatttctcttttaaatttgtagacgacttttacgctcatgagtgggaactttaccaaaagttgtgatcttgagagcttgaagaacttttagcttgccacaaaaataagaaatttcgtcaggaggaaaaacaggaaaagaagagcttgatgaaccttaatttgtcaccgatattgttggaatg

SEQ ID NO: 5525 - DNA, 3000 bp, Unknown
  misc_feature (1)..( 3000): cDNA_ID_2154097_gDNA_ID_1620799_Annot_ID_168592 3000 nt of promoter + ATG
ccatggatgaggtctcctttaccaggatatatggggccggattttgttccagccccaagagatttcgtcccaagtgaagttatttggcccgaaaagttttttggtcaaacgaatctatttccggagatgcatgaagcatgtcaaatgttcattcaaaaggtaaatgtaagaatagtgtttcgttgttgccaatgtggtttggtttagggtttaatcaaatttcaggtttagggtttagttgtgttgattgttcgttatattaggtgaatcatatagtggtggtatagttgtattgatggatatttagcgagaaattgacatttatattgttggacaggtggataatcaacaccaagcttatcgaaggcgtcaccgccaactactcattaagttgcaagacctggagagaggtatgaggcggttggaggctcatccgaaagactgggtgagatacggtttcgacaaagttgctgacattccactgccactaaggagatggtgtgttgagcatgatggatcgtcaccgaattatgcgtgtttcgcggagccaattcccattaaggaggacgatgaaccagatgatggaagttactacaggagagtggatgagcctccacgcgagtatcctcctgactctctctttcaataaacattatgtctttgttttgcttaagtttgtaaaataaatctaaatctaaattgtggttttaaatctttattttgctaactatctgtgttttgaatacaatatatgaatctaaatgtttgaatataattatctgtgttttgaatgtaaattttgctaacaattatataatcagtcgaacggaggtactttattggtcgaaccatttggacaacttagtcgagccatttggactattagtcgaaccggatgaactatttgaactaatcagtcgaactggatgaactatataggtcgaaccgtttgaactaaccagtcgaacacatttgaaccatttgaactaatcagtcgaaccatttgaactaatcagtcgaaacgtctcgcacgcattcaaatcgccaacaatccttaacagaaactcttcaatgtttccatcattctttgcaccagcttttactaccttgaccaagaagtacaacagcactaacttcaacctatctgaaccatgcttcatcttcgagcacttagcaagaacatctaaaacctttatcctagattcttttttgaatatcctcgaacaaagttaatattccccattgtatttagttcttttggggaactgtggcaatcaaacccacttaacaacgcatgctctttaatggaatacctaataggtactccatttaccacaaaccaagcctcctcgagcaaatttgtcttcactatgcgtaacataagcacccacatgcctgacgattaacgttctctaccccttcttttagaattgtattcaccatttcctcctcctccagctcctccccattcccgtctttcgcttcttcgaattgttgaatgacagcgtcaattagaggtttcaaagatgtacctgtctgatcctcttcaatttcggcggttcctttaggagaagcctcatcaccatcacgcggttcctccatagccttttcaatcttagcggtttcttttgtagtatcattcgccgcaacatctcgtgctgctggttcggtcggaaccaagtcgacggcatctccgtcgttctcaatttctgaagtaactggttctgatgtcgaaactttaccggacggcttgtccgtcgaagtaactggttctgatgtcgaaacttcaccggacggcttctctgtcgaatcatatacagggccacctttaccgtctccggcggcatctccgtcgttttcaatttctgaaggaactggttctgatgtcgaaacttcaccggacgacttctccgtcgaatcatatacagggccatcaataccgtctctaacacgagtcatcaaactattacacgaatcaagaattcgtcggaaaattgtgaaaggcgagaaattatgaatttgattttggaaaatttgaattgaatgagagtagaaacggtttgattttagaaattagggatttcgcttaagtgtttggaatgggttttgggttgctaggcatggatcttaattggatcggatattttgttgggtcgtctgagtttttggtcttttgccaattatttggattttctctcatttatctttaattcgacaaaaattgggaattagaagagtggcattcctggttactttttcgcagatagtggcactccagacatttgaacttttatcacttatgccacttttttgaaaaaactgatctggactgccatcagttaatctgaatgccaccgaaaatgtgatataccagttgtacccttaatgagttgattaaaaaaatgaaaaagaaattcaaaagctaaataaagaaaatcgagttcggagattctcctcttcgtcgtcgtgttcttcttctttggtcgacgttcatcttcttcgttggccaccatcgatttcctcatgccgccgacttgaaatccggcgtaaaagccacgaattaggtcagtttcttctcatatttcctttgacattggtgcattgtgattttagattgggattttgaattctatataattcccagctcgattcaatttgatagtttgatgattggtttgcaaagtaaagagtaatcgattagaggttgccgaaacgttatttgaggtgatgagcaaaggaatgtaggttgaatgtgagttgaatttgaattccgagatttcatattaaagatttggggggtttgtgtttgcaaagtttagattaaccaattagtttaacgaataggtatgtattaacattggaaatcaattgaaaggtaacgaattaggttcagtagaatcgagtgcgacgagagattgatttcaacgtatgataagagtacatgtggtataactattaaaatgtttgattggagttgaactggttgtattttcaggagcg

SEQ ID NO: 5526 - DNA, 3000 bp, Unknown
  misc_feature (1)..( 3000): cDNA_ID_3077495_gDNA_ID_1620799_Annot_ID_168586 3000 nt of promoter + ATG
agaatgcaggattcaaagactctcgaagaaaatgttgatgagtttctaaagatgatctcagacttgagtaaccttcagattcaggttcctgatgaagttcaagcgatcttgatacttagtgccctacctgacagttatgacatgctcaaggaaactctgaagtatgggagagaaggcatcaaattggatgaggtcataagcgctgcgaagtctaaagaactggaactaagggatagttcaggaggatcaagaccagtaggtgaaggtctatacgtccgaggtaaatctcaagctggaggagtgggaaataagtcaacagagggcaagaaagtctgttggatatgtggaaaggaaggacacttcaaaagacaatgttacaagtggcttgagaagaataaaggaaatagtgcaggagaaacagcactggtaaaggatgatgctcaagacttggtcggtttagttgcctcagaagtaaacattagtgaggataaaaacgatcaggaagaatggattatggatactgggtgttcattccacatgacaccaagaaaggagtatctgataaactttgaaaaggctaagtcagggaaggttagaatggctaataattcttactctgaggtcaaaggaataggcagcgtgagatttgtcaagaaagatggaacaagcattgttcttcagggagttagatacattccagaaatttcaaggaatctgatatcaatgggaaccttagaagcagaaggctatgaattcaaaggtaaccatggtattctgagagtcatgcaggactcaaacgaattcataagaggaagaaggagagcttctttgtatatactggaagcacaagctgaaatggctaattcagaatctttggttacaactacaggagaaacagatcagacacagttatggcacagtagaatgggtcacatagggcaacaggccatggatattctaagtaagaaagggtgttttggaaatgacaagatctcagaaataaaattttgcgaagactgtgtaataggaaaaacacacaaagtcagcttcggaacagctcaacacacaactaaagagaaacttgattacgttcactcagatttatgggggtcacccaatgtaccctacagccttggaagatgccaatacttcatctcctttacagacgattggtcaagaaaggtttggatctattttctcaagactaaagatgaagcatttcagtcgtttacagaatggaaaacgatggtagagacccaaagtgaaaggaaactgaaacacttgagaactgataatggtcttgaattttgcaaccataaatttgatggaatctgcaagaaagaaggaatagtgaggcacaggacctgtacttacactccacaacagaatggagttgcggaaagactaaacaggaccattatgaacaaagttagaagtatgttgagtgaaagtggtcttgacaagaagttctgggctgaagcagcagcaacctcagtatatctcatcaacagatccccatcatctgctttggaaaacaaaatacctgaagagctgtggacatctgcagttccaagcttatctggactaaaaagatttggatgcattgtgtatgtgcactctcaagaaggaaaattagatccaagggctaagaaaggtgtgtttttgggatatccacagggagtaaagggattcagagtctggatgattgatgaggagaagtgctctataagcagaaacgtcgtgttcagggaagatgtaatgtacaaagacatcttgaacaagttaacctcaggtatgagtcttgaactaccgtttgttactaacaaggttcccagttttgaatgtacaggtcttaacaaggatggtgaacgtttagttcaaggtggagctattgaaaaagagtcagatgaaactctagaactatccaatacagaccaggaagatacaggaacagaaaggattcagagaacccatcagatagccagagacaaaccaaagagacagattgttataccctcaaggttaaaggattatgaaatgaatgaggaaatacttgatgagatagcaggatatgcgtatcttatcacagaagatggaggaaatccagaacccactgatttccaagaagtcctgcaagaccctgacaataagaaatggcttgaagcagcagatgaggagatagaatccctcattaaaaacaagacttggactctagtggacagagacaattctcagaagcctatcgggtgcaaatggatattcaaaagaaaagctggaattgctggagtagaacaaccaaggtttaaggcaagacttgtagctaaaggttatgcgcagaaagaaggaattgacttccaagagattttttcaccagtagtgaaacatgtgtccattcgactcttgttgtcaatggtagttcatctaaacatggaactgcagcaaatggatgtaaagacggctttcttacatggctacttagacgaaaccatttacatggaccagcccgaaggttacattcatgaaaaatatccagataaagtttgtctgctaaaaaggtcattgtatgggttgaagcagtctcccagacaatggaacaacagattcaatgagtttatgcagagaattggatacgagagaagtaagtatgacagttgtgtgtactacaagatcttactaagtggagattacatctatctgttactctacgtggatgatatactcatagcatccaaggacaaggagcaggtatgtgagctaaagactttactgaattctgagtttgaaatgaaggatttaggtgatgctaagaaaatcctaggaatggaaatcacaagagacagacaagctggtactttgactatctcacaagaaggctatctactaaaggtactcaaggactttggaatggaccaagccaagtctgtcaacacacccatgggaattcatttcaaactaaagccagcaaatgatgaagaagtgcagaagcagtctgaagtgatg

SEQ ID NO: 5527 - DNA, 3000 bp, Unknown
  misc_feature (1)..( 3000): cDNA_ID_3077513_gDNA_ID_1620799_Annot_ID_168565 3000 nt of promoter + ATG
gatccattgaaggataatcgtttgcttcttgaagctaaacctttggatgaatcagaagaagctaatcacacagccaaagtcgtgaacgaattatcccgggagatatcgcgcattcttgtttcccacccggttaatgtaaagagagctgcacaaggcaagaatattgctaatcttgttcttttaagaggctgtggtattcgaatcgaggtttgtgttcactgtctcttacgaatgcttttaatgaatctatttgctccatctacttatctgttatgggttttgtatataaaggttcctccttttcacgagaagcatggtttgtggccgtgtatggtagcaccaacgaagattatagccggacttggtatgtcccttggtattgatattcttgaagctctgggagccactggagattaccggacgcttctcacatcgaaagcgattgctatagcgaatgcgctttcagctcctttgaatccctgcccaaatgtctttgaaccagcagaggacgggcataaaccgggaaggtcagatggttacgatttcggcttccttcacattaaggtgaaaacatgtctctgtcttttaacacaacataaaaaatttcattctgattctaaattattcgtgcaggctatagatgatgcaggtcatgacaaggctacattgttcaaagttcgaggcttggaagctgtggataaagcgatacgtcagctcgctaagcttctatggcaagctgaatcttcttcaaattaccagtatttcttgtgtgtgactggtgatcattctactccagttgagtatggagaccacagcttcgagcctgtcccattcacaatgtgccggttaaaggactttgtgagagcggttggaggagaatcagctctattagagacatctttagacccttttccacttccaacggatatagcatccagtgaaaatgtcatcggaaaagaagaagaagactgtgggaggagggaagcttctctggcgattagtggagattcagtctcagagttgaacgagattgcagctgcaagaggatgtcttggccgtttccatggcggtgaaatgatgggagttatcaccaagtttctgaagttggatgtataaatcaaatttcataaaattttgcattttttctttgaaaatttggattttggaagtgtaataaaaaattatcaactctaacaagctcaggaagttgaaaaaaaaatgtctaacaatgtttggaggtgtagttgcatgttaaagtttacactttggctcttaagatatacacatgaaatttcctttttacattagctcgacgagaaattaaagatatcgaaaaagaagaattttttttctctcgtgactcaattgcctacaaatttataaaaaatgatggtcacttagttaatgaagacactatctttactagatctaaacaatctgtaatgaaaattacttcacgttaatgaaagtcaatcatgcatttcattgtccaaacgaatgcttttacatttcaagcacataagtcaagatttatcgaaggttgacagctcccataattggcgtgtcttcatttgatagtgtataaaaccatcatattcctgagaaatcatcattcctttccaggaaccataaatgaaatatatgaacctgtgtttctgtaactatctccatttgagttaaagtctacgaattggcttcattttactctaattggagaacctcacttgggtctttatccacattttcataaaacttctcatttcaggctttccaaatgtattagatatttagatgatccaaaaaaacttgaactatgggagccacataattcaaagcaacttgaaaatgttagttaatttatattgaagctctctcatcattctacaaataaaataaaacattaaataaatgtgatatatatacttattaattatattgtctacctaccagactaacaagcttaccagtccaccactgtgtttggtttatatgtcgagaaaaaacaaaaatctataataaagaaaataaaagtgactggagaccgataaaataagtatcccaagcgaaaagtccaaaacccaaaatcagaccagtaatataacttgaccgtttcttaaccggtaattaccggttaactccgtctcttccgtcgacatttttccttaccagacccgttttgtttttgtcttgtttcggtctcttaacaagtcccgttttgtattcttcttccttacttcttattctatctataaaacaacaacttcactcatcatgactctttttccccattttcttactctcttgccctttcttctctcactctccggcgactgttacgagtttttaacacttccgtcgtcttctcaggtttggttcttctcatttatgttaaaccattatgtatggtaattctagaatgtagatctggttcgttctcatggatcttgattaatatgtttgtttaatccacgtattagcactaattttggattattatttggaactgttatcattagataagttttgaattatttgcttaagtaagtaaagaagataagagaaaataatatttattagtctgaacataatcttatcttaagataaacagaatttatttccaaaaaaataagtttttgttaaactaaacacaatttattaccagcaataaaaagattctgtttaatgttgttatcttaataactgatcttttgtctgttttttagttgttgttgttgtttatgacaagatcttgttctatccattaaaaccaaagaaatggaggaaggtcataaagaaccattggtgctaagagttgaaggatcacattgttctttatcagagatggatgattttgatctaactcgggctttagagaagccgaggcagctaaagatcgaacggaagagatcgtttgacgaaaggtcgatgagcgagttatcgactggctatgtaagacaagatagcattttagaaatggctcattctcctggaagtaggtca

SEQ ID NO: 5528 - DNA, 3000 bp, Unknown
  misc_feature (1)..( 3000): cDNA_ID_3077592_gDNA_ID_1620800_Annot_ID_168607 3000 nt of promoter + ATG
aaattacgcaatatttgaaaagtaagaattattgctattaaaaaatcttgatacgattcaaaaaaaattatataaaaaatacggtttttaattatttaaattttcagcatctttacacaaaaaagaaaagaattcattctcatgttcaaaactatctattttgttaactttgtttttgaattatgcaattttaaatatatttcctaataatactagggatgtttgatcttaaaataaaaacaatttggtcttagtcatcaaattttaattttttttgggtttttttttgccgtctatatttattatttattgcaaattatgagaactgtttcatatacaattctacccagaacaatttttacgactcttattagatctacgagagatgatatctccttcttcttctccatgcttttgatagacatattcaatgatcctctttacgtagaatcttgacgaacggctataattgtacatcgttggagatctcatgtacatttacctccattaatctgcaaatttgttaataaatcttagtatctgggactcgaacctcaaattttttggtataaaaacattaataaacctttcgtcaatcaaagggatttccaaaatcacgcaatatccctacctaaactggaaactccgacccaaaatcaaacaaaaatttgaattcaacatccctacctaatactacgtatattatatgaatacaacgtacctcaaatagtattttgtctttaccaatataaattatataattataacggacctactaatatatatacaaaaaaaggttatcgatatctcttctctgtacaagagatcgagtcatgaggaaatgggcccgtaaaagagtaaaagaaatgtacaatgaagaggagacaaagccatgatcctgccttttgctttgatctcttcttttttgtatgggttccactacgttcgttacccatgccccacccacgttttcgacggttcctcgtctttttttggttcttctctcactcttattatacacttgtttatcttttttagattcaacattttaaatagtgattgttgtttgttcgaacttgggtcttataagtcctaatcaacatttaattggatccattagaaacagttctttcattggagctacgtgttacgtttttctgatatatgataaatattacaaataagactagccattttagattttcaaccgtaagtatgtgtagaaatacacggttttaaatttataatcaacaaggtagtagaaaagatagatagtccacactagatatgagtaaaatatatacatcaagtcatattatataaggtgggaactatttgtggttttattataatcgttagaacgatatctcgaatttatttagctcaaaaacaaatatcactagaaaactactacatcaaaatcaataccatttcttacaaaacaatatggcatattgatagaagaatgtacaaatcttcgatgccataaacagtcgcatcagaacagttgcatgaccgtgaccatgcgaagtagtgtacatcctcatcctcacgttcgaatgaacgttctcgtaaatcgttcctacaacacatatccctaaagagagagcaacacatcctgtttgtttaatgattcggccactaaaataaacgtgtagttaagaccaaaaacgtaaagcacacctgattagaatattgatctctaagagtaaagaacgcatatattggtggttttggcggagctaaattccaaaaaccgaacataagacaggtagttagaaatgattttagagtatttgtttttaaaaatgaaatcctttagaaaatgcaatttcttgggacgataagaatgagaagaagacacgattctgaatttttctgaggccaacttcatggccgactttggaaaccgcattcttagccactgaacggcgcccttaataccatagactattctcaattttgttattaaaaatacagccaagaaacaaaccaaaaaagagcacgaagaagacaaaagacttaaaaaaaagtttcaaaaggaagagatttgtgggtgtaacacatgccacgataaacgattctcctagtaatagtatctgtccaccgatgatctaaacgaccaatttggcatttcccagttactatcataattaatcatatttgtcacgtagattcagatgtaagattactaaaaaacatctcaattattttcacaatcttagacttaagtgtttatagcatgtggataagggatcatgatcataagtttatagttatgtttagtgttttgtttttggtagttttagtttcaggcggttttgaaacactttttccgatccgacctatactcattttattttttttgttttatttacaatttaatttacagattagacattaacacatattttcaatttctcaaaattatccaaaatattcatatcttaaagatgtgaaaatttatcagaattagtgaattcgaagtgtaatttagacgatttaaactatccgaatccgatcaaaactatacgattaaaactatccgaatccgagccaaaacggtatttagtaaatttaatattttattccgtatatttctagcaatatatttaaatactcctgcccattacctgtttatacgcaattacctctaatcatctacaaacctgtcccaattggacacttctggcttccccagtcacagcctaaacagagcttgactcaataaacagcaaatataattgcatcaaaacaatactttttttttacaaattttttattccggaagtaaccccaaatggtcaataaggttccaaatctctgaaaaggaatgaggtcacaaccccacgtgggataccaactagccacagtggcacacactcgtaatatatagaaacctccaaggtcattttcatagttctatccccttataagcaatagccacaactctctttgctaattacattttacactcatctcgttctctcttccgtcaat

SEQ ID NO: 5529 - DNA, 3000 bp, Unknown
  misc_feature (1)..( 3000): cDNA_ID_2154433_gDNA_ID_1620800_Annot_ID_168609 3000 nt of promoter + ATG
ttatcctttttctcatcaaactccactttcatcaagtcttccaaatctctttaagtcctttttcttttttgattcatcctctaaacacgctcttctcaaatcttctagaaaccgatactcacacaaaactgtcgcatcctgaattatttcttgaatcattcagcaattttatcagataaaatcatgtattacttcttgtatcattcaacactttcatcagcagcagctacatcttcaacttagtcctgtaatttattttcttaacatacaattgaattcagctaatcgtccttgcgaatgatcaaatgcatagataattgtatcatcctaaataaaagacgtggggaaatcatatgacatctagaactttggagaagggggagataagtgatgatgcatggaagcatttcccaaagataatcgaatagattctctcttttcttttgtgttcgtcagtttttctttaccattccccgagacaatatggtgggtttattaattattttgattcttctataattcttcccattatttttatatattctttttaagttacccattcttttttcttcaatgtcgagacgtcgagttagttagcttttacggcgacttatggataaggcattacgctcggagccatggactgagttggatagatataatgcgtataatatttaatccccataacctatattttaattcctatacattgtaatggtagcatctcaactttaaggttagagttggaaccttaaagtttatgaatattacaaaacacttgtatgggggtggagtgcatgaaaattagagctgggatgtatatatgggaatatatatgcactacattatcttacattttacattgaaaaaatattagaagatattgttcttcatttatttaagtatatttttactgctggtgtattctactgccctatatatatctcgaaagttaaataaattcatatgttatataacttttagtcattcgtggcattcttctgttacatcttactgtggatttttcgtcttattatcttatagctgactcttactttagagagacaagtataccacaatggaaagggtgatttgacggtaaaaaaagcgattgcagtgtacccacaaacgacaatttataatttgtatgtgggatatatagtaagggaaataaaaatcatagggttaaatagaaaaagtgaatgaaactgtcttgtagttgtagtagacgaatcaaaaggacacgtagatggtcaagatacgaacctcaaagccttttccctcccatttaatgattcttgtttttgttttaatctataatttttcatgattttcttaagtctttgttttgaaaatcacgaacgaataagttctgatggatgtacttgaatattagtaacaagactaattgaattaaagaaaagagaagttattcctttgacgtttataattttccgcggctaagggaacatatacgttccttgaaactgttgccatgcaacttttgctttaacagtttagagagttttttacttcatgctacatcctttttctcctgacacacacaagagcatattatacatccatgtacctcctccatcgaccatcaatatatagatacatgtgattattaattatctacataaaaagttataccacgaagttgcgattgataatatgaaagtggtacatgctcgaaatagataatgagaatatatcagctttagttgtctcatcgttagtcaatctatatgtgcatatacagttaacaagaaatctataagcatatacgaactggggtcccaataaggtctaagaatcttttttttctttttttcttttctttgctttgctttagtttagtttgtgaaatttagtgaaaatttcattttgtctcatagagaaaccacatgttagtcaaaaattatatagtaagtccaagaaaactatattaatatacccatattaccatatagtcggagatttctagtatctctagtttagttcttcttattcattatcaattcaagtgttataaaacctcgagaccaataaaataggattcactctccttcgtgcccccaaagatataggtttacatatctatatttccacaccaccattttaaaagcaagagttaattaaagagatattttttagtcatcttggtatgtaatctggtaaactttttagtttgttatcttgtataaacaaccagtaagattttggttcttttgtaaatacttctctttgaatttaggactagtgttttaaaattactttcctcccatatttttgttttgatctttcaatttaaattaaaagttcgtttacaacccatgcatgcacacttccgaatttaaactcggattataatttggcactataataatctattagaatacgtcttgattaattttaaaatatttaggtgtcttaaaataagtacgtacgttgataaatatggagatatatacatctgtcaagtaaatggtattgaatttgccagtattagcttttgtgaagctgacgcaaaatgaaaacggctgatatctaaagctttaaccttgtgtttcttttttttgtttaaaatagtggggtctagaaatgataaattaatttaaagtcctcgatatatataaatagataaatttgtttcttttgggaataacgtagtttacggagaaacccaaatgttaaagggaaatgcattaaagctgtagcaaaataagaaagtaaaaaccaattgaaaccctaatttcacttcaaaaaatgttcccggttgttaaaggaagggccttttgctttgtccatataaatatattgtgagagtacaacaacaccttcataagctcttacactcatttcaactctctttttcgtttccattaccctcaggtaatcataacatatatataagttacatttgtagatacatatgtctttagttttgtgtaatttgttacttaattattattttctatggtgttgtagaagaag

SEQ ID NO: 5530 - DNA, 3000 bp, Unknown
  misc_feature (1)..( 3000): cDNA_ID_3077584_gDNA_ID_1620800_Annot_ID_168612 3000 nt of promoter + ATG
attagcattaaaacccacacagctaacaacatcaaagttatataatattacagagatcaacctcgatgaaaagttcccaagactatagcttaagcaacagccactccatcatcttctcgatgttgttgctttggataaactgtctgtgaattggtttaaacgctatttagcaggcgatggaggttgctcgaggagttaccagaacagcagtctttcctgttatcggcttcatacttgctgcattctctagccttgcccatacttctttcctcttttccgcagcagaacattgctttgcttcgtcctccttaaagcgggcgtggcaagacatgaacagagcctcgtccatttcgcagaacatttttcgtacgtttaaggttaagtttagcacggattggttccagtggttctgagcattcttttctaaagcagtgaacatgattggtaggatggcttgccggttatgtccaatcaagtttacaatttgatcgttgttccacaagaataaagctctttcagaaacctgaaacacaagaagaccaattggttcaaacttagcttatcttagactcatgcagatcaatcatatatgagaactatgtatgaataggaatgtacctgaaagtgggaactggtgacacaacaagcaatccgcaagaacaaagggaccatgatcttttgaaactccatcacactcattgcttctacaatttcttcgacctccccgagaaacatcacttccttctgactattcgtgataggccagaacttcaacaaaccctttatcacaacactgcctagtttcggctctttatctatgaactgagtgatacaataagaaagctgctgaaagtagtttccaacagatttaggcttgtgcaatggaatcaacactctccacaagaagatcttatgctcttctttcaaaggcaacgcaaatccactcactatactcccgaaaatctccaaaagctcagcgattccgctatgcttctctgtctcaaacacaaaccggtagaatatattgctcatggacttgcgtacaaatggcctatgaaccatgaacttcccatatacccgatgcagaatcgtcttcaaacactcccgttctctaggatcctccgaatcaaacaagtcaagcaacctcacaatgaaagcatgatctaaatacttttttgccactttagcatcaagacacggagaagtgataaacttaagcaacaaatcatacacaatctgcaaatgaggccaagcagggtcaaacatcggttcatcatcatcgttttcgccaccagaactagaccgataattcggaggaaagaccctaaagagattaacagcacacattctacacattgcaagaatagctggctcagtgaacttaacagaccctgaagctacaaaatccaaaagctccaacaatgtctgccttttaacatctttctctatagagtttttaccagggtcagagaaatcaaatgtcacacaacagagactaactttactcacaaagagattcaacttctcagagcttggtacatccttaaacggtaccaaaggctcaataccagcaacaacactagctgggaacacagcagatgacatacgcttccctgagttagatcgaaccggacccgaaccaccaccactagtaccggatctctgaaccggagacgataccggacccgaactcgaacgattcagctctcctgaatcagattttgaagacttcctcggaagtttactcagaaactgcttaaacattctctctttcccaaaaatttcaaaactttcacaaattgggaatcaaagaagctcaaatccacatattagccctaaattctccgacaaagaacatggatctgacattaaaaaaaaacagagaaacgtgtaatgtgggtttagatccgaagaagaagcagagaaaaaaaaaaggttgacacttttataatacccaatacttgaaaaccctaatcattaccttgctttctccttcaaaatcttattctcatgattccagtatccacgaacaaaaacattcctagagagagagagagagagaaaaaaaaaactgaagctagagagtttttcaaaaaaagaaaccaaatctggaagaggaagaacaaaaaacagagtttggattttgagaaattttatgattcgttacggtgttttcttcattgtttttttttagatttctgagaaagaagaaatttgcaggaaaattattttaactttcctaattttaattttgtttttttcctttttgtctcgaaaagacagcgttttcgtttcagttttatttccgataatataaaaattagaaaacatctcgcatgcaaattattaacgtccgtttgatgagacgttgacacgtaaatccaaccgttggatttgtctgagagaggaatcctaagtaatttggttcgctaaggcccatttattattatgagcctattattaaagcccatttatgattttggccttatcacaattcacaagagtatcctccactaatctctagaagaaactgttttcgtcaccgaaccagctgaaatctttttcgcaacaaaacaaactctatccccaaattcagaagctttttagggtttcttcttcctttcgcacatatcttctccgattgattttgcagtgaaattgtgtatctttttgttgttaatcaggtaaacttttcatggtcgccatgtttattttttcgctagatcgagctttttttcttcagtcaatttcggattttatttggtttatgttggtgtatattttttgatttggttgttgttgaatcttcttagaaatgggttttgtttaattttgaattttgattttgtttttcccctaatcggaaatgatgaaaatggagatgtgtgttgatcggagtatgttataggattgaatcaaagtttctgttttttttttctcagagctgttgaagtgaatgtttggatatagctgtggtggtttcgtatcatgtccagtaat

SEQ ID NO: 5531 - DNA, 3000 bp, Unknown
  misc_feature (1)..( 3000): cDNA_ID_2154448_gDNA_ID_1620800_Annot_ID_168615 3000 nt of promoter + ATG
ttatatgacagcttttgcaggtttaaacacacagaaattcacggaatctattttcctcatttttcgcctctgttcaaggacttatttagttgattctaataatagtacccagagagagacatatgagcgcaaaagtacctgcatatagatttatggcatttataattttacataccggtagacaaaataggtccaaactgtgtttagattccatctttttacattgacattaactacaattattttggttgactaacgtaagtttcggtcataattagcatttaaataaggaatgaaacatagcaacatatcattgatacggtaatagataagagagattcatattaatatcgagcaccaagagcagaggttgtaattcatagcttttctcaaaaccacaaaagaaaattcccaaattctcaaactgaaatctttcttaaaaactatacattgtactctcttttcccagagacaaagtggggaaaatgtagaaagagatctcctaacaatatatcatgaacttcatatcatccatttgcaaaagaaacttaagaagaaaaaaacttcacatttttttaaggactgatcaaatcaggaggaggatacgttagcgttgcggatacccgaagatgacgatgcactactcccatcattcttttgtttcgaagactctgtgatgatctcaggtacatcaccaatgtccagtgtgtctggaaggtattcctcagcttcagtactgtaaatctgtagaaaagaaacaccaaacgtcattactatgcttaatgcaggaagactgaagaatgaattacctcgagttgattcagcatttcgatagttgcatcaagatcacaagtgttagccaagtaaacatcattgatagactcttgtgaaagaccagggtatgtagctaatagatactcaatatccatgtccatctccaaatcctcatccttcagctgatgattgtataccatctcagatggtgacttcttaggtgacatttgagttccttgataacttcccattccttgaactccatacccataataaggttgttgctggtggtgctgctgctgcatgtgttgttgtgtgacaggctttgtatcaaccaaagaaccttctcttttcgagagtggtacataagctgctgcgtaaggattcaatgtagaacttcctgacttcattgctaagtgacacaatccaacaaacgaaagaagagttcaaatcggtgactacaaatcagatccctaattgttcaaaaattgattccaataagaagaaacgtgaccttaacctaactaatcaaaattgatgccacaaactcgatgacctaattcttcgtgatgcttttaggtacagatcaaaatcaatcaacgcaatctttaacagaaacgaacaacgaaaccctaaggaatcgattctaagattctaaaagcttcataaacatagttgaatcatgaatctaacggagatagtagataaacatgaatcatgaatctaacggagatagtttcttctcccatgatcgaccaatcaaagcacgattcgcgtatcaaatcaacatagatcgaagaaatcaacagatagaatcgaaagaaacggattcaaaacggaagaacaaaaggcgagatgattgcgattacgtcaacgatcgtcgtaagacgcttaccttagagaagaaaatccaaaagcgtcgttgaagaagaagaagacaatggtgaatatttgcagagagagagagatctaagaaacgctgaaaaagtggggagaggaaagaaaacgactcttttgatcaataatggacttttatatgcaacaaagaagaagaagcgtttacttgaaggtcgtatcattttaggggtctgtttggaaacgtgaattatcttatccctaacctggttattgttatcctaatattcgttttctttataaaaaaaaatctttgatatttttacctggtatgctgacgtgtcttttacaaagtggctacctcttcgttcctaaatttatctctacatttgaaaaatgcgtgactaaacgagatgaaagtgattttttcttatgtcctactaatcatgattatataatttgttaatgtattatttaaaatactaaatcaattagattttctataaccaagaaaaaagaattaggtcaatggaatctgcccaacctaatcacggacgatgttttggttaaacatatcgttaagatttggatgaatcttttatgtcatgtatggccggttccaagtgtgactacaggatttgggcaaattaacaaacacatttataaaacatttataacataatttagattaaacacacaatttaaaaatcaagtcttagttttattgtttggttttgaatctatatatcttaaggtcgattaatggtttcgtagtgcttcaatatgttatatatggtggtgctcctcttttgtaagttatgatcatcagatttggtttagtagacatttcggttaacttaatattaaggttcacaacaaacaaacaaacccccctaaaaactagcatcatcacatactgttttatgagcatcatcatctcagacgctaaagtagtgggacaaattcatttcaaatttgccaagtcaattcaaaataaattataccaaaaatcttaatttacgctaaactagtgggtctttttctccctaaaactaaacgtgttatttacttattcatcgtctcattgtaatagaattgaaaatgaccaagagaaaacattagtttttagacattctcggtcaaagccaatactgtaatgaaaaaacaaacagtttcacataaatctactaaaaatagcgttacaatttttttactctacactcacatctaataataagaatcactacctttcactgctaatctctctctctttacaaatccaaatcttaaagaaaaccaaaaaaataataaagaagaagaagaagaagaaggagagtgattaacaaaaacataaaactccattagagtgtg

SEQ ID NO: 5532 - DNA, 3000 bp, Unknown
  misc_feature (1)..( 3000): cDNA_ID_2154460_gDNA_ID_1620800_Annot_ID_168619 3000 nt of promoter + ATG
ttcttttcaggcttttggatgggcaatctctctttgattgcttcaggtttctgtcactttttgttctacttgcagctgcttgatagtgttacacttttgaaaggtttatctcacagaaagactctgctactgatagttcttggtcgtttgacatgttggtatgcaagaagctcaccacataagatggaagctttaagttcaactacgaaacttgtttttcgttttgttgttcttcttgagatgtcaggatgtttgtcttccaccactgctaccacgtctggccctctcctttggtagtcgtctctgttttgtacataaaaccttaatcagtttgttgtttccttaactagtcttgtaatatttgttatttgctttcttcatctagacgtccttgttttatataaacagtctatgtatgttgtattgtacaatgtttaatatcaataacaacaccttttggcaaaaaaaaaaaaagaggagatattaggaagatactataaaaattggatgggtgtctaaaatctaaatatgttacttttttttaaagacacccaactactccgtcaactcatggatggaggtggtttcagatatatagaaccggtccagacctaaaacctccgtcaattatattttactttaaaaagataccaaatttgagtaaaagtcttgtaatctagtaattagtgtctcatttaatagcgtaatgtcacgagtttgagcattgttccattaaatgttttgataattatacatttcaatttgttaaaaggcaaagaattgtattgggctttaggcatcaaaaatttgggccggtcctgaaaatagatgtggtttaagatagttgaattcacttaggttgtgattgatgttttttgtagagaggataatattttttattattaaatagttataagttataaccatggttagtcctcgggtaaataaggtgaaacattagtctcagactactaaatttatgaggcccatcgacaaatcaacaaaacaatatacacattgtttcatttttagtgatatttaaggattttgccacacaaattggaaaaacattattaaaattttttttttttatctttttaacacaaaaaatcattagctataactaattcaaccaaaataaaaacatactatacaatgtatttagttaaaaaaactattgaatagattttattttttcatagaaaattgaatacaccacttaaaatgaaaaaataaaatctcgaaaacatcacttaaagtaagatgaagagaataatatataaatattgtaagtccccaattttaggtttcggcaacaaaataagtatcaaattcttttttttgccgtctagatttattatttattacaaattatgaaaattgttacataaacgattctaccacggataatttcttccgacctttattagatccacgacagatgatactttttctccttctccatacgtttgatggacaccttttaatatcttctctgcatagaattttggcaaacagctataattatacatcgttgtagatctcatgcacatttgctttcattaatatgcaaatatgctaataaatcgcagtagctgagactcaaaccccaaacctcttgatgtagaagcattaataaacccttgtctaactattggagcttccaaatagatatcagattctttaacttctaaaatttattctcattaaaaaaaaaactgattgaaagaggcctaaaaatgattgtgcctcctacattttattgtcgtcctagttatacgtagttaagtagttttactacaaactggttacaaattttgggacttttgccaaaatcataaggacttttgacaattttgccaaaatcatgaggcctaaaaattgattgggcctcctacattttattgtcgtcctagtattctttaaccatcaagaactttccatgagacagatcatgagacttttgccaatttagtttatgtaataacatactaaaaacatgttgtggccgatcaaacacaaaccaacttctttttttttttttttttttaaacccaaaccaacttcatataaaaatttgcagaaataaacttagtttttttggttttaatttgttttaaacttagaatttgcagaaataaacttagttttaatttgtaatagtgaggatgaaaaaatgcattagacaaactacgaatcccttttacaaaaagaaaatagtactatgcggtggattattattcaccccaaaaagtttatgttagtattttgttgaaccgtcaagattcaagaacagtcattgacaaaaagatcatgatacttctcttaatttacattatctaatatatcatactaagaaacatgtgatgtaattccttcctagggtcaaacccaaaaccaacttaatttataattaccgattataattggcagaaatatcaacttagtttttcctggtttaaaattccattatttgtatttgaataacttatattgtatatagaacgaacaaaacccgttggcacgttagacgacttttgttatctacaaacaattattcgtcctaaaaataaaacaatatagtctgctattgaaaactcaaatatcaagagttaaattgttctaaaaagcaaaagaaaaaaacgaaagaactattgaagttctttattctaaaaagcccaaaaaaagaaaaaacctttttcattaatgttttggttcaatccaaaacgttacgtgtacaaaagctacaaaacgacgccgtagtgcgttgagatatgtgaccgttagcaacaaataaaaatatgaatacagagacaagacaccactacagcgtgagagagcgagtacaaaacataacctccactcgcagcgcgtgagacaaaacacccccttctctcttcttcttcctcctcctctctctatctctctgctgcatttttgttcccttcattatcaatctctctctcccaaacaaaaaaaaagcctcactttttacaaatg

SEQ ID NO: 5533 - DNA, 3000 bp, Unknown
  misc_feature (1)..( 3000): cDNA_ID_3077572_gDNA_ID_1620800_Annot_ID_168627 3000 nt of promoter + ATG
gcgatgaatattatatttgtcaactcatttaacctccttagtcataacatgtttaattttgaatttatatacaaatacaattaagatggtgtgtctacaatcctttgcccactaacctccactttaactaatagtatccctgttgtctttttttttttgttttgctctgctttttcgctcacgagacattcgtggggaagaatgacttctggttttaaatcaataattaaagggaatttcacactggccagttcgtttgctttacatagaaataagataaaaggaagaaaaaacaaagtgatgaataattagtcgtgcttagttttctaatagcaaatggggtagctaataattacccaatctgtctaatgattataagattaagtggggttgtgagaaagaagaaagcaaaggtaggaattctaacatgatgaaagaacttatacatgcttaattgaaactttattactttttagttttaattagcttatgcttatctttttttctcagacagtttatgcttgtctctttgatattcttttatctaatttatttgtcgaatattcttctatattatggaatttgatttgtaaaatacaccggagtgttttacataagttgcaatatactaggttaagaaaacaaaaatttgaaatatactaaaatttatagaaattcaaaatgagctatagaatgtaaaatatatcaaaatatcttcaagtaaactaaccattatctacttaattgaaatgatttaactattcatttttaaactaattaaaataatcaaacaattcctgttaatgcaaagtgtctccagaagtattcttccctcttcactcagagatgaaagctttaatttaggttatgaaaatatcatataaaaaaaaatcgattgttagacatttgaaaccgatatcatagaactagtcgcgatagtgcagtcttgggaagaatggtccattttctccaatcaactaatagtatctggattactccgtgttcaattgtttttttttatatgttatatttctcatttgtgtaatactagaatgaatagttttaaaaaaaaataaattatttaacatatggcaaaatctcaaatcaagacttttgacacatatcacgttttcgtgaattaataactctaaaaagtatactttatataataaaatgtaagtatgatgttttaatcaagtacacaaaactatacggctatactaaaatatatttttgggtattaaattctaattagatatataaataaagaaattttatttgattagattttattaaaaaaattatatcaaatccgtgtgagtcaatcctaagaaaattaaacaccatgcacatgactatctttgtcttttgcataacgaaaatgttcattggcctaatttatagtcattgatactgatggacgtacgttaattctctaatattaaacattggattataatttagttggagtcattagcatagatagtagaagatgatgtgtcaaaacaattaatccttcgtccgcatgtacggctacatatatccacgtaatagtcagcgccttgtcaaatggaaaataaaatataatgtagtgtgatgtcaatgggtatataattaatacattggaaacaaaaagaaataaaaatgaatggatgatggttacatttttggtctttctgcaatttacaaaatattcatatcgttgggtagttggaaggtgaggtttgggttttaagctccgaccaatctactcttgccaaattagagctaagagattatgtattgtgtctatcgtttttatttttgttttagtcgaccaattatgtattgttaagtgggtgactactagatcacacttatcctccatttggaaaccttttctaatatgttgaattcgaaaacgttggtaacaattagtcctcatttgaagaaattgcttgaacaaaaaggagaatacatgttaaatatataaagttcatgaattcaacacatcatcttctaaataagaaggttattgtataacccatatctaaccaaattccactatagaatcagtaacattactaaatcgggtttagaatcgtaaccatgtcaatattaataattttgcttatcaaaattgcttatcaaaatcagttaacaagtagtgcaatggctcatatatcttatgtgttagacatgcatctaaccatctatcacttgggcacacagaagttaatcaatattagttgggtattagtgtctcgtacaaaggtgaaagactaaagtaggcaaaaatataatgggctttaaataccaaaggcttatttagctggacaagcagatgaaaagttgaagtgtcgtcgttttacagtcacatctcattcggttaaaaaatcaaaaagaaaaacaaaaacaatgcggtgagcgtggatcgaacacgcgaccttcagatcttcagtctgacgctctcccaactgagctatccccgcttgttgatatttattactttgtatgttatatgtgccattataggtgcactaaacagcaaaagtgattttttgggggtacaatctattattgtaaaagtcaaatatatgcaatgcaagaaatcgtcttgttcacaatccaagaaggtgttgtgttgtttaaagaattaattgtaatactggttaagataatgcaacgcgtagtcgcatagacatagagtgcatcaagaagagtcgatgcctgtcttacgtgacgttaatgcgaaacttaattgggctggcctgggccttctgaaggccctatagattttatcgaccaaagtagaacaaaatagaaaggataaaaaagaaatatttgtggacagcaaacataaatttctccataaaaaatttgtcgtttattttccttatctcaatttctatggaccctatctcttgagaagtgtaaatacaggtggcgtttcttaatcttgaatctgtgaaattagtaattacatttcgttgcagaaaacatatacttttccgacaaaac

SEQ ID NO: 5534 - DNA, 3000 bp, Unknown
  misc_feature (1)..( 3000): cDNA_ID_3435687_gDNA_ID_1620800_Annot_ID_168621 3000 nt of promoter + ATG
agaaggtgatattgggtttttgatgtcgggccttttgggtataaggcccattgtatttgcaaatcacatctcaaaaaagaaggtaatgttggtttttttatctaatcaaaatatcataagagtttatagccataaataacgaggtatatagtggttacattattcggagcttaatcggaagtgttgagttagccgaatattagcccacaagagagtataaaactaggtttacgtttaggtaacgataaaactatgataagtgacacaactaagtgaggacaaacacacaaataaatattttatggaattcattagggtcaatcgaaaaatgtttcgagcttcagaaattaatgaactaaatattaagaatcccacattaaaagtttgagaagcctataataatgtatatgtaccatataataattcactcagtaccaccaattagttttgaattgtaggccgataattcctaaaatacctttgtatgttcatttcctcaaacttcatgtttagatgtccattctaagcggaaaaggggtattagaatgtttctattcgccatatcagaagttgataggcttctagagtaatgtataagatacataagcgcttttacttattgtcaactggttttaatttagaacctcatgatattaacgttaagattgttgacccatgtaaaatgactcaagtaggatatattgcaagtgagtagaatgaaaattccacattcaaaatgtgattaaaccgtaatatataagtggtatttgggagtctactcactaccaattagtttgggacagtacaaatgttataatgttatcactggaaaagaaaaaaggcaagcatagcgtccgtagttgggatgagagttactatcaaaactatttgaaccaaaatcaacaacattaaatacataggtgttcactcattctccaaccatggattgatgaaacaaaataatatcgaaaataatgatgaaaacgaatgaatattggtgagccataaatgagttggttgttcgttttaatttctctttgtctgaaaagtccacacgaaagttaagattaccagatcccccacactcttttggttttgcttttgaacatattctcgatcgaagtgaaaaaatttcttcggcacatgacactgaagtaccgtcgaaacatgccaacgggcaacgaccgtccatcattattagtagtttgattttgatataattaattgatattttaaaattaagatatcggaaaagaaaaataaatattcaaagaataaagtaaaataattatcatttttaataactttcttacttctaaaacttactctcattataatcctcctatatttaatacacaaattatgttgttatgccatattttgttttcagattaaaatgtttttattgaaaatcttctaattactatatattgttataatgtatctacgttgtaatgtgaatctaagctttttaaaatttgaaaacattaatttttgtacaaaaataaaataagtattactccctatgtttctatatatatgatgtttgggttaaacgcaactatcatttaatactgtagttttaaaaattcaaccaatcacaaaagagatggtataatctaaaaagtcataaaatcaatacatttaaaatttgtattgaaacttgtaaaatagcttatataatgaaacaaaataaaaacactataacatcctatataatgaaacagagaaagtattattaatagctatctaccgcgtttaactatcacactaagcttgatcgatagattgagtcagagtggtactaaaatcctaattatatatattggatgcatgagaagtttctttaaagatgtaatctatttcaaataattatttggaatatggccaattttgttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaagttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacctcagctcctttctactaaaacccttttactataaattctacgtacacgtaccacttcttctcctcaaattcatcaaacccatttctattccaactcccaaaaatg

SEQ ID NO: 5535 - DNA, 3000 bp, Unknown
  misc_feature (1)..( 3000): cDNA_ID_2154452_gDNA_ID_1620800_Annot_ID_168616 3000 nt of promoter + ATG
tttgcgctttgaaggtcaaacaaatttaattgtatgattgagaattaggtaactaaataagacattcatgtaatggcatcaaatatttatgatctcagacattttggaaagtttgaaattctttggtgacatctggtcttatagatattttgctgtcaacttagggcctgactggtttaaacgcagcgggtgcggttgcggttgcggaagtttgcggaaacgggcggttgcggtttcaagcgttatcaagtgttttgaacgactggttgagcgtttggtaatgggtgcgtttgcgggagttttatgactggtaaaccagcgggtgcgatagtaattaaataaaaaataaccaaaataaatataatatattactattaaaaaaaaaaatacaatatattattatgataaattgataatatttgaaaaattaaacatacttaataattaaaaccataaataaaactgaaaattcaaaaataaataaattttataagaaaaagcttaatactttatgcatttggtacatcaccaaaattgcatcaagtagtgtgataaactgtaaataacgttgaactcgcgggttttccggattgcctctatacatatgataaagtttcttcaagatatccaaacgatttttaacacatctccaactcaaattttttccaaacgttaatattcttaagaatattttctttttgaacatcacttagaaatctgattttggggtctttggattcttccgtttatttctccacaataacctgttgcagtaacgcaaatgtggtctcgtttgaccaaatgattttctaatcgagaaaacaaatcaaaacatgtattcaatcaaaaaactcaaaaaaaaacaaaaaaaaaataaacaacaatgccatgaaatattccgagaattacactagctaatgaatggatgaaaggatagatcatacttacgtttgattcttgattttgactttgatttttgtcagtttgggtggatgccataattgagagaatagggtttcattgattagggttttctgataagaataagtatagggtttgggtggaagatataattattttaattaattaatttttttttttaacctaaccgctaccgtccgcaaccgcaaatacttgcgggaaggagcttttgaaatctggcaatttcgaacggtatctagcggtttctatgattggtgccaaccgctaataaccgctaccatctgcaaacgctgcgtttgcaggtggcagaaggagaaccaatcaagcccttaaaacatatagatttggttgacgtttcttaacccaaagaaacaatcaaaattcgaagtatgtggaaacatttcctttataagaaacccacacgcatttttttttacttatataaatctcctcacctgcaagagaaaaaaaaaactttcattttattcgtcgtcagtttcatcttgttgcttcggagcgagcgagaattatcgtcggagaatttatcgtctctctctctgaaaattctgatcggtgaagaatcgtcggatcgaaagttcgtttatcttctcgtttacgtttccgtgatttaaatcctttggggtttttttttcttggtaatgtctgtgtttctgaatgtgtggttgatttttgttcgtacactttactttgatcgattaggtttatgtatagttaattgaaattttttggaagatttcagaagaagaagagaagaaacaatccgtaatctagacccttgaattgacctaataataggatacatatgatgactatgaagcagtctttgagtggcagggttcttaggggggtctttggtatctatctgtaggagggcttttaggtgctgtttcgggagattaaagccagattcaaggtgagtctgagagcttggttcttgtatcttcttgtttaccaatgggaatctaggtcactgagaaaccatccttcttgttgatctagtggaaaaaatcgattatttttctatcccaagtagttgctttttctttcttaaccttaacttgtgcaatcttcattctacctaagcatttccccttgataatgaaactctttaatcatctctgatttggccaagagtgttctttttttttgtcatctcatctatggtggattaacagaggttcctcttagttattcttcaagaaggcggcatgaatgctcactttgtttgtagtctgcttatctcagctatggtctccatagtgagtttcccttagagcatatctcgttgttgtccatgatgaagtttttgctccatgcggatcttgtgaacttgctagtagaatttttccgggtaacggcatcagaagatttttattccttcgattatggggttaccatttaggtcaagccaaaacaggtcagctttaaagatgggggtccattaactaggagtacccttcaagcctttgtttccttaaagaaatttctgattcgtatgttgactgaagagatctggtgcaaagtggcagtgggaggtaggtctatcctctttggacacttacccatctctttaaaacccggttatcccaagttttatgtcagtcccaaaccttgtttgatggtgtttgccttgcttttacgataggttggtcatatccggttgaaactggatagatttcccaagattgaaggactgaagtgaacactcaatgtgctaagcttttatttctctatgaaagctccatcaaccaagagggctgtttttagttgtttaacagggtatttgtagatcttcttgttttggtgattgttcctcttggagaaagctgattggagctgtttcaaaaatggattgtcttggtgtggtgcaatgtagatggaagcaacagttcatcgagtttttttgctggattttcaggtgactgataatgtttgcgaaatgaggaatagattttctaaatattttcttacttgcaggtttcataagctttccatcaactagcagtatctgccaatatcacagacagataattcgta

SEQ ID NO: 5536 - DNA, 3000 bp, Unknown
  misc_feature (1)..( 3000): cDNA_ID_2105426_gDNA_ID_1620800_Annot_ID_168614 3000 nt of promoter + ATG
aatggttgcgaagatggtgatatttgactcggaggaggagaaaaacacgaagagccaggactacacttgaaagagtcacaatctacaggtttcgacaaaaacatcttacactccatcatcgatctttggtccctcacgtccttgaagcaattcatcgtataattataattctctagatagcgacacgtggctggttctccggtgaaatagttagacccgtatctaaaatctcttagcttctcaagcgaacatagctcatccggtattaaaccggagagcatgttacgttcaacgttcaacacctcaagattctccatctgacccatcgacttaggtaactctccgaccaaccagttataactaatgtccaaaaccgtaacgttttgaagtaatcccatgtcattaggtatacaagattgtaaaccgttatccataagaatgatctcgtttagagtcttacccattttaccgaaactcggcggtatacatccttcaaaccggtttgaggctagaactagaaccgataccggtgaatttcccatgttaaccgggattttacttctaaaccggttactattcaggaataaagcgtcaagatctttatcgaacaaagattctggtaattcaccttcaaactcgttgtaccggagatcaagatactttaatttcggtaaaccgattaccacttccgggaatttaccagcgaaccggttattactaagatcaagttcgaaaaggagactcaactgcgaaaacccgaccgggagtgtaccacagaaccggtttgagttaacgtgaaacagagcaatatcggttaagaggccaagctcttcagggagatgaccagcgatatctccctggtttagatcaacaccggagacagttttaaccaaagggtcgtcgagagattcggagcatactacaccgttgtagtcgcacacacgtgatccaaaccagttagttgtcagattccacgggtcagagatcatggcacgtttccacgcttgtaacgccacgtaagctctttcgagccgtacgttttcgaatattaggtacggaggtatggttatagggtcgtctcgggtgtacaaaagttgccgggagccaccaggagcgacggcggagatggagagtaagacgacggtggtgaatattaataaggttggttgataaatcctcatcacactctaatggagttttatgtttttgttaatcactctccttcttcttcttcttcttctttattatttttttggttttctttaagatttggatttgtaaagagagagagattagcagtgaaaggtagtgattcttattattagatgtgagtgtagagtaaaaaaattgtaacgctatttttagtagatttatgtgaaactgtttgttttttcattacagtattggctttgaccgagaatgtctaaaaactaatgttttctcttggtcattttcaattctattacaatgagacgatgaataagtaaataacacgtttagttttagggagaaaaagacccactagtttagcgtaaattaagatttttggtataatttattttgaattgacttggcaaatttgaaatgaatttgtcccactactttagcgtctgagatgatgatgctcataaaacagtatgtgatgatgctagtttttaggggggtttgtttgtttgttgtgaaccttaatattaagttaaccgaaatgtctactaaaccaaatctgatgatcataacttacaaaagaggagcaccaccatatataacatattgaagcactacgaaaccattaatcgaccttaagatatatagattcaaaaccaaacaataaaactaagacttgatttttaaattgtgtgtttaatctaaattatgttataaatgttttataaatgtgtttgttaatttgcccaaatcctgtagtcacacttggaaccggccatacatgacataaaagattcatccaaatcttaacgatatgtttaaccaaaacatcgtccgtgattaggttgggcagattccattgacctaattcttttttcttggttatagaaaatctaattgatttagtattttaaataatacattaacaaattatataatcatgattagtaggacataagaaaaaatcactttcatctcgtttagtcacgcatttttcaaatgtagagataaatttaggaacgaagaggtagccactttgtaaaagacacgtcagcataccaggtaaaaatatcaaagatttttttttataaagaaaacgaatattaggataacaataaccaggttagggataagataattcacgtttccaaacagacccctaaaatgatacgaccttcaagtaaacgcttcttcttctttgttgcatataaaagtccattattgatcaaaagagtcgttttctttcctctccccactttttcagcgtttcttagatctctctctctctgcaaatattcaccattgtcttcttcttcttcaacgacgcttttggattttcttctctaaggtaagcgtcttacgacgatcgttgacgtaatcgcaatcatctcgccttttgttcttccgttttgaatccgtttctttcgattctatctgttgatttcttcgatctatgttgatttgatacgcgaatcgtgctttgattggtcgatcatgggagaagaaactatctccgttagattcatgattcatgtttatctactatctccgttagattcatgattcaactatgtttatgaagcttttagaatcttagaatcgattccttagggtttcgttgttcgtttctgttaaagattgcgttgattgattttgatctgtacctaaaagcatcacgaagaattaggtcatcgagtttgtggcatcaattttgattagttaggttaaggtcacgtttcttcttattggaatcaatttttgaacaattagggatctgatttgtagtcaccgatttgaactcttctttcgtttgttggattgtgtcacttagcaatg

SEQ ID NO: 5537 - DNA, 3000 bp, Unknown
  misc_feature (1)..( 3000): cDNA_ID_3077649_gDNA_ID_1620801_Annot_ID_168648 3000 nt of promoter + ATG
catccagtgagtaacaagttcctcacctgcaataatgtcaaaaaagggagaagttgtttatttcagttgaagatgattttttgagagacagggatgattctcatcatgtgtaaatatttacccagctttttccttcaagttgacagtagaaagaggcagatgtgtatccggcaattccagaagtgagagcgtaaatgaccaccaaagcggtaaagagtgctcctcggttgtatgggtagaacactccaacaagagcaagcatgaaaataaatatggtgctgatgacatggaataaaaggaaaagctacagttagttacagtaagaagaaatgcggatatggatgaaagtgtatccagatggaaagtattcgagttatgagagacttacagcgtgaacaattgagtgccactaccgagcgatgcagcaaataaagaattgtgagtagggaaccgaaacacatcgccatgaatgtacttccatccagtttcctcttgatcatcagcagcttcctcatcttgagcataccttttaagcattggaataaggttagatgagatagacaagtgtaaaacagtcgacagtgaggaaacttgaaacttacttcatgaaatcgttcttgaggactcgcatcaagatagttgcaaggaatccagtcaaaagaaggacagtgacacaggagttaataatggagaaccagtggatttccaaatgatgtggaagagaagaagacatagagtacttctccattcttttctcaaaaggagtctcagtttccttccacttcacagtgtacataaactctgcatcaacttccttatcctcagtgagatccacaagcgaatgaggatccattctagcactgatctcgatcacacggtccttattgtatagaatctcaaactgaatgtgcttgtacaagaaatatttgaattcactcggatcagatttgatatccttgtcaacctttccaatgaatccccagataggtagatcatcatagtacatctggaagtagtagtccttctcaacagcttttctgaactgtttgacctcttctttactcaacttcttgttgcagtatacctcagactctttttcatctctgaagttgagcttgtatggagcgctaactagccgatccccgtttagaacctcgccaagagcttccttcttctctttcacaccctctataaaccatattcaataatgggatgatcgaatcaggagatgtcacacaaatcagttgcggcttaaacacaaatcgtgtgattaagctagtaaagatataagcatacctgggatacagaagggaagatcaaaatatcgatacgtctcactgcaatcatcattgaacaaaaccaaaatcagtcatataatagtattcaaatctaagacagatccatcacataaacgaaaaacattccaaatgtagtttcttctttcactctttggttttaacattacgcattttgcagtgtactcagttatcaatgtcgttactcaattcaatagcaacagattcaacaataaacgatcaatttatcatcctcaggcttaagaatgggaaacaacctcagatctgaagctcagatctagaatagatgtttccgtttaccttggattgtgaaatgggccgaccttgttggcgtagagaggaacggtgtctccttccttgtaacggtggtcggaggcgtcggatctgacatagccggcgccggagaagaggatagctccgacaagaaggagaatcgtcgtcggtgtcctcattgcgtattctgctcaaatcgtgagatctgagtaactttttttatttgggagaagagggagaaaaatggaggaaataacgacaatatttatataccaaagacttcaatcaaactcgagtcagctacacaaattttaatatttttattattttctcactttatttcataagaaaaatacataaaaaaactatagtcaataatactttataccatttccaaccataaaaataaatatcaatgtctataaattcataaatatatggcttttgaaaccaagactaattatttataacaaatgtgagtggcatttaacaaaatacaaatcattttcccatatgtaggctaattaaaccaaaaaaagaatatgtaggcagtgagcgaactaattgttctgccaaacctatgtatcttatagtgttttttttccttgggtcgaaaatcttatcgtattaacacttcataaattttgaatagttaaattattacttctttgtattagatgtggagtggagtgactatttttttaatatcttttgtggttatagtatagtgaatatgaagaatgacgaatgatgttacacgagaccaagtttttgaaaaaaaaaatatatgaatctgataatcatttttcctttacgtgcgttatcgtacgtaattgctttgcatgatctcacgtcatgacagcaattatagaaactaaacaatttaaaattctcatttatacacaacgtgcatcgttttgaggcatggataatttaaggttttcgatttatagattgaatcagcaagaaattacaatgtagccacttataccaaaaataaaatcaaacaatttgaacaagatacattgaagtatggatcaaaacaaacaaacaaaagtgacactagttaagtttagagactagagtgagtcggttttgttatttcataatttggttcatgtaaatatatgtacccttcatttgaacagagtagtataatccagtaactacattcatatctagcaaagaaaacagaaacctaatcaaaaacgtattaagatttctcaaattttcgttcaaattagtgatagaaaaccagacgtaaccgaaataaaacaggtcaagccaaaccagactagattcaatcttggttcactcttaaacgaagcagattcggttcggtaaaagcatctttgaccgtaatcactggcaaaacgaaagattgatcgtttgcttctttctaccggagatg

SEQ ID NO: 5538 - DNA, 3000 bp, Unknown
  misc_feature (1)..( 3000): cDNA_ID_2025342_gDNA_ID_1620801_Annot_ID_168649 3000 nt of promoter + ATG
aaataaccagtaaatttttgttttcgaatcttgccagacagttcgtacctgagcataaaaactagtgtatttgcaatgtaagcggccatttccctacaaaagttatagggcaatcataaaaatataatatatacatgtaaagatttcctttgatttgacgaaaaaagaacactgagttgtgaaataccagaagtgatgcagactctggtgactgtcccccttaaaagctgtccttgcaaatgcagcgaaaaacctattacaattatgttatgaacaatggctttttgacacataacaacagaaagaagggataatttaccacgacttacatccccaaaatcatgacagtcaaaattccagaaaccccagcccactcttgagcctgtacatagtagaaatttcttaggtttcctagagatttaagattctccattggggactaagttatgtagaagagaagagcatacagtgtaataggcgaaatagctcgctgaaagtgttacagtgatctgagccaccgtgtcattgaatatgaatttaagccaaaaaactgatgcaattccaaaagctagaccaatgcctacactaaaaaaccagaacaacataagcggagaaaagaagacagcgacatacaatactactaacaaaggaaaataatccatacgctccgaatgagttttggacaagaaatttgattatggaaccccaatcagagttatgccccatcaccatcttgaagaataattgaaaaaccacaaccgataccctgaataatccaaacaactaagcttgatcatatatgacataacatcaccttgatgctaaacataagagtttgacatggttacccatcgttcatgagagattccccatcaattaacgtggtcatcttcttactagcaccaagctcctttagcaaagcaacaacagccacggggtcggtagctcctaaaagtcctccaagcaacaatgatgttttccagtcccagttatatggaaaagtaagctacaagagcataactcgaaaaaattgttaagttaattgaagctcacttaatcacagtcgaaaatgttgaagctagttaaagtacctttataagagctccgagacaaaaggtggaaatcagaactccaggtccagcaagcagaaccatttgtcccatacatctctaccaatgatgtaaaacaatcaataccaggaaccaacacagccaaggaagtagctcaatcaggaaagtaaaaaccttgatctggtgcacatccatggagaatgagctctcgaaaagaagaacagggagaaaaacagccaaaagtaggtcagggttgataccattccctgtaaagttgccattttttagagctcgtaatctaacagtatggagaagagaaaatacagtagcttacagatacgaattccatggccgagcttcccaaggttatgcttagttccatattctacagaagcaaaaaaatccaaaatttaactactttctaaaatcttccacgaaattgaaactgagctataaagcttaatgagcaaacaaataagacctagggatccgagaaaaatgccgatgacgagaagaacgacggtgtacggaactctagtgccgttaaacaaatatctacaagcggtgccgagaaccagcgaagttcccgcgaaaataacagcatcaacaggactcgaatcgttctcagctgaatacgaagaagatgcaattgctttctccggtgatttgtacggcaacgccgcgccgattatactcgtcatctccggtagaaagaagcaaacgatcaatctttcgttttgccagtgattacggtcaaagatgcttttaccgaaccgaatctgcttcgtttaagagtgaaccaagattgaatctagtctggtttggcttgacctgttttatttcggttacgtctggttttctatcactaatttgaacgaaaatttgagaaatcttaatacgtttttgattaggtttctgttttctttgctagatatgaatgtagttactggattatactactctgttcaaatgaagggtacatatatttacatgaaccaaattatgaaataacaaaaccgactcactctagtctctaaacttaactagtgtcacttttgtttgtttgttttgatccatacttcaatgtatcttgttcaaattgtttgattttatttttggtataagtggctacattgtaatttcttgctgattcaatctataaatcgaaaaccttaaattatccatgcctcaaaacgatgcacgttgtgtataaatgagaattttaaattgtttagtttctataattgctgtcatgacgtgagatcatgcaaagcaattacgtacgataacgcacgtaaaggaaaaatgattatcagattcatatattttttttttcaaaaacttggtctcgtgtaacatcattcgtcattcttcatattcactatactataaccacaaaagatattaaaaaaatagtcactccactccacatctaatacaaagaagtaataatttaactattcaaaatttatgaagtgttaatacgataagattttcgacccaaggaaaaaaaacactataagatacataggtttggcagaacaattagttcgctcactgcctacatattctttttttggtttaattagcctacatatgggaaaatgatttgtattttgttaaatgccactcacatttgttataaataattagtcttggtttcaaaagccatatatttatgaatttatagacattgatatttatttttatggttggaaatggtataaagtattattgactatagtttttttatgtatttttcttatgaaataaagtgagaaaataataaaaatattaaaatttgtgtagctgactcgagtttgattgaagtctttggtatataaatattgtcgttatttcctccatttttctccctcttctcccaaataaaaaaagttactcagatctcacgatttgagcagaatacgca

SEQ ID NO: 5539 - DNA, 3000 bp, Unknown
  misc_feature (1)..( 3000): cDNA_ID_3077645_gDNA_ID_1620801_Annot_ID_168655 3000 nt of promoter + ATG
aagtatatccttactggatatgagaaaataaatgcaaatgggttggcctatgttattgggccgatacccatttctctaatgaaaagaaagatctataaaaacaaacttctgcttctcgactaggacattaattctgaggtatgactatgaaggtatcatattattttgtaattcttggccaaaacttgtcacctgtgtgtttgtatgttcttacaaaagagaaaactaatgagcattaacttctgcaacgtttattttacatgtttggtcttattgctgattcagtctagttcgtcgagtattttgaaaacaacttgaggagttaatcaaaagaaacaagcttaatgtggtatatatgttccttacgactatagttcctattagtatgatgtagtcagcaagattgacttatgatgactatagaaacttcactgaatatctctggtggtcctagacagtcacagtgtcctactgtatctttagtttggttcgccaagtctagtatcggaccgtatagatagagagatgtcaattgtgtttatgtgttttttttttctctctgaagcaaattgattgatcgatttgtcagcaattcctttcgagtcaaaagttttgaccaaccagcttcttcgtgaaactctctagctgtattcacacatacacacacacacctaacaaaattattgaaacagtgggtttgatgtaaagcctaaatcattcaaccacctctctctatttcttttttgttctttttttctatgcaacatatgattatatattagatccatgtgatattgcttgagtctttaatttaaggctttataaatagaacaaatataggcctttttaggtcaacacgtgtgtgtggaaatgatgctaatgcttccaaaatgaaacagaataatgtcgtcatgagctactcatttacaagaggattgttttagtgttggattggctaatagacttggatcgatatctataatatagaccatatatataatatgtttagcctaaacaatgatatatatgtcatgtgacacttatgtgttttagcaatcactaaaataatgcaaacattaatacatgtaggtgagttgtgagttcaaataatattagtcaatactcaatagtcactgtaattgatattttgaatggcttatcctatgaaaatttagtactttcatagagagaaaaaaaaaacaaatgttaatctaaagacgacaatttagattttagcagtcgcaccagaactagtaccaggaaacataagataatatatacaggactagctacttcattatctttacgtagtttatgacaaagattgttgtataatcttcatcagctgacttctttatttatgaatgaagtggttagaactcaacttgtcggctaataattcaagcaacccaacacaatgtttgggattatcctgtttctgtcttcttctaaactttctaaagtaaggctgcttgttctgtcagtacgtgtgagatattaacatagttataagacaaacataaatatcagaaattcaatatataatgtcataataattgcttatttgattagtagttgtgtctctcgctctggtggcttcttgctttcctccctgtcggattgctagtggtttgacttcgatgtgagttctttccgatcttattggtgtttccgacgttttccgtttctttggggaagctttgtgagggttcctggttcttttgcgcaattttagtgcttagatcttcgttttcccttaacggttgatcttttttagatatttgtcttttgttttcttcgttggtctaaatagtttctccgttccgttgaggcttagttttcctcttttgggcttagtttttggagacatttagttggtctgccggcgtttgtatttcaaatggtattctaccttgggtttttaataaaattcagacaacaaaaaaaaaaaattagcagttgtggcaagcaataatgaaaggtttggataatgatactaatttttttgctgattaaattaaatatagaaataagattttcaacttattcttaatgaaattagtggagtggagtgacattggccaccaccacttccttgcttttgattagaccaatttggcatatttttcttgtaaaatatacacacatcttctattaattttagcttcactcaaaacaaatactatttctgcatttcatcattcaaaagtgatttacctctttattctcatgattaaaggttcatttcaacgtcgatagtagtatttaaattacaatttttttttttggatgcataagactaattctaaaaaatttggttggtccaaaaggtcgtcatgcaacgtacaaatacgatatacctaaacaattgagtactctataaatacttttatacatctgatcatcaaagaagacaaatcttattctctttattctattgggacgtgttaccaacgctcctctaaaacccacgcgctcccgagaatccgtcactttaattactttattttatcgtattttcatgaagacgaataaatactactaatatcagagaataacaagataaagtaggtgacaaaagaaaattagaaaagagaataacaaaataataaataacattaatgtagtataaatttttaatagtgtaaatatgacaaaaagaagctcagttttattcagactttttttctctccacattcttcttctttctttagtgtttccaacttaaccctctctcttttcttgcaaacttttgctcggaattctatgctttgctgatctattgttttctctctgcaaaagtaatgagaagctttttgctatgttaagctttagatctgctattatttgttcctgtgagtcttttatatcttgtgtggtttctttgagaccttaagcagccattgtcacaagctgagctctctttctttctctctagttcaagattctaactttggagcaagtaagcaagtcagagagaggacaaattagctgaaatg

SEQ ID NO: 5540 - DNA, 3000 bp, Unknown
  misc_feature (1)..( 3000): cDNA_ID_2032139_gDNA_ID_1620801_Annot_ID_168657 3000 nt of promoter + ATG
caaagctcctcatgactttgaaacttaactaggtattcgcagtagttggattaaaaaaacagaggatttagatggctaattaaatcccttagattaggctttatgagtcttttgatgttcttggctcttcgggatggagaatctttagccgttacttgatatttctatttaaggaaagttgggtttttgcgagatggtgacttgaatttaattttatatgtaaagatggtcgctttagtttcttgttttggaaagttatttgatctataacagagacccaaacagagaattttgaaagaaataatctaaactccagttcactaaaagctggaatttctaccaaaactgataacattcaagtaatgttttttgcatttattgcagattttatgtagacaatgttccgatcagagaagtcaaacgtacggcgtcgatgggcggtgacttcccggcgaagccaatgtctttatattcaaccatatgggatggttccaaatgggcgactgatggaggcaagtacggtgtaaattacaaatatgccccttacgtctctcaattcactgatctgatcctccacggctgcgccgttgaccccaccgagaagtttccgagctgcaaagatgaagcggttcagaatctccggctagcatcggagataacggagtctcagaggaacaagatggagattttccgacagaaacacatgacttattcgtattgttacgatcatatgaggtacaaggtggttttgtcggagtgtgttgtgaatccggctgaggctaagcgtctcagggtctatgatccggtcacgttcggtgggattcctcacggccaccgtcgtgggaagcatcggagcaggagccgattagctcgaactgagtcgatatgaatcggtgtatattgttcggctagagggcatttttggcattttctgtcttgtataggaatactatgaattatggactgaataatggaatgacaccgctatattttgatttcctccattttatgaacattatcgttttaacataataataaaatttcatttttctataagtaaacaaaatcgggattataattttagaatattttacgtatgagaaataatagaatgatgagaatactaaagtacattaaaaatataatgtataccgtgcatacaatgattcttttcttgcatcttcttcatctagctatgcatatatatatgttctcattattttggttttcaacaaaattgagtaggtttgtttaccttgtacaaatgttcaaagacgggtccaactccaataaatattgttgacttcaatgggatattttatttgaccatatttacacattaagttcattcacatatacacaatgtgtcaattgataatgtcatttcgaggtacatcgatgatataacttgtgggtccgtttggggtgacttgtgttgcgtgcgaggtacatcatattttatggagtccaatggacacatttgtcaaagagattggtcgatcgtagtcctgaagtgtcgtttatatggtttaccaagtggtgtatccacatagcatcttcttagtgaaggctttttatatagccaaaaaaaaaaatgatgttttgattcatataatttgttttaggacttaccactcatgtaattggccaatgcggcaatgccatacctcttttcttaaaaaactcaataccatacaaaaacttaattagtggtttggttaggattacatcaaaagtatgataacaacggcaaaaatgatctttaagcgtgtcattttagtatttgcggacttgaatatgtatatagttcatattccgaccattaattaatgatatcaatgactttggtaaagaaagaataaaactcgtaattagtgggaggtaaagcttgtagtattagtcaagatcagcttttagtcttttacataattgtttgtcgactactactaatctgaattatctaaagtatcatcaatgaaagtttggaacaacacataaagtcaaatctcatttatttagaaaaaatcaccaaaattcgtattctttttagaaatatgtcgacaaagggaccaaaactttaacaaaatgccgtaacttacaaaatctcatggggccatattagattcatattttatctttatcttaatactatgggccataaggcccatttatcccaaagcaaaaaaagcgacgtgataatcataaattaatcagcatctttaaaaagatgcggaatctcgatttcgtttcaaatctgatatgcataaattagagggacctaatataaacaattttgattagtacagtataaatgtataatgaactaaccgaaatttagcatttgactacagaaaattgtaaaattgcgtaattgtcaaagttggaattattgaaatttttattttttgtgacaatccgaagaattttcatgaagaaaaaaagaagagtgataaagagagtgagaaatgtgaaaataagacatgcgtcttaactaagccaaaaccaaatctctcttattaccctttttacacacacctctctttcctcaaaaaccctagatctctccctctctctctctctctctctccatctcttgtctttgccttttacgaagcttcccttcccttagtttatacattactctcagctctctttatttcactcagcttcacgttgaagacgagtttctctatttgccagatctgttatctttcacatttctggtgattgcttctctaatttcgttctgggttttactgtttccatctgaaatttacctcatttcttcgtgggttttatctgaattccgttaattcccaagttctagtgtatgatctcgttgaaatcgagttaaaaatctgatctttactcttgattctgcagatctgtttgaagaaagctatgacttgtgtttgataaagagagaagcaaaaaaaggaacagtttttatataaagatatttgctttatttgtttgttcttaattgttgccacgaaaatg

SEQ ID NO: 5541 - DNA, 3000 bp, Unknown
  misc_feature (1)..( 3000): cDNA_ID_3077637_gDNA_ID_1620801_Annot_ID_168664 3000 nt of promoter + ATG
cttggtaagacttaagagcgtctcaagtctcaacattccataagattctctgagcaatgtctcgtacagttgcttgtttaatatttaggcataaatcatatctatatattactcttaacttaagccgacatattaacttgattatcagggattattaacaattagttgtcacagtcccaactaaaactttgatgtaagagacccgattaagtgattaaataaaaagatcctccaaactcttactaaaaaaaaaaaaaaaaaaaaaaagagtaactttgtatgaactatgaatgatacatatcatacattacatgaatttgactacttttgtgaatggcctgtgagtgctgacgtatacacttttgtccacgtcagcatcaagtagccggtggacctctctcgatggtgcccactggtaagtaatgtcactgaaacggataaattatttctgcagcgcaattaacggcaatattgacgccgttaataccctttgtggacgaataccactgtctgtcaggtaagtaggtccacatcaattcacgcgtcacataaacaaagcaatttacattatcattgttgtgtatagatttggtaacgaaaacaaaataaacatttgtttcttattgttttttgttagaaaagttaaaaatgataataatttgggaactcacaacaacggtcatcgtcccaacaagtctgctgggagcaaattagcgaagaaaaagagttttctgctaacgtgtgcgtcgtttgatctgagctcatggaatctaatggaagatcccaatgtggaatattcattcacgtgagattttttttttgtttgcatcaaatctcacgttggccaatcgcagccgttcatttcttcatggggattttcctcccatgcatgtgggtacttttttaagtttttgctggatccaacggctacgatccgaaatttggctatgtgcaattaagccaaataaaagaactcgggttaacaagtctaattagtaattagctttaactatcctagcaatgaaaggcgttgggagattcaaaggtaaactagtgtctagtgatatgataattgtatttgtaagctacaaaggccatgcgattacgtaccgttttttgaaaaaaagtaccgtcggaaacaactatggaatgggccttcattttcaaagcctgatacatagtgatatgtaataataagaaaactatatccaaaaattgccatgtcaccgtacatcaactcatatgccatccctctaaatatttgattgtactaaaactcagaataattgacgataatataggttatttcatatatttattatatttgaatgatcgaattcatttgaaaaactatcaaaatacaatttcttgatcagattattcaaagagtttctatacttttgggtcaattttagatgtatcacataaatatttagattagagtcaacgaggataattatactaatactgttgaattgttcaaagtttcagtttgataatattgtggtcaagatagttgaccattaattgacattgtattagtcaaaagacataacaaacaaattctcggtctattgaccaaaaaatttccaagtttgagaaaatctgatatttatataggagcgagccatgcagcgaatcttagtttaactctactttgaaaaataccatggaaaaaattaaagacctaataagcataagcctgtgatttatccactttgttggtggtatataaggtacgtaacatagaatcagcctccatcttcctttgatataagaaaatctatataaaccaaaactaatactcggttagctcagcaagtacaatttatttatgatatttcttgtgtatccaatccttaattagtgtaattagttagtataatcatttttattgtataacataaaaaacgattacatagtttggttgcggataccttccttgcctctcaccctagtctaatccatctttatattttgcaaaagttataaactattattcagccgctctttatgttaaagcgatcaccagccttgtttcttacatctttaactctgccctacctctcaaaatttaagaataaacataacatctttggacgacgtatagtaatggagttatatgtttgatctattcgtacgtgtttgttctccctctttattcaacataaagataaataatttcttacatcaaataattaagattgcaattctagaaaaaggcaatagaaggtagggccaaagtgagttagatatatgagattagaatcaaacgtacaaaaaattccaaaacattgaaagttcaaacccttacacattagctgtcttcgttatagaagcctcttcatttttattccaaacccttacacgtaagctattaattcgttcaccaatatcttaaatcactaattataaagtacgtagtaggaaaaaataccaaattttataattttccaccaattcttaaaaatattttattcccttcagaaaaacaataaaccatcgctttggatacttcaacattttaaaacgtcattttttgggggaaaatagcgacaaattttacattaacaaaaacatataaaaatggcacatttcaattttgtgcagggcattcgaaaattcgaaattgcgaagtttaaagattctaaaccacagttttttccggattgtggtcgaatcaacctttcgggttagatcaattttaacagcattggttagaggtatatactattaattagacatctggcgtacatatacgtacttacgtgtgattctaagtttccatttatatattgtttgtgttgttttcacaaaataatcactttagtataaataacccttttagatatcatccttacccgacagaacaggtgatactcaatctagcacattctcttctcttttgttctctgtatcgcgctctctctctctctcttcattgattgagtcatcatcttcttggacaagaagtggtccgaaccaaaaccaagccagaga

SEQ ID NO: 5542 - DNA, 3000 bp, Unknown
  misc_feature (1)..( 3000): cDNA_ID_2053264_gDNA_ID_1620801_Annot_ID_168673 3000 nt of promoter + ATG
acctctttcagaattcctctgagaacatcagcgttactcaaagataaatcaaactccactttttcctctaaagcagaagcaacaccaacaccgttagcatcgctcatgcttggatcaaacatgaactccaagactctaagagacaggacttcattaatcctcttcccatagtcatcagagtactgataaccaatgttcatcaaatctgaaacaaggaacttcatattaacacttgctctcaaaatacacaaaaaccgtaagaggagtttcgggagttaccgagtaagcagcttagatccttgacaaatttggctacatattcaatacaccataaccattcagctatttgtgcgggtcgagaagaatactcatccatgagatcctcgaggctcaaatcagaaccaccatggtcatccataagagctgcgttacacaaaaatacagaatcaataaaccctaaaccattttctccttaaaaccctcaaatcgatcaattactaaagacaagcctagagatttcaacaatcaatcaaaaactagcaatgtcatacacttagattcaacatcactgatacaaaatcgctatcagacataccatagaaagagaaatgtaagtaagaatatgaaagcgaagcatcaattggctaaaacgtagaaataaggaagatgaattttacaaaccctagaagtgagttagcgcgaaattttccataatgaaaatagaaaaagaaaagcccattgatttcgcgaaactgccgccttaaattttgaaacttttccttaagaaaatttgaaatcgagacattcttctccggtcaccatgttggagtctggttagtggggaacttgggaagacgaaaagacagctgtgtatattgggccgtaaaagggccttactcgtttttctataactgatcagcaccgttgaaatttaaataaaatcatcacgtaggcttattaactaaaaagctggcataatatttacttaggccgacgaaaaagctttattgggcctggtccattaatatgtctattttctatgtctattatttccaaagaaaatagacatattaatacatgaaataaaaatagacatattaatacatgaaataaaaatagacatattaatacatggaaaatagactcgcatttatatgttgtctattttcgttgatccaaacaaaaaacaaacagaaatcaattatttaaaatatgcaatacaccaaccaacaagctacacgagtgttaaaaactatatgattaattagatatatagccagccgtaaaaaaaaaaaaaaaaaaaaaatagatatagagccaaattttaatttaaaacgtgaggcaaaattataattaaggaatgcagttttttcatgggctattttttttaagatagcagaagtaatgtatataaattgtgatcatttgaaaaaaggatttaatgtataatttgactaatcctgcgtactaattaaaccaatgacagtgaaaaagattataagaaataaagtaatagtaataaacaaacaagaaagacgcgttgcgaaagctgcgttcacacggacgctaatgatttaagatcaaatcatcttggagatgtatatctacacactacacttgtttcttgtcgactatatgtgaccctttttataacttacttttttatttgtctgtatcattacctcgaaaagaaacaaccaaacaccaatcgtcactacatatattttacctttaaaccttgacatgtgaatctaaaaacataacttatacgtatttgttccgtttattccgattctgaacaacttattaaaatgctacaaatactcgacatagaagtcaagctatgatatcgagttagagaggatgtaaacaatgcaattttatgttctgatgttgatgtgtatgtgtatttaccgacattgttttgtgttatctttatgcgtatacgcgattttgtagtcacatcagcttaatggtgtatgtgtgaaaacaaaagcaaataagagaaaaagaagaggcaacttctgtgtttcttatgtagatgcttttattatgtaagaaagagacgttagacattgctatccaaaattaactaatcagtcaaacaagtttttgaaataaagtcatgttcatattatctagttttatcacctaaactggaaatttttgatagggttaattagccgtgcggagtactacttccaaagcttaaattttagattgctaattatgataaactaaacgttagtgcgtattaccacttttcatgacaaatggaatgattgaaaattcgaaactaggaacaaaaaaaaagaagctgatttggtataatcagttgttaaattcatgtacaaatcgtatatatggttggagctagctagactgcgatcggtttgatatgtgatcaagtcataaaataagacttttgaaactctagtttcttcttcttcttgagacgcgggttaaattgtcaaagtcacaaatctttttgttttctgttttatggaaatttatatgcaattcttatggccaattttgattgcaacaaacaaaatttaaatgcatcacattcaattaaaccacatcaacgttagttaccatacatgtatggactaaaacatctgtagttgatttatagcgtagacttcctatggcttttagtatctaaaattctaattaatttaatatccaccaaaatcactataatgttttaacctttttaaagcataccgttgcaagtaatctatttacgtgttcctccgacgacttcgtaaacgatgctgttattcgtcgttttcatacttttggaataatccgataatcacagcatcacgttctttctcttcctctgttcaagattaatttatataataagttttttgattaatcatcattacaagcaatcaaccattaattatttatttctatattagtagtatatatacaaatgccttttctcctacaaaagactcgctgcttttactacaagaggaaacagag

SEQ ID NO: 5543 - DNA, 3000 bp, Unknown
  misc_feature (1)..( 3000): cDNA_ID_2053288_gDNA_ID_1620801_Annot_ID_168665 3000 nt of promoter + ATG
gagcaaaggatcattcaaaagcgaaaggactctaatactagtcgggattgcgagtcttactctggccaccagaattgaagaaaatcaaccttacaacaggtaccaaccatattccatcttcatgattctgacttccaatgttcattagaaaagtgttctgagtaggaaaaagattaggaccattacaagaaactgagtattacgcttaaccaaatcaaggactaataatggtctaatacaaacccttatggttcaatgaattggcatttcatgtgggtatcgaatattggattatgtttctcaaaaacactctttactggaaagaaccttccacaatacacaggaatagttcaattttcttcaactgctcacctgatacttgctctttttaactagcatccggaaaaggaacttcaccattcagaacctaagatatagccggcatgaagtggtggcaatggagtggctggttcaagaagtcctcaacttcaaatgcttcacacccacaatcttcaacttcttgtggtaaaacctctctgactatatattttcatgttccaagacacattatccacacagaaagatacatatgactatcatttatacatgtcaggttctacttaaaagctgctcgagccaatccagaagttgaaaggaaagccaaatccttggctgttacctcactatccgaccaaactcaactctgtttttggccctcaactgtagcagctgcactcgtggttctcgcctgcatcgaacacaacaaaatctctgcataccaacgagtcataaaggtatcatcagtcccttcaataacactttaataccttttagtatcgagaatatacaagaatcttcacaatcccaaaacctctctttctctccaggtccatgttagaacaacagataacgagttgcctgaatgcgttaaggtgttttcagtaacactctcattatatacaaatctcatttttaccactaaacgtaaggtaagtgactgttttcacatttttgttccctatacaacagagtctggactggttgcttgggcagtaagcaatcaaaaagaacaaaaaccctaaaaccaggacacagtatactccgataccaacacacaggttatcattactatttacaaaaacaaacacaaggtaagtaataagaactcctctacagatttatatacttaatcgagctggacttaattagctcttagtataccaattattagtgccaccatttgtgtcgctcatacacatttatttcttattttccctaattcattagactctcatattcttaaaaagaatatttccttgtttgatatttcctctttattacgtatgaaaggttttcaatttttctaatcttcactgtttctgatctcaaatatgaaaaagcttatcaaatccagcttaaaaagagagtgtagtcgaatttaactaaagatttaaaaatggtaatgtttttcttcacacacgctataggatgcattctcgacggtaatcaaattaaacagtttgtaaaatggttaaagcaaaacatgcttgtaaactagagatttttttttcgatcaaaaattagagatttatgtatgtaacaattatagaataaatactagcatatatgtatgtacgtacataaaagtcagtctaattctctaataaatatggtaatcttatgtgttataaacttataatcttatgtgttataaaatctcaattttaattttctaacattacggttgggattaaacctttcaacccattcgtttaagtaaccagtacattcatgatacatcaaacaattaaaataaaataaaactatatacgtaaaacttaaagcccaagtagttgaaatgtcagctttacggctatgtgagagtgggagtgtcgttctactgaaggttgatcatgaagaatgtatttcagttaggaatatcatatgaccatgagtccatgatatgatcctagatggatagtgctagtgtgggggtagagaaggaagtgagaaataagaagaaatagagatagtggttatgggccctttagcgtgaatctaatttacgtgagagttgagaccactcgtaagtacgagactaccatagcttagataatgggccttcacttaaaacaatattataaaagaccgtatcttaagtggagcttagttacatttactgaatccattaagaaaatcctaaaccataaattcagtttgtgcaaataaatatacgattatttgcatacaattgcatatcctataattaataacattgttaaaaaaaagtcaacggctgtgtgcgacactgccaaaaatatgccaaatgcttacaaaacaaaggtaagaagaatatgacaagttgggcatcaataatacgttacgtgttgacttttcaaattttaaattatatacttttaatatatattcggacctggtccatttatattcttgaaacgtaaatcacttcacaggattgtattatcgatttagttcttataaatacaattaaacaatatcttaatcagtagcccatcaaatttaggttatttttacttatgtttctatatatctcaataatattatgtaatcatttttctttaaacgtggtaagttcagtcgatgggaatatatgctttgatttgagtacaaagacgagacttatttgtcatcccaaatttcattatgtccgagaaaaaacaaaaacttgtactgtattttaaagcatcgaagcatgacgaaaaaccgcgtctagtgactcgtgtgaacactttgaaccccccaaaaaaaaaaacccgttagatatattattatgctcgaacttgccgaatttttaatgacaaaagtaccctcaaaaatctcacgttattacacttttgccattgagacgaccaaactttttcccaccgttttaccaatctctctctctctctctccgcatcgtaatatccactctccgtctctatctctatctctcattctctctcatccaacgctatg

SEQ ID NO: 5544 - DNA, 3000 bp, Unknown
  misc_feature (1)..( 3000): cDNA_ID_1014438_gDNA_ID_1620801_Annot_ID_168696 3000 nt of promoter + ATG
tttaactcctttagaggtaagcataaatactttagaacctggacattactctacttatccacgattgtggtctatattaagtattagtgttacgagaatattgttgtatattatttatccatggacactgctgtggaataatcagagtagttgtgcaaacccttgagcatgtgagtagattaacttgctgatattggttcaattttcgttcttgtaaacctatcaggtcggtttgatgcttagaggaatgggcttcaacaaaagtacatatatattccttgccgctggcccgatatatagcgcaaatagaactatggccccactactcgagatgttccctaatctacagacaaaggagatgcttgcttctgaggaagacctggctccttttaaggtttctacgattttccactgtttgttcatccaggatgagtcctttctgacttgtaaacttatgtgtctgtgtttagaacttctcctcgagaatggctgcaatagattacacggtgtgtctccacagtgaggtatttgtgacaacacaaggtggaaacttccctcatttcctcatggggcatcggaggtatttgtttggaggacattcaaagacgattcagccagacaagcgaaagttagccgtactctttgacaatcccaagttggggtaagaactctaacctcttccacctacaaacatgcttttttggttaataatatctggttgatccctcaatggttgtttctgatattacggcagatggaaaagttttaaacggcaaatgctaagtatgaggtcccatagtgactccaaggggtttgagctgaaacgatcaagtgactccatttacatattcccttgtcctgattgtatgtgccggaagaacaaaacaacagcatcagccacctgacacattcttttactggattcttcttgtgcattcttttatttacatgtgttgctaattctttcaattctttggccacatccgcatccaaacagagcgagagcgagacagagaggacttcccaagcattcttcttgggggagattttttaacacattgaagctgatgtatctaacacgagaaactgagattagttcccacgtttgtttctgggcggagaggatagcatttggatgttcatttgtgttttgcagtttgaaaagttttttgagttttgtatagttggtggtctagtgttgggtttgcccataaataaatgtagatcataggggagaagagagctgccaaaaaaatttgtacattgattggttcctttttggtttaatcttgtttacatttcattttaaatattatctttcttatggttcttccaagtgaatgtggtgagtccaatgttttttactgtctgtcattttagtttcctacgaaaacaaggcctagaagctagaaccatgtttagtaataagatcttgaataatattcgtcttgttaaaaatggccactctcgctttgtatgcgcttgattaacacatgaacctacatgcttattccacagttggcatgccagattacatagctctataagttctattgaagaagggctatgaattggaatatgattggtacgcaattgagactctttattgtgcaccttgacgcttttgcatgcttttgttctgaaccatatcttattagggaaggagggggactaaatgctaatcaatccttgtttagtatctctcgctacttttgtgtcactgccatcatgctcacatttgaatgagtatacatcttcgtgactctgctagtctgcttacgtaagtggtcattaacctcgccgtcgatggtggttatagacttatagtgtggttaagccttaaccacaactatttcggggttctgaaaaaaacccggtttagtgttacctgttttatgatgagcttgggcctttgcctttaacaattgggcctttgtattgtttttttgttttttttttatttttattgttttttacatctgaacgtttgaagttgtttattatttcaatgtttacttaaaaaagttatatcatccgaatgcatgtgccattattaatttccgaattcaatgtcaaaagatcttacatgagatcatcaataattcagtatcgagatacccctctattattgatcttagtttaacttgaaagaaggacttagtttaattatttcaaatatttaactttgaacatatatttctggtcttagtatatatggttatttcaactttaaaactaattatgatgttgacttataatgtaatgattgagtcctatttaatctaaatatgacatatatatatatatatatatatatattatattgaatgatttttaacattctcaacttacttttttttctaaaatctctttttcgattgatatacgacattactcaattgactaatctttttgaaaaatttgtgtgagtcagcaaatggctggcatctgtttttatattgtataactagtattcgcggttcattaaaaatacaaatttagtgatattgtgagagacaagaatatacgcaattatttttctaagcatgttgaataatccacaatttgatatatggtgtgaaatgattgcattaatattagaatattagctaatcatttctaagggtgtaaatttttccatctaaagggtactagtaaaaaaaattctataacgaatttctaaggatgaaaattataacaatcaacatattaactgattaatttagctaactgaacacatgatcatatagcatatatatatatatcaatacgtgactataattgtttataatatatgaaccgtcaacaatttaaaagccgtataaaaattttggtaatagtttccttgttaacgtagcttggtgttgagcttgtctatataaaggaagggagagatcatagtatttgcatcagaaaacaggaataaaagcactcaaaagtcaaagcgcgcgcgcgcacacacacacaaaaaacaatccaaagctaattgattcatcaatg

SEQ ID NO: 5545 - DNA, 3000 bp, Unknown
  misc_feature (1)..( 3000): cDNA_ID_2034288_gDNA_ID_1620801_Annot_ID_168693 3000 nt of promoter + ATG
taatttgatagttttcagcacaatggatggcatgcaaaatatttgttggtcatttttattataaattcgaacgtcacattttttagtggtaacgttacatctgtatacaaaaaagacaaacaagatttaatccaaactctacagcacatatattttaagtaaaatctgattttgattttatatatgtttaattcttgaaaaagtcatacatatatatctggtttcttgtaatgttgtgacgagtttgtgtatataagcgaagggggatgctttagtttttgtacacctccatagaaaataaacaattggcatttgcataaacactttcaaaaacaagtaatcaaaagtattttagaagcttcatcatggcgacgtcaggtacatacgtgacagaagttcctctgaaagggtcagcgaagaaccactacaagaggtggaagagcgaaaaccaactcttccctgacgccattggccatcatatccaaggtgtcaccgttcacgagggcgactgggactcccacggggccatcaagtcctggaactacacatgcggtcctctatctcattctctatttgtatgaatatgtgtttattactagctagggtttctattaatgaaaggttcatgtaaatatatgaagatgggaagcaagaggtgttcaaggagaagagggagttagacgaccagaagatggcggtgacgtttagagggctggatggtcatgtgatggagcagcttaaggtgtatgacgtcatcttccaattcgtccctaagtctcaggaaggttgcgtctgcaaagtcactatgttttgggagaagcgctacgaagactctccagagcccatcaagtacatgaagttcgtcacgagcttggctgctgacatggatgaccacattctcaagaaccagagcaaggcttaatcatcatagtgaccatacttatgaagataaaaataaataaagaaacatcctaatatatatgtgtgtgtgtcgtttgtgtttgtcttgtacatgatgaaaccgcctccttgtcttgtgtacattttatgctgataataatggcggtacgtcttgtaaacttatgcatgtatcatctctgtctttgatgatttgatgttgttatggtgtagtattggtgttcgtaatatataaagagcacaatattaggatgtatagtctcactgtatatcacataattaatttcataaagaaagagaaaaagtattaaagaaatttgtacgaggtaacaacttgactaacctgcagaatccaaaatatccattaatgaatcaacaaaagcagacatacaaaataaaacttacaaatcttttgcattaactatagaaacaaacaaaccaaaccacatgtatgctcttatactgattaaaagtcatgtaaatcctataacaaaaacatacttctagttaaaataatttacgtattaaaactacataaaacaataaaagaataagaatgttattaaataatcatcttaatttgacatcttatcagatttctttagctaaaaaaagtttgtttaatggttggacttgcaagcaacaccatgaaggtggtataattatagttattttttaaattaatttataattatagctttttatctcaacgaagttgcatcattattccaaataggtcttcgtgcaacaatatgatccatgtagcgcttgcaaatgatgcattactgatttttgtctatcatatattatcacattagtcttgatttttgtaatcacttctcagcttcttctactctaattatgctctgtacaatttattttttcagtaaaaataaccacaatcaaataaatattcaatgaataagagaagatagatttgtagtaattaaaccatagtaatttttctgtatgtaggttcaagtcttttgaatttagaagtctataacttaaaagaaacggaaattaagatatgcatgtgtgataagaaagtactaaatccgaagaaaaaaacgtatgggtgcaaagaatctataaggaggaatagatggacatgaagacacttagtccacacgtgtggagcaccaatatcactatgatgtcgttgatctgcaaattacgcaaaacctcttatgcctaggtttattctctttctcagtcggtatttatccaatgaaatgattaatcatccagtcaataatcggttacctaatacctatgagtctctgactatatatgaataatgacattctaaccgagtcgaaacttaatccagcttttacaaactatcttcacatgtcatcacttaaaatgatatggaggttgtactagatttaacgatatttccaagcgattggatattttagataattcaatttgtagtttatagattaaatatttcctcttatacatatattgaacgtttgagttatggtaaggaaaaactaacttgaattggtcggagactaaaacctaatatgctttaagagacaatggcgtgttcgtataataggttgttagtctatgtttggtttgggatttttgttgttagaatcagagtaatagttcaactttctattaaggtgtttgtttttcaaatattagctttactttttaattttgattttggagtttataaaattcaatctagaaactacagttaaaacaaattagatctagaactagagttaaaatagtcaacaatctagctcaaaaaccggtcgttcagaaagaaactatatatgggtgcacaattttatttctggagtaaaactaagcattcatactcaggatctagtagatggtgaacaaatgattttttttagctctaattaaaagaattaaaccctatatttgaaggagacaattatgtataatgttacatatacatatatatatatagccgttttgctatttgtagtgttgtggtgagtttcgtgtatataaaggaagtgcgacacttgagtatttgcatcaaacaaaacacttgacacatttcaaaagaaaacaatcaatcgagaaatg

SEQ ID NO: 5546 - DNA, 3000 bp, Unknown
  misc_feature (1)..( 3000): cDNA_ID_3077626_gDNA_ID_1620801_Annot_ID_168689 3000 nt of promoter + ATG
tacaacttcaactttgaatggcaaaatataacaacaataaagacatactagacattttgtaactatgtgtaagatgttaaccatcaatattttagtaatcaatatgtgtttatcatttttttttatatgaagtcgtgtactcgtgtgcttttgtgttctttaaacatattttgtgccagaaagattcgaatttgccaaaggaataattaaatcggatggtcaaacaaaacatgatatttatcactcgtgctctaatcttgatttgctgaaatagtaaaatagtaaaacatgtcatgagatccgtatctctcaacttaacactttaggtctaggttctgtgtaatgtgtatataagcttaacacttgatttttaggttccataacaaactcatttagagatatgtgcattcattcacatttcacacataacaataatgtttggaagatctatgaatataatttcatggttaatttgtgtaatttattcgttatgcatccaaatcgccttcgcaattcgaagtacaaatgagtactccaaactaacttaacatgaaacatttatttgttataagtaattgtgaacttctttttttttatgacaaattgacaagtaattgtagacattaattaatcagataattaatttttaacttgtaaaaagcatatagcaaaatataaagccggcaaatctggaactggactgacactaaggtgtcgtgcgatgtccttggggtgggggaatatgaagacataatggtgtgaggccatacgcacgtgtccctacatcgaatatcacatgtactcttgcttcgattttatttttatctgttcatattattaacaagattcatgaatctctctctccatagactccgacgaaacactgcccatgtgaagttcacatttgcatcctgatatcaaactttagaattgcggctgacttgcaaaatgaaaaaaataacatattaattctacgatttctagttttctattagccgtaatatggttataaaatcatttgtttgacaaattagatagttctattagactttgttttacaatcattttgttgtttgttcgtaacgttttcacagttattgtttgtaattttctagctttttttttttgctgaatttacattttattacttcttataaaatcttttacgtagataaatcacataaatatataatataatcacgtaaaacatactctagtagcgaatgaattaatcaccgtatatatagactgagtattcatgatattatcttctcgattcacgtaaccatcggagggagcgaggagaggtacgacatttgcttttgttggcggctgatcacgtgatgaataagaaagaggtgtccttgtttttattccacttacccattcaataacgtggaaacaaaacgtatagtacttaagcattttgttcttataacctacttgacagaatcaaagatacatcatacgtccctaaataatactatattccaattgtatatctccgagtaaaatgctaaaagtagcttaaagtaccatgaaaatgaatgttaacacacccaaaaacaagtcttatgcggataagaaaggaacgatgttaaccagcaacaattatcatcgttaacttggtcgtatcatcaaaacatgatagtttcatatattttaccattgcgtggacagtggacactggacgctacgtgcaggactagccgagttgggatcaaaagacacatgaatttgatgggctagatgattgatgtgggaatcatttgcactatagtacaggcttattttaaactactaaagaattgggcttgatccatactaaataaacaacccaattcgtaaaatgtagggagaataaggtggtgacaagtgataacagatttgtgctgattcggtaaagttgcattcattgtgatctgccattcaaatctgtacgaataatatgacaacccaatgaaaaaacattggacgagaatttgttgacaactacatacattttgtaacgaattcatacaactagcaaaatgaagataaactaacattcagtcgaccaatcgaaaatgtcaaatgagagtattgatacaactagagctgcacctataactctatgactatgtttctgtcccccaccagcattggtgtggtgatgcttttccacaacttctttagtagaaaaaaaggacccataaaggaatgcttttggaaaaagacaaccccactttcattatgataacacaaaaacggaatacataaaaaatgatatagtcaagtaaaattacaaaatcagtgactacaaaatttgattcgtatagttaaaaaatcacaatctaatcaaagttatatattggacgctagataacatttagccacaaaaggttaatccacaaattataaattttagtataagtcatgagatgtacacacacatggctctgaatgacgagttgctgacacaacataagaacaatgaaagggtccgtggattcgattcagaatcgagtcaaataatagtctcactcttatgtatttgcagcgacatgctttgcgtctaaattaatttaagaatcacttttttttcttcttctcatcattatttaaagaaaatcattgactcatacgtctaagtaccaagatgaataatcgtaacttttataagaatgttacacttatctgctttaactaaaaaaagttacacttgatcttagccaaaaacaaaataaaagtgaaaaccgacaaaaaagaatgatgaagaagtaaaaaaaagaggataaaaagagagttaaaaatgaataaaaagagtaaatacaaatcaaaaagcaattagtcgcgaattaaggaaagaaatataagaatgagacgaatccaaatctgcgtctcatttgttttcttcctctttcttctcagtctctgcgtttctttctcggggaaaaataatatctgagaagaagattcgagagagagagatctgaacggtttttcgcttagtctccaatg

SEQ ID NO: 5547 - DNA, 3000 bp, Unknown
  misc_feature (1)..( 3000): cDNA_ID_1376639_gDNA_ID_1620801_Annot_ID_168688 3000 nt of promoter + ATG
tggaacagttgccagctttacaacagcttctgcatcgtctcattggttgtaaggtgcttctttgatgtcatttcccgagtcgtgcactatgttttgtaaatcccgtattattttctattaagttggagaagcttttcctgacgtatgaactgactttgctctttcgactttttcagccagaaggtgctgctaagcacaatcatatcattcaatatgcactctccctggtacattaaactaaactcgggggcataatttacatatatccgctagttcttagtgttgtgtcaaatatatactatctggaaagaacagcttgatttaagctctgagatcttattgtaaattgtgtatgcaggtattgaaggagagttttaaagtgtattgtgccatcaatgaaggaattatcaatctagtagagaaggtaggccagttttttcttttcccccagagttactctctcccttcatgtgttttttgatttcttactgttttatacatgcatatattgcagttctttgaaatgccaagacatgaggccatcaaggcccttgaaatatacaagcgtgcgggtttgcaggtaatgttgttgggttattttctctgttagatcaatttagatttcacttaacaagggttagtttatcaatgcaggctggcaacctttctgccttctatgaagtatgcaaaggattagaacttgcaaggaatttccagtttcctgttttaagagaggtatcagataataacttgtttgttacatttaaatttgtgatggcaggtactttatcaatactaaataagtctatttttgtttttttcaagcctccacaatcttttcttacaacaatggaggaatatatgagagacgcacctcagatggtcgacgtcacatctgggccactggtacatatatactctcattgtggtcctactcctacagaaaccatgatttttcttttataacttatttctaaaaactttgtcaacatacagcttctgacctatacgcctgatgatggtcttacttctgaagatgttggaccttcacatgaagaacatgaaacatcatcgccttcagatagtgccgttgttccctctgaagaaacgcaactttcttcccagtctcctccttcagtagaaactccacagaacttcattgatactgatgatctattggtaaattatgcttattacatatggtcttgatttctttattctgtcattgttatccttttgtctctgattctctcagtattacacacagggtctgcatgatgatacacctgatccgttagcaatcctggaccaaaatgcactagctttggccttagtttccaatgatggtgagcttcttggtctatgtactggagctctaagtttgcctttcttgcttgtctttagtcgcaattctggttatgtttctgtttccagttgattcttcgccgtttagttttgggcaagcaagagatttggatccgtcaggatgggagcttgcgttggtcacaacacctagcaatgatatatctgcagccacagagagacagctggtaagatgtattcttgtattagtgataatgggatgcatcaattacgtaccattgtcctgttaacgtatgtcacctctggggaattgattttgtggcttctgaatcattaacatttttttctgcaacaaatgcaaggcgggtggattagacacgctcaccctgaacagtctatatgacgatggagccttgagagcagcccaacagcctgcctatggcgtcccagcttccaatccgtttgaggtccaagacctgtttgcattttcagacagtgtttcaccgccttcagccgtaaacaacccattcggtctctatgagccaacctatcatcaacaagagcagcagccacagctacaggttgcacccagccctgcaaatccttttggtgattttggggagtttccaatagttccggtttcagaaccacaaagcaccaccagttttggggcatttccagtaccggtttcagagccgtcaaacaccaccggctttggggagattccagtagtcccggttacagaaccgccaaacaccaccgcgtttggggaatttccagtggtgccggtttcagaaccacaaaacatcactgggtttggggcattaccagtaaccccggcttcagaaccatcaaacaccaccggttttggggaatttccagtagtgtcggtttcagcaccacaaaacaccactgggtttggggcattaccagtaatcccggtatcagaaccgtcaaagaccaccggtttgggggaatttccagtagtcccggtttcagaaccgcaaaacaccacgggttttggggagttcccggtaaacgcaggtgctcatgagcaacataacagcaacaaccccttcggcagcacgggcttcttgtgatcccatcttcgtatatttctcaaaatgctttatttgtctcatatgattctattgtttgtgagtagtaataaaatcacatcatcttctagtcttgcaaatcttgttctgctaatagagaaagactcctcgggattgattatataaatgaattttcattggtggaaaaaaaatgaaagatatatataactcattgtgttacattaacaaaataatttgaaatatgattagcaaaaacgctacgtagtatgtcgttttctgttctagtaatccagctaggctgaaccaatggccattcgttgaataaaaaaggaagattggaggagaattaggtaatttaagggtaatagtcagcagaagtcattcccatatgtccacgtcagtaatcctgctcgagaaagctgctataaactcagagccgttggatcaacccgtaagtttgaaaaccccaaccgtcagatcaacactacaagttaatatgagaataatgagaaaaccactttcccaaattgctttttaaaatccctcctcacacagattccttccttcatcacctcacacactctctacgcttgacatg

SEQ ID NO: 5548 - DNA, 3000 bp, Unknown
  misc_feature (1)..( 3000): cDNA_ID_3610622_gDNA_ID_1620801_Annot_ID_168685 3000 nt of promoter + ATG
cctcagttgcaatatcgaccacgaaaggatcgtacggtgaatactatgatgggactcaccaagttatggatggagtatgtggagattcgcctacaatcaataattctgctaaataaaagtaaattatccgagaagaaaatatctgcacgcgtgattattaacattgtactaatagttttctcaaaatgctccaactcattgaataacaatgtcttttttttcctctttctaaatagacaccttttttagattttactcatttttagtgttgaatctgttatatcaagattcaagagacaaatatatgactcgaattgtttgaatttttgaacttactttgtagaactaggaaccctagagagtatcaatataatttggaattttattagaaaaattgtagcgttctgatctaatgctatatatgaaagagaagaaaatgatgacatgatcgttttagtaaacgatccacaccatgcttcttaagaagaaaagtccacttaaaatgccacttttagaaaaaaatgagtgtgtactatatagtttatagactatagtggggaggtagccgactaaatatattattatttattacatacataggatttgattagtaacgtttaaaccattctcattcatgttatgtgttaacatatattatatgcttggttagtaataaaaatcaatattagtaatattcatatatgattaccaaatatgtatatgattgaatttgaagccttcatatcttagtaaattttttaactatgcattaatcattataatagaatttttcacttcaaatattaatattaatcatatcaaaacaagaattttctgtaaattccaaaactttttggttaccagaaaaagacaatgaaaagaagaagaaaaactatttggttgtttttttccaacgaaatatttgttaaattcctcgaatcatacctataatgaagcccgtaaaacttataataggcctatttctctaaggcccatcagcatcaacacttggtttggagcaaaggctttctctctcagctcaatcccagttttagctatgcgagtattcaaatgacacgaaatttttcgataacacatctttaatttcttttactacaactagtatttttattttattacagttatactcataaacgagtgcctcttaagctctttttatttcttctcttattaaagggcagatatttcaaaatatagtaaacaaaacaagaaaatgaaacaagttcaaatattatcaaataaagaaaatcttatatttatatggtggcttttactgatttcaaattttgttattctccaactttgtataattagtaatgtatattaattacaagaaaatgaaactatatatcattatgcaattacactgtttactttcgacgattaatttaatcaaactacatatcaatgtaatttccacgtcagaacgaatcggaaccttcatatattgcctgaatgctatggacgacttcaccaaattgtcccagtcaacacgaaaaagcaaagaggactaatgagctaacatgtaatatatggtccatgtttaagatacagaccaaagatggcctataacattaatgaacgttataagacgacttttaataaaactgaaaataatatcctccttatatatattatcactaggcatttacattttaaaaatttattttccttttgtgggggtgaagaattgacagagtgactgtgagtgatggaagttgaaggcgatgcatggcggcaaacctcaagctgacggcaaatggtcgattggtttctgcgattgctccaactacaatttattcttcattttcaataaacttggaattgtatagatcttttcaacgttaagaacttcatgactacaatgtatatgtgatccatcatccatagtatctcacttagactttttagttttatgctataattttcagtatgtgatccatatatagtatctcttaattgatttcaaagctttgagagctatcaagatgccatatatagtatctcacatagggcttcattattcaataactggcttggttaactctattcctcgagacgttcgttttaatataaaaactaatttatcagggtggagcagaaacgttgaacgccaaaatgacggcgttgcaatgattagataaattttaatattgtatgtgcaaagtagaacactataatttgcaaaatgattggcgcgcgggacgtggaacccttataattaaactaagaatcaaaatgtctttcgaaaagatatttggtcaatcatatgaatagtcacttgcgtgctactattagacatctttctgtaggatttggtcatcgctcgtcactcgtcgctcgtcactcgtcgctcgtcactcgtcgcttgtcactcgtcgctcgtcactcgtcgctcgtcactcgtctctgtaattaaagatacaattgtccatttaattttcatcaaacctgctaagcccgcaggcttaaacggactaacccatttgaatccgtttacattatatcctaaataaatgggggaagacaaaaataaacttttcttataagttaaagtgtgtagtagtgtgataaaactgataaattaaaaaaaaaaacttttttccaatatgtttataaatctctccatgaaatatctgcatgaaaatctttactaaatgaaaatccatatgttatttcgatttatcaaacattatccattacaaactaaaatagatttcttaagaaaaacaaaaaaaactagaaagacttggttatatactccttaaagcaaatatttagtaaatggtgatggctactttcaagataaaacaaaaacttgagactttttttttatgatttttaaaagtcgaggttccgacgagttcaaaaataatggaattaatattcttataaatacaagcatcattcttcgtttatgtcacaaaaccttaaacacattgctttctatttaaaaacctctttatttttctctccatg

SEQ ID NO: 5549 - DNA, 3000 bp, Unknown
  misc_feature (1)..( 3000): cDNA_ID_4370936_gDNA_ID_1620801_Annot_ID_168683 3000 nt of promoter + ATG
aatacaaaataatgtctttgttttaaaacataacaaaaaaatgatttttaaaaatatacagaaaataaaaattatatatattttaaattgtattaggcctattactctaaggcccattagtgtcaacacttggtttggactttggactggagcaaaggctttctttctcagctccatcccaattttagtgatgttttttttttttttcgacaacacatctttattctctcttacaagtacaacaactagtatttttgtttttcttaaacatacagttgtactcgtaattgaatgcatcataagctctcttttatttattctcttagtaaataagattacgcattttaataagaagcatctcatcttcataatgaagtttgaaattgtactttggtaatctcttatagtgagtttcacatatgatcattatattgtgcgttagaatccttgtaagtcatggtccaattcactttaatgagccatatttgttaacagggtgtgttaataaagtgatactaacttcgaacatatacagaaaaaaatatacatttgggcctttaaacctatatggccggtgagattaataaagcatctacggcagctcaacaagtacacccactagccttgcactattaagaagatcaaaacaagaaaaaaacaagttgaaattatcaaataaagaaaaatcttacatctatatagcggctcttacacatttcaaattttgtcagtctttaagtgtttatgattagtgatgtatatataagaaaatgaaactattattatgcacgtacactgtttattttccactattaatttaattcaaactattctacatatcgatttaatttccacgtcagaacgaatcggaaccttcgtattgttctgaatgttgtggacggcttcaccaaattctcccagtcaacacgcaaaggccaaaaggcaaagtggaccaatgagctaagatattggtacatgttgtaataatttacagagacaaaagatggccatatggtaatgatgatagttagttagctacatacatccatccgacgaattcttcgattgaaaaaactccacttgcttcttttatcgtgtgtgtgtaattaactaattcgtctacgatccatttcatcatttgtctgatattcacatgacaccctttttttttgttagtgcatattcatacaaaaatacaaagaagtaaccctaaaaaatagatacaacctattttactattttggataccagctccagatacacataaacttattgtagaataaaactgtttttgaagttataacgaatttttaataaaactaaaaataatgtgttccttataaatattctcactaggcatatttcacaatctctctcaagttctgtttttttctttaatttctctttgatagtaatgttgtcttgaacatagtggcaattagatattgtgtgcgaaatataagtgtcaattttttgatataagtgattcttcatgcatttgtgactttgctcgaggatttctacttattaagttaaaaagtagtagttaaatatggtttgatatattggtggaagttcttaaccaagtttaatttgaaaattagtatgtgttcatttcaaagttaatttaccgggtgaacaagtcgccaagtcgggaaaattgttttaattaggcgaaactaattttctaggccaaatattcaagtattttgaaattattaaccttcttaactatctttacacgtccagttatctaatattgcaaaattgattagtttatatatatatacacatgttttgctatttagaacactaatttgtaaaatgattggagagtataagtctttaaaaatatttggtcaataatatgcggcatatgccttggaaatagtcacttgcttgccattagtcatccattagacatcttctatagatatgtttaaaaaaatatttggtcaaatgatatgccaatggaaagatacaaatgataccgtcgacttgaattatttattctttattttaatactttaaattattattagttttcttaatataaattattttcatattaaattattttctcagttacaagttacaatatatattcagaccaattctttgcaaattgtaatagttatacttctcatcgatttggactgaatttttgaacgcaaatattcactaaacttcccacaacataaaaacaaagaacaaaaagacgacaaaaaaacaaagaataaaactaaaaaagagatttataaccatttgagaaactttaatttctagagtcacatatgtagatttttgaagtatgaatttttatttagtaaaactaataatttggatatatcatggagatatttataataatttaagaaaaatatactaaatttatttttagaaaaatactattagttttatcactctaaattagtaaaacaaatatgtatatatatttcaatattggggcattaatatttttttagaaaagaatgttttctgtaatggtattgactgctcagatgaaagacttgtttcaaaacgaagcttttctattaattgattgtttatataaaatatctaaatattctaacaaaaataacgactagttttaaaagagctagtaatagttatcattgtagcgtgcatttgtaagtccatgtaagtgctaaaaaaaaaagtatgtttttctttcgtgaaaaatgatggaaaaacagttatatatatgtgcaatttctcatatttcaaacattatccattagaaggacttggtaaaagtcacgcaaatatttagttaatggtgatggctattttcaaaatcaaacaaaaccgtgtgacgaatttcatggttttaaaaaatttaggttctgacgagttaaaaaaataatggaataatgtccttataaatacaagcatcattcttcctttatgttacaaaaccttacattgctttccatttaaaactctcttcttcttttttgttctctctctctcttcatg

SEQ ID NO: 5550 - DNA, 3000 bp, Unknown
  misc_feature (1)..( 3000): cDNA_ID_2053237_gDNA_ID_1620801_Annot_ID_168681 3000 nt of promoter + ATG
agctgttgggttctttttttcttttttaacttatcatgaaattcaaaataacaaatatatgcagttaagaaaacagaattaagttgtataatagtcttgtgaatatgattttctgtaaattctctttattagtttcatttagatcatagattcatttgaagatgaggagagatgcaaagagaggaaacgttattgtacagttttttgtttgcactctttgcttctgtcttcttcctcccatcctaagcagttgcggatacatcatgacaacaattacaaaacctttttgttaaaccaaaccgaaatccaaacaaatctcggccaagttcacacctaaagtttcactgtacatacttttcctgcagcagtagagtagactcttcatggaaaggcaggcgtaagatgttatatacaaagtgatcaagaacacgtctgattgttttttttttgatcagtagatagagatcagtggaaggttctcgtcttcttccataggcttcaatgatagtaaagaaagcctttggaccaaaacatctaacgcttccttcatccaccaatctctacaagcgtctcttgcttcatcaactttcatccaaattctttgacgaagatgttgttcaggccaaagctcaagctcttctttcacaagcattgggaacatgaatccttcatagaatgttcctttgcttttgcttaagaaatcccattttccaagttgtctctgcaccaaatatcaaattactttacaaattttggagaaagatataagtaaaacaatcccaaaacgtaatcatgtgttcagtttcaaatttacctcaacgtttccaacaactccagcttcttctagagattctcttgacgcagcttcttctacagattcatcaagctcccaaccaccctggcattattaaaatcaattacagggtaaattagttaaaacctagaagactaatattataaacgaatagttatgatttattagttgttcttgttaggagtcaaagttagtatacctttgggaacatcagagcgtgacccttttgtgatgaaataacaagaacctcaaattcgtcgctaattgtgccatcactcgaaatcttgagtctgtatggaatacacctgcaaattttaaactcacacaaagtcaactcttagaatggtgattagtggaaaaagatatagatgaaacatacccgacgacttgacgccgtcccttgttgtatctttgggattgacgacccgtacgggagaccaaacacaccatgctactagaaaaacagagttcttgaagaatctgaatctaatttttgactgtataaaagaagagagatcgatgacggttttgctttggcggctaaagggaaggaggatctgaagagtgtaatgaatgtttttgcaggttagagatcgaagttaagaattgtttgataatagttataagcaaagattggataggagttatgaagttatgatggggtgagtgaacaaaagatttgagataagacaaaaagcgttgtcttttgcctccttgcggcttatcctttttatagaaaaacgacatacattttctaaactcttttttgctctttatatttttattttttcctatcaacttttgaaaataaatcattaatagcggttaatttaaaatctaaaaaaaaaaaaacaattagtgacaccataagggtgaattttaacaaaaaagaatacaaattgttaatttaaccttttaccaaaaacaacaaaaaacatgtaactataatattttagaaccgaagtcgatatccatacgcggcaggttaatgtttacacttgagggacgacgacgtcatgtgcgtcaaccccaccattaggacgtgtggttactggtctgtgagtccatggaaaagagatggaacattaatggtttcactaaaccacgaaaagtgaattatgtcagttttttaatataaaaaacttcaataaatgattaatacaactattactaaacctaacggatataattaaacaatcaaatgttgaattttgaaattgcatatagaatataaaaacatacacgttcatttgtatgtgattacacctagatgcatgcatcaaggtcatatacttatatgatttgttatcaaatgtgaaaattgtttataaggtggtaagacagggttattacaaattctcattattgttggtttttacttttcagctagccactcttttagaaaaattcatccaaaaccaaaactattcaccagcccacaagtttatacaaggtcttgagtcataagttttctctctacatacgacaaattcaagaaaaatttaacatatgagattttaccatatgctgaaacgcagttaatgtgtatgacaaattaagagtaaaatgattttaagtttagactctaaactgtacatgtttttaaaataatccagtgtgccaatgagtagaagaaaatgataaatgtacttaatatttattttattaaaaaataagtaatttcttatatatttttattaaaataatatcatttctataaatataataattaccaaatttataactataatcttacaatcaatttgaaaatattttgttttcgaatttttaaaaaaatttaaaaataatttgaaacgaattaacccgacccggggaaggcaacaacaaagttcgacccgacttgtttagccggaaaggaaaggcaaattagcattttccgagagaaaccctgtcccgtccgtattaaacccttgcgactatctcttttactgtgtccaggcagacaccttttgttttccttctccctcacttcttcttctccaatcggaattttgaacttctctttcttattcccgctctcttggttttgcgagggagccaaaatcgatttagggttttggttttctcgctcccaagaacttcactagggttctctgtttaaaaatccgcgtattttattgtggttttggattcgttccagtgttgtttattcttccaataagatg

SEQ ID NO: 5551 - DNA, 3000 bp, Unknown
  misc_feature (1)..( 3000): cDNA_ID_2053243_gDNA_ID_1620801_Annot_ID_168680 3000 nt of promoter + ATG
cagaacgggcaagtactggatggtgattctagtgatgataccaacttagcaaatgcagcaaatgaaatggccatggaggtctcctcggaacttaaaagtgtaacacagttgtataatgagtatgctgtcccatttgagctctgggaggtgagtcttaaaatcataaactatcatctttatatatatattctcgttaatcaatgtatttttggaccatgtttctgggtaactggttttctagaagtaaccatagaaaaaggagagccactattcctctatagctgtaacttagctgatattctggaaattcgtaggttctattcatgctaaacgtaacttaaagtcgataatgactgttttaggtcatgctgagaattgttgcaccagtatcctagtttaaaattggaaaatcataagattaaactattgaattggaaagattcagtgctagtatagtcgactctctgtgtatgcttacattgcttgtttgctgttctggcttcactctgtgcagatctgtctggaaatgctttactttgccaactattctggtgatgctgattcaagtataataagggaaacatgggctagactcattgaccaagctctttcacaaggcggaatacgtgaggcctgtgcagttcttaagagagtcggatctcatatataccctggcgatggagttgttttaccgctggatgttttatgccttcaccttgagagagctgcacttgtaagcccatccttctagtagagttgttgactcatttcattgggttatgaactgaatttgagtgcatcttgtggaaaattttacaggagagatcagaaaggattgaaaatgttagggatgaagacatagctaaagctcttctagccgcttgcaaaggcgcagctgaacctgtgctcaacgcttatgaccgattattatccaatgcagctgttgtgccatccccaaatctaagaatccgcctccttcgttcagttctagtggtactccgtgaatgggcaatgtctgtattgtcagacagaatggggtcgagtccaaccaggtcttctctgatactaggcggctcgtttgcgctagagaacaaagctgctcttaaccaaggggcacgtgataagattgcaaacgctgcaaacaggcaagtttgtctctgtcattttgtttcgatttggtctgcttttcttgcccacccctaatttttaagtatactttaaaatcaagaatctctgaaaacacgaagatatgtctttttacgaacaggtatatgacagaggttaggagactagctctgccaccgaacaagacggatggtgtatacgcaggttttaaagaacttgacgagtctctcttaagtccattctccttctgatccatcacttttttctttctttcttaatatgcatccaatttcacttaatagggtttagcggctttcttgtaactttaaattgctctttggggaaatttccccttcaaagagaatcaaaaatacgaaaagagaaaataattctgtagttccctcttatattcggggccttgtctgtcaattctatctgtattatgtaatttcttcatcgaggtgttgttgttggctaaatacttcttgttttcctttagtttttcctttaaacttagttaacttattgtatttgcatgctaaattcttacaaacttgaaaatgatgtatcagaagtttttgaaagaaaatcttggttaaaagttatacagttgcacaattgggagttttgactttgactgatcttgctctcgacgttggattccattccaaattttcgtagaaccaaagtagaattttctggcagcttttgtttccccttttttggttgatctttatcctccactcgaggaaaaaaacaacacaatagaaaaattagcaacaaattattaggtaggaataggatagattagtgtgtttacgtcaaacttaggaatgatattcacgagtatgtaaagttttggttgtttctgcatgtaaactttatgtagatttctaccgtctatcaggaaatagttaaatttgtttagatgaataatgtaaaagacggtagaaaacaaaagaaacgtaactacgtaaatgaaatgtgtttagatgaataacgtaatacaatgaaagtatgaaactaagatataatataatgtaaagaaacagctcaaaatttgagattagttggtttgaccgtggtccggacttagggacatgttcggctcattaaagctcaaagattcttgtctcctcttacattgatttcttcactatatactactagtatcttcaagaaatgaatacagtatcaaattcaacgaaaattaatctatacaaatatattatgcgtgatgataaaaaaaaaaaaaggggaaaataacatgaatgtacaccaaagttaaatctgaaatttgattgagaaaaaaaaaaccagaatagaagttgtgtcattttagttagaatcatgagacatggtgtctagtgattttacatttgtcgtacatgtttggacaaaatgggatggtccctaataatttgacaacacatacaaaataaatacagatggtccctaatcccttcaatgtaaattaaccatatttctacgaaacaccagtgttatgataatttcttttggacaagaatgtactacttcattgctaattacccaatttctccttatgaaactagttaataaaatcaaagaggagcacacaattaaacagtaattaacagtgacgctaatcagtctctatcgttgtcactctttaacaaccatacccttaaacctcatttaaatctctctatctctctgcaaaacaaaacaaaacaaaaacaagaagtgttctcttcttctcttaagcccaagcatttgatgagctttgtagtgttgtcctcttcgtttgttttctgatatataccgatctaatttacaactttagcattttggttcaattttgaattgtggtgaggattgagatcggaagtaatg

SEQ ID NO: 5552 - DNA, 3000 bp, Unknown
  misc_feature (1)..( 3000): cDNA_ID_2025142_gDNA_ID_1620801_Annot_ID_168679 3000 nt of promoter + ATG
gacatgcctccaattgaagctattcttgcccctttagaagctgaactgaaactttcgagacaagaagtattttccttcctttgaaccagaattacctttgtatagctcgattcaacaacttacgggacatttaacagctttctcatatgggtttacatgttttgattggtagattgctaaacttcaagacgacaataaatcattggaccgcctaaccaaatcaaaggaagcagctttgcttgacgctgaaaggacagttcagtctgcattggcaaaggcttcaatggttgatgatctccagaataagaaccaagaattgatgaaacagattgaaatttgtcaggtatgtctatatcatttcttttacatattggaacaccagaatagggtatctcttccttttcttaccactgtggtggccttatttgttgatacattggttaaaataggaagagaatagaattatagacaagatgcacagacagaaggttgcagaagttgaaaagcttatgcagagtgttcgggaattagaagaagctgttcttgctggtggtgcagccgcaaacgcagtgagagattaccaaaggaaattccaagaaatgaatgtatatttcatatgcttctatagtacctcaataacttactgtttttcttgttagtgttttggtctcgtactgatcgtaattgtggtgttttgtgttttccttaggaagagaggaaaatccttgaacgggaattggcccgtgcgaaggtaaatgcaaacagagttgctactgttgtagctaacgaatggaaagattctaatgacaaagtgatgcctgtaaggcagtggcttgaagaacgtagatttttgcaggtcattgctgatacatattaatatttaaattctcttgctgcttcaaattgtgattcatattcacggagattaacttatactattgccaccaccgttatgtttggacagggagaaatgcaacaactacgcgacaaacttgccatagctgaccgagctgcaaaatctgaagctcagctgaaggtagaatcatagctgcgggacaccatcttattttttttaatctcctaactgaggaattgctgcttttacttatttttaggagaaatttttactgcggcttagagtgttagaagagagtttaaaggggcctacgagcagcagcagcagaggcacatctgttggtagaagttcgagcaacgggcctactcgaagacaatcccttggtggagctgaaacaagtccaaaaattacatcaaatggctcgctgattaagagaacaccaagttctcagttgagatcattgactgctagtgcaagcactgtattgaagcatgcgaaaggaacatcaagatcatttgatgggggcaccagatcattggatagaagcaaagtgctaataaatggaccgagatcgaattttcctttgaaccacaagtcttctgaaggaactagcagaggcgaatcgcctagctcaataaaaggggaagaagaatcagctgacaaggcaacaaataatgatagcgtcccaggtgtcttgtacgatctgctgcagaaagaggtcataacattaagaaaagcggcgcatgaaaaagatcagagcctgagagacaaggacgaagcgattgaggtttgctagtgtttggccttttttcctgttctttgccgcctttatatgaaatgttgtataatataagtctaaagatatgggttgtgtatatttagatgttggccaagaaggttgaaacattaacaaaggcgatggacgttgaggcaaagaagatgcgaagagaagtagctgtaatggggaaagaagttgctgcaatgcgtgttgttgataaaggacaacaagatagtaagaccagacgtctctcggtctcaaagggaaacacagctcagctactttctggaaggtattaatgtattatcatatcaactacaataagctttattattacctttagatgtcattattgtttatgtattttatcatttggtagagtgtctggacgaatcgggatgacgaggagcacacagtgacaaactgattcgatcaatcactggttggtctctgtggcttgccttaaggttcttgtaccaaattgagagaagggattcaaaagccgaaagagataatcgtgtaaagtacctgattgattcgatgtgtgtttctctaaagcattccaacattcaaggtaaagggagacattgacttcacttagctgatatatttcttactctgttgcgttatgtatagtagtactgcagtagtagaggtagggttgttttgttcaacattttaagcttttttactctcttgttttgtgtgtgtcactctctcctcttagttaattttcttattaacctcgattatattggtagcctaattttttatctttaaaagaactcttcttggtgttcaaaaaaagaactggtaaaacccaaaaaagctatatacaaaaagagagagagatagagttaatgaacaccacatgagttataagaacaccatcattgagatttgagaaggatatttacaacatttgtagtcagactttattgggaaaaaagtacatttgtaatgtaatcaggtcttaatgataattagtagttttgacttttgagtaaaaaagaaagaaaaaaagaacataaccacatgaattgaaccggttccgtatcattgaccggtacgcgtttagcgacgtgggatttgatatattttcactttcggtccaaaagtattatatatttgagcaagtagtcctacttttttggtttgaaattgtttttcccattaccgttctctgctccattgggttctttcctcttttctcccagattcatcaatccctcctgctaccgcgagagagtaacaactcaccggacgtttcaaatccatcctccgataactatattcgtttcgttagatctagatctgagcgtcggtgagagattttctggatctgtgatacgttccaggaaacatg

SEQ ID NO: 5553 - DNA, 3000 bp, Unknown
  misc_feature (1)..( 3000): cDNA_ID_1377914_gDNA_ID_1620801_Annot_ID_168677 3000 nt of promoter + ATG
tagatatgtttggagttctaacttccagtctacacaaacatacacgcgactactcatgttttcttgggtcgctaatttctatcacaactttcccacttttttttggtgtgtatcttcgattcttgaatactggtttttagaacagttaagacatattttgaagtcgcactctttacattagacaaaaaggaagctaatctttgatttttattcaattggtctccacttgtgccattactgtatttggatccagttcaagtttaaaaacaaatagatgacaaagaagctaatctttcttgaaaatttaatgtacatctcatgtagatagaacaacttattaacctaaaggacttttcttctgtcacaaacaataaaaatcgttagaactgaatttccaatgctcaattaagaacaagcagctaaatgtataaccgttaacaaagcctgtttcacatggttgatcagaaaaatgattaaaagaactttaagtaagccttaagattcgggatttaggagttaaaaagcaatgtaatcatcacagctgttttaaatcgtcaaagtagtagaaacaaaagtcaaagagagagcttcaacttccagctgcccattaattgcagcgagttggggaaaggcttattgagttatttctatccacttaccgtagagacaagtacccaatactttgtctgtttcttcttcctgtggcttctgggtctttgtcaacatcaaagctctttactttttcaacttactttatcgtgcgtctgtacggaccacaaaaggctctctctttatttctctgtgagatttttttaggatctgagagagccaaagatcatggaggaaagccaagaacttgccttgacccagttgagaaaatcggtcgagaaactctcttcttctactgaggtaatctaattcgacgctttagtttcattacagtttacaaagcttgcatcttttggccgtttcatgagtttcactgacaatgtctcgttagaaaatgagaaatatctgtcatttgattttgatgggttttatatgggctacactgttaaaactctgtctccattctcgtcatagtggtttgtctgattaggtttgagcctcccatcagaaaccctaacagtagagacagtttagtaaaagtgaatccataatcagaaaatctcatcaatggtttttgttgttgttgtttcctctgaaaagggatatgacaaaccaacattgatgaggttcctggtggcaagatcaatggacccagtcaaggcagcaaagatgtttgtagattggcaaaaatggagagcctccatggttcctccaactggattcatccctgagtcagaagtgcaggatgaattggaattcagaaaggtctgtcttcagggtccgaccaaatccggacacccattggtgcttgtcataacctctaagcattttgcttctaaggatccagctaacttcaagagtaatcacctctcacttgcttctgacctttactttcgttggaaataatctgtcccttgactttcagtgacttttgtattcatagaactgatcagcttctttcctggttctctaattattgagtagtttcatttgacttcaaatgaatgaagttttttgagtccatctatgtgttttccttgagttgattcttgcgataattatctatgaactaatcttttatctgtttgatgttgcagagtttgttgtttatgcgctagacaaaacaatcgcaaggtgtttacacattattgaaaccaaaacacttcaataatcttccggttagttggttgtgagacaagctttttggtttttatgtttcagtggcaacaatggcaaagaagttggaggtgagaaattagtagccgttattgatctggcaaacattacatacaagaaccttgatgctcgtggattgatcactggctttcaattcttacaagtaagcatctcccttcttcctgaaacaatatagttatcacacaaaaagaagtcctgtctattaaatttggaaaatgtttctctagtcttactacccggaacgccttgcaaaatgctacattttgcatatgcccggattcttcgtgaccgtttggaaattcgtctgccgttttctagagaaagcaactcaggaaaaggtttgatctttaatctcctcttgatgtatctatctctaatggttcttgagcaacgaatcacataaattatgattttgctgttgcatagattgtgatagttacggatggagaagaacagagaaaattcgaggaggagatcggagcagatgctttaccggaagagtacggtggccgagctaagctcacagcaatccaagatgttcttcttcctcaggctgctccagtaactctaacaaacaataatgtttagctctttatttttggaagcattaacctgaatatttgtaatggtcagaacataactagtggtacatctctaaatttccaaaagaagcaatgaaaacatgagaaagtaatgcgaatatattcaatctggtgactgagtgctcgctcttgcttatcttttcttattcacatcataagtaagctgtaaagcaggattgatcaacagaccagactaacttctagaaacttaatgtcctcttgttgtacgtgtaagattccaaagttagctatagatgtctttgagctaaaaaccagaatcacgagctcttaaatatgatccctaagccttgttatatgacaaaagacttttcaacaacttaatatttccaaaagaagaaatgatgaaacacatgagaaagttgtgtgaatatactcaatctggtgaatgagcagtttcaaacatcatgctgtttctgtatcttaaattaaacaatcttgctgttttgaattttgaagatgttggtcaattcactaacacactttaaagtcccaagcttttttctatcagccgcctccaaaatctctctatctctctgtctctcacttcttcttcctcacggcggcgacaatg

SEQ ID NO: 5554 - DNA, 3000 bp, Unknown
  misc_feature (1)..( 3000): cDNA_ID_2053260_gDNA_ID_1620801_Annot_ID_168674 3000 nt of promoter + ATG
gaaaaatacggaaagctccatggggcatgttgggggatggattgcacccctcattttagctcggcccaaatcaagaataaactaatcaacatcaagcccaaaaagcccataaaagttggtccatgatcctatcaccagcttagtttttctataaatagagaggcatctcaaggaaaaaaggacgaagaaatccatattaaaacgtcttcaagctcctcagctcgttctctagctcctctgctcgtcctcaagcttatcagctcgccctcaagctcctcagctcgtcctcaagctcctctgctcgtcctcaagctcctttgctcgtcctcaagctcctcagctcgtcctcaagctcctcagctcgtcctcaagcatgaccgagtaaattgtatcaccagagctaagatgggcacgaaaggttgcggcgacatcatcccatagtgataagtagacaataacagaccttaaaataaaaagacggaagtatcagttcaattttaaagttttgttcattatttttttttggtttggaagtgctagcttacgaatcaatccggtatcgcaaaaccaaacgttgagtagaagttggatcattcaagtttgacccttggacgaaagtgatttggcctacaacatctagatcatttcaaaggtgttataatcatagttcatgtttaaaaaatgtaagaatcatgaagaatattaccaggaagttcaatgttggtgttagcaagagcttgaaggttgtcaaagttacgtagcataaatttttccctctcaattgtagggccaacatctgaaacttcaataatcgttgtggcagggagaaaacggaggagaaaaggatggtcagtgatcttgtagagtttcgtgcaacgtcccacttcaaacccactaacattgaagattatgccttcacgcaaaacttggcggaaatgtgaagcaagagctgctgggataaaagcatggattacggagcactattaatgaaacaaattaagtgttagttggccatcaattacatatgaaacaaaaaaaacattaaacatctaagatgatttactttttcatcaagtaacaggaggactatgcccatgaattggccatctttcttgatgttgcgagcatcccaaaaacgaagtaggcgaccaacaacctgttgagtagagcgaccaagacgtaaagcatcaaaagctacatagtttgctttagaaggaattgcaacaacatcaacttcagccattttcagagtgtgtaatattttctggtggaaattgataattgtgtttgggggtgatgggagatgatgattttatagtagtttaaaggaagatctataggaggtttttgcttttctccagttacagtttcgatttgagatattaaaagtatgaattaaattgcaagtagtggaattttgtaggaattaagccatgtatttaagtaccttttagtaaataactgttgatgtttgagcttctggggaagaaaaatacggaaagctccatggggcatgttggagatggattgcacccctcattttagctcggcccaaatcaagaataaactaatcaacatcaagcccaaaaagcccataaaagttggtccatgatcctatcaccagcttagtttttctataaatagagaggcatctcaaggaaaaaaggaggaaaaaatccatattaaaacgtcttcaagctcctcagctcgttctctagctcctctgctcgccctcaagctcctcagctcgtcctcaagctccttagctcgttctcaagctcctctgctcgtcctctagctcctctgctcgtcctcaagcttctcagctcgtcctcaagctcctcagctcgtcctcaagttccccagctcgtcctcaagctcctgagctcgtcctcaagctcctcagctcgtctttaagctctccagctcgtcttcaagctccacatcactcaacgaccatctcctcgcctagctataaaactaataaactatgtttatcgcaagaacgacctaactcccgaccttcaacgcgatgagaatgtttttcccttatcaaagaacttagaaatatactttgttgaaattcgtgcatcaacagggcagtgactgaaacactctttttctctttcgtcgtcctctgaattgcgtcgatcgaataggagaaaatgaaatcaagggtttgcaattttaactgggttttcttaggtcatttcggttcataggttttttgactaaatcttggcccgataaacatcactaagtctatttggttctttggctcatgggctttttgaccaaatcgtggccccataaacattactaaatctatttcacgcataaaaaaaaatgtgaaggcgagtaaaaacatgtgggctccacattaaaaagatgtagtgacgtggacacttttagaagagagaaaactctgctattatatatatgatttgtttattttccatcaatatacgaatatctctacttccttttttaaagactctttaaatcttaatcaatcgttcataatatatctccagttgcattcattatccttctaaatcctctcttattagtctttaatcataaataaaaaataatacatcaatgagagttctttccaccgtccgatcaaactctggtatattgacgtcagcaatcggacgtaaacatgtcgaagttaacttgctacgcgaaacagaggattaatctctcagccaataagagacctgagaagacgagaagaaaaaagaagactttggtccttggacttgggtctttctttctctttttctttcgataattattgtacttggttctttgttctcagtgtaaatgaaagtgagaatccaaaggctatcatcggaaactgagggaacagagatcattcatcgccgcggtaagttatctgtcatcgtatatctttaagccctctgtttcttcttgtttgagtagtgatcttagattcttcaaaaaatattgtttaggttgatatagagaaagatg

SEQ ID NO: 5555 - DNA, 3000 bp, Unknown
  misc_feature (1)..( 3000): cDNA_ID_1027367_gDNA_ID_1620801_Annot_ID_168658 3000 nt of promoter + ATG
ggcaatttttggatatagttttcttattattacatatcactatgtatcaggctttgaaaatgaaggcccattccatagttgtttccgacggtactttttttcaaaaaacggtacgtaatcgcatggcctttgtagcttacaaatacaattatcatatcactagacactagtttacctttgaatctcccaacgcctttcattgctaggatagttaaagctaattactaattagacttgttaacccgagttcttttatttggcttaattgcacatagccaaatttcggatcgtagccgttggatccagcaaaaacttaaaaaagtacccacatgcatgggaggaaaatccccatgaagaaatgaacggctgcgattggccaacgtgagatttgatgcaaacaaaaaaaaaatctcacgtgaatgaatattccacattgggatcttccattagattccatgagctcagatcaaacgacgcacacgttagcagaaaactctttttcttcgctaatttgctcccagcagacttgttgggacgatgaccgttgttgtgagttcccaaattattatcatttttaacttttctaacaaaaaacaataagaaacaaatgtttattttgttttcgttaccaaatctatacacaacaatgataatgtaaattgctttgtttatgtgacgcgtgaattgatgtggacctacttacctgacagacagtggtattcgtccacaaagggtattaacggcgtcaatattgccgttaattgcgctgcagaaataatttatccgtttcagtgacattacttaccagtgggcaccatcgagagaggtccaccggctacttgatgctgacgtggacaaaagtgtatacgtcagcactcacaggccattcacaaaagtagtcaaattcatgtaatgtatgatatgtatcattcatagttcatacaaagttactctttttttttttttttttttttttagtaagagtttggaggatctttttatttaatcacttaatcgggtctcttacatcaaagttttagttgggactgtgacaactaattgttaataatccctgataatcaagttaatatgtcggcttaagttaagagtaatatatagatatgatttatgcctaaatattaaacaagcaactgtacgagacattgctcagagaatcttatggaatgttgagacttgagacgctcttaagtcttaccaagagacaagaataagctcgtgaattttgattgaataacctaaatttttaatatgaatccattaatgatattttgtgcagtaattgtcctgacagactacagacaaaatttcatgatatttcaacgaaaaataaaagagtcttcatgctacgttaaatagtacgaaattgtaaaatcatgaatatatatgctttaaatacctccagttcaccgactcacttgttgtagcttttgcagggattaggtgttcatagttactttattaaagttgcattacattaagtcattaacgttacgagttacgactccgttttgtcaactggccggcacctatcgggcattcattgacacatctacgtggtgtcaaacgttacagcctaagtcctaaccactcgttcgatgatgctaccctcaccgcctcacgtgtcggagcaacgtttaaatctttgttggtgatgggtttcttctgcacgtgaatctagttttatcgcgggtcatttgtttagtaaaggcaaatccctgaattatgatttatgatcacttgatgacaataagatttgagaaatgtatcatcaaaatgtcacggcaaatggagcaggtaacggctacatcacttttattttcttttttaattttattttaatatttcctctacatataaagcttcgacacaacttgttgttgtttttcatactcaatgatttcactttttcttaaaatgtacccgtgtgtccccaactcaccatatctatccacacttgcatatgtaaataaatttcttcgatttagatatgtattttgatcagctaaaacaattttgttttatgattcttttataagaatacttcaattgataagattttttttttcttttttccttttacaatttcaaacggatttgaatcaatttttttaaaaatccctacatgaaatgttacaatgattgaaacttattttgttttaaagagcttgtaaacttatatctgtatagatagtagtttttttttctttttgtctgaaaagaaaaaagattgtagtgttagtgactctacctgtgactatttgtcgggacacatgtgtaagcagcaaagcaccctatgctttattgctactcttgtttttttctcccctgtctttaatatctttaagaaaaaaaaagatctgatcgtccaaatataaaaggaccccttttcccactaataaagatctgatccttagtagaaaaaaaaaaaaaagatctgatccttcaatgcggtaaattttgtagtatatgctaacaaaattgtaataaccttagctatcagtcgatatgccatggttttcttttaaaacatgtaaaatggaaaaagaatccaagtttaagatattccatcagtctaattgcaaattagtatatctttaaaacatgtaaaatagaataataatcctagtttaagattccatcagtctaattgcaaattagaatctcttgaaaaaaaagttacagcatagccttttgatcttttactggtccaatgcaataaataaataaaagtaattatggaaaaaacaaactgacatatttatgaagattaaaagtataaaccaaccatagccagaagtactctgcctcatattcatactcatactatttctttcactatcctctctctctctctctctctctttcaatacagctccaaaactcgtcctcaagacgctatttatccatttaagtctcttctcttttcgtcctcataatactcttatacacagaaacgtttttcattcataacaaaaaatg

SEQ ID NO: 5556 - DNA, 3000 bp, Unknown
  misc_feature (1)..( 3000): cDNA_ID_3593429_gDNA_ID_1620801_Annot_ID_168656 3000 nt of promoter + ATG
ctaaaattaatagaagatgtgtgtatattttacaagaaaaatatgccaaattggtctaatcaaaagcaaggaagtggtggtggccaatgtcactccactccactaatttcattaagaataagttgaaaatcttatttctatatttaatttaatcagcaaaaaaattagtatcattatccaaacctttcattattgcttgccacaactgctaattttttttttttgttgtctgaattttattaaaaacccaaggtagaataccatttgaaatacaaacgccggcagaccaactaaatgtctccaaaaactaagcccaaaagaggaaaactaagcctcaacggaacggagaaactatttagaccaacgaagaaaacaaaagacaaatatctaaaaaagatcaaccgttaagggaaaacgaagatctaagcactaaaattgcgcaaaagaaccaggaaccctcacaaagcttccccaaagaaacggaaaacgtcggaaacaccaataagatcggaaagaactcacatcgaagtcaaaccactagcaatccgacagggaggaaagcaagaagccaccagagcgagagacacaactactaatcaaataagcaattattatgacattatatattgaatttctgatatttatgtttgtcttataactatgttaatatctcacacgtactgacagaacaagcagccttactttagaaagtttagaagaagacagaaacaggataatcccaaacattgtgttgggttgcttgaattattagccgacaagttgagttctaaccacttcattcataaataaagaagtcagctgatgaagattatacaacaatctttgtcataaactacgtaaagataatgaagtagctagtcctgtatatattatcttatgtttcctggtactagttctggtgcgactgctaaaatctaaattgtcgtctttagattaacatttgttttttttttctctctatgaaagtactaaattttcataggataagccattcaaaatatcaattacagtgactattgagtattgactaatattatttgaactcacaactcacctacatgtattaatgtttgcattattttagtgattgctaaaacacataagtgtcacatgacatatatatcattgtttaggctaaacatattatatatatggtctatattatagatatcgatccaagtctattagccaatccaacactaaaacaatcctcttgtaaatgagtagctcatgacgacattattctgtttcattttggaagcattagcatcatttccacacacacgtgttgacctaaaaaggcctatatttgttctatttataaagccttaaattaaagactcaagcaatatcacatggatctaatatataatcatatgttgcatagaaaaaaagaacaaaaaagaaatagagagaggtggttgaatgatttaggctttacatcaaacccactgtttcaataattttgttaggtgtgtgtgtgtatgtgtgaatacagctagagagtttcacgaagaagctggttggtcaaaacttttgactcgaaaggaattgctgacaaatcgatcaatcaatttgcttcagagagaaaaaaaaaacacataaacacaattgacatctctctatctatacggtccgatactagacttggcgaaccaaactaaagatacagtaggacactgtgactgtctaggaccaccagagatattcagtgaagtttctatagtcatcataagtcaatcttgctgactacatcatactaataggaactatagtcgtaaggaacatatataccacattaagcttgtttcttttgattaactcctcaagttgttttcaaaatactcgacgaactagactgaatcagcaataagaccaaacatgtaaaataaacgttgcagaagttaatgctcattagttttctcttttgtaagaacatacaaacacacaggtgacaagttttggccaagaattacaaaataatatgataccttcatagtcatacctcagaattaatgtcctagtcgagaagcagaagtttgtttttatagatctttcttttcattagagaaatgggtatcggcccaataacataggccaacccatttgcatttattttctcatatccagtaaggatatactttcaaatttttgtataaatgggattttgatttttctttaatatgttgaacgaatttagtaaactattcacattattttatgttcagaactatactgtaaaataactaacggtcaacaataattgagagaatttggaagttttcgttagactcacatcaataatgtgactcaaagctaataattgcaatttccgacaaatttgtggcatgggcgtttatgctgtcttctactcttcttgtatgacaacgcacatacccgagcttcgtaaattttatttctatttttttcaagtatattttgtttttaaaatgcgattttagaaagaatttgtgtgatcagaattcacggtgtaataatagtttgtatgcatactgttgtttgatgtgtcataatccaaatttagataatatgtttatgtataatgttagaaataaaaatgtagtagaaatttacgtatattttcactgataatagaaattttcaaatatccttaaactgtcaatatccaatttctttatgtttaaaatatttcaacagctaattttcaaccgctatttattttatttaaatttatcttgtcattatatttcgttattgataaatatctgaaaaagtgggtgacaaaaaaattaccgattcaaattattgtaataaaattgacaaatcaaaagattgaaatagaaaacaaaaatggactacatttctcaaaatggcaaataatttttattcatatttatcaacctcgaaatgacctacatatatagagacacaaagatcacaacaaaatcaaccattcctttccttatcttcttcctcttttgcttttctaatctctca

SEQ ID NO: 5557 - DNA, 3000 bp, Unknown
  misc_feature (1)..( 3000): cDNA_ID_1828853_gDNA_ID_1620803_Annot_ID_50505 3000 nt of promoter + ATG
atatcctttaataaagatgaataagagtaaccttatcagaatgcatggcagtagttgcagtgcccttgtgacgcggtactgcattctttgtcgagggagctgattctggacaattaggtaagaaattaacgaactccataagcagatcttcatgacccttgaataacatagtaacctacaccaacagatgatatcagagaaatacactaaaaactgtgactctaacaaataaaatgtgaagcagaaaatcagaagaattaacactctgtgcagtaataaaaaaacatacctcttcgtagacctcagagatggactttttctcctttctatacaagttcaagatgtctagaaaccgtttatacgcatgttcatcatctccaaacctcgtctgcaaaagtagaaaccccagtaaaccttaactgatataaatcatcattaccttagtatgccatttagtaccatattacatccataccttaatcttggtgacgaaaccgatagcgtctttgaaatccacccggatcttaggcttctcttcctctggcagaagggttattttataccctttgggcaagaaagtattaaaacccaaaagtaggtccctgtaacccttgaacaacactttaatcctttctatgacaccattagtgtcgattctgcaaccaagataagacaccatgagtatacgcagttcacaatgtgacatccacaatacaacacataagaaaggcaaaatgaaactaaacaagaagagaagcgaagtaaaaatacgtctgagctttgaactccttcatgagctccaggaatgactcatatttctctttattgtcgtgaaaaatatccttcacagctttgagatacgttagggcatcgatggttcgaggtagcttgtttctgcatagcacaaacacatgtaactttcaaatactcttacacatttcaattgcatcaaactacattgaagaatataacttgtggactaccgaacaaatgtaaaattgaaaagaacaaacaataaaaaattgggtttatcgagtaagagagttacgtttctcctcgagacgaaacttcaggctttcgcttttgagtgtcagtgtgaacatcttctctagctctcttcatcttcagtcttcttccactttctcccgcagactgatttctggaagaacaaaaaaaagaggcttttaagaagccaaaccaaactaagaaccgtggaaatagtccaagccaagagaaatagctcggaatcgttgtcccaagtaatagatctctcatcggaaaatcttaagagaaatcacaaaaaacgaggaaaaattctgagcaagagattttgatttaaaacctttgtagaccggatcacgttactcaaacggtgaagagagcttcttcgttcctttgttagaagatgaaactcggaaagaagtcggaggatcggtggaaacgttggccgccggagttttaaagtagagagatttagacggaaacttggcaaaatgaaaagcaaaagaagcttccttttggtagaaaatagatgattcaatggtgagattgcttctgattaggagcaatctctctgtctctctatgtgtctccctctctcgctgattttggaagcggaggagggaagagggtaaggcaacggaacgaggaagaagaagaaaaagagaggagcttgttttgcttatatacccaaagaaatcttcatgtctgtatgtaatcagaaccttcggagctaaatggaaggttacgtacgaaattggtttatttttcaattccaaatcaaacttaccggtttaatattatgtaaatcaaaaaccaagtaaaaagcagagttagggttttttttctttcaactttcattacctatgcgtaagtgaggatttgatttaaggttataaaaacgaaacataatattccagtctattcaaactaaatctggtttattaatattcgtttgtagtaagtaaagtataatatcctaattttacctaaaaagctcggtcacattttcttacaagtgggaagaatatgcaagggaaaaatgtttggtctatgaattttcatactgtgttagatgataaactttaattaggtttgatttgcatcaatttaatagcaaaattaatggttcaaaatgttttctaaatataaatatgtattgtcagagctatcatcaatgggcgtttggtctagtggtatgattctcgcttagggtgcgagaggtcccgagttcaattctcggaacgccccttcttttatttttgttaccatgggccgctctaccagattctccaggcccatttgttcgacgaggaacttgcctcatagtcgacgatcatgtcaacattaaaaacttaaaagcaaatttgtcaaatctaaaacataatatgaaaacattagttgactaattataattaccggatgagaggaggagatgatttgtccatatatacttatcgtttagacaagttcaaatgacaatagctctgctccaactacccacgtgtaacggttcacaattcaaatccgatccggtttggtctcaattctctcttttttttttcatttttttttttgataatttgaccgaaaacaactagaattaagttgaaaacaccaacgaatttaacagaagaaaaaacaactaaaactcaaaattttattttgaaccaaagaaaaaaaacaatcataagttttataacaattggcgagactaataaaattaacacaaaaccgaaccttaaccgggtcataaaacatttatactttgtctatttggacacgacccacttttagtctttaaaaaaaaaaaacgaatatccattttttctcagccaggtgagagagagagacatcgaactatcgaagaccagagaagctaggaggatttgatctctccgattcggatatcttagctctggccgatagattctccggcgattcatcttctttatccgccgtaattttcgtatataggatcggtggtggcttttcaagatg

SEQ ID NO: 5558 - DNA, 3000 bp, Unknown
  misc_feature (1)..( 3000): cDNA_ID_1828849_gDNA_ID_1620803_Annot_ID_50506 3000 nt of promoter + ATG
catacatagttcaaagagctgaacaataagatgtcataaaaaattccaaacgtttgtgctctttgtaattgtatcttaagtagagacaagacactgagacccaggaaggactcataactcttccaactaagtccacactaaggcctttagcagagaacaagaaggttacctcctgtatccgatccaagcttcggatattatcaagagtatccagagaaggtgaaagccctccatgcaaacagaaaacctacaaaatttgatgaagtcaaaaagctgtacttagaaaaagatgtatcaaacaccaactgagaaagaacagctctaacctgactctctatgagggcggtaagaggaagataatcgaaaaggtctgtaaaatacttccagacgttagcatttccgtacttcctcaagcattcgtcataaaaaccatagctgaaacagagaagcaaaacatgcatcaaaacaggatagtactttgctgatcagccagaaaccaatgaagaaaagtacgattcgctcaaatataagcttatttcaaaacaaaagcttacacttgagtaatctgccgactctcgtgattccctcgtaagattgtaagtctatccctgtatcgcacttttagtgccaccaatagagaaactgtctctactgaatagtagccacgatctgcaaagaacaaagcaagacaatgagaaaccaacaacactccttttaaactaaatctagctgtcaccatcttatggtacaccaacgaatggttaaagttccaaggatctaaagactagaattcaagggaagtgcaataatgaaagtgagcatcaacaagtctctatattgggaagtttcagtacctaccattccaaaaaaaaacagaacccacaagtaactcactctagataaataaaaaggtggatacttttccaagaattcaccattttggaatgatccaaaaacacagatctaaaatgagaaaaaaaagtaaaaaccccaaaaataaaatcgaaagaagaagaaagacagacctacatagtctcccatgaagaggtagttagtatcaggagcgttgccaccgatacgaaagagctcaataaggtcataaaactggccgtgaatatcgccgcaaacggtaacaggacacttcaccggctgaacattatattcctcgacaaggatcgctctcgcttgatcgcaaagcgtcctcacatccgcctccgataacggtttacactccatcagctgctcgatctgacggtccagatctccgttcgacggcatcttgaaaagccaccaccgatcctatatacgaaaattacggcggataaagaagatgaatcgccggagaatctatcggccagagctaagatatccgaatcggagagatcaaatcctcctagcttctctggtcttcgatagttcgatgtctctctctctcacctggctgagaaaaaatggatattcgttttttttttttaaagactaaaagtgggtcgtgtccaaatagacaaagtataaatgttttatgacccggttaaggttcggttttgtgttaattttattagtctcgccaattgttataaaacttatgattgttttttttctttggttcaaaataaaattttgagttttagttgttttttcttctgttaaattcgttggtgttttcaacttaattctagttgttttcggtcaaattatcaaaaaaaaaaatgaaaaaaaaaagagagaattgagaccaaaccggatcggatttgaattgtgaaccgttacacgtgggtagttggagcagagctattgtcatttgaacttgtctaaacgataagtatatatggacaaatcatctcctcctctcatccggtaattataattagtcaactaatgttttcatattatgttttagatttgacaaatttgcttttaagtttttaatgttgacatgatcgtcgactatgaggcaagttcctcgtcgaacaaatgggcctggagaatctggtagagcggcccatggtaacaaaaataaaagaaggggcgttccgagaattgaactcgggacctctcgcaccctaagcgagaatcataccactagaccaaacgcccattgatgatagctctgacaatacatatttatatttagaaaacattttgaaccattaattttgctattaaattgatgcaaatcaaacctaattaaagtttatcatctaacacagtatgaaaattcatagaccaaacatttttcccttgcatattcttcccacttgtaagaaaatgtgaccgagctttttaggtaaaattaggatattatactttacttactacaaacgaatattaataaaccagatttagtttgaatagactggaatattatgtttcgtttttataaccttaaatcaaatcctcacttacgcataggtaatgaaagttgaaagaaaaaaaaccctaactctgctttttacttggtttttgatttacataatattaaaccggtaagtttgatttggaattgaaaaataaaccaatttcgtacgtaaccttccatttagctccgaaggttctgattacatacagacatgaagatttctttgggtatataagcaaaacaagctcctctctttttcttcttcttcctcgttccgttgccttaccctcttccctcctccgcttccaaaatcagcgagagagggagacacatagagagacagagagattgctcctaatcagaagcaatctcaccattgaatcatctattttctaccaaaaggaagcttcttttgcttttcattttgccaagtttccgtctaaatctctctactttaaaactccggcggccaacgtttccaccgatcctccgacttctttccgagtttcatcttctaacaaaggaacgaagaagctctcttcaccgtttgagtaacgtgatccggtctacaaaggttttaaatcaaaatctcttgctcagaatttttcctcgttttttgtgatttctcttaagattttccg

SEQ ID NO: 5559 - DNA, 3000 bp, Unknown
  misc_feature (1)..( 3000): cDNA_ID_1828833_gDNA_ID_1620803_Annot_ID_50511 3000 nt of promoter + ATG
agaaaattctcgatcatcatcgtcatccgatacaaaataaagtcaggtagaggatcgagcatttataaattatggaataacaataaatcgtactatggaagcaaatcattttcttgttccttagtttgctgaccgtacatatactagttgacaaggttaatccataaatctctttgtatcattgtgtgctgtgtttttttttttttttttttaatactgtgtgccgtgttggtgcatttgcgtaattgatggaggcaacattttgaacataatcactttcttgttgcttaattagtgtatatggccatgggtacgttcttcctattggtacatatgcatgtatttatattacaaggtgagtattcgttacaagttgtgtacatatgttcttacacgtgcaattcgtacacgcctcaatttgatttatagtcaaatttcaaaaaatttgttagaaatttcatctcaaaagttataatatgatctaacgtgagactaaaaaacatatgtgaatttgaatgatataaacttgatgtttttttttaataacctatatacttattgtaggtacaatccaacgattttatgaatgttgtattttttttgtatacactgtaaagacgattttatgtcatggctattaatataagaatatacattttaaaaataagattttaaactgatgtctcttaccaatctcaagacgagtacttgtgattcttcggagacaatgagaagagtttgtaaattctgaatactccttaaacgaacagaataagtgaatttagtggtggatataactagcttgactttagatcttattctttcaaatagatttggtgtaagattgattcgacatttcccattaaatctccaaacaaatatgtgcatcaattcgtaactgtacagctttaaaaatacatataataaatggagtcggcaggtttgtatattaaattaatttgcgtgattggaatgataagcttaagatccatcatccagtgttggaggtccctttaatttttgtctacacatgtcacttccgacaccaacggaactccatttgcttatgtgtgtattggatgcttatcccatttaattaaaaaaaaaaatgtttttaaaaggtattattcctttattgtccaattcgtatgtttcctaattttggtaaatatgtttttgttaagtttgaaacatcgttccttgcattacgtatgagtaaatcatacacgagcgtatgaccgagttggaatttacgtaatgacagataaatttgtacatttacgacatataaaaatatgaaatcaacctacatatctcttttttcctttactattctgaaaattctaggtttttgacggaagaagtgaaggctataatcacagaatggaggactctgtcacgcattgtgttctagtatgccatatttaacacttgtcaatatggcttcgaaaaccgataattttccctaactaaaaataaaataaatctaagtggccacctaaatgtgtttagttattatcatacatgcatgcaacattttatcatggcatgtgaaatgtaatcataatggaggatagactgcttactacttaaaacaataaaccactaattatcagttttgaaatgatttatttttgtttaaagaagagataatgttatataatgttgtgggagacaaagatagatccaagccaggtaaggttagcttgttgatctaaattgattaaagcatttgttgaacaagacttcgccatctgtaccacccattcttctttcaattatggattataatttagtaaatatcatatatatgcctccattataacttttattattgacattattgctttcttaaaagcaagtttatttatcaaaaactattgattggtcattgtgaaacgttatatttgaccgtcaataaaactatacataacgcaatacatacattattatatcaggtaaagactaagttatattagtatcttataaaatgacaataacatgttctacgtaaaaaaaaaggacaaggattatcggttactttaatagtttgaatgattcttgatctaataattaaaacattggcgttagatgtaagtttttgaaatttaaattgattttaaatgaatcagttgatctagacaattaatttggtagaacaccgatcagagacccttcttccagaaactgtgattataaaacgtgtactaagagacaagtaaaaatcttcgtttttcttaatttaatgcatagttggctatttgcgtgcatcattatttgcacaatagtaaatattcgattcacgtcgtgtgcaggaacccattcttttatcacttccagtaacttatgacgttttaggatatgaaacatatttcaccgttgatcttgttttcttgttgttgtttaatatcattcaccgttgatcttgttattgagtttttctttgcttttcaattcggttttatgtaaccgctaaaaattaatggagaagaaacccgtcttatacctacaaaccgggaaatgtgaagaagaaacaaaccggtcggttattgaattttagggttttaaggttttgaccgatggttgacttagggcgcgcttctctgctttggtacacacacacacacatcaagctgcttcttttacctctcttctcgcttcactcaccatcctcaggttcgttctctgtcacaaacattacttccgacgaaagaattaattttacagttaggaattgtaatcagtgcgagtaagtacaggaatcgaagccggttttgtgtttcttttgcttgatttttctccgtttattctcaactttgagacttttgcttcattggttaccctataaagcttgaaactttattcgaattgagatgttccattagatattttcaaacaagttcctgcctttttactctacattaagctaaaacctgtgtttgattgaatttttgatttcggcttaattaaggttaggcaaaaccaataactggtgtgaga

SEQ ID NO: 5560 - DNA, 3000 bp, Unknown
  misc_feature (1)..( 3000): cDNA_ID_3100778_gDNA_ID_1620803_Annot_ID_50512 3000 nt of promoter + ATG
tggcacacgatatacatcgaaagagacatgaggaaagtttgtacccgtaaagacttgttaccctcaagccctttagctaaagcattggcacccaaagcaccaccgtaatttccactgaaacagattatccataaatcggtatgtcagggatatgaactatacagacaaaataaaaaaagcacgcccaaaagatatatccatctatagtcctaaactcacttgagatgtaaattgcgtattgtattattctcaagaagagctccagcaagacttgtgaatccctacctccatttcaaaaaaagaagggaagaagacgcaacagatttaattcataaacttggtatgtcaatctgaaatataactgtacaacacatgaacagaaaaaacttacagaatagtcaatcatgttattattcagctcaataatcctcaaggtcgaatttctcttcaacaattctgcgatttcctttgcaccctgcgcaagaacattggaactacttaacgtatgaaaacaatttgaaggattgtgactaacttaggagcttgaaaagcatgtaaatcaaagcatctgctcaaacaaacctcatctcctatatcagtactgttcagctgaagtatctcaatgctagaattttccatcagtgtagcgcataaagtctgccataaccagaaaaaatgaagcgaaaccattctcagccagaaacgtatacatagagaataagttccatgtgattttagagctaaagatataagcagaaatcgatatgatctcttctcttgatggaactgaggaatttctaccattggacacccggaagttaaatttaaaactagtatatcatatttccactaaccttagctccttcatcaccgatagggtttccagaaagattaagaatttttaacataatatttgattgaagaacaccatcaaaggctttaactcctgcagctgtaattccatttgcagaaaaactgacttcctctacagtctgaaacacaaacatgggtatggttagtcaatcaacataagaatatcaggactctaatgagttggtagatagcagatgtgaaagaaggagagaactataacctgattatacccaaggctttcagcaagaaagaataatccttcatctccaaagttgcatcctgcaagataaaatatacaggtgagctatatttgcgtatattaagacaaaaggaagatggcactacagatcacatttaattctaatgtaaatcagtaataagtaatgtcataacagttaaaatcattcaatgcacctgacatgtcaacacttctgaaggacctaagttcttttgcaaattcattaagcctctgcttggcctctctatcaaccttagcagcaaatccttgtaacaaattagtaccggccccgatcgaccatttcactccctgtgtagaagagttgttttctccagcagaagtctttggagacttaggcgacatgaacttcccaaccactttccacaaaactgtcagctgaaaacacaaattagtatagaagatttgagagaaaagacgaaacttttatcattactattctcgtatagatagcaatcaccgaattacatgacaagcaaactaatttccgctctattacttccacatgaaagaagaaaacacagtaatactagtccaagttttgagaagtgacggataaacaaaactagctctcctagcaatgctcgtaccgaaagtgacgacagcaaatgatcccaagggcaagacggaagacgcaatctgctgcactttagcattaggaaaaccactagccgcttgtgactccttataaaccctactacgcttcgagcctccatctgagttatacgccgctttgatcgccggaagtctcggacttcggtgatgaatcaccacaggagaaacaaacaatcggttcctagaaacggagctacccaacaattcgtaccggaacccactcttccattggcccaacccagaagaagccttcaaaattcacagagaaagaaaccgaatttagaagctacaagaattgggaaaaaaaaacaaaggatgaacagtagaattaccttggggagagagtggagattgagggagctggtggaagaagaagccattaaggagctgcttaattacgcatagacgcttgaaactctcgctgtgtgaaaaccaaccactgaagaattaggaaagtgtaagagactaaaagagacgaattggagtagaagagaagagacgatgatgaagatgaagtttgtttccttcgcgctatgtgtgtgtgtattcctttaggtacgggtgtgacccgactatccaccgggtcgaaatcgggtttaaatttatgacccgatagattcgaaagagaacgactttattagggttcataacaaaaataatcaatcacctacctgaaaacaaataacatgtggacttaaaaaattgttatgcaaaaagatttgtttttttcattggtcttcttctactacacgcatttgaatcagcagagagattaattcctcagctcggcgattcaattctcagaagattatggctttcgctactggaatcacgacgtcttcaaatccaacttttcttggtctaaagatctccaacacaagtctacgttctgtggtttcatgtaattcgatttcgtttccttctttgtcatatgtgaatctcaacctcaatcggagaaaccgcctttctgttcgatccgcttcggttccaggttcgaattgattcacaaaattgctctgctttattttcctatgagagtcctttttattttttctgggttgtttttgttgttattgccattctggttttaaaattagaaactttctattgaaattgataactttcgttggtgatgtctgagaattcttaaaaagatggtaatagctgttacttagatatgtgtagtgaggttctgctcttgaattcaaaaagtgtagtgacttgtgctcttgaatatctcagctgcacctgcaatg

SEQ ID NO: 5561 - DNA, 3000 bp, Unknown
  misc_feature (1)..( 3000): cDNA_ID_1828829_gDNA_ID_1620803_Annot_ID_50513 3000 nt of promoter + ATG
atctcgttgacttcaatctggttagattcactctctgagagtcacttattttagggaaatatgtactatagtcagatatgtaatctgcttaaataactacacaatcataagattctggtacagactcagacaaataatactaaccgcatgttcaagcttgatactctgtcttttcgtttggtttggtaactatttttactttgttatcttttcaaaggtttatgacatctgcaaaactctagctcatcattattttcaagagaagctcccagtctcgctgtcgtatgttcaagcttctgtactcctgtgtttgggcttgcaggagtcagatttctcgagcatcgaggtataacatatctactctttaaaataaatcgatgatctggaccagctgaattatgtttcaccacacatgtggagataaatttcttgacacatctggttgttctaaattggatcatgacgttgacttacagagacaaatgcagttggagaggggccaaatatactctcttctattgaaggttggaaagaagttatacaaatatttgaatggaatcgcaacaaaagagctcgaatccaccttacctcggttgaaagatgtaagttcagatgggaaaacttacataacatttccatgttcttttgctcagtcataatattccctcatttttgaaaattaacaaccctaagccctaaatacatacacgaatatcgagctgactgaaatgattcatggttgcttttggttgcagagagtgcttgaacctcacaaagtatcagtagacgaagatctcagggagggagcaaaagaagttgaggtaatcgcttctgtttccgtgcatgcgtatattttgttttggtttccatgtaaaatcgaaacaccactcacactctcaatgcttgggtttaaaggaacaaatgagggcaaggatagaagaattgttggaccctgagctacttgaccaatttgctattggggacaaagaagctgaggctttgcaaaagtcgaagatctcttcaagtggtcttatcagtatagagtccaccaaaactgataacaagaaagagaagccaagtggttttgataaatcagccaaaaagagaggcaatgataagcattcctccacatccaacaaaaagagaagagcctgagatggaggttgatgtcaacaattgtttttttgtaacagtgaccagaaaattttgatctttggtctttttacgaatttttgtaaccaggttgaataatttattaaaattatggtttgatcatacaatttttttaaaaaaacttacagattctgtttgagcattctacaaccataatacaaagttttctattaactataactatattgtttatctactgcaatgtgtgaaactggttcacatctcggcagcaaaagacttcccacatccacaggtttgtgtagcgttagggttcgagaaagagaagcctccaccaatcaaagcatcgctgtaatcaagctgcattccaaaaagaaagagcatgctctttggatcacaaactgcaaaagaagtgagtacaaattaaaaacctgagccttcaattcacagatgtaaaaatactttactgcagaagacaacaagagactgcaaaagacaacaagagactagaagtctcagttcaagaatcggcagctaagtagtatataattcaagctgcacatcaaaaagaatcaactgaccatctacttgacaataaaactttagcctatttgatcgaacaatctcagccttttttttatttggatgcatacttgaacacagaaactgacattcatattgtaagtatggcaagtctacatcatcaagaaactagctgatcttactctcagaccttattatctcagattagaagagttgatcctacatagtgatggaatagtttttacctatagtgaatccctggtattcgatagtggaatcatctggtcttgcatttgctctgttttcaaagtccatcgtgtaggacatacccgagcatcctccttgtttgactccaattctcaagcacaaatcttccccacgttctgatctcatcttactcagatgcttaagtgcattttctgacagagatatcgccggcttcagtccctccattgcaggtgcagctgagatattcaagagcacaagtcactacactttttgaattcaagagcagaacctcactacacatatctaagtaacagctattaccatctttttaagaattctcagacatcaccaacgaaagttatcaatttcaatagaaagtttctaattttaaaaccagaatggcaataacaacaaaaacaacccagaaaaaataaaaaggactctcataggaaaataaagcagagcaattttgtgaatcaattcgaacctggaaccgaagcggatcgaacagaaaggcggtttctccgattgaggttgagattcacatatgacaaagaaggaaacgaaatcgaattacatgaaaccacagaacgtagacttgtgttggagatctttagaccaagaaaagttggatttgaagacgtcgtgattccagtagcgaaagccataatcttctgagaattgaatcgccgagctgaggaattaatctctctgctgattcaaatgcgtgtagtagaagaagaccaatgaaaaaaacaaatctttttgcataacaattttttaagtccacatgttatttgttttcaggtaggtgattgattatttttgttatgaaccctaataaagtcgttctctttcgaatctatcgggtcataaatttaaacccgatttcgacccggtggatagtcgggtcacacccgtacctaaaggaatacacacacacatagcgcgaaggaaacaaacttcatcttcatcatcgtctcttctcttctactccaattcgtctcttttagtctcttacactttcctaattcttcagtggttggttttcacacagcgagagtttcaagcgtctatgcgtaattaagcagctcctta

SEQ ID NO: 5562 - DNA, 3000 bp, Unknown
  misc_feature (1)..( 3000): cDNA_ID_3077660_gDNA_ID_1620803_Annot_ID_168744 3000 nt of promoter + ATG
ataactctagaactcagatattaatactcaccgtagatccgtgacctcaacacgtgtcatgtttctgaaacatcttcattaaaactacccttatatttttttatatatttaagattgaccttataactttgactaatactgattacaccctctattctccgaatcggttatcaaaaccaatttcactggaccgtgatatcagaaaccggttcactgaggtgggcgagattttttgttgtcactctcctctcctcgttcttcgatgctcatccattagaggaggagccgatgtttctgcttccatggtaacgctctcgtctccatctccctcgctctcttgcgtagagaacgtgacatgtaaatcttctcacgtttctcgggttctaatctccggtaccgataatattaatcacggtgaatcgtcggaagccaaaatactgagagatgttcatatcgtaagaactttgagatttttctttgaatctcagttctctgtgatttggtacgttcaattacggatatctaatttgagttaatcgttgttgtgtttgtgcttcttagtcagaaaggttattggaggatttcactgagcttgcaagagagaacactgagaaggacctcgagacttgtgggactctcgctgcctttcttgtaagattgttttgctttcttcgcattcaagttgattactttgggtgataagagaatctgggtggtgagaaaatcaaggaaaatgttagaaagtttcagactttattgttcctaattacaacttctaacagagatctttgcaaatttgaatttttagtgaaactcgatctatgctattgtttaaagtttacaccttgttttgacttttgtggtcatgattcatggttgttttgcttctgttccagggttcttcgtttttcgagtttcatgaacctgatggtaattacatttctatttctgttcatgctgtaggaaagaggaattttttatgtaaccactctgataatacctaagcaagaatcaacttctaattctgtgagttatcttagaaagattatctcgatcattttgtggtattcaaaatgaggtgcttactcaggtgctaaaattggcagtgtcaggctatgaatgaagtggaagtgttttccattcaaaacgaaagagaactctatcccgtaggatggattcatgtatatctctctcttctagctccctccatgtttagtgatctgtttatctactttgtcttgacttactataacgaggttatgcatattttccagactcatccttctcagggttgtttcatgtcatctgtagatctgcatacacattattcgtatcaggtacatctctgctgtttccaaattgcatatatactaggtttgagacaattctgatctcagtttcccatcatgtcattcttaggtaatggtgccagaggcttttgcaatcgtcgtagctccaactgatagctctaagtatgttcttccaaagctatggagtcaattatacagtcaacatatttccttgatagactctcaaactgatctttttggcaggagttacgggatatttaagctaacggaccctggaggaatggaggtactgagaggctgctcagagactggattccacccgcacaaagaaccagaagatgggaacccagtttatgagcattgctcaaacgtctacaagaactcgaaccttaggttcgagatttttgatctacgttaaggtaacgacttctgtggacttatcagtaaaaaggttcaaactttatccactgtgggctaaggatgtcaataataaccgtcatcataaccaccaccctaaccagaactgtatacttggtctgagaaggctgtctgattcgggttatgaacacaaggtaccttctattaagcttagcaatgttaataaattgtcatgtccttagatttggatcaattggttccattatggaagaacaacaatgaccatagacataagacattgtattggcgtatgcaattgttatatatctgtacaaatgtatacattggcatctatttctccatataacactacattaatattatcaccatatttcgccattttatacctcttaacttgccagtgatgactgatgaaaatggttgagcttttaaaaaggacgggaaaattttaaacttgagctttgacttgttaaaaaattattcattttgacagttttcgtctgattcaagtttcattcttttcatttctcatttgattgattaattagatacaaaatagccataaattagctgtaataataatttaaaaggtatctttgagctcttttttggtaaagacatattccaaatacctctcttcacatgaaacaagagtacaaaccccaaaaacagaaccaaaggtccaaacttttcttttgaaagtaataaagctatcaaagctctttccttgttaaagtaaatagtacagaggatgggttttatcagaaaaaaaaaagctagctcatttcatattgttgagtgttgctatcaaaacccatacagatacagtactttgttttgcttcaaatccctttatggccgttttcaagcacatgatagctttcttcgtacagtcaagagtaaaacctctctttttcttaccctatcttctctctctacagatgtcacagtcacctctgtcacggatttgggtacagagactcgcagacgattcactcttctttctttctctctctctgggttttaattcaaaaagtgaagttggttaccattgtcttgtacgatcgtatattcccgatatgatttgttttgacagagcaactgctttgtatatatatgccaaatatctctctctctctccctctctccttgcatcaatttataagtaagaccaaaagagatcaccaaaactcaggcttcttgtttggcttttcttattgttgattgagagagtgagagtaagagagagagagagagagagagagtgagagagagagagagagagagtgag

SEQ ID NO: 5563 - DNA, 3000 bp, Unknown
  misc_feature (1)..( 3000): cDNA_ID_3077668_gDNA_ID_1620803_Annot_ID_168742 3000 nt of promoter + ATG
gctgcttgttgttgtcaaggcacacatgtttattctttatttttgtcaaatatttgaatcaagatcagctactattctaagaaactggctatttctaaaataacactcacgaattagccattatttataaaatggtaacggtatattcgagattccagtccatacatgttattaataaagaaagattggatctccatataaaaaatagctgtctcttacattgtagcactagctaaagatctttcaatactacgtacctagtcatacaattctttgaatatggttttaaattgtatgtgaatattattaagtgagaatagtatcgacataacaagtatgaaatcttttatttctatatattttatttaacaacctataacaaacatttcacttcaaattctcactatatgtagtccatcatcaactactttcttttcgcatatctttgaagtttttggttttactaaactaactctatcataaaaggagaaagctttaaatttaaccagaaatgaagatgcccgtggttgtacaattcttcataatctctcttctcctcacatcttcattttatgtactttcaagcgctgattcatgtaagtgtatacttaatctagttagttattttttaggttatttatcattttgaaactagttgtctgaaattctaagatttgatttgtgatggtgataaatgaattagcagcatgcggtggaaagtgcagtgtgagatgctcaaaggcagatcgaacacatgaggagtgccttgaggactgcgatatatgttgccagaagtgtaattgtgttccttcggggacttatggaaacaaagatgaatgtccttgctaccgtgatatgaaaaactccaaaggcggatccaagtgtccttgaacattctttgaagatcctcatcacatacatactatctacgtactatatgtatggaaattacatctatatatgtttgatgtatgaaataagttctgtgagcttaatgaaaattttgttatcttcaatccgattcctaaacacatcaagaataaatcatgtcgaggtttatatttctcagcttcaatttcactaaacgaataacttgggatactatgatggaatgcagaattgagaatttactctctcaattgtcttaaattcataatccaagatctacaaggggtaagtattaggactaaccgattaagggtttaataattatgtaattcagagactctaacgctttgcatcgaccaaatactacattgtaacataacacaaactcattggatgtgaaagtacaaagtagtatgtctttataataatttgtttccaaggaaaaaagacgagaacaaaaactaaaacaagagaaagatcatcccatgatatttaaatagagaatcaatctacaaaaagacggcaacctgattttcaaaacaagaacagtagatcagaggcaagccggatagtacataaaaaagactcaaacccaaaccaaagaggctttctccaactagaacgtaagtctttttttgagtcgctctgttttcgtttgtggaggaaccatatcaagtttcgacgctcacaagctcatactcgatcagcgaaagattgttatcatccttcacggtgatgtctgtgggctcctctgcaacttcaacacgtccccatctatcaactgcaagcctcatagaacccttgtacatgtcgatcttcgcattacgcagagtcactacactgccttctttcatcatatccactggataaaaatgaataatagcatcagtcataaatctataaaaagtacatgagaaatactcaaattatgcaaacaactaactatttccataaagcaatccactctcctgctattatctgtttcacagattcacaaccagtatagactataaagatgccaacttagaacagaaacttgccattaaagaagctaactgagaagagaagcagtctcttaaaagaccatcacaaaagcatttattctctcaccttggtcatttcttgcagtaaagattatgattccagtctcatcaccaactaagcattcggcaatccgcatctgacgtgactgaggacccatgggacgacctcctcctctctgcatcaccatcttcgtgttgacaactttcacattcagagagtggccattggttcctggtctcaactcattaacctttgtgaacacaggcttcctcaaagcagacgttgcctcagccatttttataacaaccctacaaaaattagccataaacaacaacatctgctgtgatcagcacctaacaacaatttcaatatctgattagacaatcaaaacctcaaatgcgatcaaacaggtttaagctatcctcatttctcacataagaaacgttttaacaattcaacaaaacaatttcattctccatacacaacaaattcaataaaacgcagcaacatagataatgaaagctaaattacacaaaagatcatatactttgatcccagaaattcacggaatctcagatcggagaaatgaaattgacgtgaagaaaagtgtagtaacgttaggaagatggaattgaaacaagaaaaaagctagctagggtttttggaaactcacgtactttttgattttgagagaagagacgacgacgatgactttagcgattagatctgtggaggcgatatacacaaagacgcggcggtcttctttataactctagaactcagatattaatactcaccgtagatccgtgacctcaacacgtgtcatgtttctgaaacatcttcattaaaactacccttatatttttttatatatttaagattgaccttataactttgactaatactgattacaccctctattctccgaatcggttatcaaaaccaatttcactggaccgtgatatcagaaaccggttcactgaggtgggcgagattttttgttgtcactctcctctcctcgttcttcgatgctcatccattagaggaggagccgatgtttctgcttcc

SEQ ID NO: 5564 - DNA, 3000 bp, Unknown
  misc_feature (1)..( 3000): cDNA_ID_3041922_gDNA_ID_1620803_Annot_ID_168741 3000 nt of promoter + ATG
tgggttttgatagcaacactcaacaatatgaaatgagctagcttttttttttctgataaaacccatcctctgtactatttactttaacaaggaaagagctttgatagctttattactttcaaaagaaaagtttggacctttggttctgtttttggggtttgtactcttgtttcatgtgaagagaggtatttggaatatgtctttaccaaaaaagagctcaaagataccttttaaattattattacagctaatttatggctattttgtatctaattaatcaatcaaatgagaaatgaaaagaatgaaacttgaatcagacgaaaactgtcaaaatgaataattttttaacaagtcaaagctcaagtttaaaattttcccgtcctttttaaaagctcaaccattttcatcagtcatcactggcaagttaagaggtataaaatggcgaaatatggtgataatattaatgtagtgttatatggagaaatagatgccaatgtatacatttgtacagatatataacaattgcatacgccaatacaatgtcttatgtctatggtcattgttgttcttccataatggaaccaattgatccaaatctaaggacatgacaatttattaacattgctaagcttaatagaaggtaccttgtgttcataacccgaatcagacagccttctcagaccaagtatacagttctggttagggtggtggttatgatgacggttattattgacatccttagcccacagtggataaagtttgaacctttttactgataagtccacagaagtcgttaccttaacgtagatcaaaaatctcgaacctaaggttcgagttcttgtagacgtttgagcaatgctcataaactgggttcccatcttctggttctttgtgcgggtggaatccagtctctgagcagcctctcagtacctccattcctccagggtccgttagcttaaatatcccgtaactcctgccaaaaagatcagtttgagagtctatcaaggaaatatgttgactgtataattgactccatagctttggaagaacatacttagagctatcagttggagctacgacgattgcaaaagcctctggcaccattacctaagaatgacatgatgggaaactgagatcagaattgtctcaaacctagtatatatgcaatttggaaacagcagagatgtacctgatacgaataatgtgtatgcagatctacagatgacatgaaacaaccctgagaaggatgagtctggaaaatatgcataacctcgttatagtaagtcaagacaaagtagataaacagatcactaaacatggagggagctagaagagagagatatacatgaatccatcctacgggatagagttctctttcgttttgaatggaaaacacttccacttcattcatagcctgacactgccaattttagcacctgagtaagcacctcattttgaataccacaaaatgatcgagataatctttctaagataactcacagaattagaagttgattcttgcttaggtattatcagagtggttacataaaaaattcctctttcctacagcatgaacagaaatagaaatgtaattaccatcaggttcatgaaactcgaaaaacgaagaaccctggaacagaagcaaaacaaccatgaatcatgaccacaaaagtcaaaacaaggtgtaaactttaaacaatagcatagatcgagtttcactaaaaattcaaatttgcaaagatctctgttagaagttgtaattaggaacaataaagtctgaaactttctaacattttccttgattttctcaccacccagattctcttatcacccaaagtaatcaacttgaatgcgaagaaagcaaaacaatcttacaagaaaggcagcgagagtcccacaagtctcgaggtccttctcagtgttctctcttgcaagctcagtgaaatcctccaataacctttctgactaagaagcacaaacacaacaacgattaactcaaattagatatccgtaattgaacgtaccaaatcacagagaactgagattcaaagaaaaatctcaaagttcttacgatatgaacatctctcagtattttggcttccgacgattcaccgtgattaatattatcggtaccggagattagaacccgagaaacgtgagaagatttacatgtcacgttctctacgcaagagagcgagggagatggagacgagagcgttaccatggaagcagaaacatcggctcctcctctaatggatgagcatcgaagaacgaggagaggagagtgacaacaaaaaatctcgcccacctcagtgaaccggtttctgatatcacggtccagtgaaattggttttgataaccgattcggagaatagagggtgtaatcagtattagtcaaagttataaggtcaatcttaaatatataaaaaaatataagggtagttttaatgaagatgtttcagaaacatgacacgtgttgaggtcacggatctacggtgagtattaatatctgagttctagagttataaagaagaccgccgcgtctttgtgtatatcgcctccacagatctaatcgctaaagtcatcgtcgtcgtctcttctctcaaaatcaaaaagtacgtgagtttccaaaaaccctagctagcttttttcttgtttcaattccatcttcctaacgttactacacttttcttcacgtcaatttcatttctccgatctgagattccgtgaatttctgggatcaaagtatatgatcttttgtgtaatttagctttcattatctatgttgctgcgttttattgaatttgttgtgtatggagaatgaaattgttttgttgaattgttaaaacgtttcttatgtgagaaatgaggatagcttaaacctgtttgatcgcatttgaggttttgattgtctaatcagatattgaaattgttgttaggtgctgatcacagcagatgttgttgtttatggctaatttttgtagggttgttataaaaatg

SEQ ID NO: 5565 - DNA, 3000 bp, Unknown
  misc_feature (1)..( 3000): cDNA_ID_2053370_gDNA_ID_1620803_Annot_ID_168740 3000 nt of promoter + ATG
tgaaaatatgagattgattatttgtataacacggaaaatatgagattgattctttatattacaatgaaaatgaatgattcaaaactaaagatcatagtgtaatatagtttagcttagaaaataattaaaacgattttatttatttatttagttttctaaattttagtttagattcagaaaataattgtttaatttccttagaagatgataaacatatatggaagatttgaatctctatatattttaaaaatcaatcaataatgtcaatataattaaaggatagattagaaaaaagtttcttgaatgctaaataattaatttgttatttataaacaaaatattaaatgctgtaaaaacgaaatattaaataaatatggaaagaaaattctaccttaaaatattttgtactattaaaaccgattttttttttgcagcaaattaaaaccgaaaattaataaatacttaagagagattttaggaatgatttttttgaagtaatgttagactttttttgaagtaatggtggatttaatatagagacattttaggcaatatttttgttaggtaaatatttgatttaaaatgtcgattgaaaaaaataaattcagtggcattgagtcgtaaataagttctaagtccaggatttatttgttaaaatgactgcaaaaatgtatatatagatatgaatcatttgttttaactctacactacatataatggtcctagctggcttgtactaaatactgagaaccctagctaaatgctgcactttgattgatctggttcaaatcaagatgattatcccttgatcagttctttgattgatctggttaaaatcaagatgtccataggattttcgcaacatagcccttgcctaagcgtctaggcgcttagacaaaaccaacacatacattacatctacgaaaaattatgtactctgtatatataaacaataaaatacatgtagagagagagagacggaccctacgagtgggagaaacatgagaagagagtatggagaagagatgtttcatgcgcattcgtcgttctttctctctgaggtttcgttgttcccgtaatgacgatgcgcttccttctcctatttctctcgctctttccattcttcttcttttccttttttaggttactatgtttaattccctctttccaaatccatctctccctctataaatataaagagatagagagaaagagccgcgtaattttagatgaaaatgatgtttttcaaagaaagtcatggcttttctggttgcgtccatgagcttacacactacttaatttatacatatatatgcttcttttactttgtaagttccactcttagagatactaaacatgtccaatatgttttttacttacttggtaaggttttgttggacacatttctagaacctagatagtgttacgctaggttttgttctagtgaagcttgtagaaaatgtgcttatcaaaatcatttcagcagaacatagtaattaaattagtcggattatatgtgatgaattcttcacataagtaccatgtttggatcgacaaaaacaacaagggaatttttttgttataccatgataattatgttgatcatttgtaataggctagataaaattaaagatacctttaaatgataatgtaacaattccatgtttaattaataggtgtccatatttattatccgaattacactatacaggtcacatatgctaagacaatttggtgtcaaaaacgaagaatctaagattattcaacaagctatcattattccttaccgatataaaagactttgaactattttttggccgtaaagctgacatatttcaccggagatgtcgttcaattatacacttgaccaagtcttattctaataacaaaaataataattatacacgtgaccaattctagattgaactttctaaccaattctacatgaatcgttcaccgaataaaaacaaaaacataaaattaaacctcgcaaaattgagtcttggagcctttgctaatttcttgaatactaaaagcagatcactgttgatctacatataattatttatttctgttgttcgttatttatccataaccaaaccatgattagaactaaatcagttctgtggatgcggtaaaacaatctcttcgtcgaatgaccccaaccaaatattcaaatgtacacttgctaaaacccggttcattggtagtccggtttggttcgtagtatttgagtcaatttcatatccctagatgttatgcagaattttgccacctagaccgaacagagcgttttcaaaacttggaaaggaaaaaacacaaagcatttagaacatgatggaacacatgttagccgcaaagaagtaaaagaagaaaaccttcattttgtcttctttccttgttttgcaaaatcgtccaaaggaataacttgtgtatatttatctgtttttgggtataaaagatatatatatatatatcgcctagtcgtcgctgcttgttgttgtcaaggcacacatgtttattctttatttttgtcaaatatttgaatcaagatcagctactattctaagaaactggctatttctaaaataacactcacgaattagccattatttataaaatggtaacggtatattcgagattccagtccatacatgttattaataaagaaagattggatctccatataaaaaatagctgtctcttacattgtagcactagctaaagatctttcaatactacgtacctagtcatacaattctttgaatatggttttaaattgtatgtgaatattattaagtgagaatagtatcgacataacaagtatgaaatcttttatttctatatattttatttaacaacctataacaaacatttcacttcaaattctcactatatgtagtccatcatcaactactttcttttcgcatatctttgaagtttttggttttactaaactaactctatcataaaaggagaaagctttaaatttaaccagaa

SEQ ID NO: 5566 - DNA, 3000 bp, Unknown
  misc_feature (1)..( 3000): cDNA_ID_3077679_gDNA_ID_1620803_Annot_ID_168736 3000 nt of promoter + ATG
atccacttttggagtttttcatattgcgatagcaaggacattcatctttgttttctcctaaaatcacacatggttagattttgtatgtgaatatagttaactaaaacttaaaaaacatgtatatatacacgacataactagtaaacaaatctttttttctaaatgtcttatataaattggacagtatatatagatcgataacaaaaatttcgctacaaattttctaactataagtaatcatccttttctagccacagaattagttacaagtaattataggcttaacattttaaaattgggctaatctgtatttctagtcacggattttcaatggctatgaattatgatagttaccaaatgactattctcttcttgtacgaattcaaatatttgaagaaggaaaaaaagaataacatgtggaaaatgcaataaggatataattgtcccttactcagtttctaagcaagtggtcaagcagcgagacgatatatacacagtgttagtatcatattgcggctccttttactttttatgtcagtttgctcagtggcaaagttatgaccaacatctacctggagtactccaagactcaacaaaactaggcatgtttaattttctgtctttgtattcacctccggtgaacgtttagacgatcggtccatgtagatcccctatccggtgaacgatgtcggccatacggccaaagagagttgagggcctttaataatttatgtaaggaatgccgaatgtgttgtgtccttttcttctatgataatgatagcttgttgaataatcttaggttatggcgccttatgatactttcctcggataatgaatacgtgcaccaaattaattgaacatgatgatactatttgatttagtggtcccgattctatcagtatacaaaacaattttccttttctatttgttgatagaaacatatatagtactgttgtaaggaattcatttttgtctaccgtggctgttgactattttacgccattgaaatgatttttgataataattttctccaaacctactgtaaatcacaggacttaaactcatggttagtaatctgaaagaagaagaatcatatctctgaacgttaggaatctcatctcacacggtaagcatgatgctatctaaactatgtctttgaacgttagaaatcttacatcgaaattatgatgcgtcctagtaatgtgtcaacccaccaacaaatctaattttttttttaatgataaacaacatatctaattgttttgaaacttttgtatctttaagaacgtggaaattccgaagtaaatagtaaaatttacttggtaggaaagatgcatgcatcttattaatttagtgtgtaagctcacggacgcaatcacaaaagccatgactttcttccaaaacatccctttcatctaaatcacgtagctctttctctcaaagttgagatttgtgactctgtatctcccggccctctctatctctttaactgtatataaagagagatggatttgaaaagagaaacttgtacataaaagcttaaaagaaaacaaaaagaatggggagagcaagagaaataggagaaggaaactcatcgtcgttaagggaacaacgaaacctcagagagaaggatcgaaggatgcgcatgaaacatctcttctctatactttcttctcatgtttctcccactcgcaaggtccgttttttctctctaactctccctctctctctttctctctctatatatatcttatattaaattgtagatgtgttttatgcgtatatacaacaatacaaacattatctacataattactgtaagatgtacgttttattctaaagagataatattttgattaattgaataggcagttgtccctctatgaccgtccatattagctctcttttaagtacggtgtctaattgacaaataaatgattcacgtagctagggtttttacggtttatttatatatattgaatataaccacattcatgtaaaagattaatgaaagtaattatcttggggttttttttgggatctaaacagttaccagtgcctcaccttatagatcaagcgacatcatacatgatccaattgaaagagaatgtaaattatttgaaagagaagaaaaggacattgttacaaggagaactcgggaatctctacgaagggtcgtttcttctacccaaactcagtattcgttcgcgggattcgaccatagaaatgaatctgatcatggatctaaacatgaaaagagtaatgttacacgagcttgtgagtatttttgaagaagaaggagctcaagtaatgagtgctaatcttcagaacttgaatgataggaccacttacacaatcatagcccaggtaccacatccacacgcatatgtttgtataatacacacgtatatgcatgtgtcatgtctttcgtataaatttttattacatatatttgcaggctatcattagtcggattggcattgatccatcaaggatagaagagagagtacggaaaatcatctatggatatatatattttgaagcatgaaatcccaaatgataagtctacgctaacgctagtgtgttttttcacacatgtgttagttctttaaatatgagatgagtaattgcttttgagttcgattatgataaatatgttgaccgtcaacataagaaaccttaaaacgttgtcgtttcgtttttattcatcccggtttaattcagtttggcttggcgtgattttagattggtccagatttgcataattttaaccaccgagtaagacagtgggatgtaaatgtcaataaaatacactattggggtaaatgtgaaaagaaaaaaatagtaagaggctatatttgaaaatctaaatatcgcacaaattgcaacccttattttagatttaggaattttgaaacccttgtcgaagagaaaagaggcaaaatctcagtataaagtttctcaaacacttgtggtaagagagcaaaatcgtgagagatg

SEQ ID NO: 5567 - DNA, 3000 bp, Unknown
  misc_feature (1)..( 3000): cDNA_ID_2053385_gDNA_ID_1620803_Annot_ID_168735 3000 nt of promoter + ATG
tcgtcggatcttgacatttccgactgtggaaccatccgaatcaatctccatagtcaccctattggactcactgattcaactcgccggcgacattctcacattcaagtcgaaacacttctctaccaataaacaaagcttcagagaaactctcaggcggatccaaaacctacttgttgtcttcgaagagattcggatccggatcagaaattcgagacgctacttccatgactctgccgccgcgtcgagcctcaaggagatccacgtcggcttccaaaagctcaagttccttctagaagactgcacgagagacggagctagactatgcatgatgatgaactcggatcaagtctcggatcatctccgggtcctgactcgatccatttccaccagtcttagtgcgtttcctgtcgcctccgttgacttaacgaccgaagtcaacgagctaattgatttagtggtgcggcaagctcgtaagtacggagtccaacctgaaacaaatgataaacgggccgtgagctccattaataggatccttgctctgtttgtgaacagagtcgtcccggatccggatgaaattaacaggatcttggatcacgtagggatcagaaaatggggagattgcgttaaagagataaactttctcggagaagagatagatgcagaacggttagatgagaagaagaagaagagtagcgatcaagtcgagcttctcagtagtttaatgggattcatatgttattgcagatgcattatacttggacggatcgagagagatgatcatcataatcatcatgaagatggtataaagaaagatcatgacttgatccgaggattgaaagttgaggatctcctttgtccaatttcactagagattatgacggatcctgtggttatagaaacaggccacacttatgatcggagctccatcactaaatggttcggatccgggaacatcacgtgccctataaccggaaagattctgactagtaccgagttggttgataacgtatccgtgaggcaagtgattcgaaagcactgcaaaacaaacggcatcgttttggcggggattagtcggagaagaaagagtcacgatgacgtggtcccggagagtttggctgcaaagggagctgggaaactcatcgcaaagtttctcacttcagagttaatcaatggcggtgaagagatgatttacagagccgtgagagagattcgtgttcagaccaagacaagcagttttaataggtcttgtctggttaaagctggtgctgtgactccacttttaaagcttcttagctccgtagatatcaggattcaagaaaacgcaatggctgggatcttgaatctttccaagcacgttaccggaaaatctaagattgcgggagaagggttaaagatacttgtagagattctcaacgaaggagctaaaacagagacgagactatactctgcttctgctctgttttatctctcttccgttgaagattacagcagattgatcggagaaaatccagatgcgattccgggattgatgaatatcgttaaaggagatgattacggcgattccgccaaacgtagcgcgttgcttgcggttatgggtttgttaatgcaatccgataaccattggcgtgttctcgccgccggagctgttccgattcttcttgatctgttgagatcgggggagattagcggcggactcacggcggattgtttagcgacgttggcgaagctggcggagtatcctgatgggacgattggggtgattcgtcgtggcggtttgaaactcgcggtgaagattttgtcttcgtcggaggattctccggtggcggtgaagcagcattgtgttggtctgattttgaacttgtgtcttaacggaggacgtgacgtcgttggggttctggtgaagaattcgttggtcatggggtcgctttacacggtgttaagtaacggcgaatatggaggaagcaagaaggctagtgcgctgatcagaatgatccatgagttccaggagaggaaaaccggttcggttgaaccgaatcttcaaagaggacggttcgttcacgcctggtgattttggtacacagtaactcttgagtattttaaagagttatttaccataaagaaaactaaataattttggttaagggtgaaattcttttattaatttttatgtaaagggtttagtgtttgtatatttagctcgggttttattttcataaaccaaagagctactgggatggcaataagcttcagtttttttaagaagctgtgtccatattccataatgtaattataactgaatcaataaaaactattacaattaaaaaaaaatacctaacttttttgttttgcatgtttcctaaaactaacattacaaatttcttggtccaaactaaagacaagaaaagtacctagctttctttgaggtaagtcctattcactcacatgatgcactaggttggaaacgcaaaatggtgtttgaagcagtggaactcgtttgtttgcaataacagggataaggttgtttaatctagttgaagtcgcaaaatgttgtttgagatctttagaattagcatctagaaatctcatatttcgtgtgacttacataaaaacttattttatgtatataagtttaatcaaaactacgtcgttttaatctttttaagacaataaacaatgttacaaaatttgtttgttaacatttcaaaattttaatataaaatgccaattgagtttatgctataaaattaattcgatcgtttttatgttcgattgattttgaattggaagcatgctattagtctacatataaacttttcaaatgtagttgttaattaatttgaatttgaaagcccacaattcaattcgaatttagttagttttgagttggaagcccactatatcgcaattatattacaatttaatgtaaaaaaagcgatgaaaaaccagaaagatttcagaccgaaacctaaataatattgagtaagtttattcgaagaagag

SEQ ID NO: 5568 - DNA, 3000 bp, Unknown
  misc_feature (1)..( 3000): cDNA_ID_3077683_gDNA_ID_1620803_Annot_ID_168730 3000 nt of promoter + ATG
aaatcctccggtaataaaaatctacactgttctgttttgaacatattgtttcctcggttgttcatttttttaatgatcaagccagagtttctttctgtatattatccacaaaacttatatatatgtatgtgaatatttatatataatatcgacatatttgcaggagctgggttggtgtcaaagaacaagtatcactatggtttcttcagtgcaagactcaagcttcccgctggatttgcctctggtgttgtggttgctttctatgtacgtataatatgtttcataatctcctgaatccaaacctcaatattctctagacatatagcttagtaatgaatataggagttattttgaagatatactaatgcataataatttcgatatgcagttatcaaacgcagagacttatccgaaaagccacgacgagatagacatagaattgttgggtagaagtaggagagatgattggacgatccagacgaatgtatatgcaaatggaagtactagaacgggaagagaagagaagttttatttttggttcgatccaacgcaagcctttcacgactataccctcatttggaactcccaccatactgtgtaagtcacactcttgactattatcatcttcttcttatttttcttacgaattagtatcatttattatccattcaatttaaggaaaaggaaaagttatgggccaagaaaagtcaaaacaaacaaaaacattagatataagttcatgaatcctaaaggcaatgcttcatatagataactagaatgactttttctgtataattttttgaatttgaaatataacaatagattaatcatcataatgagcatttgtcatctactaaagttacaaactaataaagtccacctaatgcatgttgacaaacaaaaacaaagatacaagttgatattcttagattaatacaatatatttagggattggttttagactttcagtacttaataaatattttagttaaacaattggacataaagaaactcaatatttcttttaaatactaactgtgatcgttattcaggattttaaaatgctttttcaattattggatttacagatttttggtagacaacattccggttaggcagtttccaaaccggggagccttcacaagcgcgtacccgtctaaaccgatgtctctatacgtcaccgtttgggacggttcagagtgggccactaaaggtggtaagtaccccgtcaactacaagtacgcccctttcgtggtttccgttgctgacgtggagttaagtggctgttccgttaacaacggctcctctaccgggtccgggccatgtaccaagtcgggcgggtcgatttcgagtctggaccctgttgatggtcaggattttgccacgttgtcgaagaatcagatcaatgccatggattgggctaggagaaagctgatgttctattcttattgcagtgataagccaagatacaaagtcatgcctgctgagtgcaactgatttttttttttgttaaaacacacattgttactttctattgttttatgatataattttacgtaggatattagaggtttaaagtatgtttcaaacttcgccaaaaaaaaaaagaagtaatgtttcaaattttcaatttttcttcttcttacagtattttgctctacagttgttctaatattttcttacacctatgttatatataataaagttgactgtccatcagattttcgtgataaatgagtcgtgaaaatcatataaatcatatgaaagagagcattgataaagtaaagtttttcattcaaaaaaaaaaaaaagtttttcttacaaaatgattaaaacacttgtccaagtttggatataagttagggtaacaacattgaatttttcaattattattgttaaaagggcttgcaattaaatttacgaaaataaaaagtacaggcccagcccgggcagctttttctgggaaagacccaatacgacaatacatatcatatttattaataaaagcccaatagaataatacccaaatatgaaataaccaaatgagaattgggatcagatcagaccatgggatctcatatattttactcttaaccattttatttgtatccacaagaaaaatgcttatattgctaatgtaccgctaattcgataataaggtgcccaatcagtatcgaagaaaaacaccagggaaaaagaaagaaatctaatgttttaaaaaatcatcccatgaaatgggctaattccagaaataaataaataatgttaccgctaattcgatataggtgcccaatcactcggcagaatctacttgactcattgttattttaagcatttttgacagaaacgtgaagtaagagaaatagtgtgaagacttatctaacttggttttaccttttgaacttattcataaatgatacgaaagttgagaaacttatttacgaaaactttttgcacttatttactacatttctacttttgcagtcaataatctttttctttttttgttttcatagaatcatttagttgactggtagttattttacttgattacaccattaaataacttaaactactagtctcacgctcttccacaaattcaatgcaaagctttaatttggttttgtcattggcctcttttttgtttcctcaagtaggattctttcttctcaaagtcgtaacgtaaacttacaaaactctttctttttccataaaacgttccttacatttattctctgccaacactcttttttctttttcttttttggttttttcctctatcattgtcatcttctactatcactttcagttttctgaagctttccagtttccaaattttctaaacttttttcctactattttgattttcacctctcttttgtggttttgttgaagatccacacaaaaaagcttccaccatttttttttctgagcttccatttttaagctattttcttgattttttgggtttcactggaagaagaaggataagaaaaaatg

SEQ ID NO: 5569 - DNA, 3000 bp, Unknown
  misc_feature (1)..( 3000): cDNA_ID_2053402_gDNA_ID_1620803_Annot_ID_168728 3000 nt of promoter + ATG
acaaaccacccgatttgaacagaaatatcactgagatatttggaaagttaattaacatatatagaggtacaatctctggtgtttgtattctagactactcgcttatagtaagtaagtaacaatactctttcttttttttcaaaagctttgggtgaagatagacggtcctttagctattacaaagctatccccgtcattgaaaagttccccactaggattgaaagcgttgatcagctcaaacacctccctggaatcggaaaggcaatgagagatcatgtaagttgagaaatgcttcaaatgttttgtctaggttctgtgtgtgggtgtcaaaactgcaaacacttacccttttcctagtgcatacctataacctttgttttgatgtatttctgtgagaacaaagtcttattcttctacctgaatttggcagattcaagagattgtgacaacagggaagttgtccaagcttgaacattttgaaacagatgagaaggtaattttgaagtccttggttatagttattttgctatctcccattttcaattagatacaagctcacatgtagaggccatttgcttttctcttgttcctttttctctttaaagaaaaatactgtcaatgaccgaactggagctagagatgtctgatatgttttgtttaccactataaatgtttcattactatggttgaaggttcgtacaatcagtttgttcggggaagtttggggtgtcggtcctgcaactgcactcaagctatatgagaaaggacatcgcacactagaagacttgaagaatgaggattcactaacgcatgcacagaagttggggttgaaatattttgatgatatcaaaacacgaattccacgtcaggaggtgcgattcttaaacttcaacgtgaattttgtttgtctttattatccttcttgtaattttctcctcatatttcttcactttctgtattgtaggtgcaagagatggaacaacttttacagagagtcggcgaggaaactttgcctggcgtatgaactattcagtttatcggtctgctccatatttgggtgataaaagtttagtgaaatcctaaccaacatctttactgcaggtgaatattgtatgtggaggatcatatagacgtgggaaagctacttgtggagatctggatatcgttgtcacccatcctgatggacaaaggtacctacaatcttctttcctcatcttcctgcgttagtttcctgtaacaaagtttacttaaactgttttttcttattgtcctgaccagtcacaagggatttttgacaaagtttgtaaagcgtttaaaagaaatgaactttttaagggaggatctcatcttcagcacccacagtgaagaggtaagatgatctgataaaattatttaagagaggatctcatcttcattgaaaacacattacttcagttgtttcagtatcttataaaatgatctcttttagcattagataaagctttgttctctcagagttgcatgtgtaacaaaaattcttgttcaatcacagctcctcaatgatttcccttattgtgcagggtactgattcaggcgttgacacgtattttggtttgtgcacttatcctggtcaggagctacggcgccgtatcgattttaaggtaacacctgaaaactcctaatgtcacacaatgcagaaaagaactaagtgggttagtcaaagataaaaaggacaataccatgattgattcagctatgtctaggttgatctcttcccggaagatcattcaataaatagtcttttttcataggtctatccaagggatatctattcgtttggactcatagcctggacagggaacgacgtgttgaacagaaggtatggatatgatttcatttgtatacatgtctcactaaacacatttgttggtagataaagaacacagcatatgtatatatatatgcgatgataactgcaggctgagattgctagcagaatcgaaaggatatcgacttgacgacactggactattcccagctactcacagttctagtggtaaccgggtaagtaagggagaaaagtgaattaacttgatgtgaattcttgggttttaaagtgaaagaatgattatgttgaagctgtgataatgtttgtctctcagggtgctagaggaactgcaagtctgaaactctcaacggagaaacaagtttttgatttcttaggatttccttggctcgagccacacgagaggaatctctaaggcatcacaggcacacagcctttggtactaaattttttttttttctttttgaataggttctgtatgtaagtaatcggttcctttttgtaattgcatatccatggacaactgatttagatgttacatataatgcaatgcaatgtacttgtattagaaaccattgcatatctttaaggtaaactaagaaaacctatggtactgaggaaacttgggatctcaatttttttttaaaatacaattcctttactaaataattaattacacgtgtcataagatagttggattaagtgtggaaataagagtgtcaaatgtcccacatcgaaaagccagcagaaaaccaatttgtatatataaggacacaaaagatagatggtcacgaccttacttgaacaggatctgttctataggctcgtacctctgtttccttgatttctaaggagacaggccctaaaccctggttgatgaaccatgaccgtgcggtcagagcgtgattgatggctacgatcgtcttcggacgcatccggtgctgtagaggatcgttactcggcttggtcttccttgccggggtggtcgcacggcggtctgacaggttctttttattttaccctcggtttttttttttttttttttttttttttttcaccctcaaaactttcaatttcttacattttcaccctttaattgaaacctcgctaaaaccctcagctgttttattgcagaaaacaagagataaggttgaagagtgaagcaaagcttagta

SEQ ID NO: 5570 - DNA, 3000 bp, Unknown
  misc_feature (1)..( 3000): cDNA_ID_3077687_gDNA_ID_1620803_Annot_ID_168727 3000 nt of promoter + ATG
atggtgttcttcaatcaaatattatgttaaaaattcttaatctttctggaaaccctatcggtgatgaaggagctaaggttagtggaaatatgatatactagttttaaatttaacttccgggtgtccaatggtagaaattcctcagttccatcaagagaagagatcatatcgatttctgcttatatctttagctctaaaatcacatggaacttattctctatgtatacgtttctggctgagaatggtttcgcttcattttttctggttatggcagactttatgcgctacactgatggaaaattctagcattgagatacttcagctgaacagtactgatataggagatgaggtttgtttgagcagatgctttgatttacatgcttttcaagctcctaagttagtcacaatccttcaaattgttttcatacgttaagtagttccaatgttcttgcgcagggtgcaaaggaaatcgcagaattgttgaagagaaattcgaccttgaggattattgagctgaataataacatgattgactattctgtaagttttttctgttcatgtgttgtacagttatatttcagattgacataccaagtttatgaattaaatctgttgcgtcttcttcccttctttttttgaaatggaggtagggattcacaagtcttgctggagctcttcttgagaataatacaatacgcaatttacatctcaagtgagtttaggactatagatggatatatcttttgggcgtgctttttttattttgtctgtatagttcatatccctgacataccgatttatggataatctgtttcagtggaaattacggtggtgctttgggtgccaatgctttagctaaagggcttgagggtaacaagtctttacgggtacaaactttcctcatgtctctttcgatgtatatcgtgtgccatttctatattaaaagagacatttcatagttagatctgttatcttatatgatgcattaaaggtgatttctgatgtcatcagagacaaccaatgaataaaggtcatcaacagttgatttattcccttggcctttccacctgcaggaacttcatttgcatggaaactctattggagacgaagggactcgtgctttgatggctggtctatcttcccacaaaggttttccaatagaacacttgtcatacgtctatattaactcttccgtacctctactgtagaattcagtagttataccgagatgcattttcgtgtgcagggaaagtggctttgctagatctcggcaacaactccatttccgcaaagggtgccttctatgtagctgaatacatcaagagaagcaagagcttggtttggctgaacctgtacatgaatgatataggtgatgaggtacatatatatccaatttataacaataatctggattgtgtctgtgcttctctaatatcggaaaaccttgtctctttttgctctgttgtctatcttaaagattttcaatggtttcagggagctgaaaagattgcagattctctgaagcaaaaccgttcaattgcaaccattgacctggtgagaagtgaccatcttctccagcctccctaagttttccttgcgtccatatcgagctatttgttctgctaacacgtttttggtaaaatagggtggaaataacatccacgcggagggagttaatgctatagctcaagctctgaaagataatgcaattattacgacggtcagtgccaaaaacccttctcatctttgattccttgtttacgtataactagtatgataatgacactaccactctcaatatttcctcagttagaggttggttataatcccataggaccagacggagctaaagcattatctgaaattctcaagttccatggaaatgtaaagacgctcaaacttggttggtgtcaggtaaagcctgtccataactctttatctaggaacaaaagtatttcttcacagttacttatttcgttttgtcatggttcctttcatttcttattcctgcagatagctgccaagggtgctgaacatgttgcagacatgttgagatataacaatacaatctcggttttggacttgcgggcaaatggacttagagatgaggttcctgcagacagattttatgagtatcagatttgtacttctaatatagctacgaactatatgttttcataatgtatgtggtacgttatttgcagggagcttcctgcttagctcgaagcttgaaagtagttaatgaagctctgacatctgtggatctaggattcaatgaaatacgggtaaaaaaaaagcgctacttcgtttatcaatactgtgtcttcttttaagacttgtaagcaggtcaatcttattattttgcctcatttgtaggatgatggagcattcgccattgctcaagcattgaaggccaatgaagatgtcacagttacatcgataaaccttgggaacaacttcatcaccaagtttggacaggtaagaaacatatggtgcaatggagataatcaaatctttcgctcgacattgctgagaaatttcccttttgtgttatccagagtgcgctcacggatgctagagatcatgttcttgagatgactgaaaaggaagtagaaattttcttctaggagagacattgaagtgaagaagactttgtcactctgtaattttgcaccattagttgttgtttcattatttatgacgttgaaatgattcaagcgagagataaaacatttgttgttccttacggtgagatttaattttaattcaaggaagttttcatgaaaaatggtgttgactaacaaaagagaggcattttaagtcaaagttggtcgttgaatgaggaaaaaattcattcggtttagaacaggttatttcggtttggttccgattcggttcgttgaaacgagcgtaattgcctaattggggtattcctgctttgaaagacatatactagtttggtggacaaaactcgagtgagttacgagtaaagcgagaaaa

SEQ ID NO: 5571 - DNA, 3000 bp, Unknown; identical to SEQ ID NO: 5561
  misc_feature (1)..( 3000): cDNA_ID_3077691_gDNA_ID_1620803_Annot_ID_168726 3000 nt of promoter + ATG

SEQ ID NO: 5572 - DNA, 3000 bp, Unknown
  misc_feature (1)..( 3000): cDNA_ID_3077695_gDNA_ID_1620803_Annot_ID_168725 3000 nt of promoter + ATG
atcacctatatcattcatgtacaggttcagccaaaccaagctcttgcttctcttgatgtattcagctacatagaaggcaccctttgcggaaatggagttgttgccgagatctagcaaagccactttccctgcacacgaaaatgcatctcggtataactactgaattctacagtagaggtacggaagagttaatatagacgtatgacaagtgttctattggaaaacctttgtgggaagatagaccagccatcaaagcacgagtcccttcgtctccaatagagtttccatgcaaatgaagttcctgcaggtggaaaggccaagggaataaatcaactgttgatgacctttattcattggttgtctctgatgacatcagaaatcacctttaatgcatcatataagataacagatctaactatgaaatgtctcttttaatatagaaatggcacacgatatacatcgaaagagacatgaggaaagtttgtacccgtaaagacttgttaccctcaagccctttagctaaagcattggcacccaaagcaccaccgtaatttccactgaaacagattatccataaatcggtatgtcagggatatgaactatacagacaaaataaaaaaagcacgcccaaaagatatatccatctatagtcctaaactcacttgagatgtaaattgcgtattgtattattctcaagaagagctccagcaagacttgtgaatccctacctccatttcaaaaaaagaagggaagaagacgcaacagatttaattcataaacttggtatgtcaatctgaaatataactgtacaacacatgaacagaaaaaacttacagaatagtcaatcatgttattattcagctcaataatcctcaaggtcgaatttctcttcaacaattctgcgatttcctttgcaccctgcgcaagaacattggaactacttaacgtatgaaaacaatttgaaggattgtgactaacttaggagcttgaaaagcatgtaaatcaaagcatctgctcaaacaaacctcatctcctatatcagtactgttcagctgaagtatctcaatgctagaattttccatcagtgtagcgcataaagtctgccataaccagaaaaaatgaagcgaaaccattctcagccagaaacgtatacatagagaataagttccatgtgattttagagctaaagatataagcagaaatcgatatgatctcttctcttgatggaactgaggaatttctaccattggacacccggaagttaaatttaaaactagtatatcatatttccactaaccttagctccttcatcaccgatagggtttccagaaagattaagaatttttaacataatatttgattgaagaacaccatcaaaggctttaactcctgcagctgtaattccatttgcagaaaaactgacttcctctacagtctgaaacacaaacatgggtatggttagtcaatcaacataagaatatcaggactctaatgagttggtagatagcagatgtgaaagaaggagagaactataacctgattatacccaaggctttcagcaagaaagaataatccttcatctccaaagttgcatcctgcaagataaaatatacaggtgagctatatttgcgtatattaagacaaaaggaagatggcactacagatcacatttaattctaatgtaaatcagtaataagtaatgtcataacagttaaaatcattcaatgcacctgacatgtcaacacttctgaaggacctaagttcttttgcaaattcattaagcctctgcttggcctctctatcaaccttagcagcaaatccttgtaacaaattagtaccggccccgatcgaccatttcactccctgtgtagaagagttgttttctccagcagaagtctttggagacttaggcgacatgaacttcccaaccactttccacaaaactgtcagctgaaaacacaaattagtatagaagatttgagagaaaagacgaaacttttatcattactattctcgtatagatagcaatcaccgaattacatgacaagcaaactaatttccgctctattacttccacatgaaagaagaaaacacagtaatactagtccaagttttgagaagtgacggataaacaaaactagctctcctagcaatgctcgtaccgaaagtgacgacagcaaatgatcccaagggcaagacggaagacgcaatctgctgcactttagcattaggaaaaccactagccgcttgtgactccttataaaccctactacgcttcgagcctccatctgagttatacgccgctttgatcgccggaagtctcggacttcggtgatgaatcaccacaggagaaacaaacaatcggttcctagaaacggagctacccaacaattcgtaccggaacccactcttccattggcccaacccagaagaagccttcaaaattcacagagaaagaaaccgaatttagaagctacaagaattgggaaaaaaaaacaaaggatgaacagtagaattaccttggggagagagtggagattgagggagctggtggaagaagaagccattaaggagctgcttaattacgcatagacgcttgaaactctcgctgtgtgaaaaccaaccactgaagaattaggaaagtgtaagagactaaaagagacgaattggagtagaagagaagagacgatgatgaagatgaagtttgtttccttcgcgctatgtgtgtgtgtattcctttaggtacgggtgtgacccgactatccaccgggtcgaaatcgggtttaaatttatgacccgatagattcgaaagagaacgactttattagggttcataacaaaaataatcaatcacctacctgaaaacaaataacatgtggacttaaaaaattgttatgcaaaaagatttgtttttttcattggtcttcttctactacacgcatttgaatcagcagagagattaattcctcagctcggcgattcaattctcagaagattatg

SEQ ID NO: 5573 - DNA, 3000 bp, Unknown; identical to SEQ ID NO: 5559
  misc_feature (1)..( 3000): cDNA_ID_3077699_gDNA_ID_1620803_Annot_ID_168724 3000 nt of promoter + ATG

SEQ ID NO: 5574 - DNA, 3000 bp, Unknown
  misc_feature (1)..( 3000): cDNA_ID_3077714_gDNA_ID_1620803_Annot_ID_168715 3000 nt of promoter + ATG
agaacaagaaggttacctcctgtatccgatccaagcttcggatattatcaagagtatccagagaaggtgaaagccctccatgcaaacagaaaacctacaaaatttgatgaagtcaaaaagctgtacttagaaaaagatgtatcaaacaccaactgagaaagaacagctctaacctgactctctatgagggcggtaagaggaagataatcgaaaaggtctgtaaaatacttccagacgttagcatttccgtacttcctcaagcattcgtcataaaaaccatagctgaaacagagaagcaaaacatgcatcaaaacaggatagtactttgctgatcagccagaaaccaatgaagaaaagtacgattcgctcaaatataagcttatttcaaaacaaaagcttacacttgagtaatctgccgactctcgtgattccctcgtaagattgtaagtctatccctgtatcgcacttttagtgccaccaatagagaaactgtctctactgaatagtagccacgatctgcaaagaacaaagcaagacaatgagaaaccaacaacactccttttaaactaaatctagctgtcaccatcttatggtacaccaacgaatggttaaagttccaaggatctaaagactagaattcaagggaagtgcaataatgaaagtgagcatcaacaagtctctatattgggaagtttcagtacctaccattccaaaaaaaaacagaacccacaagtaactcactctagataaataaaaaggtggatacttttccaagaattcaccattttggaatgatccaaaaacacagatctaaaatgagaaaaaaaagtaaaaaccccaaaaataaaatcgaaagaagaagaaagacagacctacatagtctcccatgaagaggtagttagtatcaggagcgttgccaccgatacgaaagagctcaataaggtcataaaactggccgtgaatatcgccgcaaacggtaacaggacacttcaccggctgaacattatattcctcgacaaggatcgctctcgcttgatcgcaaagcgtcctcacatccgcctccgataacggtttacactccatcagctgctcgatctgacggtccagatctccgttcgacggcatcttgaaaagccaccaccgatcctatatacgaaaattacggcggataaagaagatgaatcgccggagaatctatcggccagagctaagatatccgaatcggagagatcaaatcctcctagcttctctggtcttcgatagttcgatgtctctctctctcacctggctgagaaaaaatggatattcgttttttttttttaaagactaaaagtgggtcgtgtccaaatagacaaagtataaatgttttatgacccggttaaggttcggttttgtgttaattttattagtctcgccaattgttataaaacttatgattgttttttttctttggttcaaaataaaattttgagttttagttgttttttcttctgttaaattcgttggtgttttcaacttaattctagttgttttcggtcaaattatcaaaaaaaaaaatgaaaaaaaaaagagagaattgagaccaaaccggatcggatttgaattgtgaaccgttacacgtgggtagttggagcagagctattgtcatttgaacttgtctaaacgataagtatatatggacaaatcatctcctcctctcatccggtaattataattagtcaactaatgttttcatattatgttttagatttgacaaatttgcttttaagtttttaatgttgacatgatcgtcgactatgaggcaagttcctcgtcgaacaaatgggcctggagaatctggtagagcggcccatggtaacaaaaataaaagaaggggcgttccgagaattgaactcgggacctctcgcaccctaagcgagaatcataccactagaccaaacgcccattgatgatagctctgacaatacatatttatatttagaaaacattttgaaccattaattttgctattaaattgatgcaaatcaaacctaattaaagtttatcatctaacacagtatgaaaattcatagaccaaacatttttcccttgcatattcttcccacttgtaagaaaatgtgaccgagctttttaggtaaaattaggatattatactttacttactacaaacgaatattaataaaccagatttagtttgaatagactggaatattatgtttcgtttttataaccttaaatcaaatcctcacttacgcataggtaatgaaagttgaaagaaaaaaaaccctaactctgctttttacttggtttttgatttacataatattaaaccggtaagtttgatttggaattgaaaaataaaccaatttcgtacgtaaccttccatttagctccgaaggttctgattacatacagacatgaagatttctttgggtatataagcaaaacaagctcctctctttttcttcttcttcctcgttccgttgccttaccctcttccctcctccgcttccaaaatcagcgagagagggagacacatagagagacagagagattgctcctaatcagaagcaatctcaccattgaatcatctattttctaccaaaaggaagcttcttttgcttttcattttgccaagtttccgtctaaatctctctactttaaaactccggcggccaacgtttccaccgatcctccgacttctttccgagtttcatcttctaacaaaggaacgaagaagctctcttcaccgtttgagtaacgtgatccggtctacaaaggttttaaatcaaaatctcttgctcagaatttttcctcgttttttgtgatttctcttaagattttccgatgagagatctattacttgggacaacgattccgagctatttctcttggcttggactatttccacggttcttagtttggtttggcttcttaaaagcctcttttttttgttcttccagaaatcagtctgcgggagaaagtggaagaagactgaag

SEQ ID NO: 5575 - DNA, 3000 bp, Unknown; identical to SEQ ID NO: 5557
  misc_feature (1)..( 3000): cDNA_ID_1828853_gDNA_ID_1620803_Annot_ID_168713 3000 nt of promoter + ATG

SEQ ID NO: 5576 - DNA, 3000 bp, Unknown; identical to SEQ ID NO: 5570
  misc_feature (1)..( 3000): cDNA_ID_1828825_gDNA_ID_1620803_Annot_ID_50514 3000 nt of promoter + ATG

SEQ ID NO: 5577 - DNA, 3000 bp, Unknown; identical to SEQ ID NO: 5569
  misc_feature (1)..( 3000): cDNA_ID_2053402_gDNA_ID_1620803_Annot_ID_50515 3000 nt of promoter + ATG

SEQ ID NO: 5578 - DNA, 3000 bp, Unknown; identical to SEQ ID NO: 5568
  misc_feature (1)..( 3000): cDNA_ID_1828817_gDNA_ID_1620803_Annot_ID_50517 3000 nt of promoter + ATG

SEQ ID NO: 5579 - DNA, 3000 bp, Unknown; identical to SEQ ID NO: 5567
  misc_feature (1)..( 3000): cDNA_ID_1828805_gDNA_ID_1620803_Annot_ID_50521 3000 nt of promoter + ATG

SEQ ID NO: 5580 - DNA, 3000 bp, Unknown
  misc_feature (1)..( 3000): cDNA_ID_1828789_gDNA_ID_1620803_Annot_ID_50525 3000 nt of promoter + ATG
gccataaagggatttgaagcaaaacaaagtactgtatctgtatgggttttgatagcaacactcaacaatatgaaatgagctagcttttttttttctgataaaacccatcctctgtactatttactttaacaaggaaagagctttgatagctttattactttcaaaagaaaagtttggacctttggttctgtttttggggtttgtactcttgtttcatgtgaagagaggtatttggaatatgtctttaccaaaaaagagctcaaagataccttttaaattattattacagctaatttatggctattttgtatctaattaatcaatcaaatgagaaatgaaaagaatgaaacttgaatcagacgaaaactgtcaaaatgaataattttttaacaagtcaaagctcaagtttaaaattttcccgtcctttttaaaagctcaaccattttcatcagtcatcactggcaagttaagaggtataaaatggcgaaatatggtgataatattaatgtagtgttatatggagaaatagatgccaatgtatacatttgtacagatatataacaattgcatacgccaatacaatgtcttatgtctatggtcattgttgttcttccataatggaaccaattgatccaaatctaaggacatgacaatttattaacattgctaagcttaatagaaggtaccttgtgttcataacccgaatcagacagccttctcagaccaagtatacagttctggttagggtggtggttatgatgacggttattattgacatccttagcccacagtggataaagtttgaacctttttactgataagtccacagaagtcgttaccttaacgtagatcaaaaatctcgaacctaaggttcgagttcttgtagacgtttgagcaatgctcataaactgggttcccatcttctggttctttgtgcgggtggaatccagtctctgagcagcctctcagtacctccattcctccagggtccgttagcttaaatatcccgtaactcctgccaaaaagatcagtttgagagtctatcaaggaaatatgttgactgtataattgactccatagctttggaagaacatacttagagctatcagttggagctacgacgattgcaaaagcctctggcaccattacctaagaatgacatgatgggaaactgagatcagaattgtctcaaacctagtatatatgcaatttggaaacagcagagatgtacctgatacgaataatgtgtatgcagatctacagatgacatgaaacaaccctgagaaggatgagtctggaaaatatgcataacctcgttatagtaagtcaagacaaagtagataaacagatcactaaacatggagggagctagaagagagagatatacatgaatccatcctacgggatagagttctctttcgttttgaatggaaaacacttccacttcattcatagcctgacactgccaattttagcacctgagtaagcacctcattttgaataccacaaaatgatcgagataatctttctaagataactcacagaattagaagttgattcttgcttaggtattatcagagtggttacataaaaaattcctctttcctacagcatgaacagaaatagaaatgtaattaccatcaggttcatgaaactcgaaaaacgaagaaccctggaacagaagcaaaacaaccatgaatcatgaccacaaaagtcaaaacaaggtgtaaactttaaacaatagcatagatcgagtttcactaaaaattcaaatttgcaaagatctctgttagaagttgtaattaggaacaataaagtctgaaactttctaacattttccttgattttctcaccacccagattctcttatcacccaaagtaatcaacttgaatgcgaagaaagcaaaacaatcttacaagaaaggcagcgagagtcccacaagtctcgaggtccttctcagtgttctctcttgcaagctcagtgaaatcctccaataacctttctgactaagaagcacaaacacaacaacgattaactcaaattagatatccgtaattgaacgtaccaaatcacagagaactgagattcaaagaaaaatctcaaagttcttacgatatgaacatctctcagtattttggcttccgacgattcaccgtgattaatattatcggtaccggagattagaacccgagaaacgtgagaagatttacatgtcacgttctctacgcaagagagcgagggagatggagacgagagcgttaccatggaagcagaaacatcggctcctcctctaatggatgagcatcgaagaacgaggagaggagagtgacaacaaaaaatctcgcccacctcagtgaaccggtttctgatatcacggtccagtgaaattggttttgataaccgattcggagaatagagggtgtaatcagtattagtcaaagttataaggtcaatcttaaatatataaaaaaatataagggtagttttaatgaagatgtttcagaaacatgacacgtgttgaggtcacggatctacggtgagtattaatatctgagttctagagttataaagaagaccgccgcgtctttgtgtatatcgcctccacagatctaatcgctaaagtcatcgtcgtcgtctcttctctcaaaatcaaaaagtacgtgagtttccaaaaaccctagctagcttttttcttgtttcaattccatcttcctaacgttactacacttttcttcacgtcaatttcatttctccgatctgagattccgtgaatttctgggatcaaagtatatgatcttttgtgtaatttagctttcattatctatgttgctgcgttttattgaatttgttgtgtatggagaatgaaattgttttgttgaattgttaaaacgtttcttatgtgagaaatgaggatagcttaaacctgtttgatcgcatttgaggttttgattgtctaatcagatattgaaattgttgttaggtgctgatcacagcagatg

SEQ ID NO: 5581 - DNA, 3000 bp, Unknown; identical to SEQ ID NO: 5563
  misc_feature (1)..( 3000): cDNA_ID_1828785_gDNA_ID_1620803_Annot_ID_50526 3000 nt of promoter + ATG

SEQ ID NO: 5582 - DNA, 3000 bp, Unknown; identical to SEQ ID NO: 5562
  misc_feature (1)..( 3000): cDNA_ID_1828781_gDNA_ID_1620803_Annot_ID_50527 3000 nt of promoter + ATG

SEQ ID NO: 5583 - DNA, 3 bp, Unknown
  misc_feature (1)..( 3): cDNA_ID_2156237_gDNA_ID_1620804_Annot_ID_168752 3000 nt of promoter + ATG
gaa

SEQ ID NO: 5584 - DNA, 3000 bp, Unknown
  misc_feature (1)..( 3000): cDNA_ID_1810748_gDNA_ID_1620804_Annot_ID_168753 3000 nt of promoter + ATG
agatcagactataccgagacaacaacattagtaagttttggcatgttggtaaatattattgctctcaagtcttaagaaaatataatcaagttaaaaaagaaagattaagggggtgttattggttagtggattttaatagagttaaactctaacccaaatctaatgttattcattcattgattttaaatccattatttaaatcaagtgttattagttcttatacttacaatatcttcattaaaagactttaaaattaagtgttattggttttcatatttctaatgtttatattactagagtcttaattctaatgttattggttctcatattcacaatgattagttcaagtttcatgttattcatgtttgatagattttcacaaatacttttatttgaaaagatttgaatgaatctcaaactgatttcatgtgtaaattatagcaatcaaaatattgccttgtatcttgagattttcacaatcatacagtctcatgagaatattacatattgccttgttcctttgccaaaaactttctttttccttccacatctaggttcacgttacatctcggactttcttctctccttcttctttcttcttccctttcacggtaaagtctatctcttttcatcattatagtagtcatggctcgtgaatttgcttgagaacaaagtcacttttatcacttttgatcatactattatatatatttttattgtaggttttataatggaacgaaatctttgtgaggaagatgattcagatgtagatattatgttattgatggtggttggatccgttgatgcttatgaaagtcaaatcccacgtccgatgcgacgacaaatcacaaaaaagggacacgcttatatacaaaaggctttgaaagatgatcctattcattttcgtcaactatatcgtatgaatcctgaggtttttgcggaattatgtcatcttctccaaatgaaaacaggtttgaaaggtacaccacatgtatgtgtcgaggagatggttgctacctttttgataacagtgggccaaaattcaagatattgtcacacaatggacactttcaagagatcaaaattttcaacaagtattaatttccacaaggttctcagagctttaaacatgcttgcaccaacattgatggccaaggttacaaatacagtgccctcaaaaataagcaaaaccacaagattttatccttacttcaaggtacatatctttttgtgtgaataatatttcttgaagtcttatataaacagtttttaatttatgttaggactgtgttggagctattgatggcacacacataaatgcaatggtacaaggtcctgaaaaggctagttatcgtaatcgaaaaggagtcatttcacaaaacgtattagctgcttgtaactttgatcttgagttcatatatgttctaagtggatgggaaggttcggctcacgattcaaaagttctacaagatgctttaacaagaagaactaatagattgcaagttccagaaggtaatagattacaagttctaaaaggtgatttatcatatgataatttatttctaatagtgtgcttccatgtttcaggaaaatattatttagcagattgtgggtttccaaaccgacgtaatttcttagctccactacgaagtactcgttatcatctacaagattttcgtggtgaaggacgtgacccaacaaatcagaatgaattgtttaaccttcgccatgcatctttaagaaacgttatcgagagaatttttggtatatttaaatctaggttcttgatttttaaatctgcaccaccgttttcttttaagacccaagcagagatagttctttcatgtgctgccttacataactttcttcgacaaaaatgtcggtcagatgaattttcaagtgacgaagaagatgaaacagatgttgacaatgcaaatcagaattctgaagaaaatggtggtgaagaaaatgttgaaacccaagagcaagaaagagagcatgcaagacattggcgagcgaccatagctgcagatatgtggagagatgctactaatattggtagccaaagatagtaattcactttttataaagttcatgtatttgtctttctttggtgttgatggagacacttttcccgtgtttgagctgaaagatttatttttgaaccctttacactttcttttattattattatgaacgagttcttgtcgtgaaatgatatatgacatgcttccgggctaatctcatcgacataattagaaactgagaagttggccatgggaaaatggtacaagacatacaaatacagaaatgacaatgatgtcagcatgacacttgaccataacgttttaaattatgttctactcatatcggtggtggaataattataccttgacctaagaagtatgggtttatatgtattcttttgtaaacgtttaatactattaattatgaacgagttattctacctctatcatctatgttacagctaagcttttggagttatactgtaaaacattgttcattattcaaatcatatcaattaaaataaaaagtacaggatcatatcaattagaatattactttgatcatcataatattctagttgctactaaagaatagaatcatattacttagaatatatattaccatgatcatcataataatatcacaatctttttgttatattaacgtatatctttacgatcgcactatctctataaatgtcacgtacatctctcttctcattctctaagcatacaagctcattcgactgcaaagaaaaaggttcacttgttcttacttttttcttttgttcttatttacagaatcatatgttggaagtgtgatattgattaacttttgaatagttaacttttgtttcccgtctcactatttccttgttttttgcattgacgtatggttattttttattaaaatattgcaactttttcatgttttaacgtatatttgtttttccaatttgtcataggtatcact

SEQ ID NO: 5585 - DNA, 3000 bp, Unknown
  misc_feature (1)..( 3000): cDNA_ID_2156256_gDNA_ID_1620804_Annot_ID_168759 3000 nt of promoter + ATG
aagcagcaaagaaagctgctgatgtggccaacgctaagggtgttctctcaggtaaaccagaggcgtctcgctgcattaacgctctctcgttattgatgaagatcaacattactccaaaaccaaaagaaccaaggagtatgatggataagcttgagggacttacaaaacataaagaccgcaagatttgccatgttgcatcagcccttcttcacctttggagacagaggatcagagaacaagaacgtaaaaagtctgttaccaaggcttcatcaaagaacatacaaagacgaggaaacttagtgatgtgaagatcatggcttgaacaaatcaaagtctcttgtggattcaaaaggttctgaaccattttattgagatcgaatataagtgtgaggaagagataaactcatttgtaagcatggttgagtgctgagcaagtatactggtgaatttctcgtatgttatgtagggttccacattggaacctgaatttgtaatcttttttgtgtctttacttttccctgctttgtttgttacacaagagactaacttagtgcaacaatattgtggcgaatcttaattctctaaaccaaattagagtagagatagttcaatagatgtaatgaataccaaatttattatcattgaaaaaactaaaatcacctcatttttttcactatgcaattgtttagcatgtgttgacaaaaaaaaaattgtttagcttgttcattaacaaaatagtcatattgttgtttacgttcactcgttatttatttgagtgtagtaagaattacacgatttccactatttgtccttaagttcaggtttacttgtccgaatttcttaaaccatatatcaaaaatatttacactatcgcatcaaaacagatacatgacatgcatgaaaatatatatgcaagtgagatgcgtactctttaaaaaattcaagttggggtatgatataaaactgtcaaatacatatgaaataataatcaatatattaaaaataagaatacataaccatatatatatatatataatttatttatattcaaattaactgtaatatcttcataattttttttatctcttactcgtcgcttttcactttccctttttaacatcacaacaaataatgtcgttcaccataatatctcctatataattttaacaacacgttttagtaccaaatttttatatgtatgtatattactaataacgtacagtttatttctgaaaattttcccaaaaaactatgtacgatgaactgtaaaagcatgtgttcaagataggtaactgttggaattgtatcctttgattgaacctgtaaaagagagaagaagcctcatgagatgaagaaggagaagagaagaagtcaagccaagaagaagagcaaaaggaagaagaagaagttgtcgtgaaacaaggtcaacgacaaagaggaaggaacaaagtcaagataatagtgttgggcttgtgttgttttgtaagaataagtgtttgggctaattgttttgttcggcccaaatgagtaagtgttttatgttagtcaaagtgtagcttagtgaaagactagagttgtgtaagagttgcttgtaagtttggttatagtcttagggtgatgatgcctagaagtatggtctaggtctaagtagaagcatggtgcaagtgtctgtactaagtagaagtaacttgtataagtatatgttgtgtgtcttgtaagaagtatctggtgatccaagtttattatcaatgtagtctttcaaaaagaaaaacgtgttcgtgtgtttgtctctaaacaagaacaaaacagagtgcaacaaagagagaaactaaagagatagagtgaaaacagagaatcataacaaaaactctatagaaaccgaaacccttgctcccaagggtgttgccattcaatagcttcacaatagatgcatcttatttctccgtacatgccgaagaaagtttgctaaaggccaaactattcaagaagccatcaaatgatcaatgtataccaatcttaaactatatccattttctaatagatttctaaaaaacaattttgcactaatttttcatataaatatcacataaaccaaatatttttcaaagatcagatctaatcttagtgctacaaactcttccatggacgagcgagatcatccctatcaagaccataaacccttctagtattctgatttagttagttttatatagtcgattgatatcttaacaaatatcctgtattttgatattttaataaaaaaattaaagtcgattaatgttttagaatgtatttcctttatcatttcgctaaaagctaaaaaattatcaaatatatttaatatatattttcatacaattactgaatttatgtagtttgggtcaaccaacgtttttaattataaatattagcataaatacaatatatattgtgattatgtgaattaaattaatcattttagaaaacaaaattttatataagaaaaaaattgttttctttttgttacgtgaatatcgtattattacatttttcacaaacaaaaaaaaacaaattgttttccggttgcgaacagattaaaggttttatatttttcaaacgaaaaataaaaaataaaaaaataatgtacttattttcatgaggtccacccaacaacagtcgtcacactagtcgcgttggacttgcatgcgcatattatactctatagtcaaacccacactaacctacgccgatattcttatccaccaccacctcttattagctcaaaaaaatttcactaacccatagtcattattgcttatactccgtattaaaaaatgttaaaccttttgatctgacgtttaaaagcaggtttctttctatttccagataaaaaaactttactcatcgagactcgtttagtgattcgaaatttcccttctcggctcaaatcttcgatctgggctttcgtgtctttttgcgttttgattggtaataaaaagaagctttttaaaaactttttcc

SEQ ID NO: 5586 - DNA, 3000 bp, Unknown
  misc_feature (1)..( 3000): cDNA_ID_2156278_gDNA_ID_1620804_Annot_ID_168765 3000 nt of promoter + ATG
acaagtttcacttattcatcagcccgatgaaagaaatcaaacttaatttgaattattttattttattataaaaatgatcaaattcagtttatggtgttatatttgtttatttacaaacaaggatttttttttttcattatgtaattactactttatttttctgggtaattagccccatttttatgatgtatatttacgagatgtaaaacttggcctacgtacatgtgtattttatctctaaaattgcaaatgtaatatttttcggacatatattaaagaagagattgatttctagtattgggtaactagggtaattaatgatgaacaataaacatgcgattaattaatctaaactgttaagtcctaatattgctgtttaatatgaagtagctagtatatttagaaaactatatatttcgaaaacgtgatatctcataaatttgatttaacattggataacatttgtggaccaccatgcatcatgcgtgctggtaagttgattcgacaaatttctgacgtttgtaagttgatggctaatattaattagattatgcattggaaccacatagatatttcaaaaacaaacatatttaggttcgattcatcactagtaatatattgttttgaccaaggactttactcatgccctgaagcgacaatctgtctatggtgttgcatgtttttgaaacgaaaatctgtctcacaaaccctgtggttaatatctcctctggctgaagaatatgaaaccttagattggaaaaccatctatgaatttttgtctttgaaggttttatcactaccgcatctattatctctatccgtgaatatactgagcttatcccggagtgtcaatttagacacatctctgccggacgttatcttcatcgactatccactgaagcatcttgacaccacttcaatctagcggccaaaactaggagttgtgatttccctgtttttgcttaagctttttcgaaccatagctaactgttccccgacacacatccagctagcttccgatctagaatttcattcttacctgacttcaagggtcctcgccatccaagcttccccgtcatggaaagaaccttggctctggttccatttgtcgtttgtgccggcgaatagtgagactaagtacctttagtaatcgtcacaaaatcttttgatagtgactagttctaaaatacctgaattgttcgtggaagtctctttgacacaccaagaactcgcttgtggcatgttgctagctagcttctgtctctgagattttatcataaaatttttatgggtctatcctcaatgcttttaacttatcctagctatcttatctttattgtaagaatgtgcttcaagtacttgtatcctttgtttctcctcttttgggtttgattgaatgaaatcaattatgttttgcacaaaaaaaaaagacaatttgacaaacacgtgaatgcaatttgattgagttaagattaattagtacaaaacataataattgaaacccatgtaagtttggttgattctatgtaaacaaccgtttttctcaaaaggtatatatttttttgtttttggcattcaaaagctatagtttgtttctaaagtaatcatttttagctgatcaaaaccaagtaaaccgattaattattgtgtgaatgatagttaggtgttgcatttgtgtgtaaatgaccttaatgtatagtagaacggaaggttgctgttacatgattatctaaccggttctcagatggaatcgaaagtagaaaattcatatggaaccgaagttatgcgattcaataaaaccatatcaaatgtacaatatatttacacggtaagtacattgcattagtaagtaggtatgaactcctgactccatgtatagtagaaaagggattgattacataaaatacattgactgcgtgaaatgtatgataagtgcttggtccttagtcctttgttgtgtataaggagcaatttatcgggttttcgatcataaaatgatatttttcattttctaatcataggctttttaaggttttttttttcatcctaagcacaagtgactttcaaattaatcttcatttttatgactaggagatgtaactattttctagagagtaaactctttcctacatgtatcgaacccgtgatctccaaaatctctacgttttcagtaatccatggatttaaccatttgaccaactcgaagttgatttatttttgttctgatgtataatataccaccttttgtattgatttcaaggtgaaacaaatttttttataagacaatttagtttgaaaaaaaaaagggagattaaaaaaaatacactatttatttttaataaaacttaaaaacatctgttaacatagaaacaaatcaacgcatagttttgtttttttaagatacaaatagttagagaacataaaataaaatttagatttaaggttagaaaaataaaaatcgaataaaatgcagcaaaagattatctataacatgtgataaaatggaataatatttaaaatagctgtactttaatttcttttctttcttttggtgcaaaactttaatttcttaaaccaataaaatttaactggataataatctgacccataatttccttaataaaacataaaaattaataaaaaaatctcacatacagttaagtacaatccaatcccttagatatattcccccccccccccaattgaagtaaaaatcaagtattaagagttaacaatcactaagcattccaataatatatttttcaatggaatggaattaccattgtgacataactttttgttttttgtcaaactgtgacataacataaaaccattaaagaaaacatgtgtccctcctttaataagaagcacattgtgacaaacagagcattctctctctctcacactctcctctgtctcgctacctctgtctctttctcgagcactcactgttttatttaccagaaattgtgttgtatcattacatgcatgcataaaatg

SEQ ID NO: 5587 - DNA, 3000 bp, Unknown
  misc_feature (1)..( 3000): cDNA_ID_2105391_gDNA_ID_1620804_Annot_ID_168774 3000 nt of promoter + ATG
ggtaaaggagcgttggagtgtgcgatttgtttgaatgagtttgaagacgatgaaacgctgcgtctgttgcctaaatgtgatcacgtgtttcatcctcattgtatcggcgcgtggcttcaaggtcacgtgacttgtccggtttgtcggactaatcttgctgaacagacgcctgaaccggaagtggtggtggaaaccgatcttgaggcgcagcagcaatcggcggttcctgtaccggtggtggaacttccacgtgttaaattcccgaggtcgcatacgacagggcattcggtggttttaccgggagagagtaccgaccggtttacgcttagagtaccggaagaattaaggaagaagataatggcgaattggaaattgaaccggtcgaatagtgtttttgttttaccgagaggaggaagctcgaggagtggtaaacaggttgaccggtcgagggctaaatcggaccggtggttgttccgtaaaactccgtcgtttctatggaggaaccgggatgatggttcgattaggctaggtggtaccggtagtgttagaggaaattcagtaacaagtccgagcggtgactcggtacgagcagaccggtgggcttttcttagaaacccatcgtttctctggaggaatacgacgccggttccttcgccgagagttgaagtcaataataaggacggtgaaggaacatcgtcagttcaacatatcggtacagttggttcaactagcggttcccttaggctaccggtttagtgttcggtgatgttttgtgcattgttcataaacacgcaatagattttacgtaattctttaattttgtttgtctttttctgtaagatatttaaatcgacaatccaacggaaaaaggagattgttttacttaatttattttatactcttcaaaagtcaaacaaagaacgaactggagattggtcttgttcttaaaaaaaaaaaaagtcttgttcgtcgaccaaagaatacatggaactggaagatagagactacaacattattttatagcggtaatggaatgtattatctagttctgaattcatgtgtttatttctcgatgaatacgatgaacgactaaaaaaagagaggaactatataacaaacaaatttgttaccaattaatgattgttttttttttggggaaatacaacgttttttttttctcaagtagtattgttgtcggaccaaaacaaaaatttgtactaatatatgaatcaagtagataagaacaatgtatcaaattaaaatttcagataacagtttccacagttaatcatttgagcgtcaaaaaaagtaatatcatttgaacattgaagcacgaggtactttactttcagagctgagactaaagatagttcgagaagatcttattttaatacttggaagttggaaatacggaaatgaaatcatatacattaaaatataaaacatagttacttcatcagatagaccacgactaagtcgtttcgatacggattggaagattacttgttcaacaatttgaatagttacgtagaaagttgccatcattcaaattttattctagaaacataaaaatgtaaaaattaccaaacacacaatatagccgttgttgtctacaatatgatgatggtaccattgtttatttgtttttatataactgcatacgagatgttggaaaatgtttacatatattttagttagttagtttaaataataataaaataatttgtactttttatttaatttactctattttttaataattttatgttttttgtttattttatgtgacattcgatctacgtccgtaatcagattgagaatacaagaacgtctcatacctcagaaaaaatttatagttctgcattttgctttttttttgcgagagtcggcggcatctctgtcacactgaacagtaaagagaaaaatatatttaggatttattttaatcgtgtatttatactgtgttttttgggctgggtcttaaacaaatctgcccaaaaaatatatatatatatatattttattttatctcttgtgaaaatatgtaaacaatttattctttttgtgctgaatgattaataagtgaatgcaaggttccaagtttaagaaaatatatactcgatttgatccgacgaaatcatatggaattgcgagcaatacatttatcaaggttttaaaaattgagatttcaaaataacgcttttgttattataacgacaaacaaaataaaccatatttcttatagaaaaaaaatagttcgttctaaatttgtacatgactcaatatcttattttttaaatcccatatagtatcaaaaagtattaaattattaatgcacacaaagtcacaatcaatgatttatattaaataaaattgcattgactaactatttggaataaatcatggattatgtatactgtatagtatataattcgtatgcacacaatccatgatttatgttttaaaagacatatgaacacaatccatatctctgtgtacaatctaacttttcgaaataaatctaaacaaaaattgaatagtttataatttcaaagtttgcaattcaaatccaacataaaataatattaatcaaaataattaagtagaaacaattttgattggttttatgcttagttttactaactttgccattacgaccaacaatttttcactaacaatcggtttggtgacagaaccgattaataactttgccattacggccaacaatttttcactaacaatcggtttggagacagaaccgatcaataattttctaaaccgtactattgtaaaccggaatgttggtttatatgattaagatcacattggtataactctacgtgtctcgtccaatcacatttcacagcgtcaaggaaataaatattagataattaataaattttaataagaggaaaaaaaaacattcatcttcttcttcttcgtcggagtcggagcagagaaaggttttggagatcgagaccaaactccgattgaaagagg

SEQ ID NO: 5588 - DNA, 3000 bp, Unknown
  misc_feature (1)..( 3000): cDNA_ID_2156350_gDNA_ID_1620804_Annot_ID_168788 3000 nt of promoter + ATG
aagacaagcttatatttcagctaagcacgttatcgcaagcttgagacagtagtaaataaatatgaatggggtttgaaatgaaaatggtacctgaattgctggattcgaggtcaataaaagagaaatcccaaggccatcaaatgcatttccccatgaaccatctgttagtgtcttccacaaccctttagattttccaaactcgcttgtttgcatcctcgatgaagctgtatctagaggctacaaaaacatacaacttaaagttaagcaaagcatatagttttgaagcagagctgagtgcaaaaaaacaaaaaaaacgtacttgagtcaaaacagaggtacaagcaccagcagcagcagcaatgaggagattagcctttgttccaatagacttagaaccaatcctttgggaatgtaacctcttgaaatagctataactatagaaatagatgaaggacgaaataaaagactgcaaattcttagtcccaaggccttgatacaaggagagaacatttcctgatgaaattgcttcccaaaacacatctgacagatatctgtaaacatcacaaaaacagctttaggtacctcaatattatctaatgacaatcacatatgaaccattataatacctaaaaaccttaaccaaaaatagtgattcaaaagcttaagctcattgagaagccttgatcagagaactgaaattttcgatttagacgaggatctacaagggatcaacatagaaatcataaacctaatccaaaaactgaaagttaaaaccgatttcaacaattcagcaggaacacagctaaaattgaagcgtgatgcagagacataaagaagcaattctcaaattctagatcatcatcatcgcgtcgcaatcaaatggaaaaagggaagaaggagagaaacctgtatttctgctgaccgcgaacacgaatctcggcttggaacttggatttacaggtatcaagagggtataaaatggtggtgctgagaagagatccaatggctccggaggtggcttcggagatggattccaaatccaaatcaacacccatatcttcttcttcttcttcttcttcgaagagagaaatgataattgatggtatgggcgatcacaagagaatgattttcgtcttgggattttaaacaaaaagccgtgtaagattgttttttgtgatggtgacgtcatccttttcaatttttcctttttttggtttagtcggtcaaatcatagaatgtaaacgataatatcaaagtcgggccacgtggttttcatgtttaaaaccggcctctacccaatattatttcgaattagggctaggcaaaaatgccgaattcgaatcttaatcgaaacactaccaaagaaggttgattagaaaattccccaaaaaaatatccaaatgaatcttagagttaggtattttgggtatcggataatatataattcgaatcgaaactcgaactagttagtatccgaaaaaaattaaaattaagtaaagtcatcaatccatattatatagttttgagtaattcatatattttcgagtaatttgagtgattaaattagttactttccaatattttagataatttgtttatttgttttttctaccgagttttatttatagaatttggacattttcaaatacttttcaatattttttcttgtaattttgaatacggatcgaatccagataaaagttaatctaaatagtaaaatctgatcgaaaacgaactatgaaaaactgaaccgtatccattccagcccaaatattacaaatatcctaacatgaaatatgagcctaaaaatccaaaaaaattgaaaaacccaaactgaaccctaacgtctaaccataatttaaatgatgtaaacgggtcagacggtatgatcaaacaaacaaaaaaatcaagtagttttaaaagtaaattatgaatattatacagaaaatatgaattaaaggataatacagtatataatatatgttgaaatagacaggtaaaaaaaatataatgaatgatgcgaaacaaattgatagtaaaaacatattaaaaatggttaaaaacataaatgttgtagctgaaatattttactgcataatatgattataagttaaaatcaatacaaattttagacgaaaaaataaatacacggactgtacatgaaaagtataacaacgacaaaactggtgtatcacacacccatgcggttcacgttcaccaagttttactatgtaaactgaaccatttttttcttttttctttttctacttttttttttaatcataaagcgcaatgttgtaagaataatcatgaatggaagacatggttacaatccaaaagaacggtgatatacccgcattcgtccgcgttaccactcaatggcatggtctcatgtcatttcctgtattataatgacattgtcactagctaggtgatattttgttgtataattttatgaaactaaatcataatcttgtaataaataaaacatattgctatagcgatgttgtatggaacatgttttttttgtttaacgtcactgtattcaacacttaataagagggagatgtctacttcaatgtattcaacaactagaaaagactttagtatgcatgattcaataaacgtaaatgcacatttttgtgcctaaattaaagtcattgattaaaaaaactagaatcatttgctttaattgtgcctaaatcatttgcgttacgttcattgatttaaaaaaactagaaaaagagactttaattgtgcctaaatcatttgcttcctaaattagatactcccgattgctgcctatatagtatatggacaggaggaagaatttttaccaaaaaaaaggactaggaatggagaaagaataatcatatgattcgatgaacgtaaatgcacatttttgtgtatatatatacatgatggaaacacatacatagagagacctaaactacctaatacctatacattcaatatattttcatcatctttatctacaca

SEQ ID NO: 5589 - DNA, 17 bp, Unknown
  misc_feature (1)..( 17): cDNA_ID_2156354_gDNA_ID_1620804_Annot_ID_168789 3000 nt of promoter + ATG
ttcggatccggattatg

SEQ ID NO: 5590 - DNA, 3000 bp, Unknown
  misc_feature (1)..( 3000): cDNA_ID_2156314_gDNA_ID_1620804_Annot_ID_168778 3000 nt of promoter + ATG
tggcctcggttcatcagcagctttatgtgtagctctcacagctgctctccttgcttcttctatttcagagaaaacccgtggtaacggttggtcatctctcgatgaaaccaatcttgagttgctaaataaatgggctttcgaaggcgaaaagatcatccatgggaaaccttctgggatagacaacaccgtcagtgcatacggtttgttctaactgtaaaactccaaattctcggatcaaagtttcaataatatgttagagaaaaccgtttctgtttcgtggtggttgcaggcaacatgatcaagttctgctcaggcgagataactcggttacaatccaacatgcctctgagaatgctaattaccaacactagagttgggcgaaacacaaaagctctggtctctggtgtgtcacagagagcggtaagacatcctgatgcgatgaagtcagtgttcaacgccgtggattctataagcaaagagctcgctgcgatcattcagtctaaagacgagacctcagttacagaaaaagaagagagaataaaagaactcatggagatgaaccaaggtctgctcctgtcaatgggggttagccacagctcaatcgaggctgtgattctaaccacggtcaagcacaagcttgtctccaaacttacaggagctggtggcggcggctgcgtcctcactctattaccaaccggtaaactttgtcaggaactttcaatcatcctttttgtcaatttcggttctttattcttaaattaacccctctctgcaaaacaaactcgtttcagggacggtggtggacaaagtggtggaggagctcgagtccagcggttttcagtgtttcacggcattgattggtggtaacggagctcagatttgctattgatcaggtcggaaaaatcatatttggcctctcaccattcttaaacttgctgacgtgtacgtcaagaaggctgcaattagaaattcaaagagtcgattttttcttataaatgatgtgttgaatgtaaaattgctttattattataccatgtgacaaataattgaaaaaagcaaagattgtttagtttttttttttgtattttgaaattgttatgtttcatgatgggaaatataaaatgacaaagtttttacttagattgtcacattgatcacattatttcctcgtatattcatagtttgtccaacttcatcatttcatagatatcataagctggtcttttggcatgttcatgcattctaagtaacaatctgtataatggtaagcttgcaagaccaagacgatgcaaatctctaacatatgcagttgcttcttcaattttctcctctttctcaaagtactcggcaatcgccatgacgatgttatgggatggcctccaatgacaccgcctcattagtacaaacacttggtgcatagcatcaatggctttctccatattctcacatttcacccatccctccattaagatttcccaggtcttgtagtttggagtacctcctctctccaacacacaaccatgcaatgactcggctttccggatttctccattacgcacataagcacccaaaagaacattggagaccctaacatcatagttaaaacattgagcctcccactcactaaacaccctttcagcctcttcaagatcaccagttttcaccaaagacgacaatacacatatgtagttcacacaactaatcctaccacaaaccgatttagaaacttcccacaaacgaacaactccttccttattccctaaagacgcataaagcgtgataagaaagaaatatccaagcctattacttctattcaacatcttttccgcatcctcaagcaccaacctagccttctcatcaaaaccactcttaatataaacattagctaaagtacacaacgaactccacccaacttcaacactcttatcaccaaccatttccttataaaccgtttccacagccgcaactccagacacttcacaacatgcattcatccaaagattatacgaaagaacgtttcttggtatcttattccctttcatcatcgaaacaaccataactactttctcatactgaccactagcttcataaagcttcatcatttcgttaaacgggtgtggagtaacaagaaaccctaatccattcaacttctccattagagcttccgcttctttaaccattttattcttcacataagcacgaagaagcggaagataagccgatttcgctactctcatagacacagaactatgtagcagcttctcaaaatactcctctccttgtttcaagccatgagttttgatgatcaaatccaatctaagagcaatgtcataaacactaaattcaatatctttttgattctccatccactccatcatctgtatatacacacattactggcaaaatcaaaatcaaaagcttagttctcagttttaattaagggaaaaatttcaaacctggagagcgagatcgtaacgatttgatctaatgagacgcttggaaatcaatcggagctccgataaagagacggcatgacccgaatcgatccgttcctgaagcagagaggtaacgctgcgtcgtggaccgttctttctcagtatctccttcaagctattccgatttgcgactgatgacgtgtccgaaccatctgcaagtgaagacacgagccttgatactacgccggtggtgttgaacctcgtcttcgcaaccgcaacgcaacgaatcagcatttggattttggagccgccgcgaaactggttcggtctttctcgagaatctcagagaagagacggtgagagtggatttgggccgtattaaattaagttgggcttacccggcccatatcaatagttataagcccgtttaaagaaccgacgtcgtatggtcaaaaacctgaaacattagcttccttcttcttcctcaccttcaagcgccgacttcgttttcttcgaatccaaatttctgtgtctgcttttgattcacagagaaggagcaggaaag

SEQ ID NO: 5591 - DNA, 3000 bp, Unknown
  misc_feature (1)..( 3000): cDNA_ID_2156274_gDNA_ID_1620804_Annot_ID_168764 3000 nt of promoter + ATG
tattatttttaaattgatatcttcttaattttttaaaacatgagacaagtagaactctagtctggtgaaaagctcacaagtaaaacatgaaaggagtgtcttaattcaactttgttttgtcggcagtacacatcacaatgtcatatagataggttgtagacggactattttctgaattgaactgggtcgtgtttgtagactatttttttttttttttaattctatcgactgatccggtgagtttcaataaaagcacactgaaatagttcagagagaacgttttttcgaaagaccaccacattatatgtcctaaattttaaatgttttctaactaataacagggttaatcagactacatgtatttatgattattagataaatcaattgagccaaaacttaactaatagattttccaaacaaattttccaaacaaatgtgacagattatttattttacaaaaaaattgttttacattaaaactttaaataatttctacaccgaagaattgaatttgcagcacaacataagaaatcatgaatgatggtatggcatgcatatgttaatcctaacaaaattcatgattccctatccacgcaagctagcttgcttgtccaaattagatttgttcaactgcataaacaaattgtcaatttccaaagaggcaccaaaagtcaaaccataaataggtagtttggacaattattggggatataatggattagatcgtagattcaggagaatttaaggcaagtaagttggttctctatctaatgttccaagggtcttatctatgtacttcgtttcgatgattaattgatgtagttagtagtttcaaattccaaacgactatttgtatgtacaattacatatggattaattgtcagataacatgttgaattctaacatgtttctgtctatccgattttagattaaagttgtttatacaaaattttagacaacacttaaattagtactatcgttagttatatagttccattaatcatttctccttctgtatggtttatttggacagatatgtcattaagcgtttaaaaatatttgtagatttgataatttgtcaaaaatagcatttattgatattatagttgatccgtacgcgttacgaattctttagttgacctttctttttttataatctcctaatatttaaaattcagcagcagactgatgaataaaattaaatacttggttccatttctagatggtaacaggtacaaatatagatcctcacgtaagaataataacaacggaggacaaaaacgttaaattatgattaattaaacatttaattaaaagtattagcaaactcaatcaaagaatgactaaaaggttctaataacttgtgaggtatttaaacaagttaatgtaaaaaaagaaacaaaaaggttgaaacgtacggttttcatccaatgattatgaatgactataaatgattgttttttctacatcaaatatggagttccatcgtcatccaattttcttttggttacgagtgaaaacttcttaaaacacccgaatataggatctgattgataaccaaaagttgtacaagttttttagctgttaactttatcgaaatagtgcaaaactgttaaaagagctgtataaaaaaactgtacaaaaaatctaagaagaaaactttttgtaacgtttttgataaagtttttgtgattgataactatcaatactgtacaaagctgtattgtgttaccattcaaacttataatgttatagtcttggagagatattttttttactcaaagatatgaatttaagttaaaatattccataatccaaaccagcaatatatacacattaatataatttaaattgcatggaattcaaaataatacttatcgtgaatccatctagatacgttgagataagggaccaatcaacaagagaagacgtcacttttacaagttgagaataatctttcagagagaaaaaaagagtaactgtcgatttttgttgatccaaggtaacgtatatgtcctgactcagattattgcttccaattatatgtgaaaagagctttctccacattgacatataactaggatcattcgctatagacgattaatcgttgtttataatttgttataaaaaaaactttggtattttaaagaatatgtcaatatttttttcatactacagtatttttaattcgtcaaactatttaagaatacgctcatgacaaatgatcatataataataatttaaatagtacttgtatttattttttcaagaagaaaacttagttgaatgaaatttgacttaaaatgatataaagggtttgaatggtaaccattttaataacaatacagttttgtaccgttttgacagttaccaatcacaatttttttatcaaaaacgttacaaaaagtgttttactctcagctttttttatacagttccttttaacagctttgtactattccgataaagctaacaaataaaaattttgtacagcttttggttaccaataaaacccaaagtcttacaaaaaaggtcttacgcgtccacgttagctttccaatccaacccttaattagaagtcttcaccatttgctggttaaaggatattttttcaaagtgtttagcattttgtatacgtcaaactattttagaatccagatgatgaatgatcatatactaatacttagctgtatttttataatttaaaacaacaaaacttggtttaatgaaatttgacttgatcttgtttaaaaaaacgtctcacgtccacacgttagcttttccaatccaaaacccctaaagagtagaaaaccaaaataaccatttttaattcccagcctctttttatacgtagtctaaattgacaaacacatcattcgctctctttctcttctttctctagctctcttggttttttgctaaaaacagagcattttctctctagctctcactgtttctttaccataagtttcgtcatattagtacatgcaagtgtaaggg

SEQ ID NO: 5592 - DNA, 3000 bp, Unknown
  misc_feature (1)..( 3000): cDNA_ID_3077774_gDNA_ID_1620804_Annot_ID_168763 3000 nt of promoter + ATG
aatctacaaatatttttaaacgcttaatgacatatctgtccaaataaaccatacagaaggagaaatgattaatggaactatataactaacgatagtactaatttaagtgttgtctaaaattttgtataaacaactttaatctaaaatcggatagacagaaacatgttagaattcaacatgttatctgacaattaatccatatgtaattgtacatacaaatagtcgtttggaatttgaaactactaactacatcaattaatcatcgaaacgaagtacatagataagacccttggaacattagatagagaaccaacttacttgccttaaattctcctgaatctacgatctaatccattatatccccaataattgtccaaactacctatttatggtttgacttttggtgcctctttggaaattgacaatttgtttatgcagttgaacaaatctaatttggacaagcaagctagcttgcgtggatagggaatcatgaattttgttaggattaacatatgcatgccataccatcattcatgatttcttatgttgtgctgcaaattcaattcttcggtgtagaaattatttaaagttttaatgtaaaacaatttttttgtaaaataaataatctgtcacatttgtttggaaaatttgtttggaaaatctattagttaagttttggctcaattgatttatctaataatcataaatacatgtagtctgattaaccctgttattagttagaaaacatttaaaatttaggacatataatgtggtggtctttcgaaaaaacgttctctctgaactatttcagtgtgcttttattgaaactcaccggatcagtcgatagaattaaaaaaaaaaaaaaatagtctacaaacacgacccagttcaattcagaaaatagtccgtctacaacctatctatatgacattgtgatgtgtactgccgacaaaacaaagttgaattaagacactcctttcatgttttacttgtgagcttttcaccagactagagttctacttgtctcatgttttaaaaaattaagaagatatcaatttaaaaataatatgattgccattttggatttctaaatcaattaaaatattgtgtctaaatttgttaaaaggataattttatggcgaatatttggatattattagttttgttgactaacgatttaactagtagtaaaaacagaaaataaaagattagattcatgttaatacaaatgaatcggtacgctaaattacctattagaaagctaagatattttagcagaaaggaaaacgatattccctctgttattaaatgattgattatatagagaaaaaaaattgtttctaaaagattgattttttaagttttctttgtaatatttattggttagtattggtgaattgtaattttcaagaaaaatagttaattatcattggtttagagttatagaaaactgtaatacacaaaaagtaatatatttataaccaatatttaatatgttttttaatatgtgtgtttaaaaaaaaaatcaagtttaaagaacaaaggaaatatgagataattaattaaattttttgtttttttatttgaaaataaaatattaaatttatagtatacatataaataaatcaccatgacaaaatggtagatgcgtgtaattaagtgagtcacgtaaattaagagggctagcactcccggccccgggcactctccgacccacgttttggtccccacgttaatcatcaaaacacattttgttttggtatcaattaatcatttaagtttccccacaatagaaatcattttggtgcattctctatgcaaatttatggatcgaaatcgaagttaaaattaagactgtttaatggggaaaagaaaagaagttttaagactagctagttactactaactagggaagtttttaactatcatatgattttttgttgcggaagtggataaatatgacccactaaaaatcaaaacttattagtcaactagtaaccgctagatagttctaatgtttacactatcactgaccttcagattcattgaatctagacaggagaaagatccagcgtaaattattggcaaaagcgatgagaaatatcaaaaatgacattgattcacacgaatttaattataaacaaatcaatggatttgatgttcttccatttaagacgataattacggctaaacctgtagtgttttttttattcaagtaattttgtagtgatttatcaaaacttaaattattgttgtataataatagttaaaatttaggttccgaatagagacaaaatctaaatcgtaaatcgcacaatacggtccggttcattatcatgtgaatcacaccgtactttattcgtagttgaacgacgcatttttattcggaacgataagactttagtgtttgattagagtaatactgtataccaacattatattatgggctgtctgcctctgtcaccctgaaatatatcagttcaactacattccccccatactttcactctctacctatttccccctatacaaactatattcttcataattccacccaatcttacacaattccacccaattcaccaaaatcaattaatctctctgaatgcgttttaaaattaataattgcgttttaactttgataatctgctattaaaccattgacccaaccaaaatctcataacccaaaacaaaccttctgtttggtaaggaaggttcgatttataccttaaaccaaaagggggaaaattctgaattaggttttctatttcttcttatgcccaaaaaaaataaaaaataaaaatctattctatttcttcttcttctccatcgacactctctccttcttcttcttctacttcttcttcttcatcttcttcttaattagtttctccggcgttaattggagtggttggtcgttggatcatcatctctggagaatctaaagcgtgaatctgaagcgtggttgggttgaaatcacacattacccacacaaagatg

SEQ ID NO: 5593 - DNA, 3000 bp, Unknown
  misc_feature (1)..( 3000): cDNA_ID_2156241_gDNA_ID_1620804_Annot_ID_168754 3000 nt of promoter + ATG
gctgcttgtaactttgatcttgagttcatatatgttctaagtggatgggaaggttcggctcacgattcaaaagttctacaagatgctttaacaagaagaactaatagattgcaagttccagaaggtaatagattacaagttctaaaaggtgatttatcatatgataatttatttctaatagtgtgcttccatgtttcaggaaaatattatttagcagattgtgggtttccaaaccgacgtaatttcttagctccactacgaagtactcgttatcatctacaagattttcgtggtgaaggacgtgacccaacaaatcagaatgaattgtttaaccttcgccatgcatctttaagaaacgttatcgagagaatttttggtatatttaaatctaggttcttgatttttaaatctgcaccaccgttttcttttaagacccaagcagagatagttctttcatgtgctgccttacataactttcttcgacaaaaatgtcggtcagatgaattttcaagtgacgaagaagatgaaacagatgttgacaatgcaaatcagaattctgaagaaaatggtggtgaagaaaatgttgaaacccaagagcaagaaagagagcatgcaagacattggcgagcgaccatagctgcagatatgtggagagatgctactaatattggtagccaaagatagtaattcactttttataaagttcatgtatttgtctttctttggtgttgatggagacacttttcccgtgtttgagctgaaagatttatttttgaaccctttacactttcttttattattattatgaacgagttcttgtcgtgaaatgatatatgacatgcttccgggctaatctcatcgacataattagaaactgagaagttggccatgggaaaatggtacaagacatacaaatacagaaatgacaatgatgtcagcatgacacttgaccataacgttttaaattatgttctactcatatcggtggtggaataattataccttgacctaagaagtatgggtttatatgtattcttttgtaaacgtttaatactattaattatgaacgagttattctacctctatcatctatgttacagctaagcttttggagttatactgtaaaacattgttcattattcaaatcatatcaattaaaataaaaagtacaggatcatatcaattagaatattactttgatcatcataatattctagttgctactaaagaatagaatcatattacttagaatatatattaccatgatcatcataataatatcacaatctttttgttatattaacgtatatctttacgatcgcactatctctataaatgtcacgtacatctctcttctcattctctaagcatacaagctcattcgactgcaaagaaaaaggttcacttgttcttacttttttcttttgttcttatttacagaatcatatgttggaagtgtgatattgattaacttttgaatagttaacttttgtttcccgtctcactatttccttgttttttgcattgacgtatggttattttttattaaaatattgcaactttttcatgttttaacgtatatttgtttttccaatttgtcataggtatcactatgggagattcacaacccaaaaaaagaaaaaagggggattataatccgtggtctccagaggagactaagctgttggtgcaacttcttgtggaagggatcaacaataattggcgtgattctaatggcacaatcagtaaattaaccgtggaaacgaagtttatgccggagatcaacaaagagttttgtcgttcaaaaaactacaatcactacttaagcagaatgaagtatttaaaaatacaataccaaagttgtcttgatcttcagcgttttagttctggttttggttgggatcctttaacaaaaagatttacggcttctgatgaagtttggagcgactatctaaaagtaagtatcacattttcttttttaagtgaacatggtcgtacttacatattattaatatgtccctttgtttttgtaggcacatccgaacaataaacaacttcgttatgatacatttgaattttttgacgagttgcaaatcatatttggggaaggtgttgctactggaaaaaatgcaattggattatgtgatagtacggatggacttacgtacagagctggagagaatccaagaaaagaatatgtggatgattttgacaacgtgtatgagtatgatactacaactcatcatgagtcatcggagcactacgcaccatttatgtctcatggaacttcagaaagtcctaagcttcccccacgtaaaagaacaagatctgagagaagtacttcacaaaaagaagaaagtcctatgatggttgttagcagtaaaattttggatataatacaacaaagagaagagaggcaacaaaatgaagtggcacagaaaaagaataacgtttgggatgctataaaagaaatttctgacttggatgaatgtattcgttacaaggcacttacgaaaatttatcatttgggaatacaagacgttttcgtgagcatgtcggtggaagagaggctaggatggattcaaaccattatggaataatttgagcttaatttttattttctttgtttttaaagtttttaatttggattcaccaaaattattatgaataaattctttatcttattcccaaacttcaaaactctagaaaacttgaaataaaaaaataaaaaactggtcaaagttttgttagatttcgattagattataaaatcatttgttatagagttcatatctattagaaaaccaaatgacatcatatatcactgaaaatagacttccacgacagaatgaatagtgattcagtttaaatgaactcagatgttttaaaatctgataaacttcaactctaatggagttgacttcaacttcactaaccaataacaccacctaaacttataaaattcagaaaaataatcataaaccggaaacaaagctaatt

SEQ ID NO: 5594 - DNA, 3000 bp, Unknown
  misc_feature (1)..( 3000): cDNA_ID_3077764_gDNA_ID_1620804_Annot_ID_168772 3000 nt of promoter + ATG
tcaccaatgtgagagaatcaaaaccataggaagcaatatatttatatcagtgacattagaaaccaaaccaaatctgacaaaaagttcatgaggatgagacacttcacacaccgttttctgtagctgaggtggagccttaacttgcgttgtagcagaccttttttcattcataaacggcaaaaactctgcaatctgataaacaacaccaaatcatgtatatatgattcaaaccaaagatcaatgatttcaacacctaatgatgaatctgatgattattaccattgtagatcgaagcaaatgtgtattgacgctgtggccttcatataaacgtgaatacgcactttttccatgagcttcaggaactggaaatgtaaactaaattactccaaaagcatcacttcacagtcacattcaatggagaaattgagaaaaattaccgtgacaaagagaagaatgatagcttctccaacaaccaaatctgaaatcatctccaatttgaatcaaagagaactcatttccattcctaaatctgaagaaaccaatgatgaagaaagctaaaaattgaatctttttggtaacagaaacgattcagagttcaatttcacgtattttcctaaaacgcaatcaaagttaggaaatttgcttacggaagagaagaagattctcttgatccagctgttttcaataaagaacgaactgtttgaaatcttctcacgagcgacattttttatctgggtgaagaaatctcaaagaaaaaccctaactttcattgatctcaaattccatcgaaggatttttgtctgtgctgattcgactgttcaatcggaagggtttaaggcggaagagattggctacatcgcggagcactgtatctccgtgtgccttctcttctagactgaaaacgtggacacacgtttcggaaacgcaaacgcaggtttttttcacaattgggctaaaacatgagcaaggtttcaactttcaacaacacaaccgcagaaaatcacagattttgagcccaaaacgcataatcagtaaaaacacgttctaggactttcgcggtacaaagaatcttgatttgttatctcattatacagaacatcaatgaacatattacatcaaccaaaaataaacagataaacgaaaatggaatgacaaatgtgtctcaaaacaatatctggttatcgcatttggccagtttgttcttagtcccacattttcgagtcgactagagagcgattttcgagttttctgttagaagaagctgccttttgactatagaatagtgaaagaaatggcagcagatcggagcttcaactcatcgtctttccatttggattccggtgcagctgctccagcgatataaaccttttcaagattaagaaagagacgcagagtgagtaatgaatctcgaaatatgaatgtcgaggagtaatcaaatgtgtgttttgcagcagagaccttccctctgttcacagaggctactagagctatgcgttcttcatctctaccaaactcgtagaagtagtaatttctgcagatataaataacaagaatttcaaacagatgagtcctttggaaattctcctatcaagaacattgattcccgaaccgatgggagtatagtttgaagctacttgccttaaaccttcttcttcctttaccttgattgtacgagcagagtaaattgttgccgcacctgctcatgcataaagaatatcaaagacaagattctaagcaattttctaatatgtatatgatttagcgaacctggaacaaaaagtcttgcagctgccttcaatgatcccaaatcagatatatctttagcctatttgaatcagagatcattcgatgagcttagtgaacaaggcaaactgatgactgcggaaaatgtaaacttgtaaaggaaatgactttgcagtgcaaacctctaagaaagtgatcttaagttgatttgaaggacgaatgactacactcaaaacttctgatctgcatacacaaatgatttatcacacaagttatcctaatggaaatccaaagggattataaaggaagaggaacaaacaatacccatcaggagtttggaaccgggcggcgaaagtttgtggctttgccttgtcaccatagagagacaatcccgcagagtaatcctagaggatgaggtaacacataatgtcaagaacaatgatcatttcatcccaaaaaaggaagtagcaccagttttcaattcaagcttaagattctactgatcttgaaacacagaacacaatgtaacagtaactcttaaacctcaaaatcaaattgactagaacaacaaccattgattcagacctaacttggcagctaaatacattgatcactaaaaagtctacaactttaaccaaaggagcagtctttgcatcgctatatcactcattgattcgtattcataagagattggtcacagagtttacacacctcaggctcattgacgtcttcaaagtcaggaggaaccctaatagcgaacccactaccaaagtactggaaccaagacttagtgttcgcaatgccgagtcgtaacggtttggtagacttcaaaggatcagctaatgactctggaatttggttttgaaagatgaaggagacgaaacagagtgatgctgttctaagcaccacatctctccgaaaggtagcagaagaagagagaattttgggtttataagggttttgaggtttagggtttggtggatgaagagagagggagtgaagtagaatggccatgagaagaggaagaagaagaagaagaagaagatagaagaaggcttcattgcttcgaatggataagaagtggggagattctctgaagtgtttagaagacaaatgatggtgcaaggcgaagggtacaatagaaatttcgttttttttgaagggttatttggtccttttgtatataggcccattaggcccaaagtttgcatgcttttgatgtggctagtgatcctcggagcttgacacggtgaagtc

SEQ ID NO: 5595 - DNA, 3000 bp, Unknown
  misc_feature (1)..( 3000): cDNA_ID_2156150_gDNA_ID_1620805_Annot_ID_168814 3000 nt of promoter + ATG
atttgagatcggaagaaacctggagatggagagggtcctctttctggctcatttgggatatctccatccatcataccgacaatagaaaaatttggcatagattccgagcaccaaaggttgaaatccatatctgcaaaagagggaaagatggaaaataagacaaggttagagcaataatttataggagcaacgtatccctcaaaatccatttttttccatcctagaatggagcgattcgagggagaatttatgttgtccagctaatcatgcctttaaatttgtaatcgagaatataccaaattaaaaggtagtaaaagttttccataaataaaaatgggttgaagcccgttacgagttcaaccgaagtaaaagcgagttaaaataaaaaacattagttcggggacatttttggaagaggctcaggaacagactccttcatcgctggttcagcattcgaagtggacgtttcgttcttatcatccaacttgggcttggttttgacgtgtttccaggtgttgctgtcttctccttcatcatcatcttcgctttcagaagggatcacttcacccgacgcagacgcaggtcctgaacttgacttcaactgcggaggtacatccgaagcatggtcgggatcttggctacagaatcgaagttcctccactcccattgaaagggatcgctttccagagccctcacattcctttccacacaagcgatgcgcgcctcaagcatctgcctcttaagacccgagcgctgcctctcatcgcacatgcggtggtgtttatcgataacctaacatggaaaacatgtgaaaatagggagagagtaaaagagtcttcaaagagagcggttaccgaccttatccacgaaatcttacgcctctttcttatccttcagaggaaagtggaaggcaacatgtgggaacaaaacaccggacaattcaaaaccgtcgcaggacaggaacaattggctgaccagctcgagagggcaaattgtggacgcgccttctctctccatctttgaagtatcatagagggaaatttcagaaataatgtttggagggagttaagttgactagagtttcttatttataggggcttagggttaccttggaaccagaagctcaataatggtggcgtgtcagaatggattaaaccatttttagaaatcgagaaagtaaaattattgccttaatggcgtgtagtttttactattttcgaaaaacaaaaaagaaaaagcaatcgtcacattaaagataatggcccattaatgtcgaataaaacaatcaaggtctaggcccttacatttaccgaattgactaagtggggaactcgtgttaagtcgagctcagttctcgcattttatgaggaaggtctaatcaacctaaattctcaaagcctaaccacaaggtcaatttctaagagtgtggactttgcaaacccgcataacaactgagaaaccctctatggaataaaaattgaaaggtttaaaagcctcctcaagcaaacagcttgttcaagaaattgagcctccataggcaaaaactaacttttcaagaaatttaaaataggcttttaaaatatttgggacatgccccagtttaaagtggtcacagccactacgaatcagttgccatctcgaattctttcagctacgaaaggatctttaatgagcttttgttcggctgaaggttcatgagcggtttctaaaacattctcatcattcaagaccatcaccggatcgttgttcacaatcaaaggcacctttggttggatagagttgtatttgatggttgggatcagtgtgataggcaccccggcctaagaagaaatattcaaatcaattaagagcgtaaaatacacaaataataagtcttgaaagtagaaaaactcacaacccaatcaagtcccgtttcacctaatgggggtgactcggtgaaaaattcttcgtaaagttgaggatcaaagggtgaagcagggaaagccgcaagacgttcttttttgtctttcaaagtggcattcagcttggatctctcttgctcctcaagaaaatcgtcatcatgagtctaatccaactagagtaggttgctcttatactccttgatgtccgattcgagctgcgattgagccttctcagtttgaataaagcggatggccccctcgatcagctccattccgtgatctttaacctcttttctagccttcgaggctgactttgccaattcggaatcccttagcctgacaagcgccttgtatttgaagtcgagctcgacgagttggttgttcgaagcatcgacagccaattcggattaacagagtctgtcttgaacacccaatagttcattctaaaggctgtcatatccaccatactaggcttgcacttcctcaattcgacaccacctaggtgtcgctcgacaccaaagaggatatagagctgcaactattgcaaatggacgtgctattcaacttgatgactacaacacgccagatatgttctatgctagtcattccagctattctactcaccaagcccaccctccacccacttctacgagtatgatggaatacatgctataatagattctcaagagccaagtgatgacgaatgaaaggattgatggtctgtatgatgatatacaagacttgaatgctcgattcaacaaagaggatgttattgtagttcagtcaaggagtgaaattcagcaccagacctctgagaaaccccacacgactgcttgcgacacttatttacataaccactcaacaccaagtctcagtgttgaccaacacgaccttggtgtcaatcgacactcatcaggaacagaccatgattcaacgtttgaaggagcgaaatcgagcaagctcaacaccaaagcgtcaacaacagatgatagtgtcaatgaacaatggattgatgttgagatagctatgttcatggtacaagcaagcaaccacaagacgcagctgacgaagcagttgatgggaatcatctgcagcaatg

SEQ ID NO: 5596 - DNA, 3000 bp, Unknown
  misc_feature (1)..( 3000): cDNA_ID_2156203_gDNA_ID_1620805_Annot_ID_168828 3000 nt of promoter + ATG
gggctagcctatgatgatccagtggatgaatccacggacccttgggtgtgataaggatatagttcggatcgtatggatggatcaataagccgaaagctttatcgaccaccatagaccagacgaataaacagttagtaaaccgtaggcggtcgtagtaaatgaccggatcggaaacatggattgttcgataagccaagggctcaatcgtccaccatggaaccgaaggggagtacgtttagaggacggatggatcaataagccaagagcttgattcggtcatcgtgaaccaagggaatcgtacgatccccaatctctatcgttgtacttagaccagtggggttggttggttgtatggctaagtaacgatagggattggttcatcaattcacgaccgatgacgagtcgttgaacgaatggagtaaggcgacaaacgggctaaggaatcaaatccgcatattggccaaggtatgtaacgatctagcttattagttaagatagacgtttggtaattgatcgtgaaagtaggataaaggaatatgcgattgtttggcttagaatggttagcgaacatatgcatgtcttgaccgagtaaagaatcgatctaagtctaagggacaaagacgatgaaaccggtacaagagttggttagaattaaaccaaggttagaaagacttccgctgtgtaataagagagcgattatagaatttagcctcgtaaaggcaattctatgttgaatcgcgaaaaattaagaggttcggccggggagaggcgcgaacttgagtactacgtcgctggacgccgagacgtccgggactgggtctcacaagttggtatcagagcatgcttgatcctaggatggataggtgctcgggaaaacgtcatagtaaggttttggcggataaggaagttgagggatcgatgtgtttggaaacggaaacagttacctaactcacgatcaggaaccaagatattatccttgttgtcaaaacttaaacatgacgggaaaatgggttgatatattcggagatggaccgatatcaatgaaatttggatctagtcggaacttgactaagatcgggtacagacttagtcaggatttgactatttctggggttttgatcttatcggaaattgaccaagatcatggaaaaacgacaaggtcggaagagacctatgtcgggaatattgaccgagtccggtggggaccagggtcggatatattgacaaagtcagaaaaagacttaagtcgagaatatgatcgagtccgggaaaggaccaggatcaaaaatttgatcgaatgtcggaagagacaaagatcagaaaacattgatcaagtccaggaaaggacaaagatcgggaaataatgatcgagtccgagaaaggaccaggatcagaaatttgatcgaatgtcggaagagacaaagatcagaaaacgttgatcaagttcaggaaaggacacagatcggaaaacgttgatcaagtctaggaaaggacaaagatcgggaaataatgatcgagttcgggaaaggaacaggatcggaaatttgatcgaatgtcggaagagacaaagatcagaaaacgttgatcaagtccaggaaaggacaaagattggaaaacgttgaccaaatccaagaaaggacaaagatcagaaaatattgatcaagtccacgaaaggacaaaaatcgagaaataatgatcgagtccgagaaaggaccaggatcagaaatttgatcaaatgtcggaagagacaaagatcagaaaacgttgatcaagtccaggaaaggacacagatcggaaaacgttgatcaagtccaggaaaggacaaagatcgggaaataatgatcgagtccaggaaaggaccaggatcggaaatttgatcgaatgtcagaagagacaaagatcagaaaacgttgatcaagtccaggaaaggacaaagattggaaaacgttgaccaaatccaagaaaggacaaagatcggaaaatattgatcaagtccaagaaaggacaaagatcgaaaataatgattgagttcgggaaaggactaagatcaggaaacttgatcaagctcggaaatagagatttgatcaggaaacttgatcaagctcggaaatagagatttgatcaaatatgatatctaaagtctcggagagactaaagatgggaaaacgttaaggagtaaacaagatcttacatccgctgaattcgaggacaaattcagtttaaggggggtagacttgtaacgcccgtgtcccaagttagggagtaaacaagatctctcacccgccgaattcgaggacgaattcagtgtaaggggggtagacttgtaacgaccgcgtcccgcgttcataaagaggcaggtttgttttaggagaaaactagatcatggtcgaggaacggaacaaaatactaagtaggaagaacgagaaagtataagctaaaccagctaggtgagctggacaagctgtatgaactagctaggtaagctatgtgagctaaaccagctggaagactagctagctcagctaggtgagctgaccgacagctcgactgagcttggtgagctgatcaagtactgacccagctgggtggtccggtcagctgacactcgagctggtggactgtggtagctcacgggtgaagaggtgtctcggccaaaaggtgtaaggtcgagcgggtaccaacgaacgtttgcatcgcccaaaggatgcaaggaacagatgtgacctttcgaaaggatgcaaggaacggatgtgaccttccggagggatgcaaggaacggatgtgatgcttcgggaagcatccattcgccccctatataagggaggacgcccaaggcatctcagatcatctcagaacatccaaaacaccataaaacattcttaaaggagccattcttggaagaggtttaaaagctacaccactcagtgcccctatcatggtttttagaaggcttcattattgagcacactctatagaggagccttaccaaagatcagaatg

SEQ ID NO: 5597 - DNA, 3000 bp, Unknown
  misc_feature (1)..( 3000): cDNA_ID_3077800_gDNA_ID_1620805_Annot_ID_168825 3000 nt of promoter + ATG
actcgacgcgatattgagcagagtgtcaagtaggatccgtgggttcagaacgagcagaatgttgagcaaaattagtgggatcaagatgggcagtactcggtaatgaattggcatgcttactatggcatcaacgagcatgaaccttcacctgaaaactgaggtaacaccacctctccattgtatatactataacatcgttttcatttttatttttctttgtgtgttttgtgctttggtcttgaattttctttcagatttttatttcacaagggactgtttaatttaagtttgggggagggttcaagacatgtttaacattgtgttctcttttcttatttcaaattttgcatcatctaaggcatagaaaaaccataaaaatttgaaaaattttcagaaaattatttcataaaaaaaagagtgtcatgtagattgtatatcattttaggattgtatatagagtgtttgcatttaggattgctcatttgcataggggataatgatgatttcaaaccgattagcatgttttgattcaatgaagtaagttcaatgcccaagttgttagttctctgttgcataaccgattgtatctctgaaataagaccgcaccttgctttgaatttgtaacttgactatactactttgatcgaaactcgcttatctgatgtgctaagattagaagaaaaaccttaagtttgtaaaagtataaaaccaaacccgctagactcttaaatcgtttcaagagaaccccttagaacatgaaccaaaaaagagagaaagaatgagaaaaagggtagagttaggaaatctatgggaatgggatcatcttctgagctatcatattatatcattgggtagatgggagtctgttcttgtatgtgtccgttggcttttacctttagcattctactgaagctcaatgttttctctgagagtcccctgttactcgaccaaaccattagagggaccatttttgtctcttagcctaagcccgaaaccaagtgagttcataaccattgaattgcttgatccactgtttgtgcttaatgaatgttaaagggaattggttgatgtgaatgcttgaatagattaaggcaagttgttaggttgcaattgtgacgagtatggctaacttttttgagtaagggtctatcatcttgcaatcagaattagctacctggacattgagcttacccattttataggcatgcttcggtttttgaatccccaccttcaaacctctccttcaacttaagattttttgtttgcttgagggcacgcaagagataagtttgggagagttgataacactgtattttactcattttaggtgtatgtttatcattatttagctttgcatttgctcaatgtatcatatcattgtgcaccattttagcttgttttgcatacttaggcatctaggatcatcttgcattcgcattgtatgttttggtgtgttttcaggtgcaaaaggagcttaaaagggctctactcgatccattcactcgatccaagcagctacagaagaggcatcatcctactcgacctctctactcgatccaggatgctacaaaggaggctgcagtttactcgaccctcctactcaatcaaggcaacctcagatgaagcagcaaattcaactactcgaccctcctactcgatccattactcgatccatttactcgaccaagggtgaccatctctacaacacttgttgagatatcaaagcgtcttcggatcctcctcattccccactcaaccatacatctgagcatacagataggagaggatgaagcatctactcgaccaattgatcactcggagcatagacacaaaggcgcagactttgcagcaccctctttactcgatccccaaggtcgagtattcgcccaaaccgcctcaagtctcctgtcttctagtgaatctagggtttccaacattttagtataaatagatcatttggggtttgtccaaaagatctagactttatctttcagtttttctttgtgtttatgaatcttgaaacttaaattactcttaatctatttcgtttttgcatttagttgttttagtaaagttgtttagcttgtttagatctacattttggtatgattttagtaatttctgggtttgtgttcttgagaatgttgcttgaatagtgattagggttcttgaggatggattaaattagggtaatctctaggttagttaggtggttagtgtttaggtttatacccttctggattcgcttggcccctatgcggtttttgctggctaatgtggagattcgatcatagacgtccagcgtctaaaataacgccctgctctgctatgtttcatcaacgagagttgagattaggaagtggtagagttatgggggtctctgtcacgagagtggattgacctggtttttgaatctatcgtcatgggtatctacctttcgcctattagccatttgatgaaccctagagttacccttatcaatgaaactatccttagaacttctattagatcgattttcatcccctgttgattgcatttttatttacctgtcatttgcatcctctattttcatcccctgttgattgcattttaattcttaattttctcacctgttggttctactcgacccaatgatcgagtagggcttttaaagttctcatttttacttgtttgaatcctgacctaggattgttactagaaacccaccatcattataacctggcttgacttagtcgtttttgtacatatcttgattgctagcaatacagtggactggattgacaccctctataactgcatcgacatgtttgtgttttagaggaattgaactgaacacacactcttcagtataagcagacttgaaaaacctgcttatcagttggttcaagttcttgagagtacaaacgagtgattgagagttgtgagagaaacgtttaatcgaagatcggagttgtaacagattggtatcagagcctggttataggcaaaactccatcgatg

SEQ ID NO: 5598 - DNA, 52 bp, Unknown
  misc_feature (1)..( 52): cDNA_ID_1828945_gDNA_ID_1620806_Annot_ID_50529 3000 nt of promoter + ATG
aagcttgtgaaagtctctctgcaaatcttgttgctctgttgctacaacaatg

SEQ ID NO: 5599 - DNA, 3000 bp, Unknown
  misc_feature (1)..( 3000): cDNA_ID_2053446_gDNA_ID_1620806_Annot_ID_168876 3000 nt of promoter + ATG
tccagagatttcaacgcctcttctgctttaccgtagagaccgactttaatataaattgctgcaagattagcaaatgtattccaagagaaaataccttcaccttctgctttcatttcatcaagaaccttctctactccatctaaatcctttaaacttccacagctttgtatccacatggagtaagtaatatcacaaggagtaatactcttctctttcatcgcaacaaccaatgcaggcaccttctctggttgacctagccccatatacatagccatcaggttattaaacggcaaagaattactcacatgattgagatcaaccatattttcaaaatgagcctttgctttaacttcctccttttccacacagtaacagttcaataaggaaccataagtggactgattcttaatagaatcgtctaaactgttgaagtaggtctcagccgcctctaagcctttactctttgcaattagattcaaacgaatcgcgtgatcgctgccagtaaacgctatttcctttctttccatccactcaaagatctacacataattcagaaaaactcaaacactatacacatttaagcttcctatacaataagcctctaacaatggtggctaaaatcaattccaaaggaaagaggagacaaacctcgagagcgcgttgaggttgacgaaacttgcgaagatcctttgcgtagcgaatgaggtcgtgttttttgacaggtacgccttccatgacgaactgatttagcgtttcctccattttccctcctcccctcgtgccaaggcttgagagtttcttgtatattgaccgatgctttttcgccttcgtcggaacagaagcagcagcctcgccgctaatctccgccgtagcagtagcgagcgttgcacagaacctcctcgcgagccgtgaaacggaatgcatcatcagatttacggattttgaatttttttctgagtctcactcgaatctatgattttgctagggtttaaaaggcttttagaaaataagaagtcgaacttcatgtcgtttttatataactaaaaacgacatatagtttatttttgtaatcgtctctcttttgttattggagcagaaaaacttgtaaggccagaaatggctgttcttatccaggttcttcttcctcctccgacgactatcgtcttctccaactcattttctacaaagttaatactcacgcgtcgtcttcgttgccgtatctctaattcgtcagaggtggttccaatttgattttttttttttaaatctcaattcgagcaattttgtacatatatgaaatgtgtgattttgaatttgattctcaggttaaatcagatgaaggagctccgaagttggagtataagccaggacctctcgacgatttcttcatgcaatcgttccggaacaaattggtcgaggtgagttgtgaaatcgattttttttttctggtttcttcatgaattttagtgttttgatttggagtggtaattaggttttaacattagtctaatgatcttctttatgttcaagtatgtgtaacaggaagtcgggtcggattcagagaaacccgggtacgttggacttattgagttggttaagcttctcttgttgaaaggtcgtactaggtcggagacaagtgatgctgcggtacatttctcattgagaagttatatttatagacactttaggttaaagttctgagtttttggttcttttttggttgatacaggttcgaatactgaaatcgttgtttcctccgctaattttagagctttacaagcttctcattgctcctatagcacaaggaaaattagctgctttgatggttggtgagttcttttgattcttcaatcttccatgtcaatgaaaagttgtcaaaatattggtaacaattagtgttttttgtttcccattgaagcaagagttactgtacttacatgtcaatggctcatgggaccgagcaaagtaaacatcatcgatcttcctaatggagaatcttgggatagcggggtaatgatgatactggaactatgcatctgtttcgatatgatttgttttgtcagttatttttctatcctttgataacgaagaggagtttgatgaatccaagtaggttttcgtggagaaatgtcagtatctagaagaaagcaagtgtgtaggagtatgcattaatacatgtaaactaccaactcaggtattcttctgcaatttaacaagccaatcaaccgattattactgtaacaagacatgaatttgattaatccctgaaaatgtggatttcgtttttttttccagacattctttaaagactacatgggagttcctttggtgatggaaccaaacttcaaagattatagttgccaggtacatcttgcttgccccttctctaaacaatagacatatcaactctaagttcatggatttacttatcgtcattcatcaactggtattaatcaaaattaacatgttgatgtttttgaatgttcccatttctattagcatcttctttggccagttattaacttcatgtttgaatcataacagttcaaattcggagtagctccaccggaggatgatggcaatgttaatgaaccatgttttgagacatgctcaatcgctggccgccggaaattaaaatccggggagtgtcctttagcgtaaatatatcgtttttatgtccatacactgacattttacgttgtgtaataacttgtgtatatcaacattctagctttgattacgaaagaaaacacaaaatttctttaactaagatctaatccaatttttatgaatatcaaagggtattataagaaatgttgtacatgtgaggttttacattacggtgtgaaaaagaataaaacggttgacatctataacgttcaaaggggtaaaaattaatcgaatttgtggaaaatcaaaaaatattagaaggtcatacaagaaaggtcggacatgtgaaagagaaatagaaatctagttattttttttgtaaacctgaat

SEQ ID NO: 5600 - DNA, 3000 bp, Unknown
  misc_feature (1)..( 3000): cDNA_ID_1828875_gDNA_ID_1620806_Annot_ID_168874 3000 nt of promoter + ATG
tggagagtgtgctgcaaatgcaggtccggagaaaggctggatgttagaatccctttcatccacattttttctaagaggtacctgaggcaaaggacctgcaaagtttggtaaagaagtagctcttgtatgagggtaatatgcagccaccaattcatcaggatttaaaggaggatgaggaatccttggaggtggatcgataggagtaggaaacgaactctcagacatctgagattgtgaattcattgaagatctcagattttcatctctcatgaacacctcttctctaacattcctttgagcagtggagttagtcaccctatggagaggctcaatctgacggtaaggacatgagttcctgtgatgagtcattctgaagcagctactacagattctcctaagtctttcatactgaaagcttatcagagcagcctcaccaaaatcaaaaatgattctttggaaaaacctcaggcgatctgtaattccaaaccggattctcacacggatataagctatttgagtcgtggtggagtcatgaaaatccagagtgagaatctttcctaactcatgtgctatctctaaagcagtttcctcacacacatacaaaagaggaattccacgcatctgaacccataattcaatagatgttaacaggtgaaacgtaagatttacctcccatctatgagttgtcacaaaccagttgttatacaaccaaggttcccttcgtagtactgacaggagatcaatcgttagagatgtcatattcaggtttacaaaaaaaataactagatttctatttctctttcacatgtccgacctttcttgtatgaccttctaatattttttgattttccacaaattcgattaatttttacccctttgaacgttatagatgtcaaccgttttattctttttcacaccgtaatgtaaaacctcacatgtacaacatttcttataataccctttgatattcataaaaattggattagatcttagttaaagaaattttgtgttttctttcgtaatcaaagctagaatgttgatatacacaagttattacacaacgtaaaatgtcagtgtatggacataaaaacgatatatttacgctaaaggacactccccggattttaatttccggcggccagcgattgagcatgtctcaaaacatggttcattaacattgccatcatcctccggtggagctactccgaatttgaactgttatgattcaaacatgaagttaataactggccaaagaagatgctaatagaaatgggaacattcaaaaacatcaacatgttaattttgattaataccagttgatgaatgacgataagtaaatccatgaacttagagttgatatgtctattgtttagagaaggggcaagcaagatgtacctggcaactataatctttgaagtttggttccatcaccaaaggaactcccatgtagtctttaaagaatgtctggaaaaaaaaacgaaatccacattttcagggattaatcaaattcatgtcttgttacagtaataatcggttgattggcttgttaaattgcagaagaatacctgagttggtagtttacatgtattaatgcatactcctacacacttgctttcttctagatactgacatttctccacgaaaacctacttggattcatcaaactcctcttcgttatcaaaggatagaaaaataactgacaaaacaaatcatatcgaaacagatgcatagttccagtatcatcattaccccgctatcccaagattctccattaggaagatcgatgatgtttactttgctcggtcccatgagccattgacatgtaagtacagtaactcttgcttcaatgggaaacaaaaaacactaattgttaccaatattttgacaacttttcattgacatggaagattgaagaatcaaaagaactcaccaaccatcaaagcagctaattttccttgtgctataggagcaatgagaagcttgtaaagctctaaaattagcggaggaaacaacgatttcagtattcgaacctgtatcaaccaaaaaagaaccaaaaactcagaactttaacctaaagtgtctataaatataacttctcaatgagaaatgtaccgcagcatcacttgtctccgacctagtacgacctttcaacaagagaagcttaaccaactcaataagtccaacgtacccgggtttctctgaatccgacccgacttcctgttacacatacttgaacataaagaagatcattagactaatgttaaaacctaattaccactccaaatcaaaacactaaaattcatgaagaaaccagaaaaaaaaaatcgatttcacaactcacctcgaccaatttgttccggaacgattgcatgaagaaatcgtcgagaggtcctggcttatactccaacttcggagctccttcatctgatttaacctgagaatcaaattcaaaatcacacatttcatatatgtacaaaattgctcgaattgagatttaaaaaaaaaaaatcaaattggaaccacctctgacgaattagagatacggcaacgaagacgacgcgtgagtattaactttgtagaaaatgagttggagaagacgatagtcgtcggaggaggaagaagaacctggataagaacagccatttctggccttacaagtttttctgctccaataacaaaagagagacgattacaaaaataaactatatgtcgtttttagttatataaaaacgacatgaagttcgacttcttattttctaaaagccttttaaaccctagcaaaatcatagattcgagtgagactcagaaaaaaattcaaaatccgtaaatctgatgatgcattccgtttcacggctcgcgaggaggttctgtgcaacgctcgctactgctacggcggagattagcggcgaggctgctgcttctgttccgacgaaggcgaaaaagcatcggtcaatatacaagaaactctcaagccttggcacgaggggaggagggaaaatg

SEQ ID NO: 5601 - DNA, 3000 bp, Unknown
  misc_feature (1)..( 3000): cDNA_ID_1031484_gDNA_ID_1620806_Annot_ID_168865 3000 nt of promoter + ATG
actcttactctgtcttagatactctggcttttctttacatataggagttgttgttaatgttgtgtgtctgtgtttggttttagaccttggagtcactagcagaagaacatggaggacgagtggagcttgctaaagcttactacgatggtctgaccgaatccatgatcaagaattttaatggaactgatgtcattgcgagtatgcaacagtgcaatgagttcttcttccttgccacaaagcaaatctctattggcagagttggtaatatatataaagctaaagccgtttcttttgattccactagtgtttgagcattaacaaaagttttgaattttgctcaggtgatgatttttggtggcaagacccatatggtgacccacaaggagtatattggctacaaggagttcacatgattcactgttcttacaacagtatttggatgggtcaaatgattcaaccagattgggacatgttccaatcagaccatgtctgtgccgagtaccacgccgcatctcgagccatttgcggtgggcctgtctatctcagtgaccatcttggcaaagcctcacataactttgatctcatcaagaaacttgctttctttgatggtaccatcccaaggtgtgtccactatgctcttcccactagagattcgctcttcaagaaccctttgtttgacaaagagtcaatcctcaagatcttcaacttcaacaaggtaatcagttttaaatcaaattcatcgtttagagatcagaactttattaaaaccccatatgatttgttgcagtttggaggagtgattggaacatttaactgtcaaggtgctgggtggagcccagaggagcataggttcaaaggatacaaagaatgttacacgacagtttcgggaacagttcatgtctcggacattgaatgggatcagaatccagaagctgcaggctctcaggtgacctacactggagattacttggtttacaagcaacaatctgaagaaatccttttcatgaactcgaaatcagaagcgatgaagataacccttgagccatccgcgtttgacctgttgagtttcgtgccagtcacggaacttgtaagttcaggggttagattcgcacctctagggttgatcaacatgttcaactgcgtcggaacagtccaagacatgaaggttactggtgataacagcataagagtggacgtgaaaggcgaaggaagattcatggcgtattcgagttcagctccggtgaagtgttacttgaacgacaaggaagctgagtttaagtgggaagaagaaactggtaaactcagtttctttgttccttgggttgaagaatctggtggcatctctcatctgtctttcaccttttaataatttgtttggatttttgtttttcgttttccttttcttgcattttgttatcagaagttgggttgtcaatttctgtttggtgttttacttttcaatttggagacttctcaaacaaattttaatatcaaatggattttctttgtcggttaaatttgagatttagtcaaatatcttttaaattatattaaaaaggtcaacatcattggtcaatttattaaaaattattctaacgaaagtaaactttaataggtttggtccaacatcattggtcagattggttcgagttatgcgtaatttttaccaatagttgtatttgtacaattgagtattactctttagaaagttgctgtttttttttgtgtgtgtgtatgtgtatacaagaatcacttttgccaaaagttaaaaagaactttgtttgtttctgtttggatcatagtgaatgttaatgaaggaatgacccatgatgttgatttctagacaaggcaatgggaccgtaacggctaattttttgtataatacatacatgtatacatgtgtctaacctatatgaatacatgtgtctttaacatgatcatattgcccagtgaaaaaagaacaagatttattcgagttctataaaataaatcatggatagaaaaataaaagaagctttatccatttatagtggttaactttaaaacaaataattaactggtacattggtgttttaatatcctaatttttcttcttttttcctttctctgttttgattagctaattataaacttaattaaaaactccattgaaaaaagaaaaacaataataaaaagaagaccaattttcaatttgttttcggcgacattacaatccaaaagacattcttgtgtgttgtgtttctttatttttagtattaaaaaaaaccagatttaatcgggacacgaacaaaagagaaaagaaaaatcaaaatttttgacctttatgaaccctaattttgggttggtcactctctctctctctctttcctttcccaaaattggattcaaagttctttctttttgtcttcctcgtacatcacagcatcaagggttttcgacattaccagctattatgcttgaattcgtgagttttttaaaggtttcttctggggttgtttgtttgttgtctgaagaatttctctgtttccttctcgactttcgttataaagttgaaatctttgatgtattagaggtcttctttctagattctgggtttcataaataggtatatttatgttgcattcgttctttgaattggagaaaatataaataaagttcgaagctttttctcgtttagcttgttccagaaattagaggatttacgaaatatgattttaaggtatcactggttgtttggtgttttcaaaaggcttaggtgatttggtgatgttagggttttagctatttatgttagcatttgtgggtaacaaaatttgtttatgtttctttgcagttttgttgttatgttaatcgtatttggtattattatcttgtgcatatgttaggaggacgcaaggagttaaaagagcaagtcttttgagttgaggaagcttctgtagaggattattatttcaggggaaatttaagggtttgatcagcttttgtgtgttgtgcgggatg

SEQ ID NO: 5602 - DNA, 3000 bp, Unknown
  misc_feature (1)..( 3000): cDNA_ID_1828887_gDNA_ID_1620806_Annot_ID_168863 3000 nt of promoter + ATG
ttcagtttttttggttgaaaaactaaattaaaatctcataaaccaaactaaattttatttggattcaaatcgacttagttcaatttaaatcgtatcacctcgccacctcggttgcattcgcattgaatacttcgtatgtgtatctctttaattctcatccgtatatgtagcatctctcgatcgtcgttttcaatacatctattattgttgttcttctttttggggtggttttgaacttttgatactggataaggactatggacatatgaaagaaaatacaaaaattgaattaaatttcacccatgttgtgaaattttttcatattccaaaaagacaaaaactaagttgttcaatttttttttgtcaaggtacaaccttaattatatatgaaaaagcaatgtacgtacattgcatgttgttacatccacttaacgcggatcatgcattaaaatcaactgatcgaatgatcgatagtcgaagtttaatttatttattttgtaagcttttcatcttcaacttcaagctttcccatgctatttctaagtcaactcttttttcagtttctttctattattttcctccattctctctgttttttctttttaacgtttatttgttttatttcctaagagcatccatatttatcatttttatgagtgtctttaaatggttatttctaaatataaaagaaaaaaaaaaaagagagaaatacagatatttttagaataaaaattatgggtctgattggtaatcaaaagctgtacaagttttttacctgttagctggagatgttaggtttttcggaatagtgcaaagctgttagaaagaactgtataaaaaatttgtaccaaaaaactgagagtaaaactttttgtaacgcttttgataaagtttttgtgattgataactgttaaagttgtaccgtattaccattcaaactctatatcttcctagagacatttgagctttacctttaatattattttatgtgaaagacatcatgaaaagttgttgaatgttgaacgaggatggtctaagagtttctttcttcttatgtatcatttcctaagggtttgccccaaaaaagtatcattttgtgtttgggttttgagttttgacaatcaaacatttatacatcacatgatcagttacagactgtatttagatttatgtacgacagggatcggacacttagtttttctgtcctactatatatctaagtttggattttacaaaattcttagcgtgaacatacttaagtttgatcttattagaagataagattgtattcgattctttgtgtgaacataagctctgatgtgtgatccaaatatgaccaaataaatctcgataaatagtttgtgtatatatttgagcttaagctaacgaaaaataatcaaacattcaattcgattcaccttattttaggatatttaagcaatctgtttttttttttctctctaagtcgtctcggtttgggattcgttctattgaaatctttcttaacaaagtacaatgacgtacacaatgcaaattcttggagatgtgtattaatttagtaacaccgacagttaactttatatttcgaagtacaaaagaatgatatgaatattttaccatttgaccaaagttcaaaaatgaatagaaataaacttaagctagaaagagatccccccatcccacgtccacgccacaccacaccacacagtttgtaaacgtggtcggcgactcattagcattcaatgcgtttaactgtttttattaagataatctttccattttcaacattcagtcaccatttttaatttttatttttgtagtatgtccttaccaaaaagagattttgctcaaaagaccatccataccaaagattgcaaacatgtatggtcatgttggttttaatttaatttggaattagtttaggaggtgcatagagtgattagttataagctgtccaatattaattggatcttaaattcttaacaattatgaactacattcatttaatttaacaattattttgggccaacaaaatgattattttccataaatttaatatttgtaggacagtttttctttctttcttgttttggtatcaagactcgagataatctaatttgtaggtacgtggacccttttaatttcgttctcgtagacaaccgagagaagataatacaaaacaaaaactcgacttggtcctataacacatcaattaatgattcaatatatgtgtactagtcgtatgatttctctatcattagttttagtttcctaaacgtaagttcttgtcatatcaaaaaccctttaacaaaaaaaaagttcttgtcatatcaaacaacaaatacaagttcttgactttcaaccatttaatgaaacatcccaacttgtacatataatagtaatcaattcgaaataaaagtaagaataacctttacaggagaataatacgcaatattaaacggatctccatcacatatattttattgtttggttatgactgttaaagtacatatatgtaatgacggtttcagtttcgctttgttaaaaaattatgattaacaagtggaacaagacttgtaatcacgtacttgattagttatgtgtgttaatctccgattatacactaactttgactcgtgttattttatttaacaccacaaataattctacttaaatattaaacaaaagctttgactcatactctctttcgactaaaatttttggtctacgagtcatacacgcgtatacttttcaaatatactattacatgttcacttggtaatctcatttaatgcataatcatgcaagctgtacgttaacgatcaatggcaatttcttgtaaatttgcaacacgctcatgggtaatttcgtcttggttttgttatataaataccccatcaattgctctccaacatgcattgtctgaaaccaaacaaagaaaatacacgaaggaaggaaaagaaaagtaaaaagaaaagctttctgcaaaatccaaacatg

SEQ ID NO: 5603 - DNA, 3000 bp, Unknown
  misc_feature (1)..( 3000): cDNA_ID_1976770_gDNA_ID_1620806_Annot_ID_168862 3000 nt of promoter + ATG
aagaaggttttcgagcggggagagcggttttgcctaaatactttctagaagatgtcggactcgagatgttcgaagtgttgaagagaggagggaagaaaatcggagtgagtgatgatcttcctcaagttatgatcgaagggttcttgagagattacttggagattgacgttgtggtcgggagagaaatgaaagtcgttggaggttattatctaggtatcatggaggataaaaccaaacatgatcttgtctttgatgagttagttcgtaaagagagactaaacaccggtcgtgttattggcatcacttccttcaatacatctcttcaccgatatctattctctcagttttgccaggtcagtctcttttatcattattttgtttgcgtttacgtttacagattatacagtttttaattatatttggtaagagattttttggaaatactaaacgagaatgttttaactactaaatattgaagcagccaaaaaaagaaactactccatatatgttgatatctatattatgacttgttacagtttttatatatatgatgaccgataattagtaaaaagcaacatagcatattaaattgtgatagtagtgacggtgatgaaacacggacaacttgcttgattgcgaatatgaaatattaacaacataacgtcaaaaatattaacaacatatataaaaagggaaaacaaaaggaaagaacaaatcaaggcctatatcattaaatacgaataagaaacgacgacagatcctgtgtgcatagttattagtcatgacaatgaatatatctcgtcgagttgaatctcaatacctgtaattgatttttgttaggtattttcattcattgttttcatgttatactcaactgattttcttgtccttttctctctaataggaaatttatttcgtgaagaaatcagacaagcgaagctggcaaaccctaccacgaagccagtaccctaaaccattgattttccatgatggccgtctcgcgatcaaaccaaccctaatgaacactttggtcttgttcatgtggggtcctttcgcagccgcagccgcagcagccagactcttcgtctctctttgcatcccttactctttatcaatcccgatcctcgccttttccggttgcagactaaccgtcactaacgactacgtttcatctcaaaaacaaaaaccaagtcaacgcaaaggttgtctctttgtttgtaaccataggactttattggaccctctctatgttgcattcgctttgagaaagaaaaacatcaaaactgtaacgtatagtttgagtagggtatctgagattttggctccgatcaagacggtgagactgacccgtgatcgggtgagcgacggtcaagccatggagaaattgttaaccgaaggagatctcgttgtttgtcctgaaggaaccacttgtagagaaccttacctgcttaggtttagccctttgttcaccgaggttagtgatgtcatcgttcccgtggctgtgacggtacacgtgaccttcttctacggtacaacggcgagtggtcttaaggcacttgacccgcttttcttcctcttggatccttatcctacctacaccatccaatttctcgaccctgtctccggtgccacgtgccaagatcctgatggaaagttgaagtttgaggtggccaacaatgttcagagtgatattgggaaggcgttggatttcgagtgcacaagtctcactagaaaagacaagtatttgatcttggccggtaataatggagtagttaagaaaaattaaaatttgttttaggatgatgagtgagtgatgagttcggttctttgggtatgtaagtaaccaatcgattatttcatttgtttattaataatgtctacgtaaatgtaactacaatctttttttcttggtaatgtacacatatgttctatatcatatccaaaatctttgtcagacaattttgcctttcatgcaattctagtgcatatataaaacaatggtccacaaataatgtaacgaatcatctatattaattcggacaacttgaaagtttctattaaatttctatatattgttttcgtcggcacatgcatcataaatgtttttaacggtctagcccaaataatgtaaccaaacttattgtaaatcatgaatacaaacatgaatggccttgtatatataataggctaatagctggttggttataaatgtgacctatagtttagtttttctttgtcaactaaaagtttatttactcttatataactatggcatattcgttggtcaaaatacatatattctatatatcaaaacgtaaagttattcgtttacgttcgctagggcctaggctctagtagaaaccatgtgagcttgcatgtgaagtgaacaaaaatcaattcttaatataccgtactcgataaaaaagttagtcaatcgacacttgagttataaaatttctaatgatcagttacaaaagtacaaaatgatatagacttttaagtcaattattacactttttgtatgtgtaataatgaatgatatgttattatatttcgtcttaaaagaaaattaaagttgtacagcagaaatcatttgtgttagtcccgtatggaattggacagaatcaaatatgtctgtggtgggtggtgtggccatcactgtcgcaactgttgtgtttggaagaagcaaagtcttataaaacaaatatggatttaattgattgatccaacataaaagaaaagtcaaactcactcacttaaaggagaacgaaaaaattggtaaccgacacgtgtctccgttcgtttaaatggattgggtcgtcatagtaaaagccatttatatcgatcggcccatttgttgggtccactgtttacattttctgatctgatcctttaattaaaaaactcattaattttaaggactattccgcaatttattgattcttctttatcgtgcttctgattgttttggttaacggatcaaattatcgaacgatgatg

SEQ ID NO: 5604 - DNA, 3000 bp, Unknown
  misc_feature (1)..( 3000): cDNA_ID_1715684_gDNA_ID_1620806_Annot_ID_168861 3000 nt of promoter + ATG
aattagataaggccaaagatctcatcaatcacgagcatctctgatacgattgatgtatcaagaagaatgtgaatgagagaaagcaaaagaagacacgtgcaagtgaggaggcacgtgagaagaaacttgcttgaagaagaagatatttttaggatctaaaaatatcttgaacaaactcagttcgagtataaataatggctctgaatgtttagagaggtttatgttgtttgttgttgaatggtatgagagacttaagagcagagctagtgatgtgctagtctctctcgtatggtgtattgagagctgagctagtgatgtgctagtctctctcgtgtttggtgtgttagtgagtactggtttggttaaggaataaaggtatcgatattgaaaacttaacaatctcgaaacacttgtaaattgaagaaacctctcaaagtctacaaaaatgctactgagagtgaaatcaatatcagaagaaacaacaaccattttccactgattaaaagataagtttttaatataccttttgaacagacaagactgatctatcgtgctcttcattttcaaggtgagattttgtagaaaacgaaaggcataacacgttagaaacagatcgatcatatccaattaaaattgcaagattcttagataaatggtacaagaaatctaaaagaaacctgcactcgctagacatctagattcagatgcaaaacaaagcgcaaaagtaagagcaaacgtagttatcggaggatccaagtctcttcaagatgataggaaaaatgcaacgcaactcacaatagctgcaaaatggacgagatgcactattattgagcaccacctcatatgatttttcccaagggtttattgtgcttcttggcatgagcaatgaaagggctccgaccacacactctatatgcaaactagcctggtagtctttacacgtgtagaaccatatctctggattggtttctttttcacaaatatcacaccaatatttaccactagccttttcgccatagcatagtgagagaggatggtcgtcaactctatgctttaccacttgtggaaaagttgcgcatttgaagcatatggcaaatctgcaatcatcttcaatgcatcctagcacatcatagaaaccatttttgcagccattgcaaatcttaatccctccatctggtaaagtgtgatataagggatgatcgggatgactcggatgaagaaatggctcagcaattgaaccgcaccgaacatcgaatgtgatgtttccttgatggtatctgaaaccattggaccatctatcacaagcataacacctaaagggttcagcttcgtttataacaagagtaagacgttcattgtgtagcacatgccatttcattctacgaaatccagcgcagttttggtggagaatgaagtcacaatccatacagccgtaaaaggactggagacagatgggatgggtgcatgcactgcaccacttgttgtcgtcacaaagaacaccattaacatggagtcgtaggtaatgctctttgtggctgaaatgttgtattgtgttttcatctattaccacatatggttgtatatcttctgtttcttcgggtactccttcaagctctttcccattccacacatcttttctagtagcacatttagaatgaacgacatagccatgacacctctgacaagaaaagcctccacaagtccaatccaccttctggtgacaaactccacatacagacttgacaacaccaagaacagatgttcgagaaacacggtgatcatgccgattaatgtttataacgcgtggaaggtcaagacagtcttgatgaatcataaaaccacattgaaaacatacataagggcttcgatctcccttcagcccacaagcattacatgtgaaagaatcgagccttgggagaagggtgagttggtggtcatgagctttcaaattcagaagagattgttgtggtggatttaaaacacatcgcatatccaaggtgaagttacacgaagaacagtgataaaacaatctatcaccaatatatcttccgcaaagacgacattttctgtcagaatagtccggtaatttacctcttacgagcttaagagggtgtaaggagtggtaaaaatggtttacctctaacgggagatttgactctgatgggcgccatgcgcaatcaacatggaatgctaaatcacattcttgacatttgtaagaaaactcataagaaagtttcccacatttatccccacagtcgatataattcggcttcttgtaaaggttgagcttgtggtgatgcgtctcggaaatgtcaataacttgtggtggtggatacttggcacaatacatatgcacgttgaagttacagatctcacaattatagaatagactcttgatagagatgccacataagttacagttacgtgtatgacctggtttacgtagaagctgaagagcgtgacttgggtgagatggatgctcgatatattcggaggacctatcgccacagctcttgtggacgaaaaaatcgcaggttttgcaatagtagccatcactgatagcttcaaaacgtctacaacaatcacctttcctcatatcattccaaggcaacatatgatgcttgtggatcaacggcagtgacactccctcagaatccatggtcaaaaattggatctgaaatctcaaaactcaaaaatcttctctcggtaatctcaacgatcgatgctcttataaaattaatcggaataaatataaatggaagaagaggtctctcgtcactaatgagaggaaaaggccattgggctagaggttaaccaagcccaaaccgaaacataatctaaacaaacctaagttcagttatctataatatcggtttagtttagattatgtttcggtttgagcaatttcatttcggttagagtcagtttaattcggtttgtttttcaaaaccatttcttcaaacaattccttcaatttttttgtatggataaaattggaaa

SEQ ID NO: 5605 - DNA, 3000 bp, Unknown
  misc_feature (1)..( 3000): cDNA_ID_1828932_gDNA_ID_1620806_Annot_ID_50534 3000 nt of promoter + ATG
gtcctcagattatccaacgtgatccacatcgctgtttgaactgtggagcatattcaaatccctatagctccatattaattggctcaggccaatggcagtgtgtcatctgcgagaacatgaatggaagtaaaggtgaatatgtggcttcgagcaagaatgagttgcaaaactttccagagctttcattgcctctggttgattatgtacagactggaaacaagagacctgggtttgttcctgcctctgattcgcggacatctgcacctgtcgtccttgttattgatgagtgtttagatgaaccacatcttcagcacttgcagagctctttgcatgcatttgtagactcgcttccacaaactaccaggcttgggattatactgtatggtcgtactgtttcaatatatgatttctctgaagattccgttgcttctgcggatgttatttctggtgcaaaatcaccatctgcagagtcgatgaaagcgctgatttatgggaccggtgtatacttgtcaccaatgcatgcatcactaaaggtagcgcatgagatattctcgtccttaagaccatacacattgaatgtacctgaagcctctagagataggtgccttggaactgccgttgaggctgctctggctataatccaaggaccatcagccgaaatgtctcggggagtggtcagaagagcaggaggtaacagtagaatcatagtttgcgctggtggtcccattacatatggtcctggatcggtacctcattcaatgagtcatccaaattatccatatatggaaaagacagccataaaatggatggaaaatttggggcgtgaagctcacaggcacaatacggtcgtcgacatattgtgcgctggaacttgccctctcagagttcctatcctgcagccacttgcaaaagcttcaggtggtgttttggttcttcacgatgattttggtgaagcctttggtgtggacttgcagagggcagccactagggcagcaggttcacatggtctgcttgaagtacgatgttcagatgatattcttataactcaggtgattggacctggcgaagaagcacattcagaaactcacgagacgtttaagagtgatgcggctctctctattcagatgctgagtgttgaagaaacacaaagcttctctctctcaatggagaataagagggacatcaaaagcgatcatgtatttttccagtttgctttccattattcggatgtttatcaagcagatgtgtctcgggtaattacgttcaaattgccaactgttgatagcatctcagcatatcttcagagtgttgaggacgaagcttctgcggtcctcatctccaagagaactcttttattagcgaaaaatcagaaggacgcagtcgatatgcgtgctacagtagacgaaagaatcaaagacattgctttgaaattcggatcacaagtgccaaaatcaaagctttatagcttccctaaggaactatcatccctcccagaactcctcttccatcttagaaggggtcctttactgggaaacatcattggtcatgaagatgaaagatcggtgctacgaaatttgtttctaaacgcatctttcgatctgtctcttcgtatggtagcaccccgttgcttgatgcaccaagaaggtggtacattcgaggaactaccagcgtatgatctctctatgcaatcagataaggctgttattcttgaccatggcacagatgtatttatttggttggtaagttactcttgtcttcattctgtgtcttaattattttcggatcacttcagtttaatcattcattttggttgatttagggagccgaactgtcagctgacgaggtgaagagtgctgcagtcttagcagcttgcagaacgttagctgaagagctaactgaattccggtttccagctccacgtattctcgcattcaaggtccttaacatttcagaaccttatacaatttttctcaaaagaatcacacactttctaacctttctttttttatggattcaatatctatctgctaatccattgaaacataattcaaaatcttgtatatattgaaacataacaggaaggaagttcccaagctagatattttgtttgccggcttataccagcacataaagaccctccttatgagcaggtaaaaacatactaaaccatgtcagaaagaaaagacaaaactatcattgcggatcttaatccatttatttttattttttttcttctgaacccaatttttttgtgcaggaagcaagatttccacagataagaacattgacgacagagcaaagaatgaaactaaagagtagttttatagagtttgatgaagccagtttctgcgaatggatgaggagtttgaaagtagtgcctcctgagcccaggtagtcatacattttattcttgcttcatcgttttttttccgccttttactgtcagaacattttttttgttctctgtgagtcttttgtttttaggattctctttatatgatctccagttctctcaagtgaattatatactctgtccgttacaagcaaaataatgtgtagagatgatgaccgtgatttttctttttaccattttacagtcgatgtaatgccgtgtctatttttaccatccatgcttagcctttttggtttgaatccaagttatttgatggtacaaatcaatcggtcacctaaatttttaaaatctgcattatcataggcacatacatgccgaatatataaaataattcgtgaaataagttaaagctagaaaatatgtaagaaactcaatgacgtggcaaaaaagaagagtatccaccagaagttgagtctaggggtataaacgtaattaacatcaccttatccccaacgtctcaattctctctctcgtgctcttcactcgacgacacacgaaaaccggaaataaaagttttcgggttttcttcagccggactgtttttcgctcccgccggaaattctcccggctcgccgtcgacgatgatg

SEQ ID NO: 5606 - DNA, 3000 bp, Unknown
  misc_feature (1)..( 3000): cDNA_ID_1828928_gDNA_ID_1620806_Annot_ID_50535 3000 nt of promoter + ATG
aatcgaagctttcttcaaaccgcctcacgatatgaagagagattcaagattctggtcaatgatattcgtgcttcttggtgtagcttctttgatagtgtatccaatgcatacctacttgtttgctgtagctggagggagattaattcagaggataagagtaatgtgttttgagaaagttgttcacatggaggttgggtggttcgatgatcctgagaactcgagtggcaccataggatcaaggctctctgctgatgcagccttgatcaagactcttgtgggcgactcgctgtctttatctgttaagaacgctgcagccgcagtctccggtctgattatagctttcacagcgagttggaaattggcggttattatcttagtaatgattcctttaattggaatcaatggttatcttcaaattaagttcattaaaggcttcactgcagacgcaaaggttggtcgcacattcctgttttcatttttttattgtggaatgagttttcaagggtttaaggcttacttgttgaagaagaaacttaaaatagttttgaaagaaaaaaatgtttgcaggcaaagtacgaggaggcgagtcaggtggcgaatgacgcggtggggagtataagaactgttgcgtctttttgtgcagaggagaaagtgatggagatgtataagaagcgatgtgaagatacgattaaatctgggattaagcaaggtttaatcagcggagtagggtttggtatctcctttttcgttctttactctgtctacgctagttgtttctacgtgggagctagactggttaaagccggaaggacaaacttcaacgatgtttttcaggttttttcttcttcttgggaatctttgtaatgaaatcttgggacgaagaaaactaatgatcttttgcaggttttcttggcgttaaccatgacagcgattgggatatctcaagctagctcttttgctcctgattcgagtaaagcaaagggtgctgctgcttccattttcgggattattgatgggaaatcgatgatagattcgagagatgaatcgggactcgtgttagagaatgttaaaggagatatcgagctttgtcacataagcttcacctaccaaactagacctgacgttcaaatctttcgtgacctatgtttcgccattcgtgctggacaggtaacatgtccaaaagactactatcatttgtttttttggttatcttgatatttcccttacatattgacacaaataaagtgaggagacatgaaacttaccaattctgattttgatatacatgtttagtcctttaattctcttgcttatttcagacggttgctttggtcggagagagtggatcaggtaaatctacagtgatttctctgttacaaaggttttatgatccggattcgggtcatataactctagacagagttgagctcaagaagctgcaactaaaatgggtgagacaacaaatggggcttgtagggcaagagcctgtactgttcaacgacacaataagatccaacattgcctacggaaaaggcggtgatgaagcatccgaggctgagatcatagctgccgcagagcttgctaatgcccacgggttcatatctagtatacaacaggtaaactacaagtacaacaagacttttattcacttttgaaaaacagagagattacttactatgcaagcaaaaaaactctttcttatttcaatttagggttatgatacggtggtgggagaaagagggatacaattgtcaggaggacagaagcaacgcgtggcaattgcacgcgccatcgtgaaagaaccgaagattctgttactcgacgaagcaacgagcgcgttggacgcagaatcggagcgggtggttcaagacgcgcttgaccgagtgatggtgaaccggaccacagtagtagtggctcacaggctttccacgatcaagaatgctgacgtcatagccgtggtcaagaacggtgtgatcgtagagaaagggacgcacgaaacgttgatcaatatcgaaggtggtgtttatgcttcgcttgttcaacttcacattagtgcttctagttgacaaacaattgttttcctaagtcctctcaaaatatattttgagcttaaggtatttttttatactaacattgtttctaattatgtaaaagctttgacaaaaaaggaagttaccaaaagaaaattggtctttaaccacaaggtttattgttaacgacgtcgtttctcccgaatttaaccgttacgttacttatttcggctttggagagaatctgaaatgcgacgtcggttaataccacgtcatgcagtgtgctggcagttgattttataaccaatgagatattacgatcatgccagcaaggcacgcgtggttagtgaaatgaccaatagttgtagcttaagtgtaaatattaacgaaaatgccacgcatcgagttaaaagaaaatgaaaaaatgaaaatagaatcgagaggagtagtactgggtgagagggatcgtaagctacgattcaatgcgagtcaaaaattcgtctacgaatttgcttcttcttcttcttcctaatttctcgaatcgtctctccgattaaggtatcacaatttttattcctgcttcttcttcttcttcagatttctgttttcataccctaacttctctgcttgattttaagattttgccttttgtttttatgtctactttgggtagattttagttgatatacacttctgcggattttgatttgtcggtgattgaaacgaaaacgaattggtgattttgggtttagtatcgtttagaagtataacttcggaattgtcctgttttttttttctatgaactttgttttttgatattttgagctgaattttaggggatactaaggactaaggattgtttgttgaaattctctgcagattcttgatctggacacagttcaaggctgtttcagcttgtgaattgtgatcttactttgtttggattaagtagaaacttcggaatccgatg

SEQ ID NO: 5607 - DNA, 3000 bp, Unknown
  misc_feature (1)..( 3000): cDNA_ID_3077901_gDNA_ID_1620806_Annot_ID_50537 3000 nt of promoter + ATG
ttggaggcggaaacgtggttgtgggctgatgagtggttccatttaccaacaaattaggaatctctgaatcttgaaaagctaataaaaatgaaatcttttaccaaacggaaaacgccaaaagaaaagaaaaaaacagagagaggagtgtgattggtgttttggattagcaatttgtttatagaatggggcacacatagtatgccacgtatgaaaatcagatttatcgtcagaccacatgtgtattattattgttagttcatggcttcacgcaagtaagtgtttaggtttagattggtaatggtatctatatatacatttttctaatcattttagcaaataaatcctctacttgacacttatttacaatggtataccattggcattaattcttttttctttaattatttaatttgatttttaattctttatttaatatatcaatcacattattcattcaaatttaatctaaacaacaaactttaaatcaaatcccttaaaattagctatacataattatttaaatgattattaatattatactttattaaaaaggtaaatattataattatttaaagtttataaaacgtttataatatttaagagaaaaacgtttataatatttataaaatacaaaactatatgttacatatagagaaatattttagatgtaaaatctataaaaaatcaaataactatttgaaagacaccttttaaatttatttgaattataaatcttttaataaaaatattatttaaacaaaaaatttaaaaaataattattaatttcaccgaacgggattagattgtatgacggttttagaatattaaaatatatgaactttataaattataacaattaaataaccatttaaaataaaaagtttgaaattgatttgaattatatataattaaaattaaagtattattaaaacaaaaataataaaataatatttaattttattgaacggggttagatggtagaacgggtttgggtcgatagtaatattagacagtatacctaggatgaaatccattaaatatgtttaatttcattgaacggtattagatggtaagacgggtttgagtttatagtaatacgacacgttatacaacgggtgaaatcctataactaacaattaaaatacaatgatataatttaaaatatatgacaaaagaaacaatcttaacaaaaatcatatataattttaaattttaaattttaaaaatcgacttacggtgtactccatgataaaatcaagggattgtacaatatataaaaattatgattatatatttataaaatacaaacaatatgttacatacagataatttataaaataatatatttttagttatttttaataaaataaatagtcccgcggtacatcgcgggttaaaatctagtttttagtgcaattttgcaagtattttgtcaatttaacagtatagtgttaataaaatatatgatttttttgttttgttttgattttaaaaagtataaataaaagaatattagaaaagtaaatgagttagtattttatgttttatgtgtttccaccattatgtaatttacatattaccaatttaccaatcgaattttttgaagggcaagcaaaatatatgtgacaaatttcatttcatcgactatacgttatacataattaggccttttattgactaactaggcttgcttaaaggtccattaagattatgcatgtttaaccatttaaggcttaaaatacaatgttactgtcaatggtagtcttctaagtttggagagatttcttttccttgggtttgttcgttgttgatgaatatgatagcggtctcgatccatcttcattctcattcttgagattggtgatatttatgctctttgtgactttgtccctgttttcaattttcatgatctatttagatttgatcgcgttttgaaatgttttcgagtttttttcatgaatttcatgactttgtccatcgtcacattcagaaatgttttcgagttttttttgtggttttgcttgccatattatgaattttttttttctatggtttcgaaagattagctaacatcgtgatagaagatggttgatttgatgttaacttcggattggccgtgggtatctttggtaaatctcatcgacatatgcttgagaagaagagatttctttgctttctttgagtctagagggtatgaatgtatgatgatgaagtctggtttcttttgttcttagtttaaggttttgtagttcgatttaaaagtttatgcttcgtattaatttatagtgtcttaatttgcatcccttccatagaatctagattccaagaaaatcacttttcttccggctgtgtttttggaatttttttttttgtccacgatttaaatttttcttatttggacgttataatttttcgtggttccacgacaaatttcattattaaaaatttccgatgacaaaacaaaaagaagggattcgaggatcatggaatacacgaccgagttgaggacaatggaaattagtagagcccatgacacaaacactgatgatactttcatattttttgtaaggagttttctacttaaaaatacaaatcatgttaaacattatggtcattattaatcaacattacatatataccataaaataaacaaacaaaaaaaacaattacatcaaaatcatgatgaactatcaaaatcgtgtttgttgttagccaaaaaaaccaataaaacatcccactgttgcgcctcttaaatttttgtttatgtcacacctaataacagcatctttaaaatactatttatctgatatcccacgatgtccttcttgattttgtatttataaacaaattaaactatctttcaatgttttaatgaacccatatttcacctgtttatatgatcccatatctttcaatgatttgactttgtttcattgataatacttggtgagtcatttttcaatggtcgttcattcaaacattccaacacataaggagatg

SEQ ID NO: 5608 - DNA, 3000 bp, Unknown
  misc_feature (1)..( 3000): cDNA_ID_1828916_gDNA_ID_1620806_Annot_ID_50540 3000 nt of promoter + ATG
tcagcgtggaggaagttgtgaagaaaatgaaacccatggaaagagctgttttaggattcaaatgcaaacagatcatcgatgcagggaggatgaagtgggttaagaaacatggattaaattcaaagctagtgaagtatatcccggcaagcatctcgccggaaaatactttactgatcgccggaaaacccaatccttctattgcttgatgttgtattcttgttggttatttaatacttggttggtgaaaactagaagagatattacacatggtgtatacgacagcgattttgcttgttaagtcacaacttcattagctcattctctgtctttggtcaaatccactgtttagtattcaaaaccaattttctcacattctattacacatacatgaatctcttctgcgtcgattttccacgtaattaacgataaaagatcctatgaagactgcaacgtcattacacacgcacgtacggatcagttttgttccgttcacacttcacactcagtcaaatagtcaaacacctccacaaccttctataaatactcgaatcacttaccaccaacaattcatcaaaaactcgacaatggaaactcccaaaggcactatcattttcaccaccgtcggtcgaactcactacggcttcgacgtcttctctctcaacatagccacctccgtcgaacgccgtttaacagacggcgtttccgtgaacttcaacgctcaattcgtcaacgataaaagcgatgatgtcgtctttgtttcggaaagaaacggatccgccaggatttacaaaacccgatccggaatttctaagcccgagcagattcccggagctccagagagctacttccacgaccgtcctatcatcactcaaaacaacagactctatttcatctctgctcacgagcaacctgatcgttatttcaagaattggtctgcgctttacaccgtggagctcaacagcgcaaagagagaagttacacgtgtcactccaccagacaccgccgactttagtccggcggtttctcaatctggagatttcttagccgttgcttcttatggaactcgctcttggggtggtgagtttcacgagatcaacactgatattactgttttcaaagcatcaaaaccagagacaagagtggttatctgcgagcgtggtggatggccgacttggtccggcgattcaactgttttcttccaccaccaagcagacgacggttggtggagcatcttccgggtagatataccggagaatttcacggaatataccgatttcccaatcacaccaatccgagtcactccatctggactccattgcttcactcctgcagctttccgcgacgggaaacgaatcgccttagcaactcgccgtcgcggcgtcaaccaccgtcacatcgagatttacgaccttgaaaacacaacgtttcagccggtgactgagtcactcaatccgagtttccaccattacaaccctttcgtgtctccagactccgagttcctcggctaccaccgattcagaggcgagtcaactcaaggcgagtcaatcgtacctaacatcgaatccatcgtttcaccaatcaaaaccctccgattactaagaatcaacggatcgtttccatcatcatctcccaacggtgatctaatcgcattgaactccgatttcgacatcaacggtggaatcaaagtatctaaatccgacggttcaaaacgatggacgttgatcaaagaccgtacagctttctacaattcatggagtccaacagagcgtcatgtaatctacacatctctaggtccaatcttctctccggcgagaatcgcggttcagatagctcgaatcaagttcgatccatcagatctcaccgctgataaagaagatcttccatgtgatgtgaagattctcactctagagaacactgggaataacgcttttccgtcttgctctccggacggtaaatcaatcgtgttccgatctggtagatcaggtcataaaaatctctacattgtagacgccgttaacggagaatctaacggcggtggaatacgacggttaacggatgggccatggattgacactatgccttgctggtctccgaaaggagatctcatcggattctcatctaatcgtcataatccagagaacacggccgtgttcggtgcttacgtggtgagacctgacggtactggtttgaggaggattcaaatttcgggaccggaagggtctgaggaagcggcgagggagagagttaatcatgtgagtttcaataaagatggtgattggcttgttttcgcggcgaatttgagcggagtaacggcggagccggtgacgatgccgaatcagtttcagccttatggggatttgtacgttgtgaaattagacggaacgggattgaggaggctgacgtggaatgggtatgaagatgggactcctacgtggcatactgctgatgaattggatttgagtcagttgaatttgaacggtcaagatggtgacaagcttgaaggtcagtttgaggagccgttgtggatttcttgcgatatctgaatgcgatttctccttttcttataaaagactgtcatatttatgtaatctcgctttttttatttcaataaaacaaacaaaaataaatgcatttagcattatataagtacacgtgtcattgaataacaacaaagcggggatagctcagttgggagagcgtcagactgaagatctgaaggtcgcgtgttcgatccacgctcaccgcattactttttttgtttgtctaactttttagtattgggccctttctctacgctctctttcctgctcaattatttgattttgtacataaaaagcattaagcccattaacatgcgactaaaagcccatatatgaagcccaaatgttcgaggctcgttgactcacttggaaagtttgactactattgcaaagttttgtgttgcctctaaactttgaactcaagtcggagtcggagccgcactgtcgtagcaaagctatg

SEQ ID NO: 5609 - DNA, 3000 bp, Unknown
  misc_feature (1)..( 3000): cDNA_ID_1828905_gDNA_ID_1620806_Annot_ID_50544 3000 nt of promoter + ATG
aaaaccacctcgccatacaaccgtcgtatctcccgtccccttgttctctaatggatgagactatgtttcgagtttgcttatcgattctttggatgagttgagatgatagaatagatgcttctccatgtctatggcggtttctttctttccatagtgaatgtactacaagctgaaaggcatatctcgtcaagaacaagcattctttatcgagagatgtatgtgtctgtgattatcttaatgatagaatcccagtgaggacccaccaaacctccgttgagtatgaacaagtgaagaacaaatggttacgtgattccaaaggatcttgacaaagaacacaagcgagaacagatttgggcctttattcaaacccatgactgattagttattgagtgaaatcactgaaatcaaattattttcattgcagttagtaatgtcttctttgacctggttataaagtttttctttttttggttatcaaagaaaatgcgttttgtcttttctttttataatacttttattgtttcactttccgcgcaacattcacgttttggattgttaaaatattcaaagcaagaatgagcattttccaattcggtctccatcattaaattcgataaaagtttgcgacttcggatttgacacaaatccaacggccaataacaaagaatagcatacaatatggttacgttgaataaatatttctagacaagccttgtgaacaaaaacgaaaagtaaacacatttgtcaataatttaagttggtcagtctttttttaagacccaaagaaagaaacaatgaaattcgactaggaataatctttttactttcttacccctggtcacgttttccacgatgaacagaaattatggagtaaagagttattaactttgatatatgattaatttaaattgaaaaatgtatggttttattctttatttaagggaatttaataatgtattggtttgtggattttggtttcacttagaaatctaattaaaactatatgttcttttctagaacacattttttaattgaaatacaaataaactagatatagaaaaataaattggaggttataagtggcaatttagtcttttctaataccattatctttcaccactcccctcaatatacatttctcctaaaaaccctaaattccaaaaacaaaagaaagaaaaacaaaactttcttcttcttcttcttcaccatcgaaaagagataatgaaccaagaagaagaaaaaacagagaacaaaaggatcaacgagatcgatgaagacgaagaagaagagttggagaacaagaagatggacatgttcttcaatctcattaaaaactaccaggatgctaagaaacgaagacgacaatacttaactcaagattctggcgacgttgcttcgatgccgaccaagagatccgactacagcattgttcctgtattccgtgctgaagatttttctcactgtatggacttaaacctaaagccatcgaattcgattatctccaccaagaaccaagaagaagagaagcaagaagaagaagaagaagaagatgatgaagaagaagaagatgatgatgaaggagaagaagaagttgagaaggtgatgagaaaagataatggtttagatcttaatcttgcattgtaataatacactttgttttttggttctgtttcgtgaataagaagaaaaaaactttcttaattacattattaaaagagtgacattgcaattaaacttaaagcagtgaatcatcaagtcaagaagctgcatgtgaaatttccattgatgaatgttagcttctcagctttgacgacagaatctagaggaagaggaacgaaggttttgtctggaccatagaagtgagggaagctatttacttcatccacagcttcatagattaatccatctccaagctgccaaataaagcacatcaaacaaaaacaaaaatgtcaatctcttcttagcactaaaatgtatccaaaacatcaacgtagcataacgattcaaatgacaattttgtaagaactttacatcaatgtccatgaccatcctaagatcatggttctgctacttagattgtgtttatccacaattgcagcttggtaagaaaaatgtttgaaacccattttgttttcaagtgtacaaaataacactaaactttagcacaaaccacacataaccaactctagctaactcatacccactttagctaactgctcctctacttaaacatggagctaatcacgcaataaactaacatttaccaaatcaaccactcaccaaactagaggatccctaacacaaaaatgatcataaattttctatccacatatgtttcaagttaaaggtaaaagtcaaccttcttaggatcgacttgaagaaggtaaagatactccttcacatccacgaaaaagttcttcaatgtcaattgtacctagaaatcagagaatcgatttcatcacaaaagcagtaaaaatctacataaaagtaatgatttttcacaagttcaaaccaaattgcctaagaaaatgagaaaattttcgagaatcttcatcacccaaatgaaaaagttgagatctttatgggaagagagaaagacctgatcaagtttgctgagatgataataacaagttgatttatcaatctctgcaccataagaagatccattcttcttaaactcttcccattcttgttccgtactgattctgtatatgaactcttcctcagccatttttgtttcaccttaaccagtgtgagatcgaaaaatcgtaactttaaagcagacttgattcgattccattccatcagagccacttcactaaaccgatctaaaccggaaatcaatttctgtactaaaccggttttattagctaaaccgactcgtcgtcaacttcgaagttccacttccaataattacctccttcgtcgtcgctttcgatggtcgaaatcagttggtaaagaggaaactctgaaagttgtgttaaaaaaaaaactagaatc

SEQ ID NO: 5610 - DNA, 3000 bp, Unknown; identical to SEQ ID NO: 5603
  misc_feature (1)..( 3000): cDNA_ID_1976770_gDNA_ID_1620806_Annot_ID_50548 3000 nt of promoter + ATG

SEQ ID NO: 5611 - DNA, 3000 bp, Unknown; identical to SEQ ID NO: 5602
  misc_feature (1)..( 3000): cDNA_ID_1828887_gDNA_ID_1620806_Annot_ID_50549 3000 nt of promoter + ATG

SEQ ID NO: 5612 - DNA, 3000 bp, Unknown
  misc_feature (1)..( 3000): cDNA_ID_3077884_gDNA_ID_1620806_Annot_ID_168858 3000 nt of promoter + ATG
taatgtgtaaaccacactatccaatagcagccttgttgtatatgactaattcattatgacacgagtttttttttttttttaatccagttgtaatgttaagatgttagtagaagaaactgaggaaaacaggggaaataccgagataatctacatatattttcgtggcagacaaattttggcctgtatgtagtaacaaatgatattcgagaatctagatgtttatgtcttgacattattggaatcataaaataattaactatatgttaacatagatgtacaataacaacatgataagcactacttcaatgactacttgtttcataaatcgaacaagcacatgagtcatgactcacacgataacaaattagacttttatttgtttactgttccatgatttagactttagtaaacatcacaaaaacaaagatccgaagaggtaatagttatggtttttagatggagtaaacaaacttagtctcgttcacacaaagcacaaaagcttcaagaacaatggtgtacacaaacacaaacgtgctaatgcttgggctgctagagaatctattgttctttgcggggtagagcggattttgggtgcaaaacgaacaaataaaaactaaaattctatgtttttgtccttcctccacccaaatccgccatatctttagatctatgtaagataagttttataaaaaataagacaaatactgcttaaatttatcaaacctaatattctctttattcattttggtaataagatcttttagttaagagcataaagattaagaaactatgatttaatacctaacaaaaattaattcaaccattgaaaacaaatactgcaaaatttaaatgggctttgagtacaaccaagatcaatgatatctctttcgacatgtgatcaattatatctttgtctacatgagagtttcgatcaatttgagtgttttgcgatgtaacagatggattgctgcatatgattttcgtatttgttactgatatttcatagataaaaagaagattatttccaagcaaaaaagtcacataaaaatttgacggaaatgatgaatacgttgaagtacttgactaagaaaacagcgtataacttgctttattgttttctttgttacataaaccattagttgtatttgtagtcttgtatatctgattcatattaaaggtttttagatgttaaataaaaaaaagaaacaaagagagtaatcttacgtagattttgatagcaatcaatattaattccaaagtttaacgaatatgaaaactgaaattaaaaaaattaatggagaaatgaagctcattaatggtacagctaaaaattaaaatattttagtacaagtggttagtgattagttatattgtcagtttgtcactattagaagttaacaaatgatattcgagaatttagggaggtgttattagtttgtgatttatatgaatttttactgacttgaaatgttataaaaaatcttgtgttattcaattaagattttataagactcggttaaagtttagtgttattagattttgatttgttaaaagtattataaaatcttaattgaataacacaagattcttcgtaacatttcaagtcactaaaccaataacaccccctaaatctctttcaaagtcataaaccaataacacgtcctagatgtttatgtcttgacattattggaatcataaaataattaactataactatatgttaacatagatgtacaataacaacatggtaagcactacttcaatgactacttgattcataaatcgaacaagcacatgactcacacggtaaccaattagacttttatttgtttactgttccatgatctagactttagtaaacatcacaaaaacaaagatgcgaagaggtaatagttatggtttttagatggagtaaacaaacttagtctcggtcacacaaagtcaagagcttcaagaacaatggtgtacacaaacacaaacgtgctaatgcttgggctagctagaaaatctattgttctttgcggggtagagcggggtgaagaacgaacaaataaaaactaaaattatatgtttttgtccttcctacacccaaatccgctatatctttagatcgtctatgttaaaggggttttattaaatgaaacaaatactgcttagatcaatcaaagctgtatctattttgttttgttttgtcgtcttattacatcatcactagaaatatttaatctaatatgatagtcactcccgcaactcaaaaccactacgaacgactctgcgtgcggcattctatacctccgataaactttgcaccattgatctacattttttgggaatcaaaccctagtataaatgtattaatgaactcttagttaaccattgaaccaaatattaatgagattttttagttaaaagcaaaattaagaaactatgatttaatagataaaaaataataattcaaccaatgaaaacaagaaggacataatttgaatagttataattattaaacaaatataaattgaaattgaaaaaaatcaaataatttaaaacgaacaaaaacttttaaaacttcttatagtaaaagaaaacaaaggaagtatatcttatggaggttttctatcaatattaattccaaaatttaaagaacatcaaaagtgaaattgaaaaactaatgggggagatcaagctcataaatgatgtacacctaaagaattaaaaattgactatattcttacaagttattaatgattaagttatattgtcagtatgacagtaagtatcatacccataaaaattatatttattgataatgaagagtataccaagcaattcaaaagtctaatataatgattaatgttattaagcattgttgagattaacaagagaagacttttgacttttgagagagaaagaaacacgaaagaaccatagctttgcgatttcagatctaaccttcttcttcttcttcttcttcttccaaatatcttgtagtatacgaccatg

SEQ ID NO: 5613 - DNA, 3000 bp, Unknown; identical to SEQ ID NO: 5609
  misc_feature (1)..( 3000): cDNA_ID_1828905_gDNA_ID_1620806_Annot_ID_168853 3000 nt of promoter + ATG

SEQ ID NO: 5614 - DNA, 3000 bp, Unknown
  misc_feature (1)..( 3000): cDNA_ID_1021679_gDNA_ID_1620806_Annot_ID_168852 3000 nt of promoter + ATG
agatcttatgaccaaaagcgtcttcattaaatctagatatatgcatataaatctagatagattaggttatattgtgcttccattagaagcaattctcctttacactggaaaacggttgttgtcttttcaaatattggtttcagtaacattcttatagactttaagaagtttcttcaatttacaagtgtttccagaggctcttgagttatgagacatttggccttgtcaaaagagagaagaaaaatgagaaatgatgttgctagaggagcagacaaagaactactaacaaacaacactagtagtactaggcacttttggttacttgaaatcattatgaaacaaagtaaaagaagtatcgttgtcgcaagaagtcttggacaacggcgtcttcaaagcattgttgtttgagaatctacatatatatttttgcagccattctgtgaaataaatcttcaagttgggacttatttacagtggctgccactgatatttaataattatttttgataattagaaagtaaatcttcgaattaaatatttgcatttaactaccttcccaaaatctctccgcattaactatacgattagttactaaagtaaaacttctaaaataattaatatgatttaaacactacaaaattatcatttttgatattgctttttttcatgattataacaattcgattataagccgcaaaccatagagatatttgatagcaattaattactacaaaattacaaaatatttaaacaatgattcataaacatatcataaataaaatcaacattaataaaataaataaatttttttacgggacgggttggcggtacgggtttggcaggacgttacttaataacaattgtaaactataaaataaaaatatttaatagatagatacaatttgcaaatttttatatatactaactttaaaaaaaaattgtgattaaaatctagtaccacaataaaaacagggacttcggcttttattaggaacagagtttcgatgtctgagaaccaggacagatgtttctgcataattcatgtacagttaaaaacacatcttgatcgattcaacatgaaaccaaacacagactccattcattattattcgcagaatctagagaccgaaatgaaaaaaaaaaaaaccattcttgagctctgtttgttcctaagacggtgaaagcatatcaccagtcatcttctctgctttctccccacgctcacctgaaaatgttttatcaacatgtacacacgttttaaggcaagccaagatctgtgtctttcttttaaaaagaatatggcttttgaagtttttacctgtcctaactcttatgacatctgacacaggcaaaactgtatataaccaaacaagaaacaatcacaatctgagtaatttcattttgcatttacaatttgaggtatcaaacataaatctgattgtgaaaagagtaacaagaaaactttttgtgttaccaaaaatcttgccatcaccaatctctcctgtccttgctccttcaattattgtgttgattacagattccacctgcaacaagaaaaaaaaaagtaatggctcaaactcgaatttcgcttatgaagtatcgatttttttaaccatatacgtacttggtctttcttaacaacgatttccatcttaactttagcaacaaatttgtcttccgagaactcagagcctgcaaatgcaacaatgtgtatagaaaagtcatgaacacattttgacaataagaagaatcatcaaaccaattcttgaattcacggacgtaccaccgtgtctctcggtagaacctccttgtgcaccaaaccctctcacatcagaaacagtaacacctcgaatcccgattttcagtaaagcctatttatttatgaaacagagaaactcaagatttagttttggatttttcaaaagtgtaataatcatctctatatactaaggaagtaacaagtaccatctacaataactatgagaaccataaacccttcaattcaaattcacatttcaaacactagagaaacgaagatttgaccagtcctgtcgagttcactgacattatttgattttcgcatgcatcgataagaactactactcttacttatttctcaaaattctgttttatagtattcaaaatccacatttaaaacactatagactcttcatggataacaagtaataatggaaacctcaagtgattagcaaagttcaaatcttttcacatatcaaagttgagaacaaggaaaatcttaccgatgaaacttgctggattctccatggtctttatcagtccaacattcatacatgaacagagaagaaacaagcaacattgtcacaattatgagctttgattggtacatcaaaacaaaaattagaagcttacctgacaattgcttccaccttgtaaaatttcgagtctggaatataatctaacaaaatatgaaaagagaaatgctatgaacacacaaaagaaaccaaattgatcgaaaaaaggatcagagactcattactgttggcttaccagaagatatttgggcactaacgacaggtaaaacacgactgttattactcggtgactttgtgaccaaatcgaggcaagatggtcgggaatgtctgaatccagaacaaatcgaaatgcaatcagagaaagcaatgttctttcgatcagaatagaaaccgagagaagttattgagatgggtttcgtcattgacgccgccatgattctagttttttttttaacacaactttcagagtttcctctttaccaactgatttcgaccatcgaaagcgacgacgaaggaggtaattattggaagtggaacttcgaagttgacgacgagtcggtttagctaataaaaccggtttagtacagaaattgatttccggtttagatcggtttagtgaagtggctctgatggaatggaatcgaatcaagtctgctttaaagttacgatttttcgatctcacactggttaaggtgaaacaaaaatg

SEQ ID NO: 5615 - DNA, 3000 bp, Unknown
  misc_feature (1)..( 3000): cDNA_ID_2053495_gDNA_ID_1620806_Annot_ID_168850 3000 nt of promoter + ATG
gtgtctggtggagtgacacgtgtaacttctctctttgcgctgttgagctccacggtgtaaagcgcagaccaattcttgaaataacgatcaggttgctcgtgagcagagatgaaatagagtctgttgttttgagtgatgataggacggtcgtggaagtagctctctggagctccgggaatctgctcgggcttagaaattccggatcgggttttgtaaatcctggcggatccgtttctttccgaaacaaagacgacatcatcgcttttatcgttgacgaattgagcgttgaagttcacggaaacgccgtctgttaaacggcgttcgacggaggtggctatgttgagagagaagacgtcgaagccgtagtgagttcgaccgacggtggtgaaaatgatagtgcctttgggagtttccattgtcgagtttttgatgaattgttggtggtaagtgattcgagtatttatagaaggttgtggaggtgtttgactatttgactgagtgtgaagtgtgaacggaacaaaactgatccgtacgtgcgtgtgtaatgacgttgcagtcttcataggatcttttatcgttaattacgtggaaaatcgacgcagaagagattcatgtatgtgtaatagaatgtgagaaaattggttttgaatactaaacagtggatttgaccaaagacagagaatgagctaatgaagttgtgacttaacaagcaaaatcgctgtcgtatacaccatgtgtaatatctcttctagttttcaccaaccaagtattaaataaccaacaagaatacaacatcaagcaatagaaggattgggttttccggcgatcagtaaagtattttccggcgagatgcttgccgggatatacttcactagctttgaatttaatccatgtttcttaacccacttcatcctccctgcatcgatgatctgtttgcatttgaatcctaaaacagctctttccatgggtttcattttcttcacaacttcctccacgctgatcaaagaagcatctcttacttctccttcttcctcctcctttgcactgcatcagaagaacaatcaaatatgaaacaacttatatgcagtaacttctttatcatctttaaatccaagaaaatgttactttgaatcaagaaggtcaatgtcatcaacaccgggaagcttggaaccgtgatcatcatctactgcccagctagtgaacgaagtcatgatatggaactcgtccttggaaatccccaggctaaggatatattctttatctgagagacacataaccatattcttgattaaatagagaagttatataataatctgatagatcaaagaagtcacagtgactgtgagtttacttatgtagcttttccattgggaaagatgatggcaacaagtcgcaatagcgagacctctaagtactgggctttcaccatcttgtctggataaacaacatcttaagctcaaatctattatcgacacataagaatgaacatcaattagcaaaaccagatgctataaatgaagtggaaatctaatagtgaaggagcaaagacataagcatgtagtgacctgttgcaggaccacagagatgtttccctacggccacataaggaacaccgtgcaaagattcaaccgcgttaaggttcaaatcctcaactgaaaacacacaaggttttttccatcattaatacataacctggaacaagtaaacaagaaaaggtactagatttacgggaaccttactatcgattctcatacgctctaatactaagctctccttttgcctcaatgacctatcagcctatatgcgataaaacaaatgtggactgaaaaacaagatagattactaaaaataacagaatgaacacaaactagcaagcttaaccaaccttaagcttgtaagatttcctctcaactagatacacttttttgatcccatagcaatctgctagcatctgtgttaagtatcctctcccagcgccaaattcaacaaccgctggcgcagtattatcgtctttctcttccagatcgctttcgcaacattccacatttatgttgcacctcttcaatacaccaatctcttccaagttaccaagaattgaaccttgctgcaaaacatgtttctcttgaaatggtaatttcctgccaaacaatatgtatcagtcccgaaacttctcctcgccctatccatacccaagaaccaaagctccaaactattctaaccatttatgatttacctatctatctccttattaaaccatatgttacaagcttcaggtgacaaatacgaatcttcgatatctttacaaataccgccatgaacatcctcaattttcttaataagctgatgaaacttagaaacactcatactatagagcagatttctcttcatctctgaagtaacaagagaacaagatcccatcttttcttcttcttcgtcgttcccagcattaatacccttctgataaaatcgttgaccagacaattctacagtttgtttaagtaaaggacatctctttacatgccattcgagattctcctgcaacacagagctaacaaaattcgaatcaaacagttgctacaatagcagaaaaattgcaaactataacctttgaaaaaaaaaacaaagtatttgactcactgagaaggatcaatagggcatggaatccattgaccttccaatctctggctatggtttccacaaaacctgtttgataactttgaaaaattagctcctcactaatttgaacagaagaaaaaaacgaaactttactctttcacttacatagaactctcgattcgagtattcgcgcatgatcttttcttcttcggaagccagaaactgcatcgattgctacttttcgcctccattctctcagccagagttttgctcttgagacaaaggagacggaggtcttcaacgggtcctaaaaagggctttttttggcccattaagagcccatttaagtttaaaatcgaatcaatctaagcaaccatttgaaaa

SEQ ID NO: 5616 - DNA, 3000 bp, Unknown; identical to SEQ ID NO: 5608
  misc_feature (1)..( 3000): cDNA_ID_2053503_gDNA_ID_1620806_Annot_ID_168847 3000 nt of promoter + ATG

SEQ ID NO: 5617 - DNA, 3000 bp, Unknown
  misc_feature (1)..( 3000): cDNA_ID_3077901_gDNA_ID_1620806_Annot_ID_168841 3000 nt of promoter + ATG
ggaggaggaggaggaggagggattttccggtatgggttggaggcggaaacgtggttgtgggctgatgagtggttccatttaccaacaaattaggaatctctgaatcttgaaaagctaataaaaatgaaatcttttaccaaacggaaaacgccaaaagaaaagaaaaaaacagagagaggagtgtgattggtgttttggattagcaatttgtttatagaatggggcacacatagtatgccacgtatgaaaatcagatttatcgtcagaccacatgtgtattattattgttagttcatggcttcacgcaagtaagtgtttaggtttagattggtaatggtatctatatatacatttttctaatcattttagcaaataaatcctctacttgacacttatttacaatggtataccattggcattaattcttttttctttaattatttaatttgatttttaattctttatttaatatatcaatcacattattcattcaaatttaatctaaacaacaaactttaaatcaaatcccttaaaattagctatacataattatttaaatgattattaatattatactttattaaaaaggtaaatattataattatttaaagtttataaaacgtttataatatttaagagaaaaacgtttataatatttataaaatacaaaactatatgttacatatagagaaatattttagatgtaaaatctataaaaaatcaaataactatttgaaagacaccttttaaatttatttgaattataaatcttttaataaaaatattatttaaacaaaaaatttaaaaaataattattaatttcaccgaacgggattagattgtatgacggttttagaatattaaaatatatgaactttataaattataacaattaaataaccatttaaaataaaaagtttgaaattgatttgaattatatataattaaaattaaagtattattaaaacaaaaataataaaataatatttaattttattgaacggggttagatggtagaacgggtttgggtcgatagtaatattagacagtatacctaggatgaaatccattaaatatgtttaatttcattgaacggtattagatggtaagacgggtttgagtttatagtaatacgacacgttatacaacgggtgaaatcctataactaacaattaaaatacaatgatataatttaaaatatatgacaaaagaaacaatcttaacaaaaatcatatataattttaaattttaaattttaaaaatcgacttacggtgtactccatgataaaatcaagggattgtacaatatataaaaattatgattatatatttataaaatacaaacaatatgttacatacagataatttataaaataatatatttttagttatttttaataaaataaatagtcccgcggtacatcgcgggttaaaatctagtttttagtgcaattttgcaagtattttgtcaatttaacagtatagtgttaataaaatatatgatttttttgttttgttttgattttaaaaagtataaataaaagaatattagaaaagtaaatgagttagtattttatgttttatgtgtttccaccattatgtaatttacatattaccaatttaccaatcgaattttttgaagggcaagcaaaatatatgtgacaaatttcatttcatcgactatacgttatacataattaggccttttattgactaactaggcttgcttaaaggtccattaagattatgcatgtttaaccatttaaggcttaaaatacaatgttactgtcaatggtagtcttctaagtttggagagatttcttttccttgggtttgttcgttgttgatgaatatgatagcggtctcgatccatcttcattctcattcttgagattggtgatatttatgctctttgtgactttgtccctgttttcaattttcatgatctatttagatttgatcgcgttttgaaatgttttcgagtttttttcatgaatttcatgactttgtccatcgtcacattcagaaatgttttcgagttttttttgtggttttgcttgccatattatgaattttttttttctatggtttcgaaagattagctaacatcgtgatagaagatggttgatttgatgttaacttcggattggccgtgggtatctttggtaaatctcatcgacatatgcttgagaagaagagatttctttgctttctttgagtctagagggtatgaatgtatgatgatgaagtctggtttcttttgttcttagtttaaggttttgtagttcgatttaaaagtttatgcttcgtattaatttatagtgtcttaatttgcatcccttccatagaatctagattccaagaaaatcacttttcttccggctgtgtttttggaatttttttttttgtccacgatttaaatttttcttatttggacgttataatttttcgtggttccacgacaaatttcattattaaaaatttccgatgacaaaacaaaaagaagggattcgaggatcatggaatacacgaccgagttgaggacaatggaaattagtagagcccatgacacaaacactgatgatactttcatattttttgtaaggagttttctacttaaaaatacaaatcatgttaaacattatggtcattattaatcaacattacatatataccataaaataaacaaacaaaaaaaacaattacatcaaaatcatgatgaactatcaaaatcgtgtttgttgttagccaaaaaaaccaataaaacatcccactgttgcgcctcttaaatttttgtttatgtcacacctaataacagcatctttaaaatactatttatctgatatcccacgatgtccttcttgattttgtatttataaacaaattaaactatctttcaatgttttaatgaacccatatttcacctgtttatatgatcccatatctttcaatgatttgactttgtttcattgataatacttggtgagtcatttttcaatg

SEQ ID NO: 5618 - DNA, 3000 bp, Unknown; identical to SEQ ID NO: 5606
  misc_feature (1)..( 3000): cDNA_ID_3077905_gDNA_ID_1620806_Annot_ID_168839 3000 nt of promoter + ATG

SEQ ID NO: 5619 - DNA, 3000 bp, Unknown; identical to SEQ ID NO: 5605
  misc_feature (1)..( 3000): cDNA_ID_3077909_gDNA_ID_1620806_Annot_ID_168838 3000 nt of promoter + ATG

SEQ ID NO: 5620 - DNA, 52 bp, Unknown; identical to SEQ ID NO: 5598
  misc_feature (1)..( 52): cDNA_ID_1828945_gDNA_ID_1620806_Annot_ID_168834 3000 nt of promoter + ATG

SEQ ID NO: 5621 - DNA, 3000 bp, Unknown; identical to SEQ ID NO: 5601
  misc_feature (1)..( 3000): cDNA_ID_1031484_gDNA_ID_1620806_Annot_ID_50550 3000 nt of promoter + ATG

SEQ ID NO: 5622 - DNA, 3000 bp, Unknown
  misc_feature (1)..( 3000): cDNA_ID_1828883_gDNA_ID_1620806_Annot_ID_50551 3000 nt of promoter + ATG
acagcgactcaataaatcaagtcaatggtatgtgtttctggaataaatctggtgaagtaatattcccacctcggaatttggtagaacatatgaaaaacataaaaggtagaaagccaaaaccaaagaggaagaaagggaggcatgactctcctacgaagaagaaaaaggttagtaggaaaaggagggtaatgcattgtcgtagatgtagtatggctggacccagggcttccaaatgcccaataataggagtggagaaatatttgccaccaacgaagaagaagaagacatcaaacacaatgggagatggagaaggaccatgcaagtcaagcaacacaagactaatatcagatttcaagtttctctttctcctttcctcaatctcatttttgttttcagttatttattaccaaattttgttggtttttgtagcttgaacataaattatgatgcagtttaggacattttacttttcggattttcaatgcggtggtgtgttttttggcgacatgtaacacaatcttatggtctcttgttctttcggcgatatgttacccttgattatgaccatttttctgttaatgacgatttgtttctgttactttcactttcatatgacaattttttcattcaacatacaaatacaaatagaactacttagcctgttgcttttaaactctcgtataaaaacacaattctaaaacatacaaatactatttagtctcatacacttacacacattcatcttcttgaacctcaaacattacaacatacataattctactgattctagctcacaaactcaatatttagtcaagaaaaacatgataatcaccaaagctaattatcagagttcttcaagatctttagctgcattttgcactctcggatctccttgtcaaccacagcctcacacacacgcaactccattgcaagagtatcaatctcaaattcacaaacattgaagcctttttgcaatgtgattgaagctccttcaatgttatcgactttctcaatcaagtccttaatttcttcgaccattgacatatcaagccatttaaatgtatgactccaatcctaaaatttagaaaaatataaacacattacaaatttaaagttgcagacataacacaaccgatttctatctctccaaaaagtgagatgtcacacttaccccttacaggattttcagcagtcctcgatgttctcataactacagattctcatcatctacatctctcatgcaaacctcttatgagattatccatgaggtcttcgaaatccgtaattgatgacgagaaacacaaggtcactgagaaaagatgaataaaaagatgattgttaggatggacgaactcaatgcaaaacgacgttgttttgtcaaacactattccacatagtggttatgaaatgctgctttgtcgtccgactaagctattttaacggtttgactaacgtccgtttaagttaatgttggttttggaacttagtaactagtatatgtagtaaatttgaattttgttaactgttaaaataaacactcattgtatgaataggaaaaatcaccgtccacatagtcatagttaaaataggcccttttacccgtgtacacattgtattcttgatgggctgttgagaatcttgagatcggcccagtccatcaaactttgattttgtttaatacaagtctaatataagataacaagcttaataatggacatgtattggacttggttgagtaaggcccattataaatccataagggtgttcaaggtagtacatcatctcatatcaaaacaactgtaaggaagaaattcaagtaaacgagtttgtctactatatctaaccatgaattaaccctagtttattagcggattagggttgagttttacaacacatttgtttaattaaagcaatgaaaacaatgcgattatgggttagttataatgtgtggttaatgggtaaacccattaggatttaatacaagattttttttaatttttttgagtatcacaaaaaagacatacaatcttttttggattgatttaaaataacaaaaagacataacttaattcatgattgaaaacattatttagttgaccataagctaaattaaatctatggtaagttgttaactaactatgctaccaatcacacccataataagtactataaatattctgtcttatccaataatcatcccaataagtctgtacgatatctaattttccataacggatacaaacaataataagtagatatctgagtagatctccgcaaatatattactttttctgcaggatatatattcaaaatccaattgctcaatatactctataataacgatcactgtatgtgtaatttaataaaataatcctcttgatgacaaaaataaaattaaaataacaacgatcatttgtctcattgtagcatcatagtttgccaagtagcattacattacatgcacgtagacatgaataagctacgtgtgaataatatgacattttgtttcttaatattactgactcaaaaaactataatattattctaaagtttctttttctttagtagtttcttgatcttgcaagaacatcatacaccaacttcttttttcttccatcttttcgtcgtcgaaactcgaaagtttcatagaaagtttgtatttaccatttacggaagatccttcgattatagtatttcgtacaaagatatatcagtttccctaattacgacaatcatatatatattatccgtatttattacattgaaatcatctccctatgcaagtaaaaatctcattaatacacaaagaagattaggtaatcaataaatgtaattagataatacgaaatatgaagtatggaaactcggaggatcttccgttataattacttttatccattttctctgtatatatatagaaagcaaaagaaagcattttcatcacctaccatcctctgttttcatttcctctgtttttcaaacttcctctgttctctcatg

SEQ ID NO: 5623 - DNA, 3000 bp, Unknown
  misc_feature (1)..( 3000): cDNA_ID_1828875_gDNA_ID_1620806_Annot_ID_50553 3000 nt of promoter + ATG
aatccctccattcatatgctcatcttcattggactttcttgcatcatctttaaacctgggaccacccatgttctttctttttgatgaatcccccttttccaccgtgtgaacattctgagtattctcaccttgccttgatgattcacctacttccactaggcgtggagagtgtgctgcaaatgcaggtccggagaaaggctggatgttagaatccctttcatccacattttttctaagaggtacctgaggcaaaggacctgcaaagtttggtaaagaagtagctcttgtatgagggtaatatgcagccaccaattcatcaggatttaaaggaggatgaggaatccttggaggtggatcgataggagtaggaaacgaactctcagacatctgagattgtgaattcattgaagatctcagattttcatctctcatgaacacctcttctctaacattcctttgagcagtggagttagtcaccctatggagaggctcaatctgacggtaaggacatgagttcctgtgatgagtcattctgaagcagctactacagattctcctaagtctttcatactgaaagcttatcagagcagcctcaccaaaatcaaaaatgattctttggaaaaacctcaggcgatctgtaattccaaaccggattctcacacggatataagctatttgagtcgtggtggagtcatgaaaatccagagtgagaatctttcctaactcatgtgctatctctaaagcagtttcctcacacacatacaaaagaggaattccacgcatctgaacccataattcaatagatgttaacaggtgaaacgtaagatttacctcccatctatgagttgtcacaaaccagttgttatacaaccaaggttcccttcgtagtactgacaggagatcaatcgttagagatgtcatattcaggtttacaaaaaaaataactagatttctatttctctttcacatgtccgacctttcttgtatgaccttctaatattttttgattttccacaaattcgattaatttttacccctttgaacgttatagatgtcaaccgttttattctttttcacaccgtaatgtaaaacctcacatgtacaacatttcttataataccctttgatattcataaaaattggattagatcttagttaaagaaattttgtgttttctttcgtaatcaaagctagaatgttgatatacacaagttattacacaacgtaaaatgtcagtgtatggacataaaaacgatatatttacgctaaaggacactccccggattttaatttccggcggccagcgattgagcatgtctcaaaacatggttcattaacattgccatcatcctccggtggagctactccgaatttgaactgttatgattcaaacatgaagttaataactggccaaagaagatgctaatagaaatgggaacattcaaaaacatcaacatgttaattttgattaataccagttgatgaatgacgataagtaaatccatgaacttagagttgatatgtctattgtttagagaaggggcaagcaagatgtacctggcaactataatctttgaagtttggttccatcaccaaaggaactcccatgtagtctttaaagaatgtctggaaaaaaaaacgaaatccacattttcagggattaatcaaattcatgtcttgttacagtaataatcggttgattggcttgttaaattgcagaagaatacctgagttggtagtttacatgtattaatgcatactcctacacacttgctttcttctagatactgacatttctccacgaaaacctacttggattcatcaaactcctcttcgttatcaaaggatagaaaaataactgacaaaacaaatcatatcgaaacagatgcatagttccagtatcatcattaccccgctatcccaagattctccattaggaagatcgatgatgtttactttgctcggtcccatgagccattgacatgtaagtacagtaactcttgcttcaatgggaaacaaaaaacactaattgttaccaatattttgacaacttttcattgacatggaagattgaagaatcaaaagaactcaccaaccatcaaagcagctaattttccttgtgctataggagcaatgagaagcttgtaaagctctaaaattagcggaggaaacaacgatttcagtattcgaacctgtatcaaccaaaaaagaaccaaaaactcagaactttaacctaaagtgtctataaatataacttctcaatgagaaatgtaccgcagcatcacttgtctccgacctagtacgacctttcaacaagagaagcttaaccaactcaataagtccaacgtacccgggtttctctgaatccgacccgacttcctgttacacatacttgaacataaagaagatcattagactaatgttaaaacctaattaccactccaaatcaaaacactaaaattcatgaagaaaccagaaaaaaaaaatcgatttcacaactcacctcgaccaatttgttccggaacgattgcatgaagaaatcgtcgagaggtcctggcttatactccaacttcggagctccttcatctgatttaacctgagaatcaaattcaaaatcacacatttcatatatgtacaaaattgctcgaattgagatttaaaaaaaaaaaatcaaattggaaccacctctgacgaattagagatacggcaacgaagacgacgcgtgagtattaactttgtagaaaatgagttggagaagacgatagtcgtcggaggaggaagaagaacctggataagaacagccatttctggccttacaagtttttctgctccaataacaaaagagagacgattacaaaaataaactatatgtcgtttttagttatataaaaacgacatgaagttcgacttcttattttctaaaagccttttaaaccctagcaaaatcatagattcgagtgagactcagaaaaaaattcaaaatccgtaaatctgatgatg

SEQ ID NO: 5624 - DNA, 3000 bp, Unknown
  misc_feature (1)..( 3000): cDNA_ID_1829007_gDNA_ID_1620807_Annot_ID_50555 3000 nt of promoter + ATG
tctgtttctgccacttttgaaacagaggaattatttacttacatggttttgaagtcaagtcttaagatgtgatggaagaaacatgacaggattctacctttgcctctatggctctatagactatgtccatcactgctgcataatggcatattttttacatatccatttttccaagaaaagagtcataaacttatgcatgataaatacagttgacatgatttccatgaaatctaacccagcccaacaaggcccataggtagaacccatccaaaatccagcttatgagtgagttacatgtgacatttagtcactcccaagtcctaacgccgatgtgagctgtgtaaagaatatcaatactttcactcacaggtcagacactgaaattttgcttcaacttgagtcatccaagatgatatttatagaatcaagcccatctttatggttggatatcccaatctccatgaccactttgatcattaaatatcttccaataattatacgaactagcggactagtcaaatatgttaatcctaaaaaaaacatttgaaaagtcacattttccacctgttaagccatgaattctataaattctatatgagttaccacaatgtttctctgaacaaattaccgtgatgaaaaaaaaagaatgaaagctgataacaaattttggtcaagttgacaatgtttctatcgttgcttggaaaaataatacgagataatgttttgtgtctatcttcttcacatgcaatcttaaatgaaattagtatattgttacaaacgtcagagaaacaggaaaatgacgggagaccttgttaaacgagagaaacaaaacgtcagcatgttagttgagctctgtcaccatatatttatgcatatcttttggaactcttcgtatatatcacaagcatcaataatatttttttctatcttaacccatttttatttatattaaaaccgtgtaaggaaatcgccagaaattgcagacctgtttcgtccttaattgcggatctcatcaataggttaagtagtgacaacttgttgcgaggataatagtagtgatggttttcgaagatgagttatcccaaaaaaagaaaacaattgacgtggtgataataagtgatcaataatgtatgtaaacatatgaatggtgagaaacgtaaatgtttattttcctagtaatagataagatacttctagtttagagtggtccactactgtctctttaacaaaggcatgatgaaaaaaaagttcctacttgcaatttcatgtttgtttaattttagtatgactcaaaaattgaattattgaccaataatctatttgatggttcgttttacttttattattttttgttgaaagaacaaatttgagagaaaaaagcttagttaaaagttacttttgactgagcgttcgatgctttttcatctaaaccacttggaactcatcaaatagtatatttttgcttatatatacgttttcatatattgccaaacaaaattatattgttacgatgatattgtaagagcattataaggattaagttgagttaatatgtgtttagctatgtttggtttaatggaaaatcatgtgcaactagcaagaataatatcacacatcactgtttttgactaatggacaaattggatgtgacacttaatagaataattctttcttggtagttgctatgataactatatttgtcttaacgtgagaaaagaagcgattggattgatgaggggaaataagttggatatgatctctgaattcaacaaacacacatcttttacaatgagcagatgactaaactttaatacactaatatggaaagttcgaaggaaaattaccttggatgatgatgatattcgagtccagcaaacacgctttgctcaaaattgttaatccaaaagaacaaaagacatcatatctcccaatatttaatcatgactaaacaatagtaataaagctacataaatgtataatttatgattcagttaaataaagttttatgtattttatcaaagagagtccaaaagtcattttatatttacttgtcgaatatttattgtcacatatacatatgaaaacgacccagcagcttccaaaaatttatgacgttatatattaaaatttaatacgttattagatgacgtggcagtttatcattggctaaccagaaaaagctgcaagaaaggaaatgtgttactataaacttggcgcctgtcttgtagccgttgctttcctctccggccttttctctctcctctcttcgaccgtcgtcgccggagacccttttcaagcggccaaacaaagatgcaagcttttttctttaatactactgtagcactatcgcatccgatgctgttttagattttgggtactctgcttctctttctcttcatcttcctctgttcgtcgtcaggtgatccttaaatctctgagtctcttttcactgttttttattttgttagattctggttattatttgattgtgcgtttcacttatccgattcctaaggttttaaatttgtttccacttgacttgacttttgagtgtgctcctccgttttctaggtcgtgtaacccaatttcgttttttttttttttattggagattgttttaaggctttcgaaagtttaatcctctctgtttctaggaccagtaatttagctatggattgtcttgtcgaattgggtagttaaaatatctgttttttgcttttacatcgtcggctactttactggtttttgggggacttcgttggatctttcacctttctttatagaaagaaaacagcttttcgcgtttattgcgcgtacagtgatgtttgcttttctgtggatgaatccgaaattcgcttctctgtgaaagtaaatcttactgttctggatattatcttggatcctagtctctctctatcgcttatgtttgagttcacaagtctctcaaggttttaacaagtattttaatttggtagctgagtttgattgtcggaaaatatg

SEQ ID NO: 5625 - DNA, 3000 bp, Unknown
  misc_feature (1)..( 3000): cDNA_ID_1829000_gDNA_ID_1620807_Annot_ID_50557 3000 nt of promoter + ATG
acccacaactacaaagcaaagtatgtatacaacaatcaaaagagcctgatcaagagcatgtttatgctttctttgactcggatccaatttcgaaactatctgtttttattgatcttgaagagcaccatggactgtattacacattccaggattcttcaaacaccacaatggttggataggttcagctccaatccctctcttaaccatcctatacctccacaggtttaaacggtccacggcttcaccacatctcttaacacctctctcgtctctattccctgaccacaagctctccgccaacgcagaggcacgtggccaaagacgtgagtctaaaaccgtcgagtcagcttgctctgaccacaatgcaacctctcctcctagcaccagcttcctctcttcctcattgagcaaaccatcagctatatcatagttgtatatgctctgccacgtcttaaatggtgcacaccaagacccgccaccgctttctttctgatcatatatactatcattccctagaaacccgccgtgaccacagtctaagtagtagaactctgatgaagagacaattactctgtaaccagcagctacgattctctttgtgttctccggaccgttattccaagtctgtaagattgtgtgctctttaggaagaacagatggatccgccttgatttgtgcatccaacagaacatcttcccagtaaacaactgtgcggttctgtgacacgatgtaaggtaatgtcgagtttatgtacttttcaagaagctggcttagtgttccaccagaggacaagaaagaattgatggcaggatcggttttccaacagcctgggataacttcatctccacctccatgaaagaaagattctggaaattgattaacgatatcttgtatgacgtttttaacaacttcatatgttttaggactcaaagggttaagctgaccagtcccaggttcactagctaaccgctcttcccaactttttccagcaggccaccagaacatattggcacatgtcacaatttccgggtaagcttctccccatgatcctgtatgacctgtggagttttaacagtatctattagaaccaagctaagttcttgtgcaagagaaaatcaagaatggacttaccaggagtgtctatttcaggaagtactctaacaccatgctcaaaaccatactgaacaatctttgagacatcctcgggagtgtataccatgtctggtccaagagatccttttgcagcaagtgaaggttcagaaggaagcaccagtggaaaagattgtgaatcagtgatatgccaatggaacacattgagtttgtttgcactcatggccttaatagtcctcattatatcatctactccatagtaattcctcgatgtatcgagcaaaacacctctatggccaaacagaggagaatcctgaatataaattccaacgggtaagcacaaatcaggagatgttccccaaatcatctgagagaatgtctcaaggccacgcatagctccccaagccgaatgagctaacaagtgcgcggagaagctgccaatggggatggagagtttgtaagactcatcaacaccgtggtgaagcggaagagaaaaatcggtaacagtgactacaaggttcctcaaggtgtatcttttcataagtttgacaggatagctaatgagaggcgagtaattctcagaacggatcaggttgtgataccgtgttacagaggccgaaaggtattggtgttcaggggcaaggatagtgaaatttggagagagtgcaatggctttatgttgaggccatgagagaaatctcggctttggccaaatgttgataggtagagcaatggagaacaatggcgaaagaagcgtaatgaagaagagtattgggattagtatcacatgaaacttggaaagagttagcatgacttgttcttgaaatcaatctacaagaaaagaaaattgaagtatgcattacagatcaaacaacagcaccaaaaacagacacaagtaaatggtaaaagctacactcctagatcagagtaaacaagaaacagcattaagatcccaagtgctgaagtgttgaactttaatgtttcaaaagcattctgaagcaaaccctagatgataaatggggttcgtcagcaaatctgattggttgtttatcaaatctccatagtaaggaaggacagagagagcttagaagtaattggaattgcagaaaaacgaaaaactgaaagcgaagagagaaactgtaacagagtattacccttagatttagcaatttgtcattcacggaagctgtttggggagagaaattgacttgaggaatctaaaaattgcttcagtctgttcaaaacttatctgtctttactctacaaagtcttgtgaactactttgcttccagaagatctggattctggattgatttgatacttttgcattatagtaataaaaaaattctcgttgcatatttattgtattctactacttgtctattttaattattattaaaaaggaatcttattgtcttatgttaataataaattaataatagactaaactatcttattattgttaagaactgccaaacaaaaaaaaagaaagaaaaaaacttgtataatttgttaagaaaaaaaacatctataagtttgattgaaaataatttattcgcagattttgtaaccgtacaattagaaatcggacaaaaatatgttgaaacaagtgatcattttcaaccagccgtttaaaaaagcacctaacagcaaaaacataaatctgataagcccattttaaaacgagtggttaatgaattccccaatgacaactaatacatcatctataattagccatctcgtctgaactaaaacttggaagaggttgcaaattagttgttattgcagtctatatgaacccaatgtttcgtctgaacctaacgttgggttcaggcagatagtattgtcattttttttggggattccgaccagccatcgtaggaggagatg

SEQ ID NO: 5626 - DNA, 3000 bp, Unknown
  misc_feature (1)..( 3000): cDNA_ID_1828996_gDNA_ID_1620807_Annot_ID_50558 3000 nt of promoter + ATG
gaagaggctcgacgactagtgacatcactagaagcgcgatcgtcatatgagtatacatcggactatccagcgcctgcaaatggtttttttagttggagaaattaaataaaattgaataacgctgaaattttactatttgaaaaaaaacaatgaaaattattgctgacaaaaacaaacatactttgttctatgagtaaaataatgtttagaagaataatgattccttgacaaaaaaaaagaaagaataatgattaatgaaatatttctctaatgttttcactcattcgtatgttattcaactttatacttccctagactcgaaaagtgtcatatgcaataaaagaacgttgattgattgattagtaccttagtatcgcgaccagcattaagaacgacgagcgataaagttcccttggtgttcataagggctcctatagcgaatgcgtcacgcataggtatatgcataaataaagaggtgattacggtagtcacgatctttactaagaaggaagagcagatgactacaaccatcatgaacttgtcagtaaactggagcatgaaaccaatatctgctcgcaacccacaaatgatgtagaagagaggcataaggatcccggaaaggaagtcatggagcttctcctcgatcatgttacgtatgatgtggtcgtgcggaatggagagaccgaacaggaacgccccggttatggagtggaccccgcatgcgtccgtaatcaggccgcataggaccacacctcctaaaatgaaccaaacgtgagtgtctccgacgtgacctgccttcacggtcttcgcgaagatccatgcaattcccggacggatcacaaagatgcagaggaggacgaagattgcggtggtgattatcacgaacggcatcattttgttccatgtccctttttaaccaccaacaaaaaaaaagaacaacgaaaaaaatcatcagaattcttgaattaccatgcatatttttgctatatttctttttcgaggaaaaaataggattcattccattttcggccagtggatatttattttaacggttgtaggtttttgggtatgagtttgagttttggcatggggtcccaaaaagtttgaactaattgtaggaatctttacctgatttgctaaaagaagcaaacccaaaaacaaggaggacccatgtgcacaaatcagtgacaatggctgcacacatagccgtacgacccatatcggaccgcaacagcttaagatccgcaaggatccttgcaaggtcagggaagttggtacaggctagcgcgacagaccagaagacgcaaccagagatgatcttgtctggatggccatttcccgggagatagtaaagaaaggcaccaaccggtaaagcaacaagaagccctgtaaaagcaatgatgaccggtttgagctcggtgatccgcaccatcctcaggtccatccctagaccaaggaggaagatgttgtagacgagagctaagttagcgaatgtctcaagaaccattgtgaatctgtaggggaatacatgtgcgattatgaaacgtgtgttcccgagcacacttgggctaaataataatccacactgcaaaaatacaatcacaacaaatcaagacacatacggaactagagagctaaaaaattgatgtagcaaaaattgcatacgtacgaggatctgagctacgaaaggaggaagatacaagggtcgggttagatagtagaggacacgatagctaaggttcgcgacaaagagttgcgttatgaagaacggaagggaagaggctagcgtacttccgctctcccatcccttttgttctctcttctcaaagagaagactttggtcataacacacaatctttccaaaacgcgattcttcaatatcatagttaggatttgtcacattaaggggggctccggaagacatctcctcctacgatggctggtcggaatccccaaaaaaaatgacaatactatctgcctgaacccaacgttaggttcagacgaaacattgggttcatatagactgcaataacaactaatttgcaacctcttccaagttttagttcagacgagatggctaattatagatgatgtattagttgtcattggggaattcattaaccactcgttttaaaatgggcttatcagatttatgtttttgctgttaggtgcttttttaaacggctggttgaaaatgatcacttgtttcaacatatttttgtccgatttctaattgtacggttacaaaatctgcgaataaattattttcaatcaaacttatagatgttttttttcttaacaaattatacaagtttttttctttctttttttttgtttggcagttcttaacaataataagatagtttagtctattattaatttattattaacataagacaataagattcctttttaataataattaaaatagacaagtagtagaatacaataaatatgcaacgagaatttttttattactataatgcaaaagtatcaaatcaatccagaatccagatcttctggaagcaaagtagttcacaagactttgtagagtaaagacagataagttttgaacagactgaagcaatttttagattcctcaagtcaatttctctccccaaacagcttccgtgaatgacaaattgctaaatctaagggtaatactctgttacagtttctctcttcgctttcagtttttcgtttttctgcaattccaattacttctaagctctctctgtccttccttactatggagatttgataaacaaccaatcagatttgctgacgaaccccatttatcatctagggtttgcttcagaatgcttttgaaacattaaagttcaacacttcagcacttgggatcttaatgctgtttcttgtttactctgatctaggagtgtagcttttaccatttacttgtgtctgtttttggtgctgttgtttgatctgtaatgcatacttcaattttcttttcttgtagattgatttcaagaacaagtc

SEQ ID NO: 5627 - DNA, 3000 bp, Unknown
  misc_feature (1)..( 3000): cDNA_ID_1828988_gDNA_ID_1620807_Annot_ID_50560 3000 nt of promoter + ATG
ctgtgtgattttttaccacttggtccatgtcattttggtttagagaaaaatgtaccaaaccggaaaaacttacacaataccggctctgtttttgtctctcagaggcatacagtatataagtcagactcggtttccttatttaccttatgtgagtgcaacgaatcatgaccgtttctttttgttacgtgagctgtaagaaataagctacagaaatgtaagaggaagagagtgtgtggttttagttttaggtgagtggtttaatttaatatggattatcccgtaagcaaaacaagacctttgaatatctcttttaaccaattgaaaaacccttataggcttatagctaaaccttaaaccctaatcttttgttttgctaacactagaatttgttttattcattaaaaacgaaggaaaacaatttttcttttttaaaaaaaagtggataatctcgaaattcgcttctctagctaatcccatatagattataggaacagaagaaaaaagcttaggctatttgacctcctccaaatcctgatagaattgggagaactcttgccctatatatatatatatgtgtgtgtgttggcatattaattaggcgtttaagacacgtacgagaaggataaacgatggttagtcgagaagaggaagaaggtgcaccatgggtgctattcatgatgagccattcactgcctgtggagacgaaacagagtgttttggaggcaatagagagggaagccagagttttcattcaagttccactaaggaagagaaccttgaggattcctatctctacctagtgcaccagaggagtatgtgactaaagaggaccctcctaaagccaatattattgatggaccacaaacgaaatctacatcaaagcgcaagagatgtcctcttttgctcccaccaacagaagaaaaacctaagatagcaacacgcaaggccaactgtcgttttgatgcaggagcatcttcttctgggacgagagagccaacaccggagtggctggtgcggttgatgagggtaaagtacggagaaaatcctataaatgtcataaataaagaactgactgcaaccaatgtcaaaccacatcaccgtcgtctctccatgcctttcagccagatcatagattttgaattcttgaaccccgacgaaaaaaggatcatagaagaacatgccaataaggaacgtgaagaaggagtagacgtgatactcgtaaattttgatcgaagggaatatatgttgaatttgaggagatggaacatggggacctctcctctatacattttggtttcagggcggtataatgtggtcaaaggatgccgtctaaaggaaggcaatgagattcgcatctggtctttccactttgatgaccagctcaatctcgctatggttcctcttacgccaactgagtccggttaacgatcaaagacaaagctaatgatggattggtgcacaagtaagctcgggtgtgtgtttttagggaggttctatgggttttttttttaattaagaatatatcatcagcttcgttttatttagattcaaattctcattaggagtctcgagattgtgtttaggtttttgcttcattgaatatttgatattattaatgattttagtttagtaataattaattttctctaataaataattgttctgcagtaaaaaataacagtaacggtcacttttctaaccgttgtgatcagtttccttttcttttttttgcagccaccaaactttccttcttcttgatgaaacgaatttcccattttaattcactaaaatatttaaataataaataacatattttcaacgaaaaccatgttaaaacttcttaaaaactagtttaagtattaaattttaaaaacgtcgaaaactaactgcgcctaggcatcatgtccttagttggtccgtaagtggtgttcgaagttctatatggttttcgcgtaatatagatttaacacttaaattcaattttaaaaaataagaataattttctgtaaaatttaaaacgattttaaacgtttaaacttttaaaaacattaaactcaaactatgttaatttcaatattaattttaaaaattggtttaagtgttcaattttaaaaacgtcgaaaactaaccgtacctacgcatcatgtccttagttggtccgtaagctggtgtttgaagtccaatatggttttcgcgtaatatagatttaacacttaaactcattttttaaaaataataacgattttcaccaaaattcaaaacaattttaacgcttaaactttcagaaaataattaataaattcttaactaaaactatgttaattttactatttattttaaaaatatatatcttgagtgttcactttttaaaacgacgaaaactaattgcgcctagacaaaaaatacataagcatataaaaaaactataagctatggttaaaaattggttggtaaaaatgtttgcttttgcataagatagaaaaagtttaatggatttaatatttttgtatcaaatatttgaatatttcttatatatctatgaaactaatttaaaaatatttattataagatttatatgagtttcacacttgcacatgattcatgtgatacagacacttcatctcaaaacctacgaattttctttttcaaacttctcctagatctccttttttcgttttcttctctcttttgctgttgtaattagcttagatcgaatataagaatatgcctctttaaaataacgaacaaaaaaaaaaaaaaaagaagaagaagaagaagctaggaatcaaatcttaagagacaggacaagttaaagaggttttaagaagatatagtttcacaagcaaaggcaaagctaaaatatgtctggaacagaaaatgtcggacgattttcaccatcacacgtttcaatctcgaaaacaaaaacgagcactttatctcctcaaatctcaaacccaattttcttgtttcttgaatcatctctgctcataatcgaaaatg

SEQ ID NO: 5628 - DNA, 2865 bp, Unknown
  misc_feature (1)..( 2865): cDNA_ID_2992610_gDNA_ID_1620807_Annot_ID_168916 3000 nt of promoter + ATG
ttccttcgctgcctccgctaatcgaccattgcgcgtgaggagattgatgcgagaagtccatgaaacagtggtctcggaggtagattgattatgtctctgtatctttggattggcgtgatttttgtgggtgatgagcgccggcgaagtaattccgacgacgggaaggagacccattcgattgagatggtgactttttaaaattgattttttccttttatctctaactaaacccgactttggacataagaccgggtaaaatagaatccggtttgatccggttttaagattttaattaaacgatagtctatctcagcacaagtaaatccaaatcaactgtatagaaatacaaaaaaacttttaaaagccctaataaacaccgttggttgcttagccgccaagtaatgctgcagctgcatcgtttacgcaaccctccatatctttggcggcatcaatcctgttcatattcagtagctttgcagcctcgaatttgtcttgacataccatgagagatctgttcatcctatcctgcattagttaaccaaatgcaagtttctcagtacatggcaaaagcttaatgggatcagttaaggactatttttgtacctgaaacttggccatatcgctatcgaattgctgttgagatttagcaacgggaacacgacagagctcaacacagttagttgtcacttctggctttcttcttttctcaaagcactcgtttgagcatttgaaataagcttgctgcaattcatcatcaatcaaaggtgcataaatctttagcgaaactcaaaagtaaaactaattaacttttctgccctagtttgttaaaagatatagcaatacttgtactaaatgattgtagaaatatatatatatatatatatatatatataccagaagggtgaaactgatatgttcttgaataggagagagctgcgactgaccagatgcatttacttcttcgatttttctcctaaccctctccaataggatttgctcttccgcaactgccatgcgatccatcgtctctctctctggagattttagggttagggtttagctgctcttcaaattggaagcatttatttatataggcgaggttctccgaccgacaagacaaaaaacaccccttcaggataaactgaaaccgaataaactcggatggggtttggttcgattcaaaattatttatgactgacgttttggttcctgcaattagctcctcagctttaaagaaagtacaactacaactacaaggtttgctttacctattcttcctcttcgaaacacattggttttaagatctttcagttgaatacagatctggtgatttgtttttcctcataccacatactgtgaaaagcttgttgttcaagatcctcataatcttatataaagttatggtctgatatactttaccactacacaactcctaccatccattgtgtttatctattgagtcatagtgaaagggcatgaatatgattagcaagagacaaaagtaaagatgcccctttttcccaacagaggattattattagtcggcaatggagaatgacgtcttcattctctgcacaatatgaggcaatgtatcgagactatcctcaatggatgtgttcacacaactctccatagctttggcggcatctcccctgttcttatggagctttgcagcctcaaatttgtcttgacagaccatgagagatctgttcatcctttcctgcatcataattacaattgcaagtttctcagtccattgtaaaattatgcattttttgtgagttgaaattatattatacctgaaactgagacatttcgccttcgaaatgctgttgagcattgacaactggaacactgcagtgctcaacacagttggctatctcctcttgcttcctatttctgtcaaagcactcgtatgcacatttgaaataggcttgctgcaattgatcaattttccgggtttgattcatcaacttaacaaataaatatgaaaacaatacgctttcatacaacttgagttatactaatatagctgtagagatataatgaaaactgtcaagtttaagtttccaggaactacttaacatgactacaacaagacacagcttccaggaacttaacatgactacaaactttcatgttattaactagacagattgtatcaaagggcagcaaaaattagctcagaaaacttagttaaaacccattataaaagagatataccacaagtccacaagtgaacttaactagaacagattaatgccttgaattggacaatatatggaacaaaaggacaagtttttctcttttgttgcgattacaagttgaaggaaaatttcggctttttcagaattggtaaattggtcacccgaatcaaaatcaacacgagcacacaaataacatacacctatgagtaggaggatcaggaatgctacaaaaaggtatatgattgttaatatacctgaagggtgaaattgatgtgatcttgaataggagagagttgcgattgagcagttgcattaacttcttcaagttttcttctaatcctctccgttacaatttgctcctccgctgccgctatgtgatccatcgtctctctcgatctcgaatgggcgattttgattctagggttttagaggttttagatcgcaacaggctaatgtgaattggggttttaacacttttcacgtcggttaagacttttttatttataaccggagatggtttcctctataccaagattgctttttcggatacttaaaaaaccggaattgaccggatcggatcatagcaaggcagcgacattagttagagtagcgtcggatctgcgaagactttgatctgttgatgaaacagagagagatg

SEQ ID NO: 5629 - DNA, 3000 bp, Unknown
  misc_feature (1)..( 3000): cDNA_ID_3077933_gDNA_ID_1620807_Annot_ID_168915 3000 nt of promoter + ATG
ggattgaatgagtgtcttcaaagagaagagagtaacaagaactattgatgtcacaacgcaaagggtgtagaataagtcaaggggttggaaacagaaagatgttgaaaacttgggagtgtttatatatttaaatttttgaaaggctttttaaagtttgtgttgctaatgctatatctaaaagcccaaagtaataatgtaatggaatagaaaagaatccataataaataggaaaaaacaaagaaaaagtacctaatccggtagccacaaggaaaaaagaggacaagaagatggtgacaacaagacaaagaccgaagccgcgtaggaccccaaacgtaccttttaaataaaacgctgattcctttcggacttttgcgtcgcacggtctgtgccgctgtccccacaaatctctattttttacacacgcaatctctacctctgcgtctgcgtttcgaaacgtgactcttctaaccgctccacgtgagtgacttttagagcgagtttggtgtccgaaaccacgcgtgcgcgtctcctcaacgcctgagtctctctatgaagttgcattgacgtcagaaaaattaaatttgtcttacttgaaacataaaaatttacagtagtaaattatcattttcataacacttcatttattctcttgtagttaaacaacggatatactaatgaaatgaactcgttcaatctaattaaaatctcattattaatggtagacgctagagaatctcattattgtaggtgttaatttatgaaaataatacatcactttcaatcactgatttgattagattgatggattttatatacagcccatgtttttaacctctctagttgaaattttggttgattttaaagagaagagaacaaaaattcaaagacgaaaaaagcaaaaagtggaaagtagaaacaaaaagactgatggtgcagagagctggtcaaatatgttgacaaaataaaataaccttacaatgtcactatcatcaataaatgaaaaaatagttctctctatctatctataataataataataaaagcaacttctacctgggactgatattaactacgaagacctctcactctctcaatgggttgtataatagctgtcaaattatgatgtatttagtcacaagacaaaagactgattctgaacactaaagcctaattagggattagtctttactctttagtcatctgtttcatctttattattaaagtttgcaggagttgtagtagatggtgtgggggcaatatatgcagaacatgcatgcttccaaaatgtcctaactacgtcacttaaggttccatttttttctatctaaactaagaaatacttatgtatctattaatctacatctaattggttgtcaaaaaaaaatgtatcatagaagtctttggagcacataaataaaacatctggagattttctgaacataatgtgaggtcaagaatttgtgtgcaaaattacaattttcaggcatgagtggctctgattttgaccatttgaataaatttgtagcttgttataacctttacactcgtaaggaaaaaattatcaaaaaatattgatagtcgataaaattgaaaactctagatttatacaaatcaataaataaatttgaaaataattaaatgagaagtaaatgacattacttcacccaaaaagagtctagacgaaaaagacagacataaaaataagtccccttctatttgtttggagcataaacaaaaacagacacagtttcttctctctctctctctgtctctttccttttctcacgccgagatttctgcgactgctctaatcttacgaccttataagaaacgacgcttattttcactctgcttgagctcttcatcgtgtcacacagcacgatcttggacgtcgttttaagcgcaaaacaaaggaaaaagactgacgtttatacatactaaatactggtttggagttttgccttttggactcagaaaactcaaaagagagagagagacatttctgtatcttatcgggttttgtgttgtcagaaagaagctcaaggacaaaaaaaaaagcaattatttttagggttcaaacgaagcaaaatttggaactttcagaagttgtgggtggtggcttcttgaacaataaagctttttcttagactcttcttccaatttgtgactctacctatctctctctccgtaagctctttctctctctctttattcgttctttctttatttgctctgtttctttactccatttttggcttaattacaccaaatttagtctgctaaaagctaatttcaagcataattacttatctctcctcttcttgttgctaaccttcagttggattaggttttgatttcgtttatacgacaatccccgtgactgaaaaagttaccaactttgatagatatcgttaccagattctactcatagttttgttattgtaatgcaagaagttgagttcttgtttacattaacttcaataattcactgagagtgactttttgttctcctctgatccgtggaggattctctatatgtgttttgttttttgggggggttttctcctgtttttagggactctattgattcatgcatatatgatgttattctctgtttatgagtttatgcaaataatctaagcaaggtatgataacatatttaatctttttgtttgagcttataattgtgcttagaaatcttaaaataatgcttaagctgatgtgaacttgaggcctagcctctgaccacaaatcctagcctacttcgttgaccatacctttgtcttggcttaatattctaaatttctcttccaaatcctgtctcccaatgcattggttggtccaaaacaagatcatcatttcatagatcttgtaatctttctggtctgtaatttgctctaggatggtaaccttgtaccctatgtaacatgtcttgttagtataaattttgggtcatgttgtgttgatgactctttagcgcatttcttattgacaaaaggt

SEQ ID NO: 5630 - DNA, 3000 bp, Unknown
  misc_feature (1)..( 3000): cDNA_ID_3436416_gDNA_ID_1620807_Annot_ID_168913 3000 nt of promoter + ATG
gttccgtggcgaccaagatgtgcggaacagtgaccgaggtcgatgataatgcaattcaccgatatatgttgacataattgttttagtttattagtttatcgttagcatgtgacttatgacatgtgatatatcaatatgtaactcgcaacatacgtacgtgtatatcagattctttttgtcatcttccctgagagagagacactgcatctcagcctctcagctatgtattactgttgatgtcattgcttatgcaatccgaatccaaattgtaaaatcaaagaaaattttctatttctttctatttacattacctgttaattcgtccccaaatatttttgatgtcactcattattacaaaggaacaaaataaggaaccgaaaacagaaataatgggaaaaaagactacttcgacaacttccggcctttttatatttaacgccgtcccactttggaacccaatctatccacgtggagctctatcactggtcattcttaattctctggagttcacaaatttatgcaagaaaataaaaaaattgattttgaccgcctccgagtctttttacaactttttaattcgaattttgataacatctatatatacatttttggagctattttagtaaataaatccttaagttgggacttatttacagtggatgtcattgatatttaattattataactaattaatattcttaattattagcatttctttatctaatatatttccatcaattctaattacttttaaaaaggagaaatcttaggaatttattaatattatactttattaaaaataaatattatagttagttaaacatttaaaatatttaacggaaaaacgttttataatatttataatatgtgaaatgtataaaaattaaataatcatttgaaataaaacttttaaattgatgtgaattataaattttttaataaaaatattattcaaacaaaaaataaaaaaataatgtttaattttaccgaacgagattagatgataagacgggtttataatatttataatatatgaattttaaaacaattaaataaccatttaaaataaaacttttaaactgatttgaattatatatcttttaaattaaagtattattaaaacaaaaataacaaaataatttttagtttcgctgaacggggttagatggtatgacgagtttgggtcgataggtaatacgagacagtatagcatgggtgaaatctattagatatgtttaatttcactgaacgagattagatgatatgacggctttggatcgataataatacgagacagtatatcatgggtgaaatcatatatatatatatatatatatatatatatatcaaaatatcattatattaataaaattaatataattaaaatttgaattatttagttataatctaaattttaacttaataaactgtgtgttattctttctatattgttaaacagtaaaaaataaacatagtaattgtatactaaataatatatatatatatatataagagttgtacatttagaaaatattaaaatgaattatatttatttaatctactaaacaaattaactttttagtttttaaaaaagatataaccccgcggtataccgcagattaaaatctagttaactgataatcttgctgcataatatagccaccactaaatttacggtttactatcagaaatctgttttgttctaaattaaattaaattccaagatctttattttcctttacttgacacaatcgtttaattatttgtcattttattttcttaatttttaacctaaattaattaaaaaaaaagatgacttgacccttatttcattatttgtatcatattaattggtcggtcgtcggtgttatattttcaccggctagtcggtaaagataatgtgcttatatttggtgacaaggattcactaactttgatctttggtgcaattgaagatcagccatatgtatttcaaccttatattatcccccaaatcattccaacttttattttataaacattcgtggccttcatttttccactctgttgttttctcatacttttaataatttcttttgcccatttgtctttatcattcgaagaactcagaaacaactaactcttcattcttgattctcccacttaaacgacggcgtttttgcttaacgtttatgtatgcaagcaaatttacatacttttcgtgacctttggtttctgtgttgtgtgatatttactacgaaaccacttgtcaccaaaggttcttctttctgttagcgttgggttcgtgattccaagatcaatggttgtgaacttcactagttagagatactgaatcaaagagatgattcttccgagaattgggtaaatcttcgattctgattttctgggtaagaatgatcaagacccttcctttattttctttttttgttcttgcctaataattcttattctctgaatttgatttctttcttttaatgactcagaatcttccgtattggatgtttttgttcctgttcttgataatctctttatgactgtatctctacctctggattctcactgtcactgatgttcatgtctaatgaagcttctttaatttagtcttgttcgtgtcactgttcgatatttttaaatcaaaagttgctaactttgtgtcaatgatttgcttaagtaggactattttgagtttatggacatttgattcttaaattctgaggttgcatcagattagggaacttgaatcttggttactgtaaatttactaggagaaacctgagattgactattaactctgatatataacttatgtttgcttcttgcatttgatcttaacagattaaagaacacgtaacctattttcaattcgcgggtttgattccatagcttcttcagatcatacattctcgcaagtgttcgatacgggagtagaagaagaagagtctttctatgctcctgatcatgatgtcttgactctgcttcaacctaacttcaccagcaacg

SEQ ID NO: 5631 - DNA, 3000 bp, Unknown
  misc_feature (1)..( 3000): cDNA_ID_2785751_gDNA_ID_1620807_Annot_ID_168912 3000 nt of promoter + ATG
gatcaaatgcaagaagcaaacataagttatatatcagagttaatagtcaatctcaggtttctcctagtaaatttacagtaaccaagattcaagttccctaatctgatgcaacctcagaatttaagaatcaaatgtccataaactcaaaatagtcctacttaagcaaatcattgacacaaagttagcaacttttgatttaaaaatatcgaacagtgacacgaacaagactaaattaaagaagcttcattagacatgaacatcagtgacagtgagaatccagaggtagagatacagtcataaagagattatcaagaacaggaacaaaaacatccaatacggaagattctgagtcattaaaagaaagaaatcaaattcagagaataagaattattaggcaagaacaaaaaaagaaaataaaggaagggtcttgatcattcttacccagaaaatcagaatcgaagatttacccaattctcggaagaatcatctctttgattcagtatctctaactagtgaagttcacaaccattgatcttggaatcacgaacccaacgctaacagaaagaagaacctttggtgacaagtggtttcgtagtaaatatcacacaacacagaaaccaaaggtcacgaaaagtatgtaaatttgcttgcatacataaacgttaagcaaaaacgccgtcgtttaagtgggagaatcaagaatgaagagttagttgtttctgagttcttcgaatgataaagacaaatgggcaaaagaaattattaaaagtatgagaaaacaacagagtggaaaaatgaaggccacgaatgtttataaaataaaagttggaatgatttgggggataatataaggttgaaatacatatggctgatcttcaattgcaccaaagatcaaagttagtgaatccttgtcaccaaatataagcacattatctttaccgactagccggtgaaaatataacaccgacgaccgaccaattaatatgatacaaataatgaaataagggtcaagtcatctttttttttaattaatttaggttaaaaattaagaaaataaaatgacaaataattaaacgattgtgtcaagtaaaggaaaataaagatcttggaatttaatttaatttagaacaaaacagatttctgatagtaaaccgtaaatttagtggtggctatattatgcagcaagattatcagttaactagattttaatctgcggtataccgcggggttatatcttttttaaaaactaaaaagttaatttgtttagtagattaaataaatataattcattttaatattttctaaatgtacaactcttatatatatatatatatattatttagtatacaattactatgtttattttttactgtttaacaatatagaaagaataacacacagtttattaagttaaaatttagattataactaaataattcaaattttaattatattaattttattaatataatgatattttgatatatatatatatatatatatatatatatatgatttcacccatgatatactgtctcgtattattatcgatccaaagccgtcatatcatctaatctcgttcagtgaaattaaacatatctaatagatttcacccatgctatactgtctcgtattacctatcgacccaaactcgtcataccatctaaccccgttcagcgaaactaaaaattattttgttatttttgttttaataatactttaatttaaaagatatataattcaaatcagtttaaaagttttattttaaatggttatttaattgttttaaaattcatatattataaatattataaacccgtcttatcatctaatctcgttcggtaaaattaaacattatttttttattttttgtttgaataatatttttattaaaaaatttataattcacatcaatttaaaagttttatttcaaatgattatttaatttttatacatttcacatattataaatattataaaacgtttttccgttaaatattttaaatgtttaactaactataatatttatttttaataaagtataatattaataaattcctaagatttctcctttttaaaagtaattagaattgatggaaatatattagataaagaaatgctaataattaagaatattaattagttataataattaaatatcaatgacatccactgtaaataagtcccaacttaaggatttatttactaaaatagctccaaaaatgtatatatagatgttatcaaaattcgaattaaaaagttgtaaaaagactcggaggcggtcaaaatcaatttttttattttcttgcataaatttgtgaactccagagaattaagaatgaccagtgatagagctccacgtggatagattgggttccaaagtgggacggcgttaaatataaaaaggccggaagttgtcgaagtagtcttttttcccattatttctgttttcggttccttattttgttcctttgtaataatgagtgacatcaaaaatatttggggacgaattaacaggtaatgtaaatagaaagaaatagaaaattttctttgattttacaatttggattcggattgcataagcaatgacatcaacagtaatacatagctgagaggctgagatgcagtgtctctctctcagggaagatgacaaaaagaatctgatatacacgtacgtatgttgcgagttacatattgatatatcacatgtcataagtcacatgctaacgataaactaataaactaaaacaattatgtcaacatatatcggtgaattgcattatcatcgacctcggtcactgttccgcacatcttggtcgccacggaacatagacaatttttggattgtagtccaattaatgagtcccccaccaaagccgtagtaaaatcgaagtcgttctctaatccaatcatatatatatccataacacacaccaacaacacccacacaacaaaaactagagtcagtaacaacacaagattaaaaagaaggagaaaatg

SEQ ID NO: 5632 - DNA, 3000 bp, Unknown
  misc_feature (1)..( 3000): cDNA_ID_1828969_gDNA_ID_1620807_Annot_ID_168910 3000 nt of promoter + ATG
agctattaaattggatgttggcaaagggtatagcgcctaatgcaaccacatttaattctctcgtgaagcaatattgtattagaaataacctgaaggcagcaactgcaatttataaggacatgtgttcgcgaggagtaggacctgatggtaagacgtatgagaatttagttaaaggccattgcaaggctaggaacatgaaggaagcatggtttttattccaagaaatgaaagggaaaggatttagtgtctctgtcagcacatatagcgttctcattaaaggttttttgaaaaggaagaaattcttggaggcaagagaagtgtttgaccaaatgagaagagaaggattagctgcggataaagaaatttttgactttttcagtgatacaaaatacaagggcaagaggccagatacaattgtagatcctattgatgaaataatagagaattaccttgtagatgagcaactaaggggagccaattagctggtggtaggtcagaactcagaagttaatcttagtgagaatgaatgtggttttcgaggaaacattgatgcctgtttccgagtagtagaagcatcaggtcgttaaggagctctttggattgacaccaagaataagcttccgatcaatctgttagcagatgatcctttttgtgcattaaacagctaccggcagcagttcaggaggattttgctgctctgccaaaaacgcaacttgcatctttagacaagagtatctgtgaactcctccttcaacgttcatgtttgttttcttatgtgtgaggattctgcaggttcacaatcttactgatttatcatttgctaaaaaagaactgatgctggtgcaactgctctattttggcgattttcatcagcttcctatccagatctcaagttctagaccctgttagtgctcttcgaggtaacaaaaagaaaacaatggtccttgaaattgaaatgacattcaaggatttctaatcacacaaaagcttcttacttatttgcttatccctgctttttaattgtagggatatgtttattaatcctgttgagccagcttctgatctcatggtacatcatgttgttaatgctcaccaaggacttctcagtgaagaagatgtaagagagcttaaactagttttatttcttctttttggtagtataagactataagttatgtctctatttttcaggactgctttatattgtataactctcttttcagattttgcagacaagagccacatcatctctccaggagtccttaaacctacatgaagaaactttcacattacacatttaggccaatccaagaacaagactttcttggtgtaagattttggacagagtgcgtgatgacgtgtagaaacagagcattatgcaaaatgtatttgtgatacttttgtcatatttgaacaaatgttacaattttaacattgttactaagatagtaagatgtcaaatttgggatacatgtattgatattctataattctatatagcataataatccgacagctccagcgtctctttctccgtcaactgctccggcaatcacatgccattagttgaaagtttctttattacttccataattccatttatatttgttgctgattttgtttttttagtgtatttttacttcaaacatatattatccgaatcttctaagcatgccattttttttgtttcttttagttattttacgctgaatgtcacaatttatctttaagtagttttaggttaaagaccattttttaacccaacaaagtataaaatcatcgcccaaatcgtaatctagattttggtaagaatagtttggttggtaagagttacatatataacaaaataatcaagcataaatataacttggcaaatataacatataattttaaaaaatgagctcatatatatagactttctgtaattttgtttataatgattaacgatatgattgaattagtttcaataatgtgtgagatagttaatcacatgatttcttagggtcaacatctagttaatcacatgttttccttgggtcaacatctagttaatcacatgacatgtgatatattttgtgtgcgatttcgtcatgtacacatatatatttacccctttttatacattttaaaacatattttaaaaattcacaactaacggtataataaccgttaaaaaaaggcttatagatatggctaattaattacattggccgtgacgtgtatataatcgaacgattgcaaagattgctcaagtccagaattgtatatcttggattttacttagagaatcttgattgtaaaagtgttcctaatattttcaaaacagaaataaggaaatgctgtaatgatgcattccatgatcattctatagtaccttcgtgtagaaaaaaagatgtacactaggataaatatttattaatttaattttgttacttcttacattttaaagaatttcttgctttctttgtaattcttttaagagttcgtattttatcgataaattgatgctatgacactaaagcaatagaacattttatccataacaggtttttgggtctgcagttgattttctatttatgtttcataagtcaccgttgagtaaattttggacgcgcttcaagaaaaaataaaaataaaaatagaaatagaaataattcatatatacaaatatatgataaatatgtgcaaaaatgtcattgttgataccacgtcctttgctcctagaaattcgatatcaaccatgtgtcccaatgattaattggaaatgttaagctctttttatctatcatgaaaaaaaaatacacaaaccccttatcatataaatcgcacatgtattgttttttttttttttgataaaaacgtaacgcacatgtacttaattgtaccatagactccaataacgaaccaatcatgctctctctcgctttatatagatatatacccatgcatgatgcatcaaaatcaattcaaacacaaactcaaactcacatataagaaatg

SEQ ID NO: 5633 - DNA, 3000 bp, Unknown
  misc_feature (1)..( 3000): cDNA_ID_3077945_gDNA_ID_1620807_Annot_ID_168909 3000 nt of promoter + ATG
cagcactccaccggggtcacattcaccggaagcaccgttcagaccggagatgattgtgttgctatcggccctggtacccgcaacctcctcatcaccaaacttgcttgtggcccgggtcacggggttaggtatacacaacacacgctcttaattttcataatgatctatgaacaaattgcaaatagtataaattattaactctgagaaaataatgaatttcaaactcaagttagcaaataactcatatgattatgtgatgacgattgcatttgcagcatagggagcttggcgaaggaactgaaagaagacggagtagagaacgtgacagtatcgagttcggtattcaccggatcacaaaacggcgtgagaataaagtcatgggcgaggccgagtaacggattcgttagaaccgtcttcttccaagacctagtcatgaagaacgtcgaaaacccaatcataatcgaccaaaactattgtcctactcacgaaggttgccctaatgaggtatatatccaatatccatatcgcattcttttatcagatcaatccaaatatgttataacgacttagtcaaataactaacgattaattatgttttcgtatgtattagtattctggggtgaagataagccaagtgacatataagaacatacaaggaacgtcggcgacacaggaagcaatgaagctggtgtgtagcaagagcagtccatgcacaggaatcacattacaggacattaagcttacttacaacaaaggaactcctgctacttccttctgtttcaatgctgttgggaaaagtcttggtgttattcaacctactagttgtctaaaccgatgatatcaaattaatatcttggtgtaaagttatttaatttgttgtaagatgaaatggtaaaatgttattagggatttgacctttcatctttcaattgtaatgttaccgtgacgattattagattaattagaacggtgattcgatgcaaatcagttttggatatcaatcggtttgagagtaccaaaggttcttgtttctgtaacaactgatcaacttttcaaaaaaaaaaaaaaaaaaactgcagcttacaaaattacaatttttttttctcaacaaaattacaattttttttatttttttttgtcaagcaattacaaattatttagctatattttcattagtaaataaaatttaataactgagaaactggaagacgttgacttatcacaataacattgtacagtacttgtttttttttccggtcagcagagagctggctttaaaagcaaaatataagacaaatctagaagaaactgagaaaaagaatttttgccggagcttctgcttccgttttttgtaatccgagaagttgtattggcccgttacaaagcccatttgtgatgattatatattttggaaacttttttttttaattaataaagaaaagaaaaggaataatgtgtatgtatatggttgctaaatagtttaagagctaaagatggtcacactcttcagggcttaggactaaaagaatctcacatgggaatcacctgcttcctcggtctctctaccttgtagcagattctccgttcgactgttgtctcttctctcgtcttacctcttattcattctgtagatacaacaacaaccaatcaatgaattcaactagagcggcgcaagaatcatatttagggctgttgaattcaaaatgtcaacaactacaattagctaatatatataatattgactttctgtaattctgatcagaatgattaacgaatatgattgggttggtttcaataatttgtgagctagttaatcacacgtctttttttttttcggtcaactgctaagttgatcacatgtcatctcatataaaaatgaggtgatgtcgtcatttatacatattttgatcactttttacctacattttaaatttaatttcacaatattaccgttttgtatatggtcgttaaaaaaaaagagagtataaaatggctaactataacaacattcacccgtaatgtgcatatatgtacaaatcgaaagattgtaagatttgctcaactacttaatgtttgtttatattggccttcgatcagaaaatcttggttctgaaagtgttcctaatacttccaaaacataagttttgcatatagctgcaaggaaatggcagatgacaaattgttcttttaatggattatattgttcttctctttgttgaaattttgataaaattaaagtttttaaggattttgttccatgatcattttaccttcttggagaaaagtaatactttattgataaaaagaatactctaaagattaggatagatattattcatttaattttgttactactattttttttataaagaattcctatttttatggtagttctttcaggagtttgtaaattttgtgtcgataacaaaaaaaaaaaaaaaaatcaactctgcactctataggggttttggttgagtttctttctcttagtttatggctgagtttctatttatgcacaaatgatagttttcttcatttagtattgttggttctctatagaattaacgttatatacggtttatgttctaatcaatcgctgagtgggtttccacgtatttattttgttcatcaatatataaaaacaacatgtaccaagaatataatacatatacacatacgtatatggcccatgttatatgggaaattgataatgtgcaaaaatgtcatcgttcatacaacgaccgttgctcctaaaagtacgatatcaaccatgtgtgcacctaatgattggaaatgtaaactcttttatcaatcataaaatattcacaacctcttatcatatagatatcacatgtacttaattgtaccatagactccaataacgaaccaaaataattatgctctctctccctatatatacccatgcatcaaatcaaatcaattcaaacacaaacacaaacacaaacacaaacataaactcaaactcacatataaaaaatg

SEQ ID NO: 5634 - DNA, 3000 bp, Unknown
  misc_feature (1)..( 3000): cDNA_ID_1828981_gDNA_ID_1620807_Annot_ID_168908 3000 nt of promoter + ATG
tgaatcttggtttacgaaaactctgggaaattagagatctgagtttttttttaagcgtttgactttacttaagagagctatcatgagtttattctcactggatttgatgatgttgtagatgatgcaatggcgatattcgtagctttaaattcacctgaagttgatgtcattggcctcactactatctttggaaacgtgtataccactctcgccactcgaaacgccttgcatttggtaccatttctacaccatttttctcatatggatctcattacgaaaatgaagtcaataacatttcttggttgatctaatcatcattgttctatatgcatatctactagttggaggttgcgggtaggaccgatattccggtggctgaaggaacacataaaaccttcttggtatgtttccactttatggcctttgatatgtttttgtgagaaagatggatgctatgtaatgtgtttgagattcaatatatgttttctagatctttagtaagaataataattcacacaaatgtgtttagttccaatctgtgttataaatcaaatggtaagttatattgtgtctttttcacatgtcataccacttagattttttagcattgataacttgttgtcttttcttctctaaagaacgatacgaagcttcgaatagctgactttgttcatggaaaagatgggcttggcaaccaaaacttccctccacctaaaggaaaaccaattgaaaagtctggacctgagtttttagttgaacaagcaaagctttgccctggtgaaatcacggttgttgctttgggaccactaacaaatctcgcgttggtaagactttctcatccgcaatttttatattccggttcttacttatctctgttcctatcatcttatcggagatttcattaccttgataatgcaggctgttcagcttgatccagagttttcgaaaaatgtcggacaaattgttcttcttggtggagcatttgcagtaaacggaaatgtaaatccagcttcggaagctaatgtaagttccttcacccgttaaagtaatgtgatattcatacacataacacatcactttctatcaaaaactcttcttttagttttcacatctgtttaaccaattttttggttagggtagatttttggcgatcccgaagctgcagatattgtgttcacatgtggggccgatataattgctgtgggaatcaatgtgacccatcaagttattatgacaggttatcttggataatcttttttccttatttgatgttttatattgaaaatatacaaatgctgtcaacagaaccgtgatgatcctgattgttgcctttatggctcgaggttttcattacttgttgcgaccaagaacataatttagttaaacagagctttctaatggcttttttcccggtgtttctgctggatttagctgatgacaaggacaaactagcatcatcgaaggggaaattagctcaatatctctgtaaaatccttgatgtgtactatgattatcatctcacggcttacgaaatcaaaggtacgataatgataatcatttgtatgtgtgtttatttcatttggtaataagttcagttgtacacaaaattatataacaagaatttccacgactacgtatttttatcttaacctcttcttttttgtgtgtgtgtggggcaggtgtgtaccttcatgatcctgcgacgatccttgcggctttccttccttctctattcacttatacagaaggagttgctagagtgcagacaagtggtatcactaggggactcactttactgtacaacaatcttaagaggtaagtttttttcatacatacaatacaaacattcaaaatagacagttgtgttatatataatagaggatgtaaatgtcatgtgtggtgatggaaaaaaacttgttgttgtgatgtgaaccaggtttgaggaagcgaacgagtggtcagacaaaccaacggtaaaagtggcagtgacggttgatgctcctgcagtcgtgaagctcataatggataggcttatggagtcttaaaccatcttgggtcgttaattagttatctctttctctttgatgtttcactattgcgagccatttctcttgttaaaaataaggctcctcttgctgcattatttatttattgtttaatctttattaaaacgaatattattatgttaccaattaccaataataaagttaagatttttcctccgattccatgactcttctactacattcaaatctgtcacatgattgtcccacttgatcctagtaaggaacatgacaagtagtaacatttaagacattttgatattaactacaacagctggaatagaagaaatcttgagaaaagtcgttacacattcattacttaactgacgaatgatattatgtgaaaagaaaacattaatagtactatcttaagataaaaaatgcaattatgaaatttcatattgcctgccaattgaaaaataatgttacctattgttgaaataagatgccatgcattcgcattttgcacgatctgcatgtaaataattaacaataaaaaaaaacgagagaaatcagaaaactaaaggacctaataataaattaataaaaataaaacaaaggaacgtgacaaggactgagagtataaatatataataattatctgtctctctctctctcaactttgactgcgtcttccttggagaatcacaaaacaaaaacattcgtttttttgttgttgttgttgttgttgtttctcttgagaagctctctgaagaagaagactcatggaaaccaacaaagaccaagactttcgcttccgtacacttgtcgtcttcatatttctctctccctcttctcttctctttctctctctctctctcccaccaccacgacgtgctctcctctcattatcattctctctcactctcccttttctcttcttcaccattcgtccccattcccatattctctcgttcttgaattcctctgattgtcg

SEQ ID NO: 5635 - DNA, 3000 bp, Unknown; identical to SEQ ID NO: 5627
  misc_feature (1)..( 3000): cDNA_ID_1828988_gDNA_ID_1620807_Annot_ID_168905 3000 nt of promoter + ATG

SEQ ID NO: 5636 - DNA, 3000 bp, Unknown; identical to SEQ ID NO: 5625
  misc_feature (1)..( 3000): cDNA_ID_1829000_gDNA_ID_1620807_Annot_ID_168903 3000 nt of promoter + ATG

SEQ ID NO: 5637 - DNA, 3000 bp, Unknown; identical to SEQ ID NO: 5624
  misc_feature (1)..( 3000): cDNA_ID_3077956_gDNA_ID_1620807_Annot_ID_168900 3000 nt of promoter + ATG

SEQ ID NO: 5638 - DNA, 3000 bp, Unknown
  misc_feature (1)..( 3000): cDNA_ID_1829007_gDNA_ID_1620807_Annot_ID_168899 3000 nt of promoter + ATG
gacccctcttcatcaacagcgcaaatatttcagtcaacttcgattcccagtttattctcaaacggaagcttggaaagaaaaagcaagtctcttcctcttaaagttattcttctctcattattgtttccaccacagtggtgcatttgatctctttggcatgagggatgtctaagtggtttgtctgctttcctctgtttttgttcttttgcagattaagaggcttcatcttttgcttactgtcaaggagtcagctatggatgttccatccaacttggaagctcgaaggcgtcttactttcttttcaaattcactattcatggacatgcctcctgcacccaagatccgcaacatgctttccttctcgtaggttccagtcacgatggacatcttctcgtaggcttactatatcttaacatcttccattttgttttttcatagggtccttacaccatacttttcagaggatgttcttttctccatatttggcttagaacagcaaaatgaagatggagtttctatactcttttacttgcagaagatcttcccaggtttcacttttccatctgttttaattttttcatatggtactgttactttgtttgagctatcagctgagtccatggcttacatcagatgaatggacaaactttctggaacgagttaaatgtggcaacgaagaagaactaagagcaagagaggatttggaagaggagcttcgtctttgggcatcttacagaggccaaactctgactaaaactggtagactttagtctcctctcttaatcggttgaattctgcttcatttttctaacctgacgaatttatcttttgataaacttgttgtgcctgatttctgatctgtttcaactagtgcgaggaatgatgtattaccgaaaggctttggaacttcaggccttccttgatatggcaaaggatgaaggtgcttgaagaatcttctctgtgattcttttcgattcttaaaaagtatgaaagcattccttaaactaccttgtttttgttctagaattattaaaaggctacaaggctctcgagttaaccagtgaagaagcatcaaagagcggagggtcactttgggcgcagtgtcaagcacttgcagatatgaagttcacctttgtggtttcttgtcaacaatacagtattcataagagatctggcgaccaacgtgctaaagacatattgagacttatgacgacgtaatatcttcattctttcatcctttatctttccagttggtttgttatttagttcttagcctcattagttaagcttgctatttcctcatggcaggtatccgtctattcgtgtcgcctatatcgatgaggtagagcaaacacataaagaaagttataaggggacagaggagaaaatttattactcagcgcttgtaaaagctgctccacagaccaaaccaatggattcttctgaatctgttcaaacactagatcaggtataagttgagaaaactaagtaaaatacttaacattttggtgctcctttttttcccaaaatacgaggatgagtttaatcctatgcagtgaggtcagaggatatagatgctgctgttcaagagagactgagttatatttattttctgtcagctcatttatcggattaagcttccgggaccagctatactaggagagggaaagccggaaaatcagaaccatgctatcatatttacccgtggagaagggttgcagacgatagacatgaatcaggtgcgatgcgtagttttcttttgtctaacatgtgtcgctaatgaatcacatataatatgcttaaaattgttcaaagaataatcaccgcaggagactcttaacctctaaatatttgaccttaggacaactacatggaggaagctttcaaaatgaggaacttgctgcaagagtttcttgaaaagcatggaggcgtaagatgtcctacgattcttggtcttagagagcatattttcactggaaggtactaacagaatgatcctatttctgtcttctagatttttagtttctgtgtgcatactgatctcctatgtttgtggtttcttgtgaagtgtgtcttctcttgcatggtttatgtcaaatcaagagaacagttttgtaacgattgggcaaagagtgctagctagtcccttgaagtaagtttcttccctgttctgaaatcttgtcagggtattgtagttgtcaaaattgatgtgctctttctgttgctgctccagagtacgattccattacggacatccagatatttttgatcgtctgtttcaccttaccagaggtggtatctgcaaagcttctaaagtcatcaatcttagtgaagacatatttgcaggcactagcttgatctcatattctttggtggtacacatatgatctacttcattttttacattttttctcatacctttttactggtttcaggttttaattctactctgcgtgaaggaaatgtgactcatcatgaatatatacaagttggtaaagggagagatgtgggcctcaaccagatctcaatgtttgaggcaaaaatcgccaatggaaatggcgagcaaactttgagtcgcgacctttataggctaggacaccgatttgatttcttccggatgctgtcttgttatttcaccacaattgggttctacttcagtaccatggtaggttgagattctccctttttatctctcaatcactagatatatacatggcaggtttgtttttctttctcaagactgaagccattatctgtgtgttttgacagttaaccgtgcttacggtgtatgtgtttctttatggacggttatatctagtacttagtgggcttgaagaaggattgagtagccaacgagctttccgtaacaataagcctcttgaggcagctcttgcttctcaatcatttgtgcagattggttttttaatggctttgcctatgatgatggagattggacttgagagggggttccacaatgcattgattgagtttgtgctgatg

SEQ ID NO: 5639 - DNA, 3000 bp, Unknown
  misc_feature (1)..( 3000): cDNA_ID_3077964_gDNA_ID_1620807_Annot_ID_168897 3000 nt of promoter + ATG
gtgttatttgctaatactgtcactttgtaatatcaaattcaattaaaacataaaatttactccatctagataaatatgttttttgaataatggtcaattacaaaacatgtttgattgaatcacctttttgagactctccaagcaagcgtgttcgatcgatgggcgtttagccattttctacctccgttgttcttccgattaggtttcaggcgagcccgtattgtgattgggccatctcttttcgttttgttttcttgttgggctttcggccctattgtaattttctattacaaaaatcaaaaccttttgacagaaaaaaaaccactcagccttgccaaatagaaaggtccaagatatttagaaataattatgactagaattagtcctaaatgtatttagacgcttagaccatccttaatggttggatccaaacataatttataattttaatattggaaaatcaaaaatttagacactttcagtgtttattagttttgagacagcccaatggtggatctaaaaattgaggatctaaaatttcaaattttgaaaaatgtgtattcttgaataacttgacatacactctaaaaaaactcgaaatgtacacaagcaataaactcaataaaacacacaacacaacacaagcatttacttgatcacaaacataacaagtttaatttaggaaacaagaaggaatccaatgaaccactgagttgttgcagtctttatgatccaaataaatgtctaaatatccaaatttggatcaagtctattgttttttttggcaattttgatttaatgtttagatctttttgtgtttggcaccctacttagacctcccttataaagcaaagtaaaaagaatcagatattttcaaaaacgttacagcatttatattattatacaatatatttatttagaaaaataaaacatttgatgcattagaaataaagcataataataaagattttattttattttggttaaagtgtataactttgtcttgatcatagtccttaaattacatttacagagaatgtgggtccgttttatttatttgaggatttttacatttacaagttcacttcttctctttctccccatcaacaccaaccattatgcactatgccagagccagaggcagacatctcttcttggcttttaagttttaaccaaaaaagtaataacttaactcaaccttatagttattactattagacatcttcctctttcttctatcaatgcgtccacataatgtactcggttattatagtccaattttttttattttttcttaaagtttgttttgatcatattccttagtttacatttacggttttgataacgtggttctcatataatgacttgaggattttactattatatacctaacaggctaacacatattagtgtattactcagttaatttatgatagcacatgtgatgtggggtcacaatctccactgttatagtcatagtgcattacagttcatatctttctctatctccccatcgacaccatcttcttcttcatgcagagacatctctttctcggcttttaacccaagattccattactcaacccttatagaatctgtgccctctctgcttgttttgcatttcagtgaacaatagaggaaactgaaaatgaattatcatcctctttctcccatgaaaatttattatacatcttcctctttctcgtctcattacctatataaaacctcttctagatatctaaaatctaaacctaaactcaaacacaaacaacatacatagtcatcgtgaagaagagtgctctcttggagtatatcatcgtgaggactcctactgacgtctcccagaatatgacttcggagacggtctacactgtgcagatgcctcaggatggcggaggtggagccagcagctccaagtcaaccaaaaaatagaaaactagctactgtattaagtattatgttatgtaataaactatgtcgtttgactctcttcgatcggtttgttgtgtgactttttttttctgctttgttaacttattgtgagactgttttctaatttaatatctattatgctaagttatatattcttgtttttttttttctctttctaatatgtttttgtctaggaagtgtgttcttgccttcaagatgaggtggagcatgaagcggtgaccacggctacgcgacacggcgaactcaaaacaattttcctttttagtttcttacacttttctttaaattttaaatcccataatttgtttgcttgtttcatttctctcagtgtttttaaatattcaagttactctttaaagaataaaaaaaaaaaaaaatatatatatatatatatatatatactgcataaagaatggggaaactaggagtagtgaacaagagagaaaaagacattttggggaaaaaaaacatgaagctcagagtcgaaacattaataacaagacgtgtaggcgtctagcatcaacgcttaccaatcttatcggggtcgggctcgcttgtctaatgtggttcacttggtttatctatgtggattatatttattaatcaatgagtttctgtacgtgtaaaaaagtttttgtcgaacaacctaagcaatgtatgaattgtgtggttagtttttaagtcacgtgaattatattgtatacttgttttttcttttattttggtatacttgtttccttgtcaacaaatttatcgtaggttttaccagtggtccacgatagactgaatattgcgtaataaattaaatatagaaagtgaagaaaaaatatagaaaattggaggattcgattagtctgttttaaccaaaaaaggaaagaggaagaatgctatgtaaaccaacaaccaagccttggtttgctttgatttatttgttgatattgggtatcgagaatttgagatactcaatttctaattcatcaaaacattattagccttttaaaaaaaaaaaactctgttttgtggtctcttgaaacataatttctaatg

SEQ ID NO: 5640 - DNA, 3000 bp, Unknown
  misc_feature (1)..( 3000): cDNA_ID_1827914_gDNA_ID_1620807_Annot_ID_168896 3000 nt of promoter + ATG
atgagtcacctacaacatgaatctgtgcaagacacgttgtgacgatatacatctataaaaacatattattaaattgtagttacgaaatatacccaacattgcatgctgattgttacatttgttttaccctcctctgttttataaaacctcaaaacagactcttcacaaaagcttccacattcttgtccgaagatcctccttctctacccgcttcagtcgctaaacgcttccatttctctgcgttttccctcagctccaccgatttcgcctccatcactgcttccaaacaccgcattatctctcctctctctactaaaccttccgagttctctctcaccctcacacctgtcttccatatttcttccaaaagcttcgcatttgctggctgatccgaccacatcggaaacgccaccactggaacgccgagaaccaaactctccagtgatgagctccacccacaatgagtcaaaaaacaacctatggctcggtgtctcaaaacctctatctgcgaacaccacgagacaatcatcccaacctcttcaagctcgtgtctaaaaccagctatcttctcaatctctgtctcttcttctccttctattttcgcttctctgttgagtttatcagttataacccacaagaacggtcttcccccttctatgagtgctctcgctagttcctctatctgtttcttcgacaactcaaccattgttccaaaagaaacataaataacagaggactctgttttcgagtctaaccaaagtgtataactactactttgatgatctcttgataaatctttacctgattcgcttccagtgaaaatctccgcaggaagtaaaggaccaactgccaccatttctatattcggaatagctgttaagaactctggctccagcgaatcgaatgtgttgacgagaattttcgggttagattcttctttgagaaaatccatcagttcttgatatactgcttgtgcggctttgttcgtgttggaaggtgagaggaaagaaggcagatcgcggatttcgagagaaggtagattcgggaactcgaaaacggagttgtttcctgtagagtaattgtaataaatgtcgaaagcgaaggctggttggatccagagatgaacagagggaagatgaaatctacgcgccacttttggaacccagttgggaagaatcgtgtagatcaagcaacttacgggagagtcaccattctgattagcttcgatgaaatccgatagagctttatcgccattacgttcgaagtgtaccaaccggttttggacgtcgtcggtgttggagatgactccgtcgtcgaatccgtcggagaaagtaaggaaagagagattttcgacgttgttgtggtttgggatcatagagcggtgaatgacagagagacacgtggcgaaagttacacgtgcgccagttgttttgatgagccgacgagcaaaacggagagatgggttcacgtgaccttgcgccggaaacgttaccagtagaaaatgcggttgcgccattttttgaagtgactttcttaatacgtacgaggtgtgtctcctcgtggatttgtgctgttatatgtatataaatggaaaatatattagatgagagtaatgggatttcatttggggtcatgtgacatgagataacatgttttaccgcttttggcgtgatccacgacgtacgccatgatggagatcataataagtatcatgctgaatatactatataatttatttataaaaaaaatagaacgaaagaaaaagtatcatgctgtcaaaaagaaaaaaaatatcatatttttatagagaaaaaactcgaaaaatatctgtttaatatctatagttgtttgaataatatctaaattaattttatgtttttaaatgcttttttaattcaaacattcaaattcatgattattatattttaacggatgttctaactgtggttgaaatttaactcatgatattcacgaaatgtataatctattttctaaagtttacaaatatattagtgtaatctaatggttaaatgtggattgattctcttcataaatctaagttcgaatcccccttctttcctaattaatccaaatttattaagatagtcaatccctctttgtcctaattaatccaaatttactaagatagttagtcaatccacgtttaaccaccatactaacctaatatatttgtaaagtttagagaatagatagtatatatatttataaataccatgagttaaattttaattatagttagaacctccattaagtaccaaaatttaaataaacgaaagcttttaaatttgggaaaatttaataatatatgtattaaatggacaaataaaagttagatgagagtttttttaaattttttattataaaataatttttttgcatgaaattgtttttaagataaaattttgacataaccaaatattattttccgccacgaattgagtctacgagagatgtcctgtctttaaactcgtaaagttttggtcttacccaacccaatacccacaaaggtaaacgacataacggttaataatattctaaccggtttataagtttacataaatcatttactaatccgcgtgtaattaagttttatgaaatgtggttattttgtaggtcacgtgaaatttattaattttttagtacttgtttttcttttttgggttcaactagttacttttttcctttgacatcaaaattattgtagacgagtggtccatatatagatggtgaaatgaaatgaatattgagtaataaataaatatagaaagtgaacaaaaaaaattagtggaaaaggtaactggaaagaaaaggcttattggcttggcaagattccataagtttatttcaccaaaaaggaaagagtacttggccttgctctctctctcttttaaaatggtaaactggtaaagataggagactcaatttctagttcatcaaaacatatttggcgttattatttctgtggtcacttgaataata

SEQ ID NO: 5641 - DNA, 3000 bp, Unknown
  misc_feature (1)..( 3000): cDNA_ID_1827922_gDNA_ID_1620807_Annot_ID_168894 3000 nt of promoter + ATG
tttgtccatttaatacatatattattaaattttcccaaatttaaaagctttcgtttatttaaattttggtacttaatggaggttctaactataattaaaatttaactcatggtatttataaatatatatactatctattctctaaactttacaaatatattaggttagtatggtggttaaacgtggattgactaactatcttagtaaatttggattaattaggacaaagagggattgactatcttaataaatttggattaattaggaaagaagggggattcgaacttagatttatgaagagaatcaatccacatttaaccattagattacactaatatatttgtaaactttagaaaatagattatacatttcgtgaatatcatgagttaaatttcaaccacagttagaacatccgttaaaatataataatcatgaatttgaatgtttgaattaaaaaagcatttaaaaacataaaattaatttagatattattcaaacaactatagatattaaacagatatttttcgagttttttctctataaaaatatgatattttttttctttttgacagcatgatactttttctttcgttctattttttttataaataaattatatagtatattcagcatgatacttattatgatctccatcatggcgtacgtcgtggatcacgccaaaagcggtaaaacatgttatctcatgtcacatgaccccaaatgaaatcccattactctcatctaatatattttccatttatatacatataacagcacaaatccacgaggagacacacctcgtacgtattaagaaagtcacttcaaaaaatggcgcaaccgcattttctactggtaacgtttccggcgcaaggtcacgtgaacccatctctccgttttgctcgtcggctcatcaaaacaactggcgcacgtgtaactttcgccacgtgtctctctgtcattcaccgctctatgatcccaaaccacaacaacgtcgaaaatctctctttccttactttctccgacggattcgacgacggagtcatctccaacaccgacgacgtccaaaaccggttggtacacttcgaacgtaatggcgataaagctctatcggatttcatcgaagctaatcagaatggtgactctcccgtaagttgcttgatctacacgattcttcccaactgggttccaaaagtggcgcgtagatttcatcttccctctgttcatctctggatccaaccagccttcgctttcgacatttattacaattactctacaggaaacaactccgttttcgagttcccgaatctaccttctctcgaaatccgcgatctgccttctttcctctcaccttccaacacgaacaaagccgcacaagcagtatatcaagaactgatggattttctcaaagaagaatctaacccgaaaattctcgtcaacacattcgattcgctggagccagagttcttaacagctattccgaatatagaaatggtggcagttggtcctttacttcctgcggagattttcactggaagcgaatcaggtaaagatttatcaagagatcatcaaagtagtagttatacactttggttagactcgaaaacagagtcctctgttatttatgtttcttttggaacaatggttgagttgtcgaagaaacagatagaggaactagcgagagcactcatagaagggggaagaccgttcttgtgggttataactgataaactcaacagagaagcgaaaatagaaggagaagaagagacagagattgagaagatagctggttttagacacgagcttgaagaggttgggatgattgtctcgtggtgttcgcagatagaggttttgagacaccgagccataggttgttttttgactcattgtgggtggagctcatcactggagagtttggttctcggcgttccagtggtggcgtttccgatgtggtcggatcagccagcaaatgcgaagcttttggaagaaatatggaagacaggtgtgagggtgagagagaactcggaaggtttagtagagagaggagagataatgcggtgtttggaagcagtgatggaggcgaaatcggtggagctgagggaaaacgcagagaaatggaagcgtttagcgactgaagcgggtagagaaggaggatcttcggacaagaatgtggaagcttttgtgaagagtctgttttgaggttttataaaacagaggagggtaaaacaaatgtaacaatcagcatgcaatgttgggtatatttcgtaactacaatttaataatatgtttttatagatgtatatcgtcacaacgtgtcttgcacagattcatgttgtaggtgactcatgggaacctgactcatgtatagttgagtttacaaattatatgcaccttcattgattcaataaaacttgtattactaacgttattgtgatccccgtttaaatttgttgcatttaatttgttagtctaatatttaatttagatgtgggttacataaagttgctttgataattgggatatgtttttttctgtctaatacacagataaaggcaaatatacgatcaatcacagttttaattatttttgttttttcaatgaaacaactctgacaaagaagatttggattggccaagtgatctcacatattctaaaatgtgagaaaaacaaaacagtattttgaattttttttatttaatagaagatttggtcaattgttaacataagttgatgatgaattagttgccaaaaaacccaaaatccattataacttttgcaattaattactctgttactttttaaccctaaaaaagcatgtatgtatgttattagagacagacgactctctctactcataaaatctctctcacatagatagatccctttccacagtttcgtctctgcttttgattcttctgaggtcccctgaatttacagaatcacaaagaccaaatttttcattccaatttcggatctttacccttaaaaaccatgtcagagatg

SEQ ID NO: 5642 - DNA, 3000 bp, Unknown
  misc_feature (1)..( 3000): cDNA_ID_2159919_gDNA_ID_1620807_Annot_ID_168892 3000 nt of promoter + ATG
ttctcggtggtttagtttctgaatcttgttgtctctttctctaggcttggttaagctagaaccagacctcttataccttaccaaagccttcctttccactaaagaaactctcttgattggtgaactggcctttctcaagtcatcatcatctctattatctccaactacctcctttacatatgattcatcgtcactcgaggaggaagaggaagatgaagacgacgatgatgacgatgatgatgatgaagatggatcctcagaagacaaagactccaccgttacattatctttggtgttattatcttcactatcttgattttcttcttcctcttcatcggtttcacttgagctatcttcaccatcactgatagactctacaattctgctactttcttcaaatagcttcttcttggctgaagctcttcttctagcttcagtttcagactcagaatctgaaagaatctctatttcgccagggactgatttttccaaaaccaaacctctaatctcaggggaacacttgtccttcaaaaatctgatttcttctgacacatcttttaacacagaagagctcggaactgatattacaagatccaaatcagcaatctcaggagaactcttctgcatcagacatgtgttcttctgttcagacacatcctttaacttagaaaatctcggaacaggtatcccaacatccaaatctgtaatctcaggggaacatttcttctccacgcccaaatcactaaccctaaaagacctctctttcagacatgggttctgctcagacccatctgttaacctagaggagctgggacctgatttcttctccacattcagatctctcattatcctagaaaaactctcttttacagagttgttaggtacagagtacatgttactgacttgaggaggaggaacactgtcgttgcaagttggtgtgatgtcctcaatgtcggagtcatagtttttaggtttcttctgccgtcgtttctttgggggagatgtcaccggagctacagtctccatcttcttccgcttgttaacagcctgaagacgctgccagctccgggacttcactctcttcccaatacactccattaaagcaaacacaaagatctgaaaaaagaaagactgttagaaatctagagaagacgacaatggggtctgtaaagaaacagagagagagaaaggtaacgaacctttagatgagaaaaaatcgaatctttcactcactcacacgggtctgagaagaagatgatgaagttcttgagtttttagagaaatttttgattttcactggtttcagaaagtggaacagagagagatgggcagagagagagagagagaagggcatgaagaaagcgtgatggcaaagccaaaccatgctatttcaggaggtctctcataccgccaaaacggtactatttttccacacactctgctttttggttttggtcaaaaaatttcttacatttcgttaaaaaaacagctcattaatcagtttccatttcaagcattgtttttttctgttctaaattacctttttgaccactctgaaattacagagtcaacacgtcactcaaaactgcaggaagagaagatatttcattacaagacaaacaatgtgtaataaattatgtcttactgcttctaatttttttttctgtgttttccttttgcttttgttttgaaatgtaatctttttagtttaccaatctagatttgttataacaatttaaatgaaaaaaatcgaatcatttactattttataaaagaatctcaaaccctttctttgaatgggattggagattggagtattattgaaatcaactaccttcctcttgctggcatttaattccactattagacctttatattatttttaaactaaagaatattgtgtttgaaagaaaaggcaaccaaaaatgattacttacaaacatatacaaacaaaggtttttagaatataaagtagcaaacaacatcattccaaggagagaaaacagagaagaatacttgtcattaatagagagaggtatgagttcttcacgcaaagtctttttgatattggaacttggtcattaatttacatcaccaacaagttctaaatatgatgaaagaaaatttatgtaccaacttcactttaagtgcccaccttttatctaatcgcagtaatgaacacatcacgtcctatgaggctttgacaaattaggaaaaaggctaaactgtgttagtcagaagataataacttacagaggggaccattattaatctcctaagtttatgtttttgtgacaagttacaaattcctcagaggattattagagaagcaaatatcgaaaactgtataacaaaactaacttcttaagaccgtaccgtcacataacatcaatgagccattaccatagccgaaaccagtcagctacacgagtacaagacttattatggtatgtagtcatctcatgatttaagggtataatgaagtatcaactgttagtcccccaagatcctaattgcatatgatcagaactctggactcgtttcttaagtgaggatttgcaaagctcaatctttgtcattgcgattatgttccggtgacgatgttcaaaatctttccggggatttagttccatcactgtctttcttttctatttgtttttgtctttaacaatgtcaaagtcaaaatctcaccgattctgtaaattccaagttatatgacgtgtcattgtattattggtgcgagcgatagcacaacctttgcgtctgcgtcggtagcgaactcttcggaaatatataatctgtaattaaaatgagactaatcccaatttaaaatcaaaaacctttttatttatttttgttttcctatagagatttcttagaaaagaaataaattacttctcttttatttttcattcggtttagctcgtggaactgaatctggtgtgtttgttgatcagagtaatacggacattgcaatttttctaaatccggcgattaaat

SEQ ID NO: 5643 - DNA, 3000 bp, Unknown
  misc_feature (1)..( 3000): cDNA_ID_1827934_gDNA_ID_1620807_Annot_ID_168890 3000 nt of promoter + ATG
tgcctttataagctcagaggctgcctaaaactccaaatcgaatcaaaagaggacaaaaaaaaaaactcctttaagaaacaatatctttatccataatacaaataacatatctctacttgaacgaattagacaatagaaacatacctcatcaacataaggccagatctttgtcaagtgatggttgagccaagtcaactgaagtaaataaaaagccaaagcaacaacaagaatcagtcccaagtatgaccaaattctaaaactttcgtgttcttccaatacgcagaaagagagagatgaaaacacatcaatatgtaagtaatgttgtaactcaacttctgacgctcggagaagacaacccaggaaggataaaactcaggaggcaaaagcttcctggaatcctccaccgtcatcctcgcaaaagcagccaccgtattcgccttataaaacagaaacaaaatcccgattaagaagaaaaaaaatcgaaattttcaatccgaaaaagggagagtggggtctcacaagttcagagcgaagcttggatcgagaattctccaacttgacaaagccgatgatgattgcgattccgacgaggagtccgattacaacgccgactatgaaacccatatttaatcgccggatttagaaaaattgcaatgtccgtattactctgatcaacaaacacaccagattcagttccacgagctaaaccgaatgaaaaataaaagagaagtaatttatttcttttctaagaaatctctataggaaaacaaaaataaataaaaaggtttttgattttaaattgggattagtctcattttaattacagattatatatttccgaagagttcgctaccgacgcagacgcaaaggttgtgctatcgctcgcaccaataatacaatgacacgtcatataacttggaatttacagaatcggtgagattttgactttgacattgttaaagacaaaaacaaatagaaaagaaagacagtgatggaactaaatccccggaaagattttgaacatcgtcaccggaacataatcgcaatgacaaagattgagctttgcaaatcctcacttaagaaacgagtccagagttctgatcatatgcaattaggatcttgggggactaacagttgatacttcattatacccttaaatcatgagatgactacataccataataagtcttgtactcgtgtagctgactggtttcggctatggtaatggctcattgatgttatgtgacggtacggtcttaagaagttagttttgttatacagttttcgatatttgcttctctaataatcctctgaggaatttgtaacttgtcacaaaaacataaacttaggagattaataatggtcccctctgtaagttattatcttctgactaacacagtttagcctttttcctaatttgtcaaagcctcataggacgtgatgtgttcattactgcgattagataaaaggtgggcacttaaagtgaagttggtacataaattttctttcatcatatttagaacttgttggtgatgtaaattaatgaccaagttccaatatcaaaaagactttgcgtgaagaactcatacctctctctattaatgacaagtattcttctctgttttctctccttggaatgatgttgtttgctactttatattctaaaaacctttgtttgtatatgtttgtaagtaatcatttttggttgccttttctttcaaacacaatattctttagtttaaaaataatataaaggtctaatagtggaattaaatgccagcaagaggaaggtagttgatttcaataatactccaatctccaatcccattcaaagaaagggtttgagattcttttataaaatagtaaatgattcgatttttttcatttaaattgttataacaaatctagattggtaaactaaaaagattacatttcaaaacaaaagcaaaaggaaaacacagaaaaaaaaattagaagcagtaagacataatttattacacattgtttgtcttgtaatgaaatatcttctcttcctgcagttttgagtgacgtgttgactctgtaatttcagagtggtcaaaaaggtaatttagaacagaaaaaaacaatgcttgaaatggaaactgattaatgagctgtttttttaacgaaatgtaagaaattttttgaccaaaaccaaaaagcagagtgtgtggaaaaatagtaccgttttggcggtatgagagacctcctgaaatagcatggtttggctttgccatcacgctttcttcatgcccttctctctctctctctctgcccatctctctctgttccactttctgaaaccagtgaaaatcaaaaatttctctaaaaactcaagaacttcatcatcttcttctcagacccgtgtgagtgagtgaaagattcgattttttctcatctaaaggttcgttacctttctctctctctgtttctttacagaccccattgtcgtcttctctagatttctaacagtctttcttttttcagatctttgtgtttgctttaatggagtgtattgggaagagagtgaagtcccggagctggcagcgtcttcaggctgttaacaagcggaagaagatggagactgtagctccggtgacatctcccccaaagaaacgacggcagaagaaacctaaaaactatgactccgacattgaggacatcacaccaacttgcaacgacagtgttcctcctcctcaagtcagtaacatgtactctgtacctaacaactctgtaaaagagagtttttctaggataatgagagatctgaatgtggagaagaaatcaggtcccagctcctctaggttaacagatgggtctgagcagaacccatgtctgaaagagaggtcttttagggttagtgatttgggcgtggagaagaaatgttcccctgagattacagatttggatgttgggatacctgttccgagattttctaagttaaaggatgtgtctgaacagaagaacacatgtctgatg

SEQ ID NO: 5644 - DNA, 3000 bp, Unknown; identical to SEQ ID NO: 5634
  misc_feature (1)..( 3000): cDNA_ID_1828981_gDNA_ID_1620807_Annot_ID_50562 3000 nt of promoter + ATG

SEQ ID NO: 5645 - DNA, 3000 bp, Unknown
  misc_feature (1)..( 3000): cDNA_ID_3077945_gDNA_ID_1620807_Annot_ID_50563 3000 nt of promoter + ATG
tcatcaatatataaaaacaacatgtaccaagaatataatacatatacacatacgtatatggcccatgttatatgggaaattgataatgtgcaaaaatgtcatcgttcatacaacgaccgttgctcctaaaagtacgatatcaaccatgtgtgcacctaatgattggaaatgtaaactcttttatcaatcataaaatattcacaacctcttatcatatagatatcacatgtacttaattgtaccatagactccaataacgaaccaaaataattatgctctctctccctatatatacccatgcatcaaatcaaatcaattcaaacacaaacacaaacacaaacacaaacataaactcaaactcacatataaaaaatgacaaaatcagctataacatttccacttatcttcacacttctcaccttcatcgatgtctcgagcagcgcctccattgttttcaacgtcgtgagcttcggggccaaaccagacggagtcaccgattccacagcagcattcctaaaggcatggcaaggggcttgtggctcggcagcatcagccacggtggtggtccccacggggacatttttgttgaaggtaataacgtttggagggccatgcaagagcaaaatcacatttcaagtgaccggaaccgtcgttgctccggaagattataggacctttggcaattccggttcctggattctcttcaacaaggttaacagattctcactggtcggtgggacttttgacgctcgaggtagtgggttctggtcttgccggaaatctggccagaattgtcctcccggtgttagggtacatatgcttctcctctatctatagttattgtaaataaaaacaacaatctgacattcatacataagcgccaccagaatgcaaaagagcaacaaatagctttaatcattattgattagtaataactaaataagtcaatatattttttttaatagtcaaataacatatctttattccaatcatttacttacgattaaaaaaaaaaaggaattagttgatagttttcaactatattaattcaggcacatttaattttcaatatgatctatccatgccatttttaggaatttattttataagcatataataactattatgataatgatttttggacaaggaaatggattctttggtcaaaataaaatgaaatatttataatcttattattaatctatggcgtttatatattaattactgtagtcaatatcgttcaactccgcaaaagacgtgatcataagtggagtgaaatcgatgaacagccaggttagccatatgaccctcaacggttgcaccaatgtggccgtccgtaacattaggctggtggctcccggagacagcccaaacactgacggcttcaccgttcagttctccactggagtcacattaaccggaagcaccgttcagaccggagacgattgtgttgctatcggtcaggggacccgcaacttcctaatttccaagcttgcttgtggcccaggtcacggggttaggtatacaccaccgtctaattccttagagtaaattatgtaaatatatcattaattgttaggaatcatgaatttccaacaaaaaaaaaactagcaatattgccttcactcactctggtcacaactcatatgatgatgtgatgactggcagcatcgggagtttggcaaagcagttaaacgaagacggagtagagaacgtgacagtatcgagttcggtattcaccggatcacaaaacggcgtgaggataaagtcatgggcgaggccgagtaccggattcgttagaaacgtcttctttcaaaatctaatcatgaggaacgtccaaaaccctatcataatcgaccaaaactattgtccgtccaaccaaggttgccctactgaggtatatccatatcatatttttgatcaatttcagactaatcaaatatgctatatcaaattatcaacttagtcaaataactaaagatttattatgtttatggtatgtattagcattcgggggtgaagataacccaagtgacgtacaagaacatacaaggaacttcggcgacgcaggaagcaatgaagctggtgtgtagcaagagcaatccatgcacgggaatcacattacaagacataaagcttacttacaacaaaggaactcctgctacttccttgtgcttcaatgctgttgggaaaaatcttggtgttattcaacctactagttgtctaaatcgatgaatttatttggggttaagatgatatcactgtgaaatgttattaggaaactgatttttcaaatagttttctgtaacaaggtatatgatcaccaatttctgtaacatacaatttttttttttttattaataaaatattattttcagtaaccaacaaagtggaagactttgacttgttgtcaccatcacattgtgcttttgctttttggtctttgatttggacaacaaaaatataaagaaattagagaaaagaagctttaactggatataaagttttaaactggagataattgacatagtaattaagaatttgttgcttcaaaactcaaaagaaaaagtaatcactaatattactaaagattttggaagtttagcgaaattaataaagaaaacagctgaagatgcagtcactcatcacagtctctctctctatctctatatcctgagaatcttacatgatttgcccacaaaaagcattgagatttacaaatcaatctattgggtttcagctacactctactgaaatcagctgcaaccttttttttttttctctctcttctttcatcacatcggtttgaatctttacaagaaatctggaaatcacagggaagtcagggttttccattttcaagctggttctgttattacgaaacacgggttgctggaaaagagctcacggattcttcaaacaaagttggcatctttcagatttgggagaaaaagttgttattcaagatctttgtgtaatctaagggagaagcataccatg

SEQ ID NO: 5646 - DNA, 3000 bp, Unknown; identical to SEQ ID NO: 5632
  misc_feature (1)..( 3000): cDNA_ID_1828969_gDNA_ID_1620807_Annot_ID_50565 3000 nt of promoter + ATG

SEQ ID NO: 5647 - DNA, 3000 bp, Unknown
  misc_feature (1)..( 3000): cDNA_ID_1828965_gDNA_ID_1620807_Annot_ID_50566 3000 nt of promoter + ATG
ttatttcaaatgattatttaatttttatacatttcacatattataaatattataaaacgtttttccgttaaatattttaaatgtttaactaactataatatttatttttaataaagtataatattaataaattcctaagatttctcctttttaaaagtaattagaattgatggaaatatattagataaagaaatgctaataattaagaatattaattagttataataattaaatatcaatgacatccactgtaaataagtcccaacttaaggatttatttactaaaatagctccaaaaatgtatatatagatgttatcaaaattcgaattaaaaagttgtaaaaagactcggaggcggtcaaaatcaatttttttattttcttgcataaatttgtgaactccagagaattaagaatgaccagtgatagagctccacgtggatagattgggttccaaagtgggacggcgttaaatataaaaaggccggaagttgtcgaagtagtcttttttcccattatttctgttttcggttccttattttgttcctttgtaataatgagtgacatcaaaaatatttggggacgaattaacaggtaatgtaaatagaaagaaatagaaaattttctttgattttacaatttggattcggattgcataagcaatgacatcaacagtaatacatagctgagaggctgagatgcagtgtctctctctcagggaagatgacaaaaagaatctgatatacacgtacgtatgttgcgagttacatattgatatatcacatgtcataagtcacatgctaacgataaactaataaactaaaacaattatgtcaacatatatcggtgaattgcattatcatcgacctcggtcactgttccgcacatcttggtcgccacggaacatagacaatttttggattgtagtccaattaatgagtcccccaccaaagccgtagtaaaatcgaagtcgttctctaatccaatcatatatatatccataacacacaccaacaacacccacacaacaaaaactagagtcagtaacaacacaagattaaaaagaaggagaaaatgagagaaggatctcatcttatcgtcttgcctttcccaggacaaggccacataactccaatgtcccagttctgcaaacgcttagcctcaaaaggtcttaagctcactctggtcctcgtctccgacaaaccctctcctccatacaaaacagagcacgactcaatcactgtcttccccatctccaacggcttccaagaaggcgaggaaccattacaagacctcgatgattacatggaaagagtagaaaccagcatcaaaaacaccttaccgaagttggttgaagacatgaaactgtcgggaaatccacctagggctatcgtgtacgactccaccatgccatggcttcttgatgtagctcatagttatggattgagcggtgccgtgtttttcacgcaaccttggcttgtcacagctatttactaccatgttttcaagggttcgttctctgtaccgtctacaaagtacggtcactcgacattagcatctttcccttcgttcccgatgctgactgcaaatgatttgccgtctttcctctgcgaatcgtcctcatacccgaatatactgaggattgtggtggatcagctctcaaacattgatcgagtcgacatagtgttgtgcaacactttcgataaattggaggaaaaggtacagaatataaatccatatagaggaacatgtctctgtcttttgtaggaagtgttttaagttttattttctctgcttgtagttgttgaaatgggtccaaagcttgtggccagtcttgaatattggaccaacggttccatcgatgtatttagacaaacgactgtctgaagacaagaactacggttttagcctcttcaatgcgaaagtcgctgaatgcatggagtggctaaactcaaaggagcctaattctgttgtctatttatcattcggaagtttggtgattctaaaagaagatcaaatgttggaactcgctgcgggtctgaaacagagcggacgtttctttctgtgggttgtgagagagacagagacacacaaacttccaagaaactatgtcgaggaaatcggtgaaaaaggacttattgtaagctggagtcctcagcttgacgtacttgcacataaatcaatcggttgtttcttgacacactgtggatggaactcgacgttagagggattgagtttgggagttccaatgattggtatgccacactggactgatcagcccacgaatgctaagttcatgcaggatgtgtggaaggttggggtaagggttaaggcagaaggtgatgggtttgtgagaagagaagagattatgagaagtgtggaagaagttatggagggagagaaagggaaagagattagaaagaatgctgagaaatggaaagtgttggctcaagaggcagtttctgaaggaggtagctctgataagagcatcaatgagtttgtttctatgttttgttgaatgatttaaattgatatgttcaaaagtacatcgtcttttgcaagtccaattgtaattcttgttgttgttgtagtaataactaataatatagtttctcatttgtcttcagctctctattaattccaagttccaaatgataacatgtgagttaaaaatccagggtttaataaaatatccaagccggataaaattttgcataactctataaaaattcatctcatttttttttaaaaatgaaatatacactacacacctaaagctactttaaatgtgacggccttatgcagtcaaaggtcatatggtaggttgaattatcatcgatgtctatccccacacatcttggtagccacgtttgacctttttggatagtagtcacaagaaaagtcgtaaaatcaaagtcgtcctctaacccaaccttataaatacacacacccacacataacagagtcagagtaagaacgaaagacaaaaaaaaaaaagatg

SEQ ID NO: 5648 - DNA, 3000 bp, Unknown; identical to SEQ ID NO: 5631
  misc_feature (1)..( 3000): cDNA_ID_2785751_gDNA_ID_1620807_Annot_ID_50567 3000 nt of promoter + ATG

SEQ ID NO: 5649 - DNA, 3000 bp, Unknown; identical to SEQ ID NO: 5630
  misc_feature (1)..( 3000): cDNA_ID_3409372_gDNA_ID_1620807_Annot_ID_50568 3000 nt of promoter + ATG

SEQ ID NO: 5650 - DNA, 3000 bp, Unknown
  misc_feature (1)..( 3000): cDNA_ID_1828957_gDNA_ID_1620807_Annot_ID_50569 3000 nt of promoter + ATG
ccccaaatcattccaacttttattttataaacattcgtggccttcatttttccactctgttgttttctcatacttttaataatttcttttgcccatttgtctttatcattcgaagaactcagaaacaactaactcttcattcttgattctcccacttaaacgacggcgtttttgcttaacgtttatgtatgcaagcaaatttacatacttttcgtgacctttggtttctgtgttgtgtgatatttactacgaaaccacttgtcaccaaaggttcttctttctgttagcgttgggttcgtgattccaagatcaatggttgtgaacttcactagttagagatactgaatcaaagagatgattcttccgagaattgggtaaatcttcgattctgattttctgggtaagaatgatcaagacccttcctttattttctttttttgttcttgcctaataattcttattctctgaatttgatttctttcttttaatgactcagaatcttccgtattggatgtttttgttcctgttcttgataatctctttatgactgtatctctacctctggattctcactgtcactgatgttcatgtctaatgaagcttctttaatttagtcttgttcgtgtcactgttcgatatttttaaatcaaaagttgctaactttgtgtcaatgatttgcttaagtaggactattttgagtttatggacatttgattcttaaattctgaggttgcatcagattagggaacttgaatcttggttactgtaaatttactaggagaaacctgagattgactattaactctgatatataacttatgtttgcttcttgcatttgatcttaacagattaaagaacacgtaacctattttcaattcgcgggtttgattccatagcttcttcagatcatacattctcgcaagtgttcgatacgggagtagaagaagaagagtctttctatgctcctgatcatgatgtcttgactctgcttcaacctaacttcaccagcaacgatgtctagtagtaccaagaacattccaaaacctcctcctcttccttgtattacctaccagcgttttcaatctagtacaaggaaaccttcgagcttaatgcgccttgtgcctaaagaagcacttgaaacttgggataagcttttcaaggaaggatctggagcagatacatatgttgaaaccgataacaagtctcactttcctgcccattcaagtgtcctggtgagttttattaactggtaattgagctcattttccgggcttactgatcaatattacaaggtttttgtcttctgcaggctgcagcctcaccagttatagcgacacttctgaatcaatcgagggataagaatgggaatacatacctcaaaatccatggagttccttgtgaagcagtctacatgttcattaggtttctatactcttcctggtatgttctatgtgttacaaatgctttcgtaatgcttgtttctcctttgaaccatgcctgatattaaaacctacagctacgaggaggaagaaatgaagaagtttgtgctccatttattggttctgtcacattgctactcggtcccatctcttaaaagactttgtgtagagattctcgatcaaggatggattaacaaggagaatgtgatcgatgtgcttcaactagcgagaaactgtgacgtgacaaggatttgctttgtatgtctttccatggtcatcaaagacttcaaatctgtatcttcaacagagggatggaaagtgatgaaacgctctaatcctttgctcgaacaagagctcattgaggcagtcatcgaatccgacagtaggaaacaagaaagaagaagaaaactggaggagagagaagtgtatttgcagctctatgaagccatggaagctcttgtccacatatgtcgtgaaggttgtgggacaattggacctcgcgataaggcccttaaaggaagccataccgtgtgtaaattcccggcgtgtaaagggcttgaaggtgcgctcagacatttcttgggatgcaagtctagggcttcatgttctcattgcaaaaggatgtggcagcttcttcagcttcactcttgtatctgtgatgattctaattcttgcaaagtttctctctgctggtaagttatatcgcacatttcagacaacgccaacaaccttaagatacagatggtaatcgttttcttaaccttgtaggaatttcaaggagaaaatgaagaagcttagcaagaaagaacaatctaaatggcgattgcttgtagaaaacattattagggcgaggaacagtctcgggcccttctcgtcacgttcttctggtttgatatagaaacaggttttagattttagtgtatagccagttagacacaaaaagaaaacgtacataggcgcagggtatagtgtatattgcgcaccaatacggcgcacaatagtggttttgaacaaacattgtctatatcaagttggttgttatatacatgccgagtcgtgattcgtgacagtaatgtgaagaagtttttgcatcatcactcattttatgttagaaattcaaatcaataatattggtcctaaacgactttatttagaggcagacaaaaaagatatacattaatgttatttatatcatgattgtcatgacttaacatatttcaagttgagttatctagtgaaaatatatatatcctagttcatgaaaaatgaaaatcaaccttcttgagtgttatacttctttttgtaaggataataattgatatatacggcgggtctctcgttgacttttgatggtgatttgactttgcaatgtcaccaagagcaagtagctaatttaaatcacttttaacttccaatttgtttatgtttggtcttcagactttacgtcagaataattatttttgtgtctttaaatgaaaacttcaaacttcatcacatcaaaaatctcaaccccatttttagttgtcttctttttccttgtttttcaagaaaccagacgaaa

SEQ ID NO: 5651 - DNA, 3000 bp, Unknown; identical to SEQ ID NO: 5629
  misc_feature (1)..( 3000): cDNA_ID_1828953_gDNA_ID_1620807_Annot_ID_50570 3000 nt of promoter + ATG

SEQ ID NO: 5652 - DNA, 2865 bp, Unknown; identical to SEQ ID NO: 5628
  misc_feature (1)..( 2865): cDNA_ID_2992610_gDNA_ID_1620807_Annot_ID_50571 3000 nt of promoter + ATG

SEQ ID NO: 5653 - DNA, 3000 bp, Unknown
  misc_feature (1)..( 3000): cDNA_ID_1828950_gDNA_ID_1620807_Annot_ID_50572 3000 nt of promoter + ATG
ccttgtaccctatgtaacatgtcttgttagtataaattttgggtcatgttgtgttgatgactctttagcgcatttcttattgacaaaaggtatggaattctctagagacgctggaatgatgatggagaataagcggaatgtctgctctctcggagaaagcagtatcaaacgccacaagtctgatctctctttcagttccaaggttttgcttatcctagctagttttcatggatttctcggtcgaaatagtcttcggtacaacaaattgcatggtaatgatccgtccatctttgttctcttaatggcaaacaggagaggaaggacaaggttggagaacgtatttcagctcttcaacaaatagtttccccttatggaaaggtaactttgttttttttggcaagcaaatcaaaagaatctgtctctcagctcatacttttctctaatgttcacagaccgacactgcatcagttcttctagacgcgatgcattacatagagtttcttcacgaacaagtgaaggtctgcagttcaataccaagcatgattcattcatctttatctgagttcccatgttcttttgtacaggtgctaagtgctccgtatctgcaaacggtacctgatgctacgcaggtgagtatgatcttgaatctcaacttcatttatacttagttcactagttctactctgcatctgacagatcttcacttggaacttgaataccttgcacggactgattttcccgtcttttgtaaccaggaggagctggagcagtacagcctgagaaacagaggattatgtcttgttccaatggagaatacagttggagttgctcaaagcaacggcgctgatatatgggcgcccgtgaagactcctctatcaccagctttcagtgtcacatctcaatcaccctttagatgaccaattcgactaatcacctactacgatctttgtgttaagcctaaaaaagaatgaccaattgttatttttctgatgatgcctctgtaacatatatagacagagagcacatgatgttggtttagaacagctcatggttggcaatgattgttattattattcgactgcttaatgcatccccttactttggacttgtgtaatatgcccaaacaggaaccaaatgattttaatgcaaagtaatctttatcccaaaaaatgcctcagatatcttaagcttttctttgtgtgattcttacctacagcatccaatacattattctagatctaaagacccaaggcaagctttctttcagtgctgaaggtatgatcgtggatttccctaatacatatagctttctttcagtgcttgtaatagtgccaaactgctgaccacagaattaagattatcctttcataagaacattggattaaatacattaccactgagaattgcaaaggttcagaacatacagactgttgataccaagggaccaaatagcttggacaaagataagataagtcggtcataatgtgtttttaactactagattgcaatgctttggcatatgtaaatgtgacagggaggatcatcctcttcagctctacatgggataaaactaacttgctgcagtaggcttgaccttctctcgcatatactgcagtagatgttcgcgtttccagttgtcgattctgcaaaacaagcaaatcaagaaacaaagaggtcagctacaaccttggaggaatgaagttgtgttgctgatagaggatgaggtgttaaagacatcacttattcatgctcacaacgagaaaatcctttcaaaaaccaatttaaactagaggtctaagtaaatgatacagcagaatgtaacagagcaacgagagagtgagaatagaaactgctgcagatccatggatagttatatttttatctaccaagctaacatggatatatcaggtcaccttgaacgtcttaaatcaggtcaactcgttcccccacccaaactctaatactaaagattctagcaaggagttgagcaaagggggttataaagcaacttacctaattgattccttatgttcaccgtcttcgtcgagcatgatcaacttgggtggtgagttgaaaatgtactgaactttgacgctagggaacttttctttctcttcttcaatgaaaccaacaatttcaggatagaaaaccaacttcctcatacacacctctaatatagcgccagaataggtaacctgcaatggcaaaaaaatgtaaacttctcttcattcatatccatgttataggagatgtttctgtattcatctaatctattcccattaaaattcaaaagcactacaaattacatgcctagtgatcgtaccttgctcatggaatcctcagaatcatcagcacaacatttcaagcaatcagataccaactctgcaaacaagatcaatcaatataagataaccaatttagtaattccactcctcaaaaccaactttagagagaatgatctagctcataaaatacacaaaaactaaaatatagaatcttttgggggaaaaaaagcaaaactgcagtaattgagatcaaataaagcacgcatagaaaggcacgaaccttggtccttaacgtattcagagagtgagtggcaatcggagcagagtgcaagaccgctaaaccctagatcctcacattctttagtgctgagctgctcttttgctgagatcgtcgatgccaatatcaaaatcatcatcgctgataaaacaaccatcttcgccatctctctctgtttcatcaacagatcaaagtcttcgcagatccgacgctactctaactaatgtcgctgccttgctatgatccgatccggtcaattccggttttttaagtatccgaaaaagcaatcttggtatagaggaaaccatctccggttataaataaaaaagtcttaaccgacgtgaaaagtgttaaaaccccaattcacattagcctgttgcgatctaaaacctctaaaaccctagaatcaaaatcgcccattcgagatcgagagagacg

SEQ ID NO: 5654 - DNA, 3000 bp, Unknown
  misc_feature (1)..( 3000): cDNA_ID_3076789_gDNA_ID_1620808_Annot_ID_168931 3000 nt of promoter + ATG
aaagttacaagtgaaagaaatcagtaattttttatttattttagaagtgaatttggtttgagacaaacacgaacaataaacttataaatctacttaattaattttctgcttagctgaatgagtttctaaaaaaatttggttgcttattaaagattaaacaaaatgccgattgcagatctttcacgtggttaatcaatttataaatttttaaaacaaaacaatcgaagttcaattttatttttgtcgtaatcgaagttcaattgttggatacaggtctgacgcgatcgtgataagattttatatgctatttaaaagaaatcatgtggcctggccaaacacacaagtgttattagtaaaaaactatcttcagacttgttttatataaatacatttatttgtatcacctattatgaattgttttttctccatatatatacgttgggttatatcttatttcaagtgggtagcttatactctctctgttcctttttgtttgattgtttagaaaaaacacacatattaagaaaatatattaaatgttgattataaatgtattatttttagtgttttacagttttctataactctaaaccaatgatagttaactatttttcttgaaaattacaattcaccaatactaaccaataaatattacatagaaaacttaaaaaattaatcttttagaaacaatttttttttctaaacaatcaaacaaaaaggaacagagggagtatttaattgcatcagttacaattttgagaaactctcttactaaaaataatataaacaattaataaataagtagagagaatgacaaaaataaaaaatagtttctctgcagagaaactttggagtaatgatggaaaaactatatgtataggtatgtgtttataattggacagaaactaaattatattaaatatatattttttttttttttgaaaaacttttaaagtatatgtaaatctattggtgagatggctaagtttctcttcttctattttttccttctggatattaagatctattatctcattattatatgtttaatccaagataatcacttacctgccggaattgattctcgttatatgtaaatcatcatgttaaacagttaaaaaaattgtgatatgatcaagtcctataaaagtttgaaatgatgatcaaacccaaacaaaattaagcttacaaaaagagaaaaaaataatatataagccttatgtttaacaaaatgtttagttgatataagtcgtttttaggatctgattggtgcacattttagctgaagaaaatgactcttaacgtcagctcaaaacataccaatcaagtaaaaagacaagagaaaataactatgctagctctactcttcatataactgtaaaaagaaagagatgttttcaccaatacaataggatgaaaatacttttcttttttgtttactccatttaaaagagttacttttactctatatttattatttataccaatgaaatcagacatttatatcagtttataagaggaaataaaactttaaagaaaagagagaaacatagcttttcgccaattttcactgtgtatctgtattcaaataattagagtaaaacaaaaaaaaattatacccaatcttaacataattattttcagcctttatttttcagctaagatgatttaccaatcaatttttaggtgagatagttatgatgcctaataaattggaggtgcaaagttcaacaaaaattttacttttatgtttaattgaaaaagactgcttctcagtttaagaactatggcccatttatagatactgattaaaacgtggattgtaaaatgtgggcaatcaatattattttaaaaatgtggagccatagttattaactgtgattaaatttccccctcctccactttcacgcaaactaatatttaaaacagtcttaactgtgattcaagtaataagatttttcttttattattatttgacagtacttcctccgtatcattttaagtgatattttaggaaatgtttttagaatgtagagttgtagaggaaaaactagcagaaaaacaaaaatgcaatttatatatagtacagaaggttagtttaattgtgtttcgagttaaatctcttttttgatatggaaaattattctttaaattaaaatatttaacatttgactttggataggagaagattaaaagctgaaaagctggaacttcaacacttttgagaaaagtgagctacaatagtattaatcttaccatttactgataaataaatatatactttctgttcaattttaatagttttcaaatttattcttgttgcacataaacaacataggatatataatttttttagttaggaaatatatgcttttacgtttctatgaaaattctagatatgattataatttactcttaaaatatgaaatagaaaaatggagtggaatattattatttagaaagatatatatatatatatatatatatatatttgtttgtatgcagaatgttagaccaatataattagtggacatttctataaaaaaacaaaaaattgtggaatggatgggataaaaaaaaaagagagatcaaagataacattttaagatgtttttctttctttaattttcaacaattttaggcaatttagtagtagggggaaatgtatttctatgaaaatccaaatatatgctaatgtatgcaacaaggaaagatatagtaaccaaaactccacttcatattacaaacaataattatttttataaaagtattgacttgtcgtctgcaaacgtgattacgtgaaccttactggtaataatacaaaaatcacagctctaatttgccaacccaatccagatctctctagttctcaacttctcatataattattcattaatatatttattttgagattttggttgattttttgatatataaatattggacttgccattttctattacaaccatcaaatctcaataaagcaaaacgaacaagaaa

SEQ ID NO: 5655 - DNA, 3000 bp, Unknown
  misc_feature (1)..( 3000): cDNA_ID_3077974_gDNA_ID_1620808_Annot_ID_168932 3000 nt of promoter + ATG
atgcgaaaaaactttaattattttttataatgatgatattatttttcgcaaaaatagaatcatataaagatgagaaatgaactataataattaataaaaaattaatatgataatttagatatcaaatctaatttgttgattttaataggttacttttttggaaattaataatgtatttcgtttttctaattaaattaaattaattaaaatttagatatcaaatcttatatgttgattttgattggttattatttttgaaaattaataatgtatttcgttttttaattaaatttaattaattaaattagtatttgactttttaatctttaaagagataaattaatttactctttaaaattttatttctaatggcatacatatgtaattacttacaaaaattaaggttatatttaaaatgtacttcccaaataatatagtaggatagtcgtcataaataaatttccaatttgttcaaattttttatataaaaaattaccaattgactttaatttggattgacttacacatttttagttgtcttgatgagaattaacaagaacaacttgcaagaagcttgaagagttatgaagtgatacccagagaaaggagtgtgaatgagaagtaaagatgtcatggagagaccggagacgattagtgcatttgaagaaaaagaaagtctcatgccatgtttggctcgagaacatacatatatagagagacaagccgtgttgaaaaaggaagataacaaaagcgtgctttgtcttttggtattatcatatatttataatcataatgttttctatcaagggaggcagaagaaactatactgtacgacgttaaagttacaataatgtttcctcgaagtcattagctcaatgtagtagtagagacaaaatcttttaactatattcgaatatgatactatgtttggagatggctgaattgctatataatttataaatttgttagcattatcatatatcgaaattgtagatttttttgggtcagaataaaaatctggttccaaaaatagaaagatgcatgcatcgaatgttttttttgtttctttcttttttcacttattaaatggagtatttagattctatctaacttatataaaattttctacgtttttggatttttttttccaatgttttttaaataatctatactccattagctatgaataacatcagttcatttgattctgtgaaggaacatcattattcgggcgtgctctttgggattgacatcctacaagattccggtctaagcgaaccccttcgataatatcgactttttattgcatagaacaattaataaaaattgaccattataataagacattgatctcaataacttagggagcattattatgtgagacaaaaccatgtgaccttttttttttttggtaggcaccgggaggtaaacacctccctgaatttatttatgaaattaaaattacatccgcactagtcttggaaccgaaattcctaactcatcatccctcaaaatcgagtctaaactattcgggggagaagcaaaagcatgataccctaaaggtaaatcgaacgcatagttagccaacccgtccgcaagacggttggcctccctatacacgtgcccaatccggactatccagtcccttgataagaagccatggcacatacgtaccaagaatgacagcgggtgggaagaaccaattcctgtccttaaaaacccaaccaccatctcggagtctacctcaagttccagccgcgtaatcccacgatcccacgccatgaacaacccgtaatacactccccataactccgctaaaggcgccaagcaacgaccaatattcagcgcaaaaccaaaacaccactcaccatactcgtttctcaacgctccccccgctgtggctaaacccggattgccatgagaagcaccatccgtgttgagtttacaccatcccaagctaggcttactccaccggacttgtctttccatccgactcctggaattgttactaccgctgccacaattatttgcctttgccacctcctgtgcgatgtctttcacaagcttcacacggtccctacactttctattctctccaaacacattcccgcatctccatttccagccccaccaacaagctatagcaaaagtagttgcccacgagataccattccatacaaaaccatcttgaagattctcaaagagccactccaataacggtttcaagaaaaaatcccgacgtttctgcgcaagactaacaaattttatacattagtgaccttttatcattagtgtttttctttttaacaaaaaagacatcagtgtttagggcgtacgtttacgccacaaatgataaaacccaaaatctcttcagggtttttttatagtaaagtttattaatcatcagtactacttacataaattaagtcacgggttatagaaaaacgttagtttgatattagcaagactaacaaatttatttaatgtatatgacaaataatcaaggactcaacaatgcaagtcatttgtttgatcatataatttggcgcatgatatcatggatataatcgtataaatcattttcataatgtactacgtacagtatccctaaataaatattctctgatgggccttattgctaaacaattgggcttagaaaaagcgtataaaagtaacgattttatcttaattcatgcttcagcttcacttgccccgctttatcagaacgaaaccctcatagagcaaatctgaggtaaattggttctctctgttcctcctgtacgacttttctccattggtaacgttttcttcttttcttcgaatcataatcttgtgttgtgtagcgtttccgtgttcctgaagcaaatttcgttgattgtttagattttcattaaaccattaattcgattaacctagaaaattgttgaaattgcttagaagagtttctaattttgtgaaattgatggtgttttataggttttggtttggacaaaaagaatg

SEQ ID NO: 5656 - DNA, 3000 bp, Unknown
  misc_feature (1)..( 3000): cDNA_ID_2170990_gDNA_ID_1620808_Annot_ID_168936 3000 nt of promoter + ATG
gctgcacaagctctgtcttgggcaatatcagaacataacatcagtaaaccttggctaaaacgctcagttgacgctagaatccgagatgcccaaagagaagtagacgatataccagagagcattgcggagctagagaaatacgcagaagacacagtttccactcttctgtacaatacactccaagcaggcggaattagttcaacaacagctgatcatgcagcttcacacattggtaaagccagtggtcttgtcttgctgcttaaatcattaccgtaccactgtaccagaaaccgtcaccagagttacatccctgcagatctcgctgagaagcacgggttgctcgtgaaacaaggtggacgattagaaattcttctggataacgattcaagagaaggactaagcaatgtcgtgtttgagattgcatctgttgccaatgcacatctcctgaaagcccgtgaactggcgggaaaggttcctgcagaagctaaaccggtactgcttcattctgtgccggtacaagttcttctggattcgttaaataaagtacaattcgatgtgtttgatcccaggattcaaagaggagttcttggtgttcctccactcttgtttcagtttaaactcaagtggtattcatggagagcaatgttttgaaaacttgtctttatctcccttttcttgcctcttttatttctggtttcaaagactttacattaaactccagcttacttgtatttcttttgtaataatacaaaattacaaatggtgatgaatacaaaataaagaatttgttttttacttacaaataatatacagttttcatatgttataatggaagaagcccatcttcttgcatttttctgtacaacaaatctgatttatcccattggcgtttcctacaaaagcctgagatcatcgtagtgtaggacacaacatcaggcttaagtcctttgcaagaaaggctacgaaacaagtcccacgcatcttcaacattaccaatcttgcacatcccgtgaatgacgatattataagtagtaatatcaagttctatttcactcttttgcatattctcgaataacaccaatgctttctctaccctccagttcatacaaagcccatacaacaaaatgctgtacgtcctaatattgggacgagaatccatccgactgaaaatttcttgcgccgcatctggtctacccgcttgaaaatagccctggattatagtgttgtatgtgatagtgtcaccaactaatcctctttgagccatctcgcggaagagtttcgttccttcatcaaccctcttagacttgcaaaacccgttaatgagagtattataagtcactacatcggggagacaacccttagttaccatcaaatcaagcatttgtttggcctcatctacccgaccgtgcatacaaagaccgttgatcaacgaattgtaagtgaaaacatccggatctacacaccttcgtgtcatctcctcgtacaacttcatcgcctccgaaaacttcccttctttcacaaacacatcgatcaccgcagtgaaagtaatgacattaggaacaatatccctcattaccatatctctcattagccgagctgcatcactccatctaccagaacaacaaagaccggccacaagagagttataagtaacagcatcagctctaaccccatctctttccatccgatcaaacagctccaccgcgtcattcaccaacccgatcttacaagaaccgtcgatgatcgtgttgtagataacaacatctggtctaaatcccatttcctccattttactaaccaaatctatagcatcaaaaactctattcccttgacaaaatccattaatcaaagaactaaccgtgacaacatcaggctcgtaaccaaacttcatcatcttcccaacaacagataaagcaataacaaatcgagagcatcgacataaacaattaatcacaatgttgtaactataaagatcatgaccaattccacaaacttccatatggtgaaacagagagatcacaagatcgtaattcttcgatttggcgattttactcaatactttactgaaatcaactattgaaggaagaggacgagattgaatcattttacagaacaaatcaatttcttcttctaaattcatactcgatctcttagtagaaaaagttcttccccagaaacggctaatgaaaggaacaattacaggattacctttctggagaagacacagattgagaaatttatttgcttttgatgcaattgagatcgtggtcgatctccgcatttgaattattaacctcgttttattcgtaatctatgtatctgtaaatgggggctaaaaccctagcataaaccctcttatctcctccatgggagagagacgatgatgagagcgagatatgaagaccggttcaattccggtttactattttctaattaaactgggttaatagtctaatttcaaaattattttagagctctgggttaattaattagtgccgttgtaacggtgaaataatatcggttgtgggtccattaagtgtacacgtgttcggactataatttgcatgttctctgttgtgtcgcgaagcagaccaattcgttgattttatgagatcagcagagtaatattccaaaatattcaatcgtcgacatcacaaccattttaattcgtattttttatatttatttaatgtaatataacttagttttagaggaaacatatcaaaattaaataattaacacgttaaaattacatcggtataatatgtataggagtttataaaattaaatttatcataaaagcatatgctaactttaattaagtgctttctttttaataatcaggtggcattaaatataattagacaattgatttgtttgattatattttggtgacaaataaattattaacaccattgtctaaccatcctttgcttttatagttctctttattctctcaaaaagcctctctttctctctcttttgtttctcgctgccatg

SEQ ID NO: 5657 - DNA, 3000 bp, Unknown
  misc_feature (1)..( 3000): cDNA_ID_2171006_gDNA_ID_1620808_Annot_ID_168940 3000 nt of promoter + ATG
actaaattcttcaaaggtcaagcctctcttacggtatttatggagttcatatagataactaattattacaactaataaatacaataattaataaataaagtaaaaatagttttatcacctcaatttgctttcttagattactaataaacgtgtatgcctaaattaatcaatatctaacattttcttagatcttaataaaactttaagtatttcataacattctacttaaattattttcatatcgacccattgtatggaagaaaagttccattgctaaaatttcacgcaattattaatgtatgaaaaatacttatatgtgaaaaatacttaacttaataaattcaatttaacaacttcatatacaataattatttatattcattttcataaattatttataatcaattaacgatttcttccatactttagaaatatgggaatccatactcttcggccttaaagatatatatatttggtcgtttatgagtaaaatatgttttttgaagcatatgtgacaaatccagaatacgttaaacattggagccggatgtaattggtaagctttcccaccaaaaaacctcagcttcaatcaagtaaaagttattagatatgattgagttattaatagactcaaccaattttcttttcacaagtttccttttacgtataatttattattatattatatcacatgttctatatatacacacactatatatacatacatgcacatgcccattagtttcacctaggccattcctcttttaaagcaatcgacgacccaaaaaagaaagcacgatacaaaaatgaacatcttatctcaaacccaaatccttcatctctctatagctattcttctcttcatcacaacatcatcatcatcattatcaccatcatcatcatcaccatcattatcaccatcaccaccatcatcatcaccatcatcggcaccaccatcatcattatcaccatcatcaccaccaccactatcattatcaccatcatcaccaccaccaccgccaccatcatcatcacctctatcatcattatcaccatcattatcaccatcaccaccatcatcatcaccatcatcggcaccaccatcatcattatcaccatcatcaccaccaccactatcattatcaccatcatcaccaccaccaccgccaccatcatcatcacctctatcatcattatcaccatcatcatcttcatcaacatactcaaatcaaaccaacttagattacatcaaaacatcatgtaacattacactctacaaaaccatttgctacaactctctatctccttacgcctcaacaatccgttccaaccctcaaaaactcgctgtcatcgccctcaatctcaccctctcatccgccaaatctgcctccaaattcgtcaaaaacatatctcacggaggtggtctaacacgtttggaagtagttgcggttgctgattgcgttgaagagattggagactcggtgacttcgcttcaagattcgataagggaattggattctatcaactataaagatagtgcaaagtttgagatggttatgtcggatgttgaaacatgggttagtgctgctctcacgaatgatgacacatgtatggatggtttcagtctagttaaaacggccgtgaaagatttggttcgacgacatgttgttgaggtagctcggcttactagcaacgcgcttgctctcattaatatgtacgcctctacgcaagaaaacttttcttaattaaatgttttcatacagaaaaaaattgttttatacttatactagaaaattaaaaagcttatgattggatgtatgtatacatgtatgtcacaccttgtacttgtcatataggtaggtattgttgatttttctgtataaatcgtatgtgaatattttgtatattattgaaagatggtgaaaaagttgcaacaccttgttgccttgttggactctttctaaggcccacaaatatctgcttggtaagattcattagtaatacaattagagaatcataatcatagacattgtctattttggtaattaagcaaaacctagttatacttgtacctttgtctttttttattttatttttcaatgttccttccgtctgttgtgaactagtctgtatgtgtttttgttttgttttttataacattagtttgagctatattaattagatttgagaacttataaatatggttatgagagagtaattggtctatacaagtaggacggaatcataaatgaaacacgagctatattgagaaatgagaatgtcttagacgtgccagcttttcgactactcagttgttatcgccaaatcaagtttgccatacttgtgaattcttcctttaacctaagtttgataatgagctagtgttgtgaggaataaagctgtactgttgttatatatacaccattaactaaaatacgcaatccatataaaaaaaaaacgcaatccaaaaatcgaacaatatttgaatatatgacttaaatggattgtcttttaatttggaattttaatccaaccaaaaccacaaaatataaaataaaagaaaactaaaatttctctgaaacgaaaaataaatttgaatcgaaattgttaatatattcactttacctttagatactaattatttgcccttatttctaaaccaaaaatcttaaaagaaaaaaaaaaaaattaatccaaaatccggattaaacacatagacggtgacgtgtctccttatccatttggaccaataaaaacttcagacaatttatagaccatataaattttaaaaccgacgagagaaataaaaaaacaatttttaaaccaacggttcagaaacaaaccacgccaagcccaaaaggcttcgttatccccaagccatacgagagattacgagtaagtgatacgttagccaaagagtgtcaccaattgattcaatatcccaagaggaagaagaagaagcaagagaagaagaagatagaagcgatttttataaaaatg

SEQ ID NO: 5658 - DNA, 3000 bp, Unknown
  misc_feature (1)..( 3000): cDNA_ID_2171020_gDNA_ID_1620808_Annot_ID_168944 3000 nt of promoter + ATG
ttcatgaaaaatcttagcttcaaaatgaaaattatgtatttgcaggaggataagcatggcaagtctaagttcgaagacagtgcctcaactcgctgatgctatacatgctgttgttactcgcatcgcctaattaaatttgcgattctgttcttttgttgtttaatttatgaacacaattagagaataaaactgcgttcttggtttacatttaataagatagcacaaagaagcaatattatggatgatattgtttctagttggtagtcaaacctaccaaaatgaggattgggacctttaaaccaacacagttttttatattttgttttcattttcaatttatataataaagattacatcaattaacaacacagatccacactcaaatcagatatgcaaatgatagagtccgattataaccggtaaatatactaacatgggactcaataatgaatcaatgataatacataacatgtgaacaaaaaatactttttgtttttctttaaatattaaataagttaagccaaaagcaaacaaatctcgagaatttattgagctaataataataaaaccgggtaaaggaattcagaagaagatggatgagatcaaagacaagatcacggtggtgactccataaccggcgagcttgttcccagctccggcgtcttttttggtattccctgctgaatatttagaaacccatccatataatataagacaaatcgtcaatcagcaaataacaaataaaaaatttataaaaaaataaaaaatctgacaagtttcattttttagtggttttgtccgaattattcaagtcaatactcgagacaaaataaagtacacaagtaaaagctggcattcacactctgtttatgttttttatatagaaaacaaaaaaagagagaaaaatctgggaaaattataagatcgatttagagtatcaattgaataattgccttgattaacaccatttgatttggttaattaactctactaatcaaatcaatcgaataattcaattaatacacaatcaagtcgatcaatatttcatttttttttttttttgataacaaagtattcaaggaaataattgtaaggagtaggtgaagagtttggttcatacctggagctggaggaggtaaagaagcttttggcgatggagctcctttagctaaacaaaaaacaaaaacatgattaatactgatatatgaaattgcaaatctctgtttcataatctcaacaagatctaaaaaatgttagcagtagacaaaaaactatgctaattttcttagtcacattcacattaatcagaatccacaaatccattcataatgcatgttgttgacaaaaaaattaaaaaatcggagatcggagaaaatgaaattggttaccggtacaagcggagagatcagtggtgacgttgcaacgacggctaagaccgagagctttctcagtggtgacgttgaactgagcgagcaaacctggactggtgtagattgtacagagacatgtaagttccttctccaccgcttctttaatcgagtcgcaacattctttcaccggcgttgttgtcgtgttcaggtcgttgaagcaagggactagcttgctcacgcactcagtttgtgcttcaatagtcggaaccaaaagcaaagccatcaccgtcatcgccgccgcaaagatcatcatcgtcttcgtcattttttttcttttcctctctctttgctttttttcttttggggttacttgtgatttttggttttgcttttgtttttggctataaatatttataaacttgcttaaggaacctttcgtattttactctttcttttttttcttgttaatactccattagtttaatagtatgtatcttttcttttaatgttaaaataaacgctaaggggacggtaactttccgtctaacacttataacaattagttgaggccgtctaacgcctataactattcgttaagatctaaacgattttagaataaaacaatatgtacttatatattatataaaaagttgaaaaacattatcaaaaagcctaaaattatcaaattttttgaaaataaatttaaatttaacattttaaaggaagataaaataaaataataaaaagtatagttttttttaacacaattatatatatttttaaaaagattcaaattttttatcaaatattataacacatttaaatctacacaatccatctaatagtcgtttaattcgcttaatgaccgcataatccaccaaaaatatttcatcgtctataaataccgaaatggtctaatagcgtttagtgccgctttcttaaagacttctttttcatgataagtttttatttctcagatacttcaactagaagattgaatattttttaggtaatttaataaattttattgaaaatgatgtttatattaattgccatttgacgtaaatctctagattctaggatgagttaatcacgttttgttttcttgccaacttttgttctttgtacacttcaatttgtagctgtcaaaaataaaaattatagcctatgctaatatagtaataaaacatctaccaaatttccataaattttgttgaattttcttgtggtaggactaggtcaacctgaaatactttgatcttcaagtaatttgcaagactaaatcatttcataaattttggatccaaaccagcattaaaccatatggataaccagcgcgataagaatagttctataattgggctatagaaaggccttacaaggttttgattaattgggcctctgcacatgtttaaaaggacctccttatattgccacgtgacaaacatgtgatcgtcagatcaaaacgtttaaacggttacgatctgatcaaacgtctctcagcacttgtaaattcaacggtcacgaatagtcccgccattaaaacagataactagataagagaagtttagagataacgtagctaaccaaaaaagcagagctcacacttagaaaacaaaaaacaaaaatg

SEQ ID NO: 5659 - DNA, 3000 bp, Unknown
  misc_feature (1)..( 3000): cDNA_ID_2171025_gDNA_ID_1620808_Annot_ID_168947 3000 nt of promoter + ATG
gagttgagaaatgaatacttgcgtgagaagttaggacttgttcctgtcgaaaggaagagtctttctcaagaaggggaatcgatgatctcttcactcaaagctgcaagactgaatcgacagatctttgattagtagtaaaatagatttagattaaaattgtattcagctgcgtctacgttgtaaattgttgttctaatcttttttgtacttaacgcaaaacattttggaaaacaaagctttgttacttatttgacgtgaagtgaagtttacttttcttattaaaattgaatgattaatcttcacatgggcttaggaagcccatataattggaccattgatcttaagcaaaaacgacgacgtattattgtttctctgattctctctttctctaaattatcaaaaaaacgctacacagtcgtcgtcaagaacaaagacgattcgattgaattctccataagaggtccgacccgaattcgaaaacccgtaagaaccgaatcgaagatgagcaaggatggtttgagcaacgaccaagtctcatcaatgaaggaagcattcatgctattcgacacagacggcgacggcaaaatcgcaccgtcggagctcggaatcttaatgcggtcactcggcggcaatccaacagaatcacaactcaaatcaatcataacgacggagaatctctcgtctccgttcgatttcaatcgattcctagatctaatggcgaaacatctgaaaacagagccgttcgatcgccagcttcgtgatgcgttcaaagtgcttgacaaggaaggtactggattcgttgctgtggcagatctgagacatatacttacgagtatcggtgagaaattgcagccgagtgagtttgatgagtggatcaaagaggttgatgttggatctgatggtaagatccggtatgaggattttattgctagaatggttgctaagtaagatctaaatctgtgaaaatttgaattctttagattagaacaaatcttaggatttgttcagaaagtgtttaattgttaatgtaattgggaatttggtcataattaagctgtgttatttgaaaagatggttcctttatgatattgaattctgcaaatgttgtatatgttcgtttggtgcttgaacttggttctttatgttctgcatcaaatcgttgctcctttgaggttggtttcgagttttcgttcacgatattagcgttttgttggtttcttagtttggtggaacttagtatgatagttttgttggttaggaacttggaatctttggaatggtataagtgatcttgtgtttgatcgtgagctttgtttgttcaaatatctttggaatgaatggtctagttatgtgtgttgggtgttcgggaaaagattatttattctgatgtgcagatcaatgaaacacagtaagtgtttatttctttttcttctgtgttgttcttcttattggcactgctaaggaacaagtgtcttgattctctggacattatgttgcaatgacttttggttagagttcttgttgtggttgttttgtggttcgtgtctagctcgcttgggtttgtttagaaggtgaacttccgataggaataaggagggggtttctttttcatgtgtactgtcgtctaacaagtttaaattaaatgatgcgttttatcaactgtgttgatcacttaatagcgtaagggtttatttgcgcgattcagtacaactggttattttgaaattgcaaatatcatacttttttttttggtaggccacagggagaagaatgtctccctgcattttattaatgaactataaaaataaatcaaattcggacatgcctcggaaaacctgttttatcgcacatgccaatgttatgcttttgcttgttttctaattaaggctccttttggaaaacctgtctgaatccgctatagtgaaaccactgagggagagaatcttattaaattaagatcgtgtaaggaaagtaggatctcgaggtctatcgtacgaaaagacaaaagcaataatggaacttattagtgagcgagagagaggacatggacacgtagtgtcgtattaagagaagataagaccaagtggctgagagattataaaaagacaagagggtcaaattttcactttggttgatagagtcaatcacgccatgagtagcatagtgcggtggcttctgggtagtctactttagctgagctttctaggtgtagcatctaacagccacttctttttctttctttgatgatgataatacaagtttgagtttagatagtgtgcatcactaaattggaggcgagaaccaaatattgtatcgtttaggaatttaggaggaagaaatcttttagcatcataaatctccacgtttaagtttcaactttcaagtaagaactacattaaacttataaatactatagtagctaattagtctttaaatactgttttaattgaatggataacctctatgaccatctaagttgtcactccatcaaaaaatcaaaaaccaatcagaaatatatttagagatgcgatcaaacacactctaattaaaaaaaaaaaaaaaaatttggtaaactctagatgcgatcgtaacttgactaaactctagacatcatgaataaccttggccaatatttaattacgttgacaaactagcttagggtagtttcgttgtgaagttctgatcccaacaaaaagctaaagggatcttatatagtcgagccaaatttaaacttttttttcttttaaataacctacattagtttattgcgtttgtaatgacatgaacatgttataaaacaaataacctaaaccaattgcatggttagaataaattagtaaaatatctcatagatgcgatcaagcgtacaggactttgaaaagcgttaattattgtttatttcttatttaacatgttgtttaactggactaagtaattatttatctcagcttttataagtaactttccaaaagatagtcaaaaactctcactcaatcgatg

SEQ ID NO: 5660 - DNA, 3000 bp, Unknown
  misc_feature (1)..( 3000): cDNA_ID_2171022_gDNA_ID_1620808_Annot_ID_168946 3000 nt of promoter + ATG
ggttaagtgggctaattgggttttccatgttaaagctgaccaacgagccggtatgatcatatctcaggccacggttcgtgactccgagacaggtatctaacaccataattcaaatatttacatttacaaaaaaaaaaaagtgtctaaatctatgttgatcatttgtcatgaaaagtattttaggttaaatggttcatttaatattatttaatgatgaaatttgactacaacattctttttcgaataacgtacgtctcacgcatgctgtttatttatgtggagtaagcaggtgaaccaagaagtgtgatgtacaaaggattcccatcagagttgtttgtaccgtacatggaccctgaggaaggatggtactacaaaggttatatggatgcaggcgagctcggtttaggacccacggcaatgccgctcgtgcctctcaacgattgccctcgaaattcttactatatagacggtgttttcgcctctccagacggcaaacccattgttcaacctaatatgatatgcttgtttgaacgctatgcaggcgatatcagctggcgacattctgagatcctttttgccaatgccgatgtatgtcctttgtttttttatttactaattaagttttatgaactaagggtattagatctttttaaggtatagttcggatttttaagaaagctatttcgtcgttttcttgccggagttcgctagccgttcaatccaagctaccaaatcggatatagtacgtataggtttaatatgattgagtttacggtttaggctttgtttttagtataagataactttttcttaaaaaacatgttttagttcaatttgtttccctttctaaccaatctaaatagacaaaaagtataactataataagcatataagggttaatttggttttcggtccctattttctggtttgattcggactggtttttatttgctttttggtttgaatgataattgattcataaattgacgacttaacagataagagagtcaaggccaaaagttacattggtagctcgaatggcaacttcggttggaaattacgactatattttcgattgggagtttcagactgatggtttgatccgtgttacggtatgtgaacacatttttttctgtatatgaatataatttgtttttttatcaagtttcctaagtttaaagctattgttaggtcgcggcttcgggaatgttaatggtgaaagggacaccttacgataatgtagatgacttaggtgatagggaggatgatgctggaccgttgatctctgagaatgtgattggagtcgttcatgatcatttcataacgtttcatctagacatggatattgatggaccgatgaataattctttggttaaggttcatctagagaagcagagagttccaacaggaaaatcgccaaggaagagttacttgaaggtcaagaaatatatagccaagactgagaaagatgctcagatcaagttgagcctctatgacccatatgaattccacattgtgaacccgaaccgaaaatctcgggtaggaaacccggctggttacaggatcgtaccgggtggtaatgcagcgagtttgcttgatcacgatgatcctcctcaaattcgaggtgcattcactaataatcaggtatttaattttaggctatgtttttatatataagattctgattagctataatctcggtttaggacttaatgtgtccaaatgttcatttaactgatgcaattggttttatcggtttagatatgggtgactccatataaccggtcagaacaatatgccggaggagttctaatttaccagagccaaggtgatgacacactacaagtttggtcagaccggtacgaaactaatttatgaactataccaattgagacataccgtttatggtttgaaacatttctctgatatctttgttttgtggtgaaacagggaccgttcgatcgaaaacaaggacatagtactgtggtacacactagggttccatcacgtaccttgtcaagaagattatccagttatgccaaccgttgcggctagctttgaacttaaaccagcaaatttctttgaatccaatccgattcttgggtctgctcctttcttcgaaaaagacttaccggtctgtagaccatttgcttcatcttgaccggttctgttctgactaatactctaatagtatacaagtagagaagatcaaatatccggtgtagccaaacacttgttgaagtttatttgccggtttttgcaataataacaaaacgtccaatatctgtaatccccgacgtaacataataccaaaaatcttcagtttcttcagagagaagttgttcgtgttcgagttattgtagagccagcatacgggctgttgctttgttgagtttgcttctcttaacgaagcagagaaggcgttggaaacgaagaagggtgaaactttttacagtcgtaagattattcttgacgtggctgagatggctccagaccctttccgactcaagtacaaccttgtaaagaagctttgttaccaagactttcaacaagaaagaccggaaagacagcagataaaatccctgttctgcggtaagaagactatcatctcttctgacgactgatagaagctcctttggtgttttttagttgtgatatctattccagttacgaagaccttcaatgcaagtatgcaactgtgctttgttacttcgttttttcttttcttcttgttaagtttttgtcttaattaaattaaaatatgcttaatttttagttatttacctaaataattaaaatatgcgaattgaactgatttggtaaataaataattaaaatcacaatcaatacatagtatgattcatgtggacatgtggttggacaggttggtgaacctaattatgctttaatttctcaacactttgttcaataattggttttttttttttttaatgaattttggggtcaaattcatttcaactgattcaatcaattctcatg

SEQ ID NO: 5661 - DNA, 3000 bp, Unknown
  misc_feature (1)..( 3000): cDNA_ID_3077987_gDNA_ID_1620808_Annot_ID_168943 3000 nt of promoter + ATG
gtgacactttacccataaacacaaaaacattttatgatgatttcatgagatgatcttgagacattttgttgattcttcttttgatacagttgttggatatggtggagaaaaaccaaatcaacagatctttgttggcacttctcgacgaaaacatagccaatgcatacaaaggaaaccaggttagacccggttaataattgagttgacaaaagaaatttgttctggttcgaagttcggttaggtttgattcgggttctgtttttgattaacatatgtatttcggttcttgctcgaacccatttttccaaaacgtgaaactcaagtaacccgaatcaaaccggaaaatcgaatgccaaaccgtaaaattgactatatgataaagcttttaatcatcgtatgaaattcatatgtatttgttgcagaaagaagcaggagattacatggagaagatacgctcttcagttcttaagtatttgacagtgtaggatcatatgagtcttcgaaagatttctcaagcttttgaatgttttctattatcggggaaaattgtatttatatttttgtttgttgagtaaaatgtattttctttttttccgaacgatgtttatatttttagggtcatttcagatcttcaagtaataaaaagaatttaatgaaataatagcgatgacaaaatatgaaatttcgtatgaccgtataatgcaataaaacaatgaaataaaggaccaaaattgatgatatgtcaagtgttttattttccaactagtatctcgaaaaatctacgtttgtaagcttttcttcattcattgcatgtctgtttagtatggaacaaagttcgctgtaacaatcaaatctcttttcttcgtaataaatgaaaccttttgttttagaaaacaaaatacatgaataagtatgggaagtgggaacctacaaaaggaacaataactaagaaaaaaaattatcaaaaaaaaaaaaattatatagaaagagaggtgacatttatgaaattgataactattggttccaagttccaagcaccactgttacataattatccttattattatcttcacatgcatatgtttgtttggttatatacgtaagagtaaattaagactagtataaataattaaagactatagtaaaatcaaaatgactcgataaatgaagaaagagaacatgcccacttgttcttgtattgtgttagctaccgacgtacgggttttggaatttggacaagattctttttactttctatcggcgtttacgagtagattcatgtgagttttttttcagtcaaccatgtaattattcttataaccgtagattcatatgaaacttatatggatgagttttcacgtgttcactaacgttacgtactacacatatttgtgttggcgtatatttcttcattccattttattttaagaaattttttcataggttttagaaatcaggaaattttcatatgttttagaaattttattttgggttttactttatttattttttaaatatttgttctggttaaggaactgtcatttctgatgagtttttctgttcatatgaaaagtgagagtaactacgtattctgttcatgttgaccaaagacaaattaaaattaagtaaatatctattcaacttccctgattactcggatgaatgctcatccgtgaactgaaaattaaatagtaaccaaagaaaacgcatgagagaccattgtcgtttgtatccattatgatctggataagcatctcaaataaacacaataatgcattgggaaaaaagtaactaattaaatactacaaaaattgcaatttcaattttaaaaaaactttaaactattgccagtgtaacttatggcatgtggatatgtgttgctcgtctgatcgatgactcatcttgaaacttaatctgcacattaacacatgtaaatagtactttttaaaaaggatcagaatgtagagttagatttggtcagtgggattttaaccaaagtgattgagatattttatttagttgtattttaatgatttagcacataaattaagtttatatatatatatgtttcattatctatttaaaatcaatttcaaccaatggaaaatcaaattacagaatttcaagaatcacaataataaaatagtaataattttacataaaaaaattaaaacaacaataaagtgaaacaatttttttttgtttaaacaacacttattaagaaacaaaagaagtatatacaaaaaatattacctctgctttattttacgtgatgtttaaaatttttgatacgcatattaaaaatcaccaaaatttcagtaatttatcttttttacataaaaatattaataactacaactaatttaataaataaaaatatatactgtaaaatgttattgaccaacaattattaattataattaattttacatagaaaattgaaactaccatttaaaatgaaacagaatgtttttaaaacatcatttaaaattatactgagaaaatatatgcaaaacaaaataaaaaaaaacttttatattagggatatggcctaacttagcccgaaagctatctcaagagttaaagattgtcacatcctttatatattacccaaagatcttaatcctaaccaatatagaacattttaataggcttttccgagatgcgtgtgagaaacggtccaagcctagaaatacaacaagacctatcacttgtgtggccatataggtaaaaaaccatttttgtaggaatttgtttgttggaccaaccataagctctgataccatattagaaacgtagtctaacttagcccaaaatctagcttaagagttaagaattgttacatttttatatattgtgcaaagatctaaatccaaatcgatataggatattttaataatttattttgacctaaatcaaaccctatataaacagcatccactgatacaccttctcttcattttagaaaaaataaacaaacaaacaaaccaaaacaccatg

SEQ ID NO: 5662 - DNA, 3000 bp, Unknown
  misc_feature (1)..( 3000): cDNA_ID_2171002_gDNA_ID_1620808_Annot_ID_168939 3000 nt of promoter + ATG
agggaatagagtttttgatgctatagatttggttagtaaaatggaggaaatgggatttagaccagatgttgttatctacaacacgatcatcgacggttcttgtaagatcgggttggtgaatgacgcggtggagctgtttgatcggatggaaagagatggggttagagctgatgctgttacttataactctcttgtggccggtctttgttgttctggtagatggagtgatgcagctcggctaatgagagatatggtaatgagggatattgttcctaatgtcattactttcactgcggtgatcgatgtgtttgtgaaagaagggaagttttcggaggcgatgaagttgtacgaggagatgacacgaaggtgtgtagatccggatgttttcacttacaattcgttgatcaacggtctttgtatgcacggtcgggtagatgaggccaaacaaatgcttgatttgatggtaactaagggttgtctccccgatgtagtgacttataatactctcattaacgggttttgcaagtctaagagggttgatgaaggaacgaaactcttccgcgagatggctcaaagaggattagttggtgacactatcacatacaacactataatccagggctattttcaagcgggtagaccagatgcggcgcaagaaattttcagtcggatggattctcgtcccaatattaggacgtacagcattttgttgtatgggctttgtatgaactggagggtagagaaagcattggtgttattcgagaatatgcaaaagagtgaaatagaacttgatattactacttataatatcgtcattcacgggatgtgcaagattggtaatgttgaagatgcgtgggacttgtttcgtagcctttcttgcaaaggacttaagcctgatgttgtgtcctacactacgatgatctcaggcttttgtaggaaacgccaatgggataaatcagatttgttgtacagaaaaatgcaagaagatgggcttcttccattataacatatgaaaactgtatattatttgtaagtaaaaaacaaattctttattttgtattcatcaccatttgtaattttgtattattacaaaagaaatacaagtaagctggagtttaatgtaaagtctttgaaaccagaaataaaagaggcaagaaaagggagataaagacaagttttcaaaacattgctctccatgaataccacttgagtttaaactgaaacaagagtggaggaacaccaagaactcctctttgaatcctgggatcaaacacatcgaattgtactttatttaacgaatccagaagaacttgtaccggcacagaatgaagcagtaccggtttagcttctgcaggaacctttcccgccagttcacgggctttcaggagatgtgcattggcaacagatgcaatctcaaacacgacattgcttagtccttctcttgaatcgttatccagaagaatttctaatcgtccaccttgtttcacgagcaacccgtgcttctcagcgagatctgcagggatgtaactctggtgacggtttctggtacagtggtacggtaatgatttaagcagcaagacaagaccactggctttaccaatgtgtgaagctgcatgatcagctgttgttgaactaattccgcctgcttggagtgtattgtacagaagagtggaaactgtgtcttctgcgtatttctctagctccgcaatgctctctggtatatcgtctacttctctttgggcatctcggattctagcgtcaactgagcgttttagccaaggtttactgatgttatgttctgatattgcccaagacagagcttgtgcagctggatggtttatgggctttttggtgtagagtttgtcaattgcttcttgccaccaaagtaaccgcatcaagccgattttgggatcagatgcaacatccatggctcttgcggtttctacattaaaagcccggagagcaaatgctgctttacgcatctcagttgggagttcaaggagacagaggtagtgatgatagtcatagtttcgtacttgctgcacacaataggacaatgctgaacgcaaactactcgagcctcctccattcatcagtataactccaactgtgtttctttctcttatcctacaaccatataaaccacaaacaagatcagttcataaaaacaatgaaaaactctggtttcttctatcactccattataaaacagtaacacagaattcatctacaaacacaagagaaaatcctccaattatcaccacttcaaataaatatactgaataattctcactaatccagaggttttgtgaaccgttaaactcattcaggaattaacacaaacacttggtggacaaagcactggaattggtatttaacaaacaaaatgagaacttttcaacattgcttaacacacaatcataaacccaataatcacacatggataacaaatgagatcactaaagttcacagaaactttccaattagtaatgtaaaatcgctggaaaccattaatgtcgtccaacaataacgaaacgagcaaaaaacaccttaccctaactcgaaaaactctgagattcaagtttcctatgtttaggaactgaatctaccatccaaaatccaaataaaatcaacctttcgacccgaaaatggaaatcgaactctgaacaatcgtgccggagaagaagcgttgggtcaatgtagagaaatacgtcgtcgattaatataaaaccactaatgttattacacgacgtcggttctgctacagtgtaacaggaagtcggttttgttataaaatgacacgacgacgtttttatgtaaagaactgtttaatgaataaacgtgattaggatagtattaacccgaaaccaaacactcttatatcgaacaaatatatatacactcgtatttattcgcctaaagccaaaaacccattagcccctcaaggtatcttccagaagcaacgagaagacctgcaagagaaaattttcagattcaact

SEQ ID NO: 5663 - DNA, 3000 bp, Unknown
  misc_feature (1)..( 3000): cDNA_ID_1829034_gDNA_ID_1620809_Annot_ID_50574 3000 nt of promoter + ATG
ttgaagaaaaatcttaggtttgctctcttctctctgatcttgatttctcttactttattttcttttccgtcacaattcccccgtgattttgataggttgtgattttgccggttagaaaaaattagttttctgatctccatctctttagtgatctcccgaggcattttatgagcctttcaaactccatcaacttagcacaccgcgatgatcttcctcctattcacaagcaaaaaatggtttggagtccatccgacgacaccgaggcgaacatctcgaggttagatagcgatgcagaatcctcgtcacatgtcccataggaactgagcagttttgtggctcggtaggataccctagcatacatggctcagtaattagattgcttgaggatgtcgagccgaagcctcttcagaaagaaaagtcgtcctctagtagtcgtcgaagcttgggcttctaactggaaggaagcgccctagcttttagctctctccgaggtgaagcttaaagatatttacttcgaaccggataagacgaagaagcttctgcaggctgcgcaagcgctttaaatggcaaaggctcaaaagaaacccaagccacctaatggacttgagggctcgtctcgacttcactgatggagtcacccttcgctgatggagtcacccttcgccttcctaccctaagccaaagagcaaacgatccccccgagggatttttaacattgtacgaggggttcttctacttctgcttcatgttgtttccgatcttgaggttgttcctcgagtacgtgacctcatacaagattgccctttctcagtttcctatgcgcgccctaaggcattgtatggggattattgtgcggagctatgaaacaaagacaaatgttatgctcgggcacctgaagaactacttagagattcactgaactccgagtccgattgataggtactacgcctcgcttgccaagaatgagccatatattgaccacttcttatttgtggcccccgacgactcttctcttcatgaggaccttctcgggaaaatcatgtcgagatggggaatacttggtagatggtttgtcaccgagcctcctactcttaatactaaccctattttatttattttctacagatcgtaccttcaagttccttgaatactgccttgccgacctcattcaagctcaaaaggaattatctgctcagaagtgcaattggcagaagcatttttgtcgagaaagggttaagagggctataaagttatcacatggcgtttcctgttcatccagctcagcatcctctgatcatcaatccagattctttgtcgagatgcagaagacaaagttgatgctttgggggttgaaatcccagaagaagaaaaaggaggccgaggcaaagcggcttcttgagacggatgttgggacgtagacagttgctcacgaggcgacaattaaattcaaaaagtcgcacctgaggcgacttctgtagagggaaacaaggttgtgaatcctccttccttggccactgaaccaagtcataccgaggcgaatgagaaacgtcaagtttctaaaactatcgcccttgaagcaggtgtgttgccgatcgtcacccccgaaggaacggatgcgtcgatggtgatggccttgccggttgatcgcaggccaaggcttccgggaagcgccaaaggagcaaagatcgtgaggcgaagaaaaaaaataaaaagaagaagagctaggaggaaggcctgccaatttacgaggataggatcgcctcggtgaattttatcgccttctgtacggggcatcttcttcccctacagagaatcttctagaggttgtgcgatacgacgaaacatcgtcatgttttctgaaggtaaaacatgttcttcttgttcctgaactgaattatactagggtgaatttctgttatgacatccctttgttttagttttcaataggctttttcctcaatgaacaaaatggtccgagcttacgactctgtgatttggagttgcttagatacataccagaagttggccaaggaaaagctggccgttgctaagcgcgtttaagtcgtggctagagcgaaggcaactgaggcgagtttgacaaaggagaaggccgaggaggacgtgatcgatcatacgattaaggcaggaaaggtagccgcgcacaaccttaaaaagaaaggataagtaggccgccgaccttgagcaccttaagcatatgctcagagaggagaaatcgttttgagaaaacaaagtagctcagacacgcaaggccacaaagcgggaagtctcggtgaagagaagtgatctatatgctaagtctgtgaaagactctcaaagaatcagaaggtttcaagtcgagctgaggagatcgcgcacgtggctcaatctcagtcgttcatctctaacggaagaatcttatctttctcggttttttcattttgtttaagttgctttgtaatttttgtttcgtatcatcatgattcagagtttttgaatcgagaggttagagagagagagagtagaacaattgtaaagagagagagctcagttttgagctaagaagtttagtggattccggagaaatctccgacgagacgtaggattccaaattagaatctgaactcgtaaaattctcttgtctccattctaagtttctcggtgtctagtatcaaacgagtgtgagagaaagtgagattgatcggtgttcttgaggatcaaaagctcacaaattggtagtagagccaggtagtgctaaggttttagatcgaatcaaagatgttgaacaataagctcaagatatctcagttcgacggatccggcggcttctctctttggaagacgcgaatgttctctcacccaagagtaatggggttaacagacgctttggtggaacaagctccattaccaccaatgaaagcagaagaagaatcagatccagccaagaagaaacaacggatcgaggaagaatgagcgaggatcgatatagatgagaaggcgatg

SEQ ID NO: 5664 - DNA, 3000 bp, Unknown; identical to SEQ ID NO: 5663
  misc_feature (1)..( 3000): cDNA_ID_2170541_gDNA_ID_1620809_Annot_ID_168964 3000 nt of promoter + ATG

SEQ ID NO: 5665 - DNA, 3000 bp, Unknown
  misc_feature (1)..( 3000): cDNA_ID_2170557_gDNA_ID_1620809_Annot_ID_168968 3000 nt of promoter + ATG
cacaaatcaatcttagaaaatatcatcgccccatgtaactcgtctagcaacagctcaattacaggaataggaaacttatcaggaattgttgctctgtttatagcacaataatccacacaaaacctccaagaagagtcttttttcttcaccaacaacatcggactagctagagaaaggactagtacttggcctgataattccagttactaacataacttctaccatcttctccaagaccacattagtagcatgtggataacgatatgaccggacaatgatagaagagacacccggcttcaatgaaatcgaatgctccagccctctaaacggaggtaattcaatatgtatgtcaaagatggtgggaaattctgacaacacaacctctaccactggtaacatctccattgtggccaaggaagatagacttagagacccttcagtcaaatcagactcatgaatctcaaccagcttgggaactgctagagattttaatgagacatttgacttatgtaaagatggatctccccacaaggtaacctgctgacctagataagtaagactccactcctgagttttccaatccacttctcatttacccaatgtttctaaccactcaactcccaacacaacatccacaacaccaagttccaaagacataaagttacctccaaattcaacaccaccgagccagaacagcacccctttacaaactccagaacaatgcactgaaactccattacccaacatcacctccaaattgttatcagcacacaacttcagcttagaacgatgtgctactgttggagtgatgaaattatgagacggcaccagaatccaacagcaccactactgtgctcctgccaatcattctcaataacttagtagttttgggagaatgacaccccaaaaaagaattatgagataaacatctcataacaggagaacaaggagcacactctacttcctccacctgaaaatcctcatccaaaacctccaattccagcccatccactactgttaaaatctgcaactcacgcaaaggacatacatgaccacgagtgtattttcctttacagttaaaacaaattcccttacttctcatcgcatcacgctcctctatagtatgcttttgacgaggttatgctcgttgaacctcctgacctggtgccccactagtaatcaaaaacggcttagtatacgacttgttatacgtacgagcagcaacaacattcttactccctcgttcactaaccatctgataataggcactagactccattctcaacaccgcaactttctgatttggtaatcctcgagactccttcatcttaataacttctttcatttctggttttaacccattgtagaaaatcttctccaagtgtgacacatccaaacccacaacttgagtagaaagatcctcaaactctgtcacataagatgaaactgatccttttggcgtattgcgaagaatgtgtttcccggatcatcctcaattgattccccaaaacgcagaaacagacgttggcgaaaatcctcccaagatcgaaactcatcgttaaccattttccaattaaaccacttcaaaacatcacctgtcaagctcaacgagaccaaattcaatttatcatcattatgataccttcccacacgaaaaaattctctccacaattgaaaaccatttgtaaggattagacccattaaaactggcatttcaatcttcttcaacaatccaacacaattatctaatggcaaaagattatccaaatacctttcatcctccataggagcacgacgtgaatggatcgacgacgaaccaacctttggtgactgatgaaagtcatgtggctgctccgacgctttaccagcacgaatctccgtacgttccaatgtagaaatcaccgatctgaccaacctgtccagattctccaatttctcttcatgttgagccttcgcttcacacaatcgttcgaaatttccctacaatccgagaatatcgtgctccatcacgttcttctccacatgatccgccacatacaactccgactcagcttcaacacccatcgcgacttagatcggaccagtttcaccgcaccaatgataagtttaagctactccgattgtaaaccaaaactttccgatgatcaataatatgatatctacaaattacaaaggttgtaactgcagaaatcacaagatacaatcattcttagctctcacacaaagacgattacaagagatcagcataaatctctctactggcacatcaccaggctaaaagtctcagcataaaaacatgaaatgcaacaataaagcctcaacagctatttaagcatctttgataacgacaaagtctctctctccgtcagagtcttcttccttctcttctttcttgaagtctctctttcggtctgagtctttgcccattcctgcgttgaccgccatgtcctcaatttctttaactccaatatgctgacgtgtcctgtcctctgcctcacataagcctgatgaatcgtatcaccaaaccaatactaaataattgatacaagtaccgaactgtaacgcccgtgaaccagaaaatgggttagggtttgtttttaaatcatccggtttaattggttgggttaattggaaaccctagagtgtgcctataaaagaaggaaactcgaaattagggctttatttagacacttttcgttttataaaagagaaaaagagagagaaggagaaggagtagaatcgttagggtttgggagaaatcagtttcgtcatatcaaatcgtggtcaaaggtaacgaaatttggtagagttattcccaagtcttttatcgttgttctccagtttttagaactggtttttgatttaaattggttgagttattcgaagtttcgtaagacacattttcgtaagacacgttttttcagacgcgaattaggaccaccggagattgacactgagatcgtggtctcgtctgttttccgatcggcacgagattttatg

SEQ ID NO: 5666 - DNA, 3000 bp, Unknown
  misc_feature (1)..( 3000): cDNA_ID_1829019_gDNA_ID_1620809_Annot_ID_168983 3000 nt of promoter + ATG
tgcattattgttggtatgatcgcatccgtaagtacatgcaatgcaatcgtatttatactttttggcgactttaggaaccattcgccgtggatcccacccgctatgtatggataacccatctagtctcaaacaggcttgatacatgaaaaaatgtgaaaacaacgtccaaacaaataattttggtcccgtaatgtagcacggaacgaaaaggcccaaaaaagtacctaaagatcaaaatttgtagtcgaaaaaaaaacaatggtattggcttgcttctttcgtcggagggctctcattgggctttccgaaaaactatcacatgccaagttttacattacggtttaaaagttatagagtcaaaaagttttaaccaaaaaaaaaaaaaaatagggatgcaacacgaggatttcccgggaggttacccattctagtactactctcgcccaagcgcgcttaactgcggagttctgatgggatccggtacattagtgctggtataatcgtatccgttaggacatgcaatgcaattgtatctatactttttagcgactttaggaaccatttgtcgtgggtcccacccgctacatagggataccccatcaggtcctaacgaggtttgatacatgaaaaaatgcgaaaataatgtttgaacaaataattttggtcccgtaatgtagcacagttcacgaaaaggccgaaaaagtacctaaaggtcaaaatttggaaccaaaaaaaaaaacaatagtagttaccattgtcttgcttctttcgtcggagggatctcattgggctttctgaaaagctattacatgctaagtttgggcgcatagtttaaaagttaaagttttaaccaaaaaaaagaaaagaaaaggatgcgacatgaggactttctgggaggtcacttatcctagtactactcacgcccaagcatgttaactgcggagttctgatgggatccggtgcattagtactggtataatggtatccgttaggacatgcaatgaaatcgtatttatatttttttggcgactctaggaaccattcgccgtgggtccaacccgctacgtaaggataccccgtctaggtttgcgaggcttgatacatgaattttttttgaaaacaacgtccaaacaaataattttggtcccgtaatgtagcacagatcccgaaaatgcccgaaaatgtacagaaaggtcaaaatctggagtaaaaaaaaataatagtacatatcattgtcttgcttctgtcgtcggagggctctcattgggattttcgaaaagctatcacatggcaagtttggcctcatgattttatagttatagagttaaaatgttttaaccaaaacaaaaatgagggatgcaacacgaggacttctcgggaggtcacctatcctagtactactctcgcccaagcacacttaactgcgaagttctgattggatctgatgtattagtactgatatgatcgcatctgtttgtacatgcaatgcaatcgtatttctacttttttagcgtctctagaaaccatgtgccgtggatcccaccctaatgtttggtcatttgatgtcttacaagccaaatgaagttatgaagtatcggctattgctttgggtttttgatgtttggaattgtcacatgtagaaattattaggctcattagtttttgaactctttaatgtttggttatttggtgttttgttggatacagaatttggttctgtcttaaacttctactttctcgtttagactagttcaaagacttttagatgttttttgctttgtccttaattcatttcattggttatacaacttctacttctttatatgagttcgggttttctatagtttcatattgattttgggtaattactttatgttttgggtacatatgagcaaaactgaacccaaactcgaaacatattttggaattcggataacacccatgcccgatctgaacccgatgataatttattcgaatccgatccgatgtctataaatatctgaacgatcctatacatgtacgccagaatacccgaaacaccttaaccgaatccgaatgagtacctgaatgcccatgactacctagaactatacaaaatcatcttgttgatcccaaaaatctgtttagaataacaacattaattttctcaatgtttcttcttagcttaaggagaaagaatatcattttttgacaacgaaaagtcgtagtatcagtgacttaaaactactccaaattcctaaccaattaattttgtttcggtggcattaataatgaattcattgatatttatattctgcgattattaataaatatctcatcggcggtctcaccacatttggttgattcaaaagtctccaaaccctttggaatcttcaagttgttcttcatcaattccacaaacccagaaacaatctttcttccacagagataacccactaatcaatttctctccttttccaattcactcaggtaaaggaacaatctttctatcataaactccattgttgatgaaaccctcgatgttggttgattcaattctgtgtaaattgcttttgaattgtgttatactttgagttttacaagtaaagcttgatcctttcgtagtgggtaatctcattctcgagctaaacgtgagacccttttgttccatggtgttctcgttttgtataaaactgtttaccccaatttccgatttctttaatactttaatttgattctctcttttggattttggtatataaagtgcagctaactttctgtacctaaggatttgactggttgttgcttcaagctttgattcgtctgtgtacagcatttgccaggagagccattagcatcactatggttgaataaatgtataagaatagtgaaattctttgagtgtgtatagatgttcttttgtggagtttgatccatatgtaggtggtttgttgctgcagctgattgtgtgggtttaggcagtgagagctgtttagttgaattcagtttttaaaggtgatg

SEQ ID NO: 5667 - DNA, 3000 bp, Unknown
  misc_feature (1)..( 3000): cDNA_ID_2170561_gDNA_ID_1620809_Annot_ID_168969 3000 nt of promoter + ATG
atgggcctctacaccgtccactaataaggtccctacacaaacctcatgtgctaataaccctaacattcatcacaaaacaatgatatctaaaacaacagaaataattcacaaagtctgagtgtcagaaatcataccagtgatcgctctgttgctcgtactgcctatctcacgcgtagtgtagccctgcggtgccgctccaatatgtgctaactgctgtacattttgctgcactccctgctgcacctgcgctccttgctgcaccgccggttgtactactgccacaaccatcagctgcagcttaggacaattcggcttgaggtgtcgtctctccctacagtggtagcattccctcgtctcagctcgcagctcgctgcgtgcaatccgctactttgtggtcaaggctcccacaagaaaaacatcccgcacgaccccctgtctagctttagaaggatgatcccacttcctcttctgcccctgcgcagggttgccgcccttgctaggtgccacctgccgctgagtcttcttcggttgtaccgctagactcactgccaccacttgcttctaaaggtcctcctctacctcagcagctgtctccaccagtgccgcttttgtggcgtactgtgacactctacaccgcaccctccagtccggtcgaagtcccctcaagaacctcctcatctgggcctggtcatcctccatgccccgacccgcatacaccaaaagtcggttaaactcccggtcatactcccgaaccgaccgctcaccctgtgtcagctcaagaaaacgcgcctccatacggtcgagcgcctcttgcggacagtacttggcattaaactcagccacgaaatctgcccaaaacatatccgcctgcctcctcttggcagtcacactccgccaccacaaatgtgcatccccctctagaaaatgcactgccagatccaccagatactccaccgagcatttgctcgaaccgaagttccgctcaacccgagacctccaactatcggcctcctcaggactagtaccaccagaaaaatatccggtgccaatcctctgcaactgctccatcatcctcaaataagatggaacctcctcagcaactgcagccctctgctgcacctccgccactcgtggcgcaactggagcctgcactggtaccacacctggtaaccgcttcaacaactgtctcagtaggcccgccaaaccaacctctagaacctgggctcctccggctgcggcagccaacactcctgggtcctcagcaccaacgacatgcacaccgataccgacaccagctccactagcccccactttggctgcaccagctatatcggcaccaagaccgtccccaaccccggctccacaaacctaggctgcgaacccagagtctgctcaactgtggcactgtgcccatcactctcgccggtaccctcgaggactcgtcctctatcgcgaccacgaccacgaactccagctactcaagaacaaaaggctaagaatatagaacaaacgaatatatcacaaacaacttaccatggaatctcatttaaggctcagagaagatgatgctaggactccaacaacacacaattgactaaacactccataatcaatcctcagtatgctaacatcctagctcatccaacatcaatcattaggaaaataaatcatcaattaatttttctacacatcttataactgtgatcgctctgataccaaattgaaacaacctgacccatttttttttaaaacataattaaatattcccataaatatctaattaaaccaaccaataaaacaacaattaaaccgcaagtcaaaaatattattttatgaataaataaataattcgaccaacaaaaccaaaaataactaacaatcctaaccgggttccaataaccaaaacacaaaaataaaacaaacgagttcctagatcatcctctcttctttgtcatgattccacgatcacactttatctttacctgcatcaacaatacaatgagatgcgtaagtattatcataaatacttagtgaggcgatcctcccatctacgagctatacacacaagcaaataaaagggtataaacacaaatacaacacaaacacaccagtcattgaacaattcaccaaaaaacacattcaccgtatctacatattatcacacaaaacaaatcatacaacccaatcgctcagataagctcatggtcatgcactcaccttaacaaattgattctaacaataaataaacccaggaaagactctccttgcgtctgaaacagtccagaaacgtcctacaacaagtcacaaccaaaagcaaccttgaagcaaacttgacatgaaaaatagaaacaaacaaccttaaatacaaaaccctaaaatacaaaccaaccgttaactatcaaatccctccggtgaaaagctaaccgtagacgtcacgaagcttcccataaaatctcgtgccgatcggaaaacagacgagaccacgatctcagtgtcaatctccggtggtcctaattcgcgtctgaaaaaacgtgtcttacgaaaatgtgtcttacgaaacttcgaataactcaaccaatttaaatcaaaaaccagttctaaaaactggagaacaacgataaaagacttgggaataactctaccaaatttcgttacctttgaccacgatttgatatgacgaaactgatttctcccaaaccctaacgattctactccttctccttctctctctttttctcttttataaaacgaaaagtgtctaaataaagccctaatttcgagtttccttcttttataggcacactctagggtttccaattaacccaaccaattaaaccggatgatttaaaaacaaaccctaacccattttctggttcacgggcgttacagttcggtacttgtatcaattatttagtattggtttggtgatacgattcatcaggcttatgtgaggcagaggacaggacacgtcagcatattggagttaaagaaattgaggac

SEQ ID NO: 5668 - DNA, 3000 bp, Unknown
  misc_feature (1)..( 3000): cDNA_ID_2170549_gDNA_ID_1620809_Annot_ID_168965 3000 nt of promoter + ATG
actcatgtgtttctctatattaataaaacactgattgtggaagtcaaaacttacacaatcgaaattatatttagggtacgtctgtgggatgatactttgcgagattttaaagaaaagtgattgcaaacaacagatagtgttcttgatattattgataaatagatgtgtttgattgtacaagtgattagattatgaaaagaaaagtgttttgccttcaaagtcagagctcttgagtcgtctgaagttgagggcgttatttgtgtgtctctcttttatgcgaagtccttgagtcgcttcatatagacttgataaatcgcctctcctgcaatattctcggaagatttgaatatatccttaagtcggttccagaacctttctgccttaaggaaatattccttattcttcagggacttcgggaagattttctgatttgatataatccttgaagattcttccatatcatttctgtgattctcgtaaatgatccggtttccctggaaattatcctttgagcgagacaatattttacaagtctttgccttgggtgttcttgatgttttccctcaggatacttcctctatgttcggtgatcgttcgagaggtggcttcggggtatccggcgtgttttggctcgggtgcggtgacgactgcatgtagcaaactatctcccaaggcgatgtaggctttccccgtagcgttctcataatcggcttgggttactgatatatccctattttcactgattttatctaagttttaagtataagattttgagtctttatgttgattctcgagtatttttagtgtcttttcaggtattctatgcagtgggacaacaatggaaatgaggatacattttgcagcaaaagctaaggaaaagggaagctaatgatgattttggactcaagaatcaagaggagtgtcgttcgacaccagtttcggcccaacaaagtccatgacgctttcaagtttacagaagagaaaatttgccccagaagacttccttatttgcattattagtccctggacgttttatagggtttatatacatttttttagaccctagtttcgattatcaatcttttttgcaaaaccctgttatagagagacataagctattcatccattgttttcagagattcattcagttttgaatacagtgaagagattctttctttctctcatccttattgatgtgtttatgttttcatactcaattatgttgtttgcttcaatcaatatgtctgagtaatctgcttgtcaggaatagggtttctcattagggattcatatggtttagtagattgcctcctctgctaggttatctgtagagttcttcatctttaattatgcttaatgctagatctagagaaattaactagatcttgaatccagacaatagatatgcccaccataggtatctgtagttggatctattatttgatgagccttgtttataggtgtgtaataagaatcagcctatctactaaggtgaacaatcgaactcgttaagaatgcatatttaggttaataatctttcggcttctcgggttattcttagctatagatatagggagtttcgcggaacaccaccggttattccattattagagtttgagtttaagaatggttcgataacaacctatctttcattagatctactaaccaatagtttccttagaataccctgatcctagctcttttcataatcgtttacaacacaatcaacttgctctctttttactttatttacttattatttcaatcatcacctgctagcttaatcttgacattgaactcattgtttgaacaaaagcattttgtgaattcgatccttaaatactgcaactgatctcttatttgagagagtagttcttaggataatttgaaccgtatcagttacgttgtgaagttagcacctacccattttgtgaacttaccccgaggcggttgaacagacaaaggacccaaggcgttttgacatggctcggggcaaacacatattttaccccgaggagactattagtcttcaactgtctggctcggtcttgcctgtgggggaattcgaccccaacaattagcccccagctcgttggtttaagagttaatgcgacgagcttcatggatggttcagccgagccaacaacttcttctttgaaactgattgatcgttgtctcctaacgcttcatcttccctgacggtcaaatttatgttgcgtgtgacgtttgtttcttgagaagaggaagcgtctcgcgtattctcgaattttcagcggatgtgacgcgtttcactgagctcacgcgcatttgatgcgcttgaaactctatcaaataacgagctaccccttcaaaaattcactttgaagtttttgaagaaaaatcttaggtttgctctcttctctctgatcttgatttctcttactttattttcttttccgtcacaattcccccgtgattttgataggttgtgattttgccggttagaaaaaattagttttctgatctccatctctttagtgatctcccgaggcattttatgagcctttcaaactccatcaacttagcacaccgcgatgatcttcctcctattcacaagcaaaaaatggtttggagtccatccgacgacaccgaggcgaacatctcgaggttagatagcgatgcagaatcctcgtcacatgtcccataggaactgagcagttttgtggctcggtaggataccctagcatacatggctcagtaattagattgcttgaggatgtcgagccgaagcctcttcagaaagaaaagtcgtcctctagtagtcgtcgaagcttgggcttctaactggaaggaagcgccctagcttttagctctctccgaggtgaagcttaaagatatttacttcgaaccggataagacgaagaagcttctgcaggctgcgcaagcgctttaaatggcaaaggctcaaaagaaacccaagccacctaatggacttgagggctcgtctcgacttcactgatg

SEQ ID NO: 5669 - DNA, 3000 bp, Unknown; identical to SEQ ID NO: 5666
  misc_feature (1)..( 3000): cDNA_ID_1829019_gDNA_ID_1620809_Annot_ID_50580 3000 nt of promoter + ATG

SEQ ID NO: 5670 - DNA, 3000 bp, Unknown
  misc_feature (1)..( 3000): cDNA_ID_1829011_gDNA_ID_1620809_Annot_ID_50582 3000 nt of promoter + ATG
acatattggttacaagtatgggcaatagagaagaaagggccagtattcactgcactatacactcctttagctctcatccttacttgcattgtctcatctttccttttcaaggaaacattttaccttggaaggtttgtcttttttttttttttttttttttttgctaaagtatgtaaacataagttccgatctacatgtctttagaacctgatattgagaatgtttgtgtttggacttggggatataaactggtgcagtgtgggtggggcagtgttgttggtgtgtggactataccttggtctatggggtaaaactaaagaagaggaaatacaaagatatggtgaaaagcaaagccaaaaagaaattatagaagaagttatcatcgtctaggattgcatctcaaaaggcatcagtacacccatattccacgtcctttgatacttttattgtcgcagttatcatatgaataatgtctaattttcatgtaatgtgtaaatattaatgtggagttttcttttcctcaacgtaatgttttattgattaaataatgaggtaacatattgggtatattagtgacgattagaggcagtagatttgtagccattcaccaactcaaaaagttgaaaatgaaggagtaactacctaaattgaagctatttatcgttccctttaaaatattctcatatatctagatgtagaatatacttttttccgatctaacttagttttcctacttactaaaaataccattgtaacaagactttgtcactacatgctttaacaatttcatagaaagaattaatagggacacatcaacacctttggctatagttagcgagtttttgacatctaatccacatccttagtaaatccaccgtctatgcatgagtactcgtgtcccttggtcagcgaatcataccaaaataaaaacatttaccttatttcaagattaaattttaaagttgaaaacctacacacaatttccacatgtatatatttattcttctctaaacaactaggaaaagaaaatgattacctttttcacccttaacgaatttcttaaaatattcttctttgtaatagcattttacataatattcaacacgtttaaagtttcttagcttataaaatgattttaatttaatattattagattctcataatctattgtattgtaatagcattttacatcatattcaacacgtttaaagtttcttataaatgatttttaattaaagtattagattctcatatctggttgtatcagattctacaataatcttactttgttggtttaacttagttttcttacttgttaaaaataccattgtaacaagactttgtctttacatgcgttaacaattttacaaaaaaagaattaattgggacccttcaacaactttggctacaattagccagtttttggcatctaatctcacatccttaaatccaccgtccatgagtacttagtggcgaaggcagaaatatatattacggagatcaatattaatatataattaaataattatattatatatatatatatctaaatactattaaaaaaaatttataaaacaagttttctatataaaaaaatagaacaaaaaatgatatcactagtgttgtaacttcataaattattgttgtttttccgacaaaatatagtatgtactatgtaactttagaaatacttaattttttgtttgtggtaaatacacgagtagtcacatgttattcatcattttctatttaaaaatttactaaaattttggtgaaaaatggtatacatcttttttgttattcgaaatttttaatttgtttatctaaacgtaaggattagtacccacattagttaattgttttgtatatctaaattcatgtttttaggggaataatataaccagttaccaaaatttgatatattaggaaaatatttaatataggattcaggaaattgatagaagaagaataagattgatatataaaaaaatatggcaattgagtgggggtgcaaaaataggatttgaacttcgagtaaaggttggtcaattctataaataccatttgttgttggtttaaacttaattttcctacttgttaaaaataccattgtaacaaaatttgttctttagtctatgctttaacaatttcagaaagaagaattaataggggggacccttcaacaccttggctacaagccaatctaactcgtgtcattttggttaccgaatcatacaaaataatggaatgtatttttactgattaagaatcacaaataaaattactttttacaaaatataaaatctaaacaaaaaatcttggcaagctcataaaattgtgctgtatttaaataaagtcttgaaatccgcgactctttacaaacaagaaatggttagctaactaaactgagaaaaaacagcaaagaaaatcagagagatcaaaaaaaagaaaaaaaagaacagagattcttttgaactaacgaagacatatgtaagtcttctttgatctgtgtttatatctctttgttttgctacccactcaaagatatgattttgcaaagaaagcttagtcttttgtgttcttgaaatcttaggtttgtgttcttgaaatcttcttaggtttatgttcttgaaatcttaggttatattcagctttggaattcagtgaggtagagaaaagaataagtttagtacggttgtcaaaagacattgatttcttgaaaaacaattgttggaattttaagaatttctgtggttgcgtggtgattttggttagttctaaccttaatttttctcaatgtttcttggtcttcacatttctataattacatttcttctatttcctattctctaatataattcataaaatatatattatgtgttgaattagtgtttctcatagagatttgaggactatatgttaagtttatactaagaaaatggttttggtatgtttttgcagcgtttctctaaagtagaatctttggtattcggaaaaatg

SEQ ID NO: 5671 - DNA, 3000 bp, Unknown
  misc_feature (1)..( 3000): cDNA_ID_2053625_gDNA_ID_1620810_Annot_ID_168994 3000 nt of promoter + ATG
cgaagatgacttaagggttgatgaagccaaggttgatgagagcaggcagatggattttgcaaaggttgaaaagcgtgttagaacaactggtggtggtagcacaggaacggttaggtatggactactcatcattcttcatctacaagatatcttatctcttttcacatattggctgtttgctttaacttgatgcactaatggtgtcatcctctcttaattcaggaatctgcgtatcagagaagacactgcaaaatacctgttgaacctcgatgtcaactcagctcattatgaccctaaaactcgttctatgcgtgaagacccacttccagatgcagatccaaatgacaagttttatctggtcagttgatgatcatcatggatcatgtggttgtatcatatcttttgatggtataaaataccaaccatctgttttacttgtatcatgtatgcagggagataatcaatatagaaatagtggccaagctttggagttcaaacagctaaacatccattcatgggaagcatttgacaagggacaggacatgcatatgcaagcggctccttcccaagctgaattgctctataagagctttcaggttgcaaaggagaaactgaaatctcagacaaaggacacaatcatggacaagtacgggaatgcagctacagaagatgaaattccaatggagcttttacttgggcaaagcgaaaggcaagttgagtatgaccgagcagggaggattataaaaggacaggtatggtttctgatggtttccttcttgagtcagttgcctgtagcattcttattgtgatatgaacagctatgatacgtttattttgtgtggatctgtttcattcttaacgtgtttgttgtgtacaggaggtgatattgccaaagagtaaatatgaagaagatgttcatgctaacaatcacactagtgtgtggggatcatattggaaagatcatcaatggggatataaatgttgccagcagatcattcgcaatagttactgcacaggttctgctggaattgaagctgcagaggctgcccttgatctgatgaaggctaatattgctcgcaaagaagcaactgaaggtctgtgtaagctctattccttatgtatttttggttgcatttaatggaaaaaatgctcctgaggaatgtctaaagaaacgtatttctgcatatgtaatgttgttttacaccatgtaacattggttttgtattttggtgatcagagagcccaaagaaggttgaagagaagagaatggcgtcatggggaactgatattcctgaagatttggagttgaacgaggaggcacttgctaatgctcttaaaaaggtaaagagtctcattcattctcttgcacagacgtttctttgtcctgcagttttatcttaagcacttgtgtttttttgttttgcacaggaggatctcagtaggagggaagagaaagatgagaggaaacgcaaatacaatgtcaaatacaacaacgatgtaatgatcatctaaaccaatcttaacactctaataacattttgtatcatattcttgatttagtgttgattaatcaaaatctctcatttcatcgcaggtgactccggaagagatggaagcttacagaatgaagagagttcaccatgaggatccaatgaaagatttcctctgaaagaagttggctttcattcccttttaccatgtaacctgaagaaacaagcttataatgttacttgtagtagtagtgttagtatgttgacattaaagctttgtggaagttttgctactactggtactaaaagctttttgttactgtcttaaagaaggcataatgtccaacatcgtctcttcttgactgaactttatctgattcgcttcttcattcgttactctatacgacagtttaatcacatatgtaggtactgcactcaagtaagatgttccatcgctgagtacactggcttgcccgcctgtggcgtatagggtcgagtatattagccaaaccaaaaaatttactagtgcatatgaaattaagaaccactcaatcaaaactaaactatggatcaacgtagtgattattttgcaaattagccaattaaccaacttacgaatatgaatttggattcagttttgttatcgtatgttttttttcacatatatgaattaagggtccaacgataagattacgaacgaacccacgaaccagagactaaaccaggaaaagcaacacgacaaagcgactatttaaaacaaaaataaaaatataatcgagctctggcaaagttaaaccctaattcccaaattggagtcacgaaagcaatctccaaatctatctcattcggttcgaagaagcttcaaaggcgattcctttgctttagctaactagtaattcatcgttttcatctttcgcctccacaatttccgtcaggcttctactcttttggtgtattgttgcggtgcttataacgtgatcccttcgtgattttcaggtagtttcgtcatgtcttggtgcacgattgagtcggatcctggtacgttggtctcttcttagtgtttaatgtctcttaatggggtttgggtttgtgctttaattgatttctcactgcattgaatggtttattagaacttaaactcgatgctttagatgttaagtccatgttttttgtttgtttgatgaaaagttgtgaaatttatgctcctagtgaatagtgatgtgagaatatctgaagtgatctgtgtgtgtgggtttggtactattttaaacattgaagattatctcaaagttggggagtattttttaggggtctaaggttattttagctgcatctgttgaagagttcatagtaacctgtagatagttcatatccggcttgaatgatatttgagtttatatagtaaacaaaagtgttggtatttggtatagatctcttgagtggttttctgcacactttaactgtctgtagtctgttttattgagattctctggtgtagtcaattacaatg

SEQ ID NO: 5672 - DNA, 3000 bp, Unknown
  misc_feature (1)..( 3000): cDNA_ID_2053583_gDNA_ID_1620810_Annot_ID_169006 3000 nt of promoter + ATG
taaaaattagtcacaaaaagatatttttaagaaaataaatatagttcagctacatcctaatctgtaagaaatattagcaatcgtttattacaaatttgttacgagatatttttgtgagaaattttgataaaaatatcttgttactgtgcacgtcaatcttctgacgcagtactaactaaggcatatctatgcttcatcatgataccggaaaatgaagatattttagttacgttgcattgctttgtctataaagatgaaaagtaattattttattagagatgattggtactcttaattataaagaaagtaggtttaacctacacaagattcaaagaaagctaggaaaaaacatttcgaaggaactctcggaagattccgactttctggtgatactacttccattaccattgtctagctggaacaccttaggctctaaatcctcaatgaagtaaatagagtttgggaggcatccgtaatactcatgagccaaaaccgagaaacaagtatcggtagccatcacaaatgcattgtctcccaaggtcttaacttctacccatttggctaattccttatctatcttgtaaaccttgaaaccagccgttcttgaaaattgaaataaggtcgattttctctttcgagaattctctttggggaggcgtttgataacgtaaagctctccacagcaatccacaaatctcatgtaatatctcctacagccattagtcatgttttcatcgagtgaagtttcgtaccttgacatttcaagatcggaattaatgcaccaaacgatgccttttgaatccaagacgtaagttactcctttgtgaactataatgtcggagaagtgatgacccatttgtttgaatccgttcaagacatttccattccagtagttgattgttccatccctaccgattccgagaattccatgatgatgatcatctccttccttcactttgacaagagcacttctttggtatcctggattcggtagtcttcccttggcgtccttaagaaccgcataagattcttgaatctcggagacagtgaaatccaaaagatcaaggctctcggaagaaatacgcaatggaaaacgtgagagagggttgaggagatggaatctcccggagttggtgtccatgtcggatttgattatccagcccttactcggagaggaggagagagtgactcggaagaaggctgcacgtgagaggaacgcgccggggttgcagctgaagacatggtcctctagaagggtctcacttggggcgatggggttgaagtcaatgagagggcgcctatggaaaggattcttcttcacgccggagacagaggagtgccatgatacacagatgctgctgaaacgcttgtattcaactagggagaacgatcgggcggcgataaaatggaggagctcctccggtaaggtagaccaatctaccattttgctactttgattgtttgtgatttgtgagtcacataatatatatatactacgtatacttacctaaaagtcctaacattttaggttccaaatggttgtgtttttaacttttaaagaaacaataaaatataaaatcaaaattcactcattcccataaataagaatgaatacattgaacctaaatgaaaaatatgagttctaatttgctaaagaatattaattcatattctattcgattttataccattaatgattttcatggttcatcatttgttgaattgaaatttaatagcagtacttaaagagtaaatactctctccatttgtagacaaaaatattttgggttgacttccctaaactacaccaaaacagggaccccaaatagtgtttgtacttaggcaaaaagatttaattatgtttcataggtgattgattatatattctaaataaacaaaaacaaaagcccaacaaatatatgagactaagacacaacaaatcaaaaatgaataataaatgttacaaattttagggttaaagcctttgtaaaaatgacttttagaatgacaatttgaccaactaacagaaaattattgattagtgtggcacccaaaattattacataaaatgtggccttggcacaaatcgtgtattgtttttgcgataagagaacaaatccatagcaaacgtttgtaacgcagtgaaaggaagattattagagcatccttattgatggtctcttaacacaattcttatgttaagagatatgtcttataactaacaaatgtctcttattgacttgaaagtagcctgggtctagtgaagtcaaccaaataatttcgatgtctttttccttgtttcttaagagatttattttttgctttaccatgccttttttattaattaattatgacgaatcataaacttttaaaaaatattgattgtaaataatttattgtataaaattactattggtttaaagtaataaagaaacaaattaataccaaaaataatatttatatttaaatattaattaatttttttaatatatgtgaaaactcataaaatcaatcattccaaaacagagagagtagtaaacttttgcggacgtgacttgatttaatgttttctacacttctgttatgataccaaagatgaagatattgtagttgctgtgtgtgtctataccgaaaatgaagctgaaacgtaagcttttttattaaagatgattggtactcacaattataaagaaagcagctttgacctaaaacaaatttcagagaaatctaggataaaacatttggaaagaactctgagaaaatcctgacattgttgcgatattacttccatgccattgtctagctcgaacaccttaatctctctctcgtcatctgtgaagtaaatagagttttacatcatccataaagccaaaactgagaaacaagtaacagtagaatcaaaaatgccttgtctcccaaggaattaacctctatcgtttcacctaattcctcttcgaacttataaccttgaaaccgactgtttgggaaaccaagtgaggg

SEQ ID NO: 5673 - DNA, 3000 bp, Unknown
  misc_feature (1)..( 3000): cDNA_ID_3078026_gDNA_ID_1620810_Annot_ID_169009 3000 nt of promoter + ATG
tggcttaaaccctttgatacaataacaatttggtaaactgttcgagtcgcaataaccgaaattcccgcacactttgtagttatcgcataggtccttcggtgagtaccatagttgcttccaactctgtgttgtctcaaaccaagtcaatcgttgtaataaacccgcagagtttaagtataatctcgagtataagtttgttttgttgattcggtatgagtaagtcacttcctccttacttgctgtgaaattgtaaaccatgtaatcaacttgaattgtccctggtacgctgctaaaacgcattccattccatggaccgctgcggtatagtatcgactccttgctgcatatgtaaaactcagggaactcgctggtttcgagttttgtcgaaaactcaccgcttgatggatcatctgttgttttccaggatctcaagatcctgttgaatccggttttctgatcccatcccaatttcatctccgcaagtaaagtatctgtcggaaaatcgaaactctgccatagaagtctgttattggagtctctgagcaagaaattaccgttatcaagaagctctgcagccactggtgatctcacatctcctccggttatattcgtcgaccaaacaggcctatcggactgatcgaaaatgacgaggttattgccggatattttgagagttccgttggagctagagagaggattgtctctgtttgcaacccatacgtaggttcttatagggattatcttgtaccatatgccgagataccaacgcgaacttgatgcgggattgaagaaaccgagctcgaagatttgactaggagatataatggttttgttgcttgagatagtgagagattctgtggctgaaagagtgtttggagaaacagagaaagcaagaaacagaattaaaatgaggaaaatgaagaaagaatggtggtagtttggtacacttctcatctctctctaggacagtttctcgtgttctgttttctttcttcttgagggaattttatgagaatttgagaatttttatcttcggagattcatattattgttgatgtgtgccgttatttacacgattactctgtatattacattgttgatgatatttcattttcggctgtcttttcttggttttcttggttttcttggtcttcttgttcgcatttgaaatatctatagactctgtcactatagagttgacctagcaaatgacaagaaaataactcgttagatagacatttacttatcagtgtttttgtaattttcttagtaactgacctttcttcgtttacgcaaaaaagaaacaaatctcgtcaacactccttatttgtgtgtgtgtgtggccaggcctatgcgtgtctcagagagatataaaactaatttgtgtttttctcgttataaataatcttttttttttggttttctttcctttcctacgaatatcaattcatgaaagaaattaacttacaccaccaagcttcaactatttcattcgctagacaagtaaatcattaaccttagactacaaaatgacatttgtttggcagagcttcgtattcgtagtgctgtgtgtactggccatcgcatcatgaccggttcaattctatcatgggttctagaacaaaattgttttttggctgcccttataaatttcttttaaagattttacattatttaaaaaaaattgtatgacagttctaataaaatttagttattaaaaacaaaagcaatacacaaaatatttatgggcccttctgttttattatttataaaatttagttataaaatttattatttattacaaataatgagacttgttacataaacgattttacaacgtacaattcctttaaagtcaccaaaatattgtcaataaatattaggtgcaatcataggttgttgttattcttgatttgttttgtatgattcttacttgttcagatcgtataaactcatcaataccacttgaaggagttatcaatattttatttccatgctttatatttttagaactttatctttttatttttgcatagaattgagccatctcataacatttgctcttaattgatgcactctctctttaaatgaatcaagaaattgttaactgctatattaccttcaacatttttttctaattcatatataattttgtattattgtgtaaaattttgtctttataatattatttgacatagattttattttatgaaaattttgtcaatacaaataattattattaatgttgaagactatgcaaatgcaaaaaaaaatagaaatagattttagaatatactaaattctattgctttcttcttctctagcttctctctaaaacatccacgaacacatcctctttttttaaattaacattattgtcatagccttataggactatctagtcatgtttagcttatggcgtagataggctagattgcgaaagcgtgtaaaccggttaaatacgaaacgtaattactttacatagtagacccgtaagtaaacaaataactcaagaaagccccaaaattttaccattttagttaattacttcttctcctcctttccctccaaatccttactcatccatgtccttctaaaagaaacctctgttcctgtctcccaaaaccaaacccttcttcgtctcgaagtaatcaaactctgacaacaacaactcgaattcaaagtaagcggctaaaatttcattgcatcatcttcaaatttcgttgccacacgctctaatgttcaagccaacgttagaatttagggtttttcattgcgaatctcaaaatcctaagacgttgtttaccaaaaagaacaaagaagaaaaaaccttactttacctttcaatgatcaatggttctcgtaaaaatagttccttttgcttctctgttatagccaaaagtgtaaagttcgtacctttgagggttcacttgtttaatgggttttgttgcgttaatctttcagagtacgaaatcgagtttggtaactttaatataaatg

SEQ ID NO: 5674 - DNA, 3000 bp, Unknown
  misc_feature (1)..( 3000): cDNA_ID_2053559_gDNA_ID_1620810_Annot_ID_169012 3000 nt of promoter + ATG
agggaggtcaggatctttacgttagactagccgctgctgaactcggttagtttctttcttatttgcatttactaaagtggttcttactttttgttttgattaaaaagttatgacccaaagtcaatatatcttcccaatctgcggaccaagtcatgtaatattgtccctctcgaagcaaagttcaaactccctaatctatagaggctttggtcaacaaagtacattcttgatgtttggtcaatttgtttagttttttttttttgtcatctgtttttaattagagatcaaaagattaataagagtttagctagatccaataccattataccaaaaagaatttttgtttaagttaaattaattattttgtttatttttcgtattaattttttttaatcaaacgtacaacaaaggatatttttcgtatagaagtaaatatatgcctcgtttttattgcagaggacaagagaatcaaaaatgaaaaaattataggttcgagtattggagtgagcattttgcttcttttaagttttgtcatcttccatttttggaaaaggaagcagaagcgatcaataacaattcaaacacctaatggtaaaataaatcattagctttcatttcctttatttttgtcaataaattttgataatcaaatgtcttgattgttttttttttttttaacgcctgaatgaaacagttgatcaagtgagaagccaagactcgctaatcaacgatgtggtagtatctaggaggggttacacatccaaagaaaaaaaaagtgagtacctagagcttccattgttggagttggaagctcttgccacggcaacaaacaatttttctaacgacaacaagcttggacaaggtggattcggaattgtttacaaggtaaaagtgattcaaaacatattgaaaatctaccacagcacatggtttcattgtataatcacatgtgtggtaatagggaagattacttgacggaaaagaaattgcggtaaagagactatcgaaaatgtcctcacaagggaccgatgagttcatgaacgaggttagattaattgcaaagcttcagcacataaaccttgtccggcttctaggttgttgcgtcgataagggtgagaagatgttgatctatgagtacttggagaatttaagccttgactcgcatctctttggttagtgactcaaacagcttctgttctaataattgaacatttttgtgaaaacgttaacttgttgttggttgtgttggatgtgtagaccaaacacgaagctctaacttaaattggcaaaagagatttgatattatcaatggtattgctagaggacttctatatcttcaccaagattcacggtgtaggattatccatagagacttgaaagcaagtaacgtattgcttgataaaaatatgactccaaagatctcggatttcggtatggcgaggatctttggacgggaggagacagaggctaatacaaggagggtggtcggaacttagtaagcaatcattcttcaacaaaacaaaaaaagagcttttatctcaagtccaaatattttcttaaaaacctcataacatatgagtttatattttgttatgcagcggctacatgtctccagaatatgcaatggacgggatattctcgatgaagtcggatgttttcagctttggggtcttgcttctagagattataagtggaaaaagaaacaaaggattctacaactcaaaccgtgatcttaatctcctcggttttgtaagctaaaaacctcttcaattcgatattgttttgcattcataatctgattataacactaaagaaatattacatcctttatgcacaggtgtggaggcattggaaggaaggaaacgagctagagattgtagatccgatcaacatcgattctttgtcatcaaagttcccgacacatgaaatcttaagatgtatacaaattggtctcttgtgtgttcaagaacgagccgaagacagaccagtgatgtcctcggtaatggtgatgcttggaagcgaaactaccgctattcctcagcctaaacgtcctggattttgcattggtagaagtcctcttgaggctgattcttcttcaagtacacagcgcgacgatgaatgtacagtgaaccaaatcactctctcggtcattgacgctcggtaatttgtaacttacggcccaatctgtttacatgcatatcattttataggtaagtctaaatagattttattactacatatatgattcgatatcttgctctatctaatttaatttagacaaaagattcaccacatgtttcacatgattttgatttagagcgagaattataaaaaaaaaacatttagacaaagacaaaaaaatgcaagatttggagttgtcactccaagatttgaagtttgagaccgaaactcaattaagtgggaattcagtaatgattaatattcactttttgtacatactactgataatagaccaatactggaagcgaacataggactttatggctattacaacagaggactttatgaaacaaatcgaatatataccttaaacttttatgaattcatcggtgaagcattctcttgcatataacatttagtatgtcgccagcaacattgaaattttgtctattctcgtacacacacacacaaatggttgaggatattatttttttggagtaaacgaagaaaagtcagttactaggaaattacaaaaccataattatcaatttaacgacttttaaggtcattgactcaattctatagtgacatagtctatagatatttcaaaagcgaacaagaagaccaagaaaatgtagctgaaaatgaaatattatcaacaatagagagaaatcgtgtaaatgacgttcacacatttcaacaccaaacatgtcgtaatctccgaagataaaaattctcaattatatgtacataaaattttcataagaagaaaataaaacagaacacaagaaagtgtcctagctagagagagagagagag

SEQ ID NO: 5675 - DNA, 3000 bp, Unknown
  misc_feature (1)..( 3000): cDNA_ID_3078018_gDNA_ID_1620810_Annot_ID_169019 3000 nt of promoter + ATG
gataaagtcgtttcattgtttgtagagttccgttgacgcaaaacgtgacgagaaaccgacaaaatgagacacctacataaccacgtggaatgatatatgccggaactataatgtaaagttcgaaatggagaacactaaaaagacaaaagataagctataaacctctaattaggtataagttaacacagtgcaacaacgtgaacatccatttggccaatcgacatattatgctctaaatttactaaaagagtgaattactcggtaactatacttattatgagaaattgattagttggttagtaaaaattaatatgaacatttacattacataacttttatatagattgagtgttttttttatcattatataatattttttatgtgaacatttcatttatcaaataaatgtgtataaaaccataaatctgatattctaaaaaaaaattttcttagtaaattagatatcaacataaaatataacatgttacagtaaaaaaaaaaaaagctattttgtgaaccctacaaaatcaaatatcactatccatagattttcattgcctttgggtcatttccctatctgttgtttacctttttgacgggtttctttttgcggagaagcataaaaggatttgatcgcatattcgcattaaaggctcaattggtagaaattgaagactaattttaaattgcaaacaaagagacccatgccacttgtgacttgccccacgtaggtccactatgttgtctcttttcatcacacaacactataagacaaattctcttataagacaacttgatccctaccatcacctaatgaatgatatatttttcaatattatgaagaaaaagaattatagagtattcataatcaattgggaatgattgaagtagattatgattcttatatatttcgggtgatttttcttacaaaaatacaattttcaacatgccatgcaaaacaattttttttttgctttttttttttttctcaaatcagattttattttataattgacattgcaaaaaagtccgaccaatttctaccaagaatttagttcgaaattggttagaccatttttgatcgaatcatgaattgctatgtttaataaattaactacccaagaaatgatatctaaatgactgattgatcgataatgggtagtaatttcatcttagacaaaataagcatagtatactatttcccccaatattatagttacctaattaatctcttaaacaactgattaatcgatttaagcgatcgacaaaatataacataaaattatgtttaatagattacaaatcctatatatacatcaagttaacgcctaatggttgttgtaaaacctttaactgtgttttttttttaattggtcagatttgttttagcatatttctttaaatcgcatttgagtggcggccaaagtttaacagattaaggaccctaattaagacctgacaacttcattctttgaaaacaacaaacccgtggtattacttaatcgctgtcaccgagtgcattacgaaccccatatgtccacatgcttctttcaaactaatacaaaactgaatacgatttccttcatcaataattgagtataataagatcttaaatactctaactacaattattaaaagaaaaggttaagtttttgccaatagcttccacgcaagtggttgaccaattcaacttaactttctcaaaacaatgagattccacctaaactatataaatgacgtaggaattatatgtattacactaatataacaactcttatatattagttcatctctcttattctcgcaaagttttatttatttatatttaatatttaataataaattaagttttgaatgctatttgtgaatttttttaaatgaggagctatttttggaagatttttttttttggagctatttatgtcaatctcccaaaattaaaatttacagattttatgcttattgtttttgatgttaatttggtataatatattttccttaaaatagaccattacctcaacaaatatttattgtaactaatcctatatatatatatgcaatataatataatatcatattatttaatgtttatatataataaattaaaattccattgattttatgtttacatatttttataaaatttaatatagttaaacttaaattagtttatctatattcgtaactaataaaccaatgtcaatttttatatcagcaatgaagaattaatttatgatttatttttttaaccaaaaaaaaaaaacaataaataaggatcatgacctatcaagatctggaaaatctttcaactgttacatatatgaatatatgatagacaaaccataaacatatcaacatcaaataattaacgtcattagctgtttactatattaatcacacaattataaataaaggtaactaactaaagtatctaaaatggaaagaacattttgttgaccacataataaaaacaaaacaaaaaaatagagacaaaggggttttacgtcatttcaattcctgacgaaaaaaatctttaacacagaggggtaaaactgtcatttggatatcggctcccactataaaaagcctatttgcttcgtgttttttggtcaccaaacccttcatcttcttcgtttcagcttttttttctctcatgtttctcgtcttcttctaaacttttgtgaccacccaaaaaaaaaaacgtaacggaacaaaaaaaaaaatgctccgatcacggaattgtaagatctccgccgcgaacgaagccgttatttctaatcgtctttcaatttctaatctcaaagttttattcgtttttgaatcctcgccattgaataatttgattaatcgtttttccgataagcttcgtcgttgaacttatctccgatctctgcaaattttctctcaaatctctccgatcttcctaattgattagaaacttctccatcgtttgctcaattatttcggatttttctctgtttctttccaacaaaatcttca

SEQ ID NO: 5676 - DNA, 3000 bp, Unknown
  misc_feature (1)..( 3000): cDNA_ID_3078022_gDNA_ID_1620810_Annot_ID_169016 3000 nt of promoter + ATG
taatcaagctaagtcctaaagtattaattgtagaattacgaactaagcatgaacaccataatcgatattaatgcagtattgcagtttgttaaccttgttctcttcttcctacatcgtatcacacaaaacagtgtttagtgtctctggtaaaataattgcaagaaaccagaacatcccaattgtgattccgaacagaccaaattgccataatccattattctgagtttctgaccaacaaccaccatgatagcactaagaattcaccaccaaaaccaatgtttgtctcaccataatcgctaaatttctaaagcatgttggaaatagctcaattgtatatatcatctccatgttaaaagaagagcagtcactaaaatattgccacaagcccattattaactttatcatcatgttactttatcataaataaaaactcgattattgatttggaaaattttgcaaatcaataaagcatacgatatggaattttttttcattctaaaatatgacaagaaaaatgcaaaacataagcaatacataagcaacacacaagcaaacaaaattataagctcaaattttaagactttaaaacattgctagttatcaactacacaaaaatgtgtaataatataagagaccgaaaatatgtgttttaagactgtagatagttgtcattaattttgttttaactaaaaaatatttataaaactattctatataacacttctttttctatgtgttattcgcaatacatcatacaagattttggaactgtcggaggaggcgcagcgggcattacttcatttaccatcgcagagctcatctcgatcgtgtcgtcggtagcggccacgccttggggaaaggattcatccgctattcttgttaaccttttttaattgagtcttcgaattgtgaacaaaagccttttgtgttgtacttggttcgaattgtgaacaaaactcaatggttcaatctttataaggaatccttatcatttttaataaatgttttttgataattatgaagtttagagtttttgtagagtctctatattttttattatctaatagtggagtctttaagtaagtttttaaaaacaaaagtattttttaaataatttatttgataaaacttaaaacttattagaaatattaaaattgtaaatatatatcataacttaaaagcacaaaaaaaactaaaaaaaaacaaaataaaaggcttacaagaagaaactaaaatccaagattccctatctcggtgaagactttcgttgaacatgttgtgtgtactaaataaacgagtggagaatgcagcgacaaaacaatagattcgaaaattgggtttgaacttttccagagatggaggtctccttgttatcattgtgaatcacatttgattttcacgatttgatgatcaagagattgttcaatcgccatcggagttaacaagagaaaagagaaagaaacgacatagaaaaatgaaaataatacgttggcaaaggaaaacaaatgtttcgtccaaaaacgttaccaattgagaagttgacacgtatgcgcaccttaacattattaaaaatccaagcttaggaatgcacctaagtttatataacattttttatttaatttttgcccattttaccgaaggattcatacattagaaactcttaaggatcactaatgaaggtggtcttagatcggttcaccagtgggcaaatataaaacatctatcgtatattttcttctagttaccaaatttaggattgcatttttgtttaattattttgttattctatgactccaaatggatatgtccggtttaacggctgatcaaatgcggttcggttctaataatgactaatatatatatatatatatatatgaagaaaattttgttactacagtagaaactctataaattaataatattgggaccatgaaattttattaatttatagtgatattaatttataaaataataaatattaatttatagaaatatttacgtgaaatacaatactaaattcttcttaaaatgttttttaatttagtttttcttatgttttgttgtttgtatattcagttatgttaaaaaaaagttatttttctcttgacttttataaaacatgaggcttaatccaatttatctttgtacaaatcttagcaatgattaaaaaatgttacaaaaccaaatatgacggataaatacgcaaagagttatgtgagtataaaagagataataccaactgtactctaaaaagagttataattatggtttgaataaaagtttcatataaaattagtgttagaatatatgcttaagatttatgattattaatttatgatattattgagaccatatttttacatagggatttcaaaaaaattattatcttattatcttatcgattttggttaatttttacattggtccgacttggaaccggtaaagtttattaatttatcgtgtttattaatttatcgaatattaatttatagagtttctactgtatatgacttatcaccatgagattgtaataactcttatctaataatactcactcaagtaaaagatccaataatcttcaaacgaaagtagtaccaggtatgaaactccagcgttgatgatgtgagcttctcaatatctactagtcaaagacgcatcggatcgatcatcggagttgcatcggaatttatcgggaaagaatggattgggcccaatgtggaaatgataagtcgtatgggcctaaatcatttagtcgtaggcccaatatgagtttaagctctttgatatttcagagaatgttattcaatttattagtaattttcaaatgatataaattcaatttattaatcacttggttaaaacttatacacgtgaaaaaatgagaaatcattttagtacattgttgaccatctttttcgtatagactactatctctgatctcttgcgagttaagtcagtaactaggaaaattcagaagcgctctcaatctcaaaaatatcc

SEQ ID NO: 5677 - DNA, 3000 bp, Unknown
  misc_feature (1)..( 3000): cDNA_ID_2053565_gDNA_ID_1620810_Annot_ID_169011 3000 nt of promoter + ATG
ataagtctgacggtattcgcgtggtagcatcttctaacatccaaacaattcagtattgcatcttcttgtgaaggattcagcttgagaaaacgacgaggagcaagaccatcacttccttcttgtaaacactgaatgcaaaatccttcatcctacacaagcagaagccaaaaatgatatgactacaaacatcgaaagctattacagagtttatcaatatcttttacctcactgtttcttcgaaggactcttgagataagattcaagttcacaccttcatcaccaggatgcaatgcattccagatacggatattagtagttaaattgacgagatgaataccgaaaaggcgttctttcttctcattcttcttcctccttccatcctcaacgaaaagaggttttgaagccaagatagttacatcattaggcctatctggatctaccttacacactaaagcaactatataaggttcactggaaatattgaagccatcaacatggtttggtctttgatctgttagcgagataagatctctaggcatcaactttgtactagcctcattacttattccactcaaacgcactttatagaacaagtcattaggaagcttatattccgcagtttgcataatgtagcttatttcaaccacaggtgcttgccacaacttcctcatactcgacaataaagcggcatgtgtttcttcgataagcggaggaataaaggtcttgaagtagtctccggttgattcaaactccataggtatcttctccacctgttataagcaatcaaacacacaaaattactctctaggaagcttctctttactcaaatgggacagagaacacaagaaagtaaaacagaacctgtcctttataaagatcaacattgagaacttcgtcaagagaccatgagagcaccagatcgactaaatctcttccttcaatacgcattctcggcatttatattaaagttaccaaactcgatttcgtactctgaaagattaacgcaacaaaacccattaaacaagtgaaccctcaaaggtacgaactttacacttttggctataacagagaagcaaaaggaactatttttacgagaaccattgatcattgaaaggtaaagtaaggttttttcttctttgttctttttggtaaacaacgtcttaggattttgagattcgcaatgaaaaaccctaaattctaacgttggcttgaacattagagcgtgtggcaacgaaatttgaagatgatgcaatgaaattttagccgcttactttgaattcgagttgttgttgtcagagtttgattacttcgagacgaagaagggtttggttttgggagacaggaacagaggtttcttttagaaggacatggatgagtaaggatttggagggaaaggaggagaagaagtaattaactaaaatggtaaaattttggggctttcttgagttatttgtttacttacgggtctactatgtaaagtaattacgtttcgtatttaaccggtttacacgctttcgcaatctagcctatctacgccataagctaaacatgactagatagtcctataaggctatgacaataatgttaatttaaaaaaagaggatgtgttcgtggatgttttagagagaagctagagaagaagaaagcaatagaatttagtatattctaaaatctatttctatttttttttgcatttgcatagtcttcaacattaataataattatttgtattgacaaaattttcataaaataaaatctatgtcaaataatattataaagacaaaattttacacaataatacaaaattatatatgaattagaaaaaaatgttgaaggtaatatagcagttaacaatttcttgattcatttaaagagagagtgcatcaattaagagcaaatgttatgagatggctcaattctatgcaaaaataaaaagataaagttctaaaaatataaagcatggaaataaaatattgataactccttcaagtggtattgatgagtttatacgatctgaacaagtaagaatcatacaaaacaaatcaagaataacaacaacctatgattgcacctaatatttattgacaatattttggtgactttaaaggaattgtacgttgtaaaatcgtttatgtaacaagtctcattatttgtaataaataataaattttataactaaattttataaataataaaacagaagggcccataaatattttgtgtattgcttttgtttttaataactaaattttattagaactgtcatacaattttttttaaataatgtaaaatctttaaaagaaatttataagggcagccaaaaaacaattttgttctagaacccatgatagaattgaaccggtcatgatgcgatggccagtacacacagcactacgaatacgaagctctgccaaacaaatgtcattttgtagtctaaggttaatgatttacttgtctagcgaatgaaatagttgaagcttggtggtgtaagttaatttctttcatgaattgatattcgtaggaaaggaaagaaaaccaaaaaaaaaagattatttataacgagaaaaacacaaattagttttatatctctctgagacacgcataggcctggccacacacacacacaaataaggagtgttgacgagatttgtttcttttttgcgtaaacgaagaaaggtcagttactaagaaaattacaaaaacactgataagtaaatgtctatctaacgagttattttcttgtcatttgctaggtcaactctatagtgacagagtctatagatatttcaaatgcgaacaagaagaccaagaaaaccaagaaaaccaagaaaagacagccgaaaatgaaatatcatcaacaatgtaatatacagagtaatcgtgtaaataacggcacacatcaacaataatatgaatctccgaagataaaaattctcaaattctcataaaattccctcaagaagaaagaaaacagaacacgagaaactgtcctagagagag

SEQ ID NO: 5678 - DNA, 3000 bp, Unknown
  misc_feature (1)..( 3000): cDNA_ID_2053579_gDNA_ID_1620810_Annot_ID_169007 3000 nt of promoter + ATG
aatccctaatctaatacaatctgtaaatcaagttaattctgataataaattatatattaatgcttcaaagatatccataccacaaaaaagtaagtataaacaataaacactatatttggtgtttagggaagtcaacccaaaatctttcatctagaaatggagagaatattttgtaatgctacaaattttcaagtccaggccaaaacatgcatctatcccacaatgatgaaccatgaaaaccatttatggtataaaatccaattgaatttaaattattatttttaaagcaatttagcactaatatcttgcatttaggttcactctatgagaagaaagaaagggagtaagggttggatgcttctaaagctggatttagagaaggcctatgacagaataaggtgggattttttgtcagatacgcttgtcgcagcagggttttctgaggtctgggtgacttggataatgcagtgtgtttcaggcccggatatgagcttgctatggaatggtgagaagactacacctttcaagccattgcgaggtctgagacagggtgatcttttgtccccgtatttgtttgtgctgtgcatggagagactctgtcatttaattgaaagatccatcaatgctaagcaatggaaaccgattaatttgtcgcgtggggggccgaagctctcacatatttgctttgcagatgatctgattttattcgcagaagcttcagtagagcaagtacagatcgtaaggagagtgttggaagcgttctgtactgcctcgggtcaaaaagttagccttgagaagtccaaaatcttcttctctaagaatgtctccagagagttaggcaaattgataagtgatgagagtgggatacaatcaacctgtgattggggaagtatcttggaatgcctgttcttcaaaagagaattaataaagatacctttggggagatcttggagagagtttcatcccgcatgtctggttggagagaaaagacgttgagctttgcgggccggttaacactcacgaaagcagtcttatcctcgatgccggttcactctatgagtacaattctgttgccgcaatctattctgaatcgacttgaccaactatcccggaccttcttatggggaagtacagcagagaagaaaaagcagcacttggtaaagtggtcaaaagtgtgttcaccaaagaaagaaggaggtttaggagtcagagcggctaagagcatgaatagagcacttatctctaaagtgggttggaggttgctccaagagaagaatagcctctggaccttagttttgcagaagaaataccacgttggtgaaattagggattcacgttggttgattcctaaagggagttggtctagcacttggagaagtattgcaattggtctaagagatgtggtatcgcatggagttggttggattcctggtgacggtcaacaaataaggttttggactgataggtgggtgtcgggtaaaccgttgttagagcttgacaatggtgagagacctacagattgcgacacagtggtagccaaagatctgtggatacctggtcggggttgggattttgcgaagattgacccttatactacgaataacacacggctggagttgcgtgcggtggtgctggatctagttacgggagctagagacagattgtcttggaagtttagccaggatggacaattctcagtgcggtctgcttatgagatgttaacggtggatgaggttccaagaccaaacatggcaagcttctttaactgtttatggaaggttagagtgccagaaagagttaagacgtttctatggttagtgggtaatcaagctgttatgacagaagaggaacgacatcggagacatcttagcgcctcgaatgtgtgtcaggtttgtaaaggtggagttgaatctatgctccacgtgcttagggactgtccagctcaattggggatttgggtcagagttgtgccgcaaaggaggcagcagggtttcttttcgaaatctctgtttgaatggctctatgataatctgggggataggagtggctgtgaggatattccgtggtccaccatttttgcggtgataatatggtgggggtggaagtggagatgcgggaatatttttggggagaacacgaaatgcagggatcgtgtgaaatttgttaaagaatgggctgtggaagtgtatagagctcattcaggtaacgttttggtcgggattacgcaacctagagttgaaaggatgattggttgggtgtctccatgtgtgggctgggtgaaagtgaacacagatggggcgtctcgtggaaatccggggctggcttctgcaggcggagtactacgagattgtacaggagcttggtgtggtggcttctctctaaatataggccgctgctccgctccacaggcagagttatggggagtgtattatggattgtatttcgcatgggagaagaaggtacctcgagtggagttggaggttgattcagaggtgatagtgggttttctcaagacagggattagtgactctcatccgctgtcattcctggtgcggttgtgccatggctttctacagaaggactggttggtccgaattgttcacgtgtatagagaagctaatcgtcttgcggacggattagcaaactatgcattttcgttatctttaggctttcactcttttgatttggttcccgatgcgatgtcatctttgttgagggaggatactcttgggtctacccgaccaaggcgagttcgtttgtaattttctttagtttcttaataaatcacgggaggcaattgtctcccggtcacttaccaaaaaaaatgagtggattttgtttttatattttcttatttctttaaaagttacaaaaacaaccctatgaaattattaggtttcttgtgaagtacacgaagcgtcgtataagtaaatattagagatattatgtgactcacaaacaaccaaagtaacgaacgaaacagatagagagaagagagga

SEQ ID NO: 5679 - DNA, 3000 bp, Unknown
  misc_feature (1)..( 3000): cDNA_ID_3078034_gDNA_ID_1620810_Annot_ID_169004 3000 nt of promoter + ATG
acagaaactagacactgcctaaagttcacaatgcttgaaagctattaaaccacaaaatggggcaataagaaccatatatacagatgaccataagcaatagaacctagacactctcaatgctctgaaagctatgcaaaactcagattggggtcaaccagagtcatccccatatcctgctacctacttaaaaagtctagctactagctagtcagtaagattacaagaaacggaaccgaaactagacactaccttaagtatgcaatgcttgaaagctattaaacaacaaaatggggcaatgagaaccatacacacatatgaccataagcaatagaaaactagacactcccaatgcttgaaggctgttcaaaacacagattggttaacgagaatcagacacatatcctgcgacctacttaggttctagctaatcagtgcttgaaagaatgaaagctattaaaccacaaaatggggctatgagaaccatacacatatcctgcgaccaagttaggttctagcaagtcagaaagaaaacaagaaacagacttctcgagtcacgaccttggttcctttgatgatcaatccatttaagtattaagctcctaaactagtcacattggtatcaaagataatgaataaatccataggtaacatcataatcacacttatatatatctaagaaacatcaactacaaatcgtaaaaacactgatacttagagtatagtaagtttagataaatccataacagagacgaatttacttgtacgcaacaacatagataagcaacaacgtaaatcatgataatatgcagaaactgaaattcacaacctcaaatcaagcagcttccttcacaggagcaggagctggagctggaatcttaacataacccaatttcttcaagctagcagcatcagattcatcattctcataatcatcttcttcttcctcaaaatcatagctttgacgattcacaacaagagcccaaacaagatacatagtagcagcggttaaagcaccacaaccaacaccgaacaaaagcgcgacgacgacgctaagaatatctctggttcgatctctaaacgaattgatgttatcagagatcaaagggagggaacgatccgattggatctgtggcttctcgtgacgacgattgacgaagaaaggaaccacgtggtgaggatttagacgacggattgtgaaaacggtgacgaatcgtgtggaggtgaaatcggattcgaggttagggttttctggggttattgagagggaatatgaggagattaggaaggttttgcaaggacgtgcggtggtgatggtggtgattgagaggaaagctacgacggcgatcgcaaatcggaggtacgatgatgacgtcattgttatcgtctttgacttcttcttcttcttctgacgattttgaagacaaacctaacccaagaagattcggtgaacgaagaagattaaaaagattttctaagatacgtgttattatgaaataacccctctacttttgtatttgatcatataggtcccttttatcttcttttcttataaaaggtgccaaaatattatttaattttgacttaactattttaagtctaaatctcattatttatactcacataagcaaacaatagatttatttctctatttatctaattttcaataggttaattgttaattgatatgaattttgtccaagttatacaagttctaataccacaaatagtttgtgtaatatgtgaatagtctgaacccacctcgcatataatcaaacttctagtagttataaattcataagatttttgttattctaagcaagttaatgatgcattcatggtcaatatcaagttaaccatttgtttattaatatagtatagtcaaactttcacattttatatttattagtcaatattaatagctaagatttttttacctaattattatggttagagaatctaaatgaaaattctatctagtcactcatagtctcgtaccatagaataagagcacgacactttcgaatattccaacttttctcttatttaaaataatcctctcctttcttgtaaacaaagagctaggttagacttaaatttagcagcggtcacagagcgataaaggaaaaaaatgacgatctcaaatgccacgacatgacatgatagaatctttgaggccagccatgagcccatgaggatcatccttcgtggcaaagccagctcacgtttagagtctttaacaatgtagtgagagaacataaaaatgaaaatgtcaaatcggtgtaaacgtttggacacatagtttttattttttttggtctttccacataaataatttggtactattgaaaagcgatagaaatattttttttttgggaaaattgtggtagaaaaagtaaaattcccttgtaatctttaattataaaaaatattggttaatagttaagtactccgaaattaaaagtaatttgaagaacaactcactatataaacgactattgttctgaaatcaaatgttcaaacaatatttacgtgtattttcattttaatattttaattcttttcaaaaaaacacatttgcaactaaaacttaattctgttaagattaatacaatctacgacccgtcataattggctcgtttaacacgtaaacatgtcataatctaaattccaaaatccatttacgtatcaatttaattaactctaaatccacaccaaagaaaaaactcagattttacactgtgtatacacaccacaccatagtccacgtgcacgtaggttaattatttataaaaaaaacacatttgacttataaatatagaaatattaaaacagattcgcttctctctctcactcacacaatagagagaatcattcagttacaagaaaatcgtcctcttctctcgccgatctcttctcttcagatcctctcctctataaaatctctccctctctcgttcccctcctcagatctgactcaaatcaaatcaaaaactctcagct

SEQ ID NO: 5680 - DNA, 3000 bp, Unknown
  misc_feature (1)..( 3000): cDNA_ID_2053621_gDNA_ID_1620810_Annot_ID_168995 3000 nt of promoter + ATG
tccagttttaattaaatttaaaacatcgtgtgtgagttgacaaaatcaaattacaagctatcttgcagttttacgtattacctcttttaattaaacacaaggcaacaatgttttttcttatataaacaatttaccatctgaaataaacatactttaccaatcgacgagagatcacaagtataaggagagtactactccctctaatcatgcacccctaaaccataaaccacttacatcttcgaaatagttgaaattgaagaaagaaataagttgatatggtagaagtttatgagttattaactgtgatggtttcactcattgtggtgaagctatttcattggatatatcagtcgaagaatccgaaacctaatgaaaaactacctccagggtcgatgggttttccgatcattggagagacttttgagttcatgaagcctcatgacgcttttcagtttccaacattcatcaaggagagaatcatcaggttcatttggtaattttctctagcatgcagtaactcataacttacttaagtaacgttgtcttttttttcgatatggaaaaaataatagatatggaccaatttttcggacaagtttatttggagccaaagttataatctcgacggatattgaattaaatatggagatagcaaagacaaaccatgctcctggtctcacaaagagcatagcacaactctttggagaaaacaacttgttttttcagagcaaggagtctcataaacatgtccgaaacttgacattccagttgttaggttcacaaggtttgaaattgagtgtgatgcaagacatcgatctcttgactcgcacacacatggaagaaggagctaggagaggttgtcttgacgtcaaggaaatatcaagcaaggtaaagaaaagttatccatttcgtactcttgttgatattgcaatccactagatattggatgatctcaaatctttgtatatttaaacgttacagattttaattgaatgccttgcaaagaaagttaccggcgacatggaaccagaggcggcgaaagaactcgcactctgttggagatgttttccgagtggctggtttagattccctctcaatcttcctgggactggtgtttataaaatgatgaaagtaggtgtttttagtaaccttaattgtagtaatttttctacaaaattaatgatccaagccgtgaggatgatgtttcgttgcaggcaagaaagaggatgcttcacttactaaaggagacaatactgaagaagagagcatcaggagaggagttaggggagttcttcaagatcatctttgaaggagcggaaacaatgagcgtagacaatgcgatcgagtacatatacaccttatttctgcttgctaacgaaacaacaccacgtattcttgcagctacaataaagctcataagtgacaaccctaaagtcatgaaggagttgcatagagagcatgagggaattgtccggggtaagactgagaaggagaccagcataacatgggaagagtacaaatctatgacatttacccaaatggtgagtttaaatcaatataagattggctaatacatagtaagtagctcatagaaatatggttgtttgttttaggtgatcaatgagtcccttaggatcacaagcacggcgccaacagtatttagaatatttgatcatgagttccaagttggttcttataaaattccagctggttggatcttcatgggctatccaaacaatcatttcaatccaaaaacttacgatgaccctttagtattcaatccatggcgttgggaggtgaatgtcatatgatcttttacttatttactacaaatttagtaaacaaattcatagaaattttaaactaaatgtttagggaaaagacttgggcgcgatcgtctctcggacttacattccctttggtgctggctctagacaatgtgtaggagctgagtttgctaagctgcaaatggccatttttatccatcatttgtctagagacaggttcattttcattaactaatgattgtgattagattttatttttgcttgcagccaaagtttttacttacatgtaatataccttatatatggtttgaaggtggtcaatgaagataggaaccacaatacttcgaaactttgtactcatgtttccaaatggatgtgaggttcaattcttaaaagacactgaagtggataactcgagtggttcgaatcccgattgctgcaatggataaaaaccatcgatcttgttcttgaacgattattgcaaatgttaaatacttaaaagactagttggtaaagatgatttatcaaacgagtcatatgaggatttaagttttatgaaaaatttactggacttataagaattatgcttgtaataatgaaggataacatgcatatttttcctatgttgaacaaattgaaaatacattgttacctataaaaatggagattaaaagcaaacaaatcctcacctaaaacatgctttcttgacctctttaggctctggcaatttaacaagtagccgtttaggcctgtttagttttagacctgtttacatttttaagcttgcaagcttaggttggttcatatatgcccatttacattatattcaattaattggagaactttataccatggttttctctttctatggacatttttcaacccaatcaaaaaaaagaaaagtaaactgaaatctcttacttagaaaattgattctactatactatatccggttttaaatctggtccttgtttggtcttggggataataattagtggcgaaaacggcgtcgcttttgctttggttttgggttaaatgagtggtgtttgctaatgaatgggcctctacgccttttaacagcccatatttgatcacatttcaatctatcacatgattttaaccataataaagccgtagccatttcttcttcttcgttccttcagatttttcgcaacagagagagaagtcgaagcttcacgatcgtataataatg

SEQ ID NO: 5681 - DNA, 2305 bp, Unknown
  misc_feature (1)..( 2305): cDNA_ID_2053753_gDNA_ID_1620811_Annot_ID_50583 3000 nt of promoter + ATG
gaattctctgcttatgctccaagtttagtgacatacaaaccaaccaactacgcaaaatgaaaagaaaaaggaagaataaaagaagaaagatgcagattacttcttagttccatttgcaatactttttttgttacgtatttttttgcatcgtctcctgttttcattcattgtctttcatttccttttgaacatttattaatttgttttttgctatttatcatctaactaagtatttagatttatcatgatattttaggctttttttcaattgttagtatcaaatttttcaatataaaacaaattatatctaccacaatgcagattcgtcttgatgttctttgtgattgtcttggcattctctatatgtttttgtggaagcatcggagttttagattagatatgattaacgtaggagttcatgtagaagtagagagatgtgttgtaatttataaaagaggcttcatgataagatagcttttgttgtttgtcttcacttccatggttcattgtcttccttttccattgatgtgctggtgaatcacaaagatactcatgcatttttcaatcctaattttggcatatgtaagtttttttcaattttgtttgctttttaatccaggcattggatgaaaacagagagaattcagggctaaagaaagcctttgatttttttttttttgtgtgtgtgtcaaaacagataataaccttttgtttttgggtcgtttaattgctatatgatgcatcaaatcttgtaaacaagagtgattccaagaaggtggaagtatttccgcatgattacggttgttgcttcacaaaataggagacggcttgtttcctctgccgaaccattgacatgtaaaggtaaatgttcatgttttgagtgattgattgattcaagccttaattagcatgtttatattctcttttccatatcatcaactaacattcataccagttgtttctaagagatttagtcgctggcatgaactaatatatatgcaatagtatagaggcacacaaataaaagatttgatcggataaagatcataagaaaaatcagagacataaagaacatgcatcatataaaataaatgtaattgaaagggataacaaagaaaacatttgataagcattgacctatgaaggcgctacttcacaaaaacacgagactcttgatgtgatttgggtaaaccttcatgttgtacatatagtctttaacaaatccatagcggcttctaaattcatcacccacaattccttcaaccgagacttctctaatactgtttctcctcggatcaaaatatagtagataaaacgattcaaacaatatcgatggtgcaaaaacaatctcaccagcatcactaacaccataaaagcttggcttttctttccgtattaggtccatttcagaaagagtcaaaaacgcgattatgcgtccattcgtgtctatctccattcgtcaaaatccatatatcaatagacgggaatttaaaagtcttaactagggctaaccttcccacataaggtaccatataacaacttttcctataataaccctctggaagtttgatctggttgaacttttcagatctaacgtctaagctcattagtttgcgttccacttcaataccatcaccaacataaacagttgctccatagtacatgactccattaattagtatatgcatcccccacaacgtatagtagatcgatgcctagggacaccgttggttattattctccatgatcttagtccttaagctcccagtgtacgaatgcaaatcttcgagtctctctagtaacatgtagtagtacaatgattcaagttttcaatcaatctgatcatatttacgctaccattcttgattagatgcttatcctgctcaaaaatgtattcagatatatattaacaattacttttgaatggtatcaaatatttattaactaattctttttaataatttaatccaattaaattttaactttttaatggattcaaatatatactcattctttatttagtgttaaaaaaaaaaaagtagctcaactggaaatgtatgtaaattatatattaaaagctgacccgggtctagaggatgtatggaaagccaatagcatcgtttcgaacattgcaataatattgtgtggtgacaagcaacacatgatatgtccgtttagaaacagacaaaataagaagaagaagaaagagtcgtggaggattcttcattcttcctcatcctcttcttcaccgattcattagaaaccaaattacaaaaaaaaacgtctatacacaaaaaaacaaatg

SEQ ID NO: 5682 - DNA, 3000 bp, Unknown
  misc_feature (1)..( 3000): cDNA_ID_2993959_gDNA_ID_1620811_Annot_ID_50584 3000 nt of promoter + ATG
ccatatatcaatagacgggaatttaaaagtcttaactagggctaaccttcccacataaggtaccatataacaacttttcctataataaccctctggaagtttgatctggttgaacttttcagatctaacgtctaagctcattagtttgcgttccacttcaataccatcaccaacataaacagttgctccatagtacatgactccattaattagtatatgcatcccccacaacgtatagtagatcgatgcctagggacaccgttggttattattctccatgatcttagtccttaagctcccagtgtacgaatgcaaatcttcgagtctctctagtaacatgtagtagtacaatgattcaagttttcaatcaatctgatcatatttacgctaccattcttgattagatgcttatcctgctcaaaaatgtattcagatatatattaacaattacttttgaatggtatcaaatatttattaactaattctttttaataatttaatccaattaaattttaactttttaatggattcaaatatatactcattctttatttagtgttaaaaaaaaaaaagtagctcaactggaaatgtatgtaaattatatattaaaagctgacccgggtctagaggatgtatggaaagccaatagcatcgtttcgaacattgcaataatattgtgtggtgacaagcaacacatgatatgtccgtttagaaacagacaaaataagaagaagaagaaagagtcgtggaggattcttcattcttcctcatcctcttcttcaccgattcattagaaaccaaattacaaaaaaaaacgtctatacacaaaaaaacaaatgggagagaaagaggaagtgaaactattaggagtatggtacagtccatacgccataagacctaagatcgctcttcgtctcaaatcagtggattatgattacgttgaggaaaatctgtttggatccaagagtgagcttcttctcaaatcaaacccggttcacaagaaagtccctgttctcctccacaacaacaaaccgattgtcgagtctctcaacatcgttgaatacattgatgagacgtggaactcatctgcaccgtccattcttccttcacatccttatgatcgtgctcttgctcgcttttggtctgacttcgttgataacaaggtttggtttctttcttttcctttatccaacaatttcaatttcttattatttctttcagttttcttttgatggaattttttggaacttttttattattattgttacattccaatgaatttatctttcgtgcatggattatcttggggatatatacttagatcgtcctatttgagtgatttatatatgacaaaaataaaagagtaatgttgtattacataatacgtggatataaactcggatgaagacacattaccaatactatcacaagctagtcaactcaggtctaatgaaatccagtaaatacttcttctagtagtagcatataagtttgttctggtatacattattagtcctagataatcatacattatttctaacataaaaatgtcctaattcttatccataaatttaaataagaatcatcaggcttacaagagaacgacatttgtttgattactctgacactagaccacatttgtttgtttgcgtctccgttggtgtttctatgctacggtgaataggattttatgatatagggacgcaattcaaacataaataaacaattgtagcttatatattattcaaaaactaaaaatgcagtggtttccggcgttgagaatggcggcgatcactaaatcggaagacgcaaaagcgaaagccatggaagaagtggaagaagggttgttgcaactcgaggatgcgtttgtttctataagcaaagggaaaccctttttcggcggtgaagcaatcgggtttatggatatttgctttggaagctttgtggttctcttgaaagctagagaaaagtttaaagcagaaaagcttttagacgaatcaaaaactccttctctttgtaaatgggccgaccggttcttgtccgatgaaacggtgaagaatgtggcaccggagatcgaaaaagtagctgagtttctacaagaacttgaggttagagctcaatccgcagcttcaagatcttgagatcatcttagaaatgtattgcaatgcaattgtgttttgtgtacatgtaaaacgaaaataagttgaagttttaaagtgttgtgttcagtctatgctaggatttatgacgcggtgtatgggctacggactattttcagtttatgtttatcgaaaatataagggtcagcccaagattattaggggtcgtcccccctttaacatggaaatctatttaattcgggatcataattatttttggtaactgagataattttggaaatttttcaaaaatctttttaaaaaacttgctttaatattaagtttctattgggttttcacttttcagaccttcacatctttcttaaccaatatgagcccgccgggataatgtgctttcacatcgaaagttaaacgacttatcttgaccactagtacaatttgtctaatagtagtacttaattgaccactagtcctaattaatctactaatttttctgttttacattttaattaatctgctagtactaaattgtcctccatggaccctcttcattgcatctgctcctgataagccaaaaattttaatatcttgaaccaatcaaatttctctggtcagagagatctagtagcacgaatatatttattaacaaaaaagctaacaattattagagaaaattaagtaactaccaaaaagagtaacattgacaaatactttcacaaactcaaaaaaagaaagatatgaaaaatgagtaataataattttaaaataataaaataccttttctgtaaaatagacaaggtcccaaagacccagctcaagtccagctctctgtattcattaagttaccttctaaacattcacaccatctctttctctaaca

SEQ ID NO: 5683 - DNA, 3000 bp, Unknown
  misc_feature (1)..( 3000): cDNA_ID_3078071_gDNA_ID_1620811_Annot_ID_169064 3000 nt of promoter + ATG
taccggggatgaagaaagaagaggttaaagtagagattgaggatgatagtgtgcttaagatcagcggagagagacacgttgagaaagaggagaagcaggacacgtggcatcgtgtagagagatcgagtgggggattctcgaggaagtttaggttaccggagaatgtgaagatggatcaagttaaagcttcaatggagaatggtgttttgactgtgactgtgcctaaagtggagactaataagaagaaggctcaagttaagtctattgatatctctggctaagccaatttagcttgatttgagttctctctgggtcttgactttgtgtgtgtgtgtctctgatgattatggttcttcgtttgattgtagttttaaactaataatcaatggaagctagtaacttgtgtgacaagtaaatgtatggtggagaaatgtgtgtatttggattataatagaaatacctattttcatctagaagctcaggatctagttattgataattagagctcgaaactgagatggatcttattgtttggatagttgttttaactattcaggatcttattgtttggatagttgtttaactatttataactagagatcgaaattgagatggatcatgaatttcattgaaaattaaggctaaactgtttggctagttgtttaactcttaagcatgtatctggagatatctttattcattgtttgattttgacattgtggttcatcttgtttgatggagactctttgtaggaaatcgctttggccaacaccaatgtgaactagtctggccaatttagttaattgattgatcatcatattgtttttggcatttttcagaacgtgtaataacagtgaaggaattttgaggtacctgctcaactgaatcagattcaggagggttttaggagaggtaatatggaagtagcaatgcttaagaaagataaagctagagctcttgatgatctgctgaaaatcgactaaggaagccaatgacaaactcagacaggaaaaaactgtaagaagaagaagaaaataagagaaaagcaacaaagctatggaaagcttaactttggatttgcaagttaagtatttttaaagcaagggaagcattggagaagatcttgttgatatgtcaaccatagcttgaacattgtggagcccaaatgaaaaggtataagttggctgcaaaagatacaaatgaaaactgtggaaaaattcttgaagactgagataagtacacactcaaaatgagtttttcaattctaagactatgtgggaacagcgagaacttcagttgtgtggaaaattgggaacttggcaaagtgaatttgtctgaccttcaggaaaatgagaagaagaagaagcatgtatgaaaaatacacttaaggaacttgaggagaagagtgaggatttgtaggaaagagttggagaagcggagactggaagcatgaaagtcgaggcaaagaaggttgctttagaaaacagaaagctcagagcaatgaaggttttttctcttgaaaaactcgataacttgtcaaaggtatatgaaagcttggtggatacaagtgaagcgtttttaaagcaaggcaaggattggagaaggtcttgttgatatgtcaaccatagcttgaacattgtggagcccaaattaaaagttataagttggctgcaaaatatacaagtgaaaagtaaggaaaaattcttgaagactgagataagtaaacacccaaaatgagtttgtccattctaagactgtgtagagacagcgagaacttcatttgcgcggaaaagtcgggaacttggcaaggtaaatgagaataaactgaaggaacttgaggagaagaatgaggatctgtaggaaagagttagagaagcagaaactggaagcatgaaatttaaaggaagcttgttggtcaacgaagtcaagccaaagaacattgctttagaaaactcagagcaatgtaggtttgttctcttgaaaaaatcgatgagtcgtcctcaaaggtaaatgaaaacttggagtataaactgcagactgaagaagaccgagagcttaattgacaaagaaaccaacctatagagcattactaaagaagctgagaagagctcaggaaaatgaaatttgctggctgaaggaatgaattagacattggttaatacacaaaatgcagagcactaatcaaagattagttgagaaaatagccaaacgcagagtttaagaggaagtcaatggagtcttcttatcataacaacattgaggagttgtcactaaaacttcttattccgggtatttaaatggcttcttcctccgcaacttctcactttccagaacacaaagacttataaacaaaccatccttcacgtatgtgttgaattgaaatgtgaatgtgacttcatcaacacaatgacttcaaaacccaacgacggtcttcctttcttttctcaccaataaaatgtagaaaagaaacaaagtacacaagaaagacttttcatttaacgatatctccactagtagtagctataactaaatggggtcatcgttattgactttgaataagaaatgttcaaacacttcaattattacataatatctttgcaataaaataacaaacgttaaagagccgtcgcattattagcacaaaaaatatcttttgtaaataaaaaaacaacgtaaaagagccgtcacatttgaataataaaacccatcttgcacataaaaaacacgactttttattatttttgattatttcaacaaagtatgaatagtcaacataaagaaaagtccgccttgatgttccttcctcactccctatttatccattttctaatcccaccctcttctcttcattcatcatcttcctcctctctctcttctctgtatcacccaactaaatcctcacgggattagatccaaagtctcaaactttgatccaaaaacacaaactttgttcaaaagacataaactttgagccaaagtcacaagctttcttggtgaacg

SEQ ID NO: 5684 - DNA, 3000 bp, Unknown
  misc_feature (1)..( 3000): cDNA_ID_3078075_gDNA_ID_1620811_Annot_ID_169063 3000 nt of promoter + ATG
agtgttgtggtaggtacaatgagctttcagatttttcagttctgtcgacaggcgtttcgtttgtggtttccattttgtgttatgctgcgagagactagtaaatcagtggagattacgctgaaggatgtttctagaccacgtactcgtctctctagagattgcattccgttatgcgagctctccatgaacttctgcaatattaagtccaagaaaacattcaaaagtcagcacattacagtttgttggatgttttaaaagttaataaagataaatgagatcagaagaaaaggttacctgaaagagatctaacagactggactgctgtttttcgatctgtgtaatctggtgtcttatcagagacaactcttctgcattactctttgcctgagaagaactgctactaccactgtcagttttaggactctcctcatcactactctgaacaacttgtgacttgttcgacccattctctttgaccttatgcatctttgccgggaacagaacccgtttagctcccaatgtcgaacgattccgcttctctttcgacacaacagcttcctgctcaacatccttaggagtgtcaccacgatctaatggctcaacatcattcgactttgagcttaatggtgtgtttaaattcctatctttgcctttcaatgtgttgcttctctttcctgaagtcgcagacaaaccagaagaagctgatttggaggaggaagaagactctgagacctctgttgaatcaccttcaagttgcttccataaacccaatgtacgattcattgtctctctaacaagtttgacctgcacaagttatatatgaagttattaaccaagaacactaaagtcaaaagtgattgcacttcttataaatttttaccataaattgttttgaaattttaccttatcgaatcgtctgctctcaagaatacctagacatgtcttcttatacagtggagctaattcttcttctaccatagccactctagccattgcctccgcagcagctttcctcgcacgccaatcgtcgctgcttagaaactccgagacgtttggtaaaagccagtctagcaccgccttttcgctgtttcgaccgccaacagcgccgattacggttcctatggctccaagaagttccgctttcgccttgaaaccttccgatttaagcaacttcccaatcttcggcagggccttctgcagttgctcaacatccggctcatctgctgcgtctaccgccgcagcaaggcacatagcagcgctgatctgcgcattgggatcgcaatcgtggataaccgtttcgatcattggtccgaaaaggatggagaaaggctgtccggtgatgttggtagtcatatcaacggaagcggcaacacaagcggcacggacggaggaatcaggatcacggaggcggcggagaacggtggagaccatcttcgagaggtgaggagcgagagaatcgccatgagaacgagaaagaacagagagaagcgaaacgcaatgtttcctcaccggagattttgcggaagagtctgtactctgaagacagttaataaataaagagaaagtctccggtgagagattaagagcgattgaatcaagctctgcggcagcgagagcaagagtatcgcgatcagagagacgattgagacaagcgatgactcgttgcttgagatcagtaaccgtcatagccggctgtgaatgagacggagaagaacggatttgaacggaaggcattgtgaaaatgtccggagactttttcagagatccgccatggaaggagagaagaaaaagctttgtggagaaactaagatttggcggcagaaaaaaggctatgaagatgactctactacggttggtacttggcctttttaaacaagactcgtctttggcttgccttttaaacttgtcatatttcactacctgccacaaaatttacatttactattagtttatatccaaaatttctagttttcgtaagactatgtcctttttttgtttctaaacatcgaatatgtcaaatttagtattatcttacaatttttttttgttggtcaaaatattatcttacttgtttctcgttttatgaacgtctttgtacatcaaaacagattcaatataccaacaaggattctaacgtacgcaaggaatagttaagtaaatcctctatgtagtaatgggaaattgttaggactttgaagtaagtatcagagactcgtgtataataaggtattcaaagtcaggaagataataaaatatttgtgtaacttggtggccacttagaagaagaaccaagaatatacaagcaaaaaggaaaaaaaactagattccgtaagattttcttttatttcaatcctgattataattaaaagaaggaaactatatccacaaccacaatgttacacatgagctaatgagcaagtcaagcaaacacggtttcttaacgcgtaaccaaacgtgaaatgaactattctttctatttttctcaatattaggatgacatatatactgttatttaacatctatatatctaataacaaactaaatcttcgaatcatacttttctcaacaaaagattgcattgataagttcttaatttaaaatatttatgagtacatccaagacaaagaatagttctctattttcagagaggactgcatgtaatggtagtaatcatgttttctcttaggaaaaaacccgcacaacgtttatgggaaacatgtttgtgtttgaataacctttatggaaaaacaaaaatatttagcaactgattaaaactctttacacggctcatatttaaatattgggcctttagagcccattatggcccataaacacacaacttggaacgcttctagacttttctggatttgcctcatttctagaagctctggagatttcttcttcatcaataaatagaatcagcaaactcaccagctttcatcataaattcgaaattcaattcgtcggaaaattgttcagatttcgaaatcaaccgagaaa

SEQ ID NO: 5685 - DNA, 3000 bp, Unknown
  misc_feature (1)..( 3000): cDNA_ID_3078079_gDNA_ID_1620811_Annot_ID_169057 3000 nt of promoter + ATG
aaaagatggctcctcgtcagaagaaacctaacaagtctgatgatgatgatgatttgcgtaggaagaaacagagctttttcaaacagagatttccaggctttaagaagaaagcctctgagctctctgttctctgcggcaactctgtcggtttcatctgttacggtcccgacagcgatcttcatgtttggcctcagtctcaagatcataacccacaagccctacatgagatcgttgccaagttcaatgccttgagtgatgagaggaggaagaatcatgcatgtgatctcaatgacttccctcatcatctcaagggtttgtctcgtgaggagttaaggaagcatctccttcaccttgactctcaattacttggagtcagggaacaaaagatagaaattcttaagaagacgctcacgggttcttccgaaaaagatggtgctagggtttcagagaactcggccatctccgatcacaagttgaagatagagcctcatttgaaggatatattgtcggaagatcatctaattagggtttcagataagaagctgggttcgtgtgatgtatttgacgagttggcttacgtggtccgcgggtcaaggaatttgaacgagaatgtttccaagtacgaatcaaaagatgcagataacacgggactggatcatcttgtaactttaggcggtgattatcttcaggaggcggcagcagaactttaccaaacttacaatctagggaatttttgtgatgatcatgtttgggatctggagtttgcctcaagactaccactacttcatacttttagcgatcctctcatgaccaccaatacttgccaaacgatgagcaccgatatgatttcaatttgataacttgatgactacgttagtgaaacatgtttctttcaccttttctcggtgattgatcattttttagtatctaaacttgtatgtttgctccaacacaaatctatttttgtaaagttttggtagtgttttcttgtttattattgattaatcaaacttttcctttctttctgttacttaaatgctgggcttgatagtagtataagaaatttgtccacaaagcacaccgcaaagttccaaaagctaaaacccttgtaccttggagtctctgcatgtgagaaaggaatatgagagttaaaaagagttttttcgtaagacaccaaatcatctacaatgacgatgagcgcaactttctatcagtgagcttgcaagctagcgttcttgacttcagaaatgtgattatgattaatagttgagttaatcttccttaccaactttaaagaaagaaaacaatcactatgtcatacattcttcaggggttaaacatgtcggatatgaaagtaaccaaaagaatcctcattgagataagcaagtaataccttccaacctgcgaaattgttcttgtctggtgattctaaacagaaagaatcttattcttgttttagctcttttgttctagactagacactagtgaaagtgaaatttcaagaaaggttacaggatcataccttttgtttggtggaaacagaggattctgaaattcctggctgtggtcacatacatacatcaatcacatatttactagtttctaatgagaaagttcagcttggattcagttcatcttctctcatctttaaggtccgaactatgtccaaactttggcaatatatttcaacaaagactctaacattcttatatgtgagtatgtgacgttgtatctcagtaacttgctcatccaactctctgcgaatattcagattcttgattcaggagctcccaaaacttcggaattccaaatgacgtacacaattgcctaaaacacaagtctcctgcttaaccatgaatagttgagtgaatcaaaatctcactgaacaacgttgtacaagaaatcaaagttcacgatcaaacttacaagcatatccatgaagataaatgagcgaaaactaattacttggcgtatatatcagttttgacgtttggagctgggaagaaaaatgaaactgcaaatcaaataatgtcaccacattaaattatttctgatcgtgtcattattcaactgatagctgttattatttctggtcaacctcttatttgttgtctcttagtaaaagttttcttctagattgaacaatgttttaaaattttgacaagaagaaaaattaattgtttaccgatttaaagacaagaaagatctaagttagtgtatatttaattaatgcagctttagttttttttgttatttggtattttgtcaacaattttttttttataatataatgttcattccacgatcttcggaattgtgcacatccgtcgttcaccaacataattcaaaggaaccagccaattaaacttagaaaaatattgatgcccatgtcacaacaacgaagaccgttgaaacgacggtgttttacacagccaacgaacaagtccagcatggcggtttttgagaaccaataagaaattaaatgtattgtttactctctagagtaaatttattaatttttaaagaattcataatattccataaattaataagtttactagcaacaaaaaggtctgaagtctgtatctgacgatcacgcggcctaattgcgcgtggcaatttcttcaacgcggattttttttttcctgccatttcttgcatcaacgcggattaaaaaaaaaaaaaaaagtgttttcggtaataacccgaaagagaaaatacgtatcggaaaaaatgcaaaattttcaaaaacatttaattttaattttaatttcaagccaaattcgggagcgactttccaaagacgaacaaagccattgaaacggaagagaaggctgctcctttggtcctctctgtttctaccgtcgattcagatctctgcctctcgcaatcgaatcaatttgtgtaacgaatcgacgcgaattatagtggtgaagaagtcgacaattcgattgttgtgtaagttgacgagaggattggatcggtgtgaattcctcctaa

SEQ ID NO: 5686 - DNA, 3000 bp, Unknown
  misc_feature (1)..( 3000): cDNA_ID_1829093_gDNA_ID_1620811_Annot_ID_169046 3000 nt of promoter + ATG
aaaaggttcagagagaagacgattccacccaaatcatcaacgaagagctagttggttgcgttcacgatgtttccttccctgaaaattacgttcctcttgctccctccgttcacaataaaccaccagctaaagatttcccctttacacttgactccttccaatctgaagctatcaagtgtctcgataatggcgagtcagtcatggtaagcttttactctggcttcaattgattttggtcactgaatttctaatctgtcctattgaattggtgaatcaatttgtaaagattacatattttggttcaagctgtgaacttttctagttttgtgagaaaactgaagagtatggtttcatgttcaggtttcagctcatacatcagctggtaaaactgttgtggcgtcgtatgctattgccatgtctttgaaggaaaaccagagagttatttacacttctcctataaaggcacttagtaatcagaagtacagagattttaaagaagagttttctgatgttggtttgatgactggggatgtgactatcgatcctaatgcctcttgtcttgtaagtaccttttaaactgttcaatgttgtctcagaagtttcttttatttgctatttgttcttagttttgtgttctttgtttcaggtcatgactacggagattttgcgtagtatgcagtataaagggtcagagattatgcgggaggttgcgtggattatttttgatgaggtgcattacatgcgtgatagcgaaagaggtgtggtttgggaagagagtattgtaatggctccgaagaattctcgttttgtgtttctatcggcaacagttcccaatgccaaggagtttgctgattgggttgcaaaggtatttcactcttgctactccttctacctctcttttgtgaatggattgatacatttttgtatcaacttgtaattatgatttcacatcaattatttattttggaggaagtagaaacatgtcttggcaaaatgcaatatagttttcatatgtcgtgtttctttgagtagacttagtaaaacagcctgtttataacaaatgattttttttttttttttttttttttggcgttgttgctctggagatttgattatagaattggtattgcaggttcaccaacaaccatgtcacattgtttacaccgattatcggccaactccacttcagcactatgtctttcctgctggaggtaatggactttacttggttgtggacgaaaaatctaaatttcatgaggatagcttccagaaatctctcaacgcactggttccgactaatgagagtgacaagaaaagagataatggaaagtttcaaaagggattagtgattggaaaacttggtgaagaaagtgatattttcaaattggtgaaaatgataattcagcggcaatatgatcccgtgattttgttcagtttcagcaaaaaggaatgcgaggcacttgctatgcaggttagtttcctcttcttctgtttgtctaatgcaagtaaataaatcatttaccgacaaattttttatttgacttctttcaaaatccctggatctttaccctgtcatatgagaatgtcatctcattttggggatgttatttttttgtaactattagccaaacatgaatctgaatttgtttctgctgaaataagaaaattggtccagaaagttaggtgtttttttagtttgtcttcttcttatgcttgggatcagtcttatccttttaaaattgatattgggttggagtgactgtgataagctcctggagtcttatgtgaagatgcggtacctatattatactgtatgagttggatcgcaaaagaagtcctcacttgaatcaagacttttctatagtactgttcccaccactgaattaaaaaactttcgtcattcttaatcttgatagtctgttattacattgcagcaacggtctcttcaatctctatattttttgtttgtatagactgttcaaattttgttttttatgatttttctagtgtgtttgcctgcaccttgtagtgcgtactctgtggtgtgttttattttatgtgtattttacaacctgaagttcattgtctgcgtactgtgggtcttactgttaaaacgtgagtctaatacctgtctgtttgttccacagatgtctaagatggttttgaacagcgatgatgagaaagacgctgtggagacaatctttgctagtgcaattgatatgctttcagatgatgataaaaagctacctcaggcaagcattcattaaagctctttctaagatgcctgagtgtttgtataatgcaccttaacctatatcttttgtgaatacttttcacaacttcttgaaacatattgtcatgttttaatgttgtgaggtatctgtgcgctaggatgatcatgtgcacatctctgtaggaaatggctagtattattggcttataagtagtagatttcccaccaatctcgcctctattatctcaaattttatattttattttgtttgccttgtagccggctctcctcttgcacaaaaattgatttttccctagatattaatcttttctctaacatgtaacatgtaatagcttatattccttacatctgatgttccataaagggtcatcttggtgcttgtttagttgatctagtttcagatgcgatttggcaaatatatttgtcctgcagcgaaattgacatgattcatggcttcatgtactgcaggtgtcaaatattttacccatcttgaaacgtggtataggcgttcatcattcaggactgcttccaattttgaaagaagtaattgagatattatttcaggaaggtcttattaaggtaggtgaaggcgtagaactacaattttcatattgtcaattcttgctaccttttgttatgtaattttgtgatgttttcctttagtttgaagtattgccactgaagtttgaagtattttctcttagtgtttgtttgcaacagagacatttagtattggattgaacatg

SEQ ID NO: 5687 - DNA, 3000 bp, Unknown
  misc_feature (1)..( 3000): cDNA_ID_1829097_gDNA_ID_1620811_Annot_ID_169045 3000 nt of promoter + ATG
ctatatattattttgaagattttcactcaatgcaaagatgaacctcaaaattacttttatcaatgacacatttttaaagagaaaatatataaagatatgaaagtagtcactagggactatgtaatcaattgtgctatttactgtttaaacacactaaaatatatagttttaatgtaattaagtaatcctacaactttcatgtgaaaattcctagtcaaatatttcacgtagtgagttatttaaagtaaaacagaataataggtatgcttatacgggtcgagttgctttattatgaatatgattatatgaatcaaaggatatgaatttatatttatcaagttaccacgttacgaccaaatttgggttatgggtttcaaatcttgaacggttcatggtattccgccgcttttgtcctatcaagtatggacacatttttcaaaagtacgctggtgccgaagtagtttgttgtggccttggttaactgtaccattaatgcgtgtttataaactacatgctaactctaataacttctcatacattcacatcaaaggacgatgagcctcatatacatacatagtgatcagagccatcctctaagcaaaaagactatcctttttaaaaaagagaatcatattaagggcaaaaattaactttcaaaaataattggccaagaagcgatgactaatgtttttgccaaaaataaaacaaaatctcaaatctcaaagcctgtttcatatctcttttaagaagagagaaagaaacttaggattccagaactaaacgtcgaaagttcttagatatcttatttcaaagggttctcctctgtcagaaattctagaataacagattatttcatcttaggtggactgtcatttcttctaactaggctagtagcaaatcattatgcccaatttaaagctaactcgctctccatctccattcgattagattagtagttaactttaaaccaccaaaaaattttatacatttatttgttagagaatatttggaagaattgggtggtctcgctttgtgccgctttcttagctcaaggatttttggattctatctacatgaacttcgttatcaattttgatgcttgatatttttgcctagagtgtttcagtttttttgtttttcttttctttttctagcagaattgtcacatgttatattcatattttgagtattttctaagaaacaattaggatgctacatagacatatttttgaaaagaattaagaaaaagtaataggttttggaattttgcaaaacaagcgagaagatgctacacttgattgttttcaacaaaaataccctcagaaataatggatgagattcacatgatagcactaaatcgctacaaaatctcttcactagtgtctcctccatagtcaaatccgagctccagataaaaacattacagattcatatgacaatattaattttgtcactcatatgaatttggttaaatatataatctaatttgaaaatacaaaaatcatgattcatgatgcacctttcaattcacataatgttgaaatacagaaaaaataattactctctcatttctttataatataagttttagaaagaaaccaaaaattgtctcataaagataaatgtagatttttttttaattttatctcctattaactagggttgaattaataaaacaactaatgaatatttattaaacacgaatatatttgtagtagtaaaaaaattcttaatatgtatgcaaagtctaaaaacatacaagttcactaatctctactaaattaacagctaaacccaataaatccgttaattatggctagtttagtgaatttttctcaaagaaaagctcttttttcaaagttaaggagactagagagcaagtcatttgcttgtggttggaaacaaaaacccaaagcgacgacacaattaaaaaaaaatataaagaggagaggagaaaaagaggcaagccatagccaaagggttcgtgtcggcttcaaccaaacactgacggtgtgtgtatacacctttacatacacacctttatctctctctctctcacatctttgttacaaatcaatcttctactgttttctttttcctcttcttacattattttttgacagcaattcttagtttctcttctatcccctttctgggttttgtttgaaccctagctcgctttggatccagtggttttaagttaaaggttcgatttttatttctgggttttgcttgttttgcttggttctgcttagtaaatgttggaaaaggaggagactttagaggatctgtagtcagatttgagctgggtttgtcgattttactaggattttgattttggggataatctagatcaggaatcgttactttgtttcatatccaaaattcaactctttttctcgttcctgatctaaaaatcgttccttttcaagctttctaaatgaggtttctctttggtggttctgaaattttgtctgtagctgttgtgttcttctcttagatttgattctgtatgataattttaggttctgagtttgaagtcttgtcattgtagagatggttttagtaacagttttggtgttgctttgtgtgaagttattaaggactaaaatctgttcatttttggtatgttattgagcaggttcttgtcttgcttttgctttatttgttctttctttttacctctttgtttgagtgattattggattttctcttcaaattgggtaataaaattttgagaatctgagtcttgtgatgtgctttagacacaatgtagaacaaagcagttacataaatggcccacatttttgtcagtaaatttatgaatggggttttaaatgtttctacataataacatctatcagagttttgtttgtctaaattagaggaggataggtccatcttcttcttttctctttcagaataacatttcaatcttatagttttctcttcttttgttttgttgcccaggtaaatttatcgaaagtaagtagattccta

SEQ ID NO: 5688 - DNA, 3000 bp, Unknown
  misc_feature (1)..( 3000): cDNA_ID_3078100_gDNA_ID_1620811_Annot_ID_169042 3000 nt of promoter + ATG
taataagaattttgaaatgcatataaaacttgcacatgtttctcctttttgatgtgcattcttcaatgactaacataatctcctaaatacaacaacatcatagcatttgagtctctgaaaaaatgaaaaattatagaaataattgaaacaattagtaattaatgccaaaacagtttcaaagtcagaaatcagaacaagaataattatacacgtcttagattggtatatataaaaataggaagctctttacgttgcatttgacttttgtttttaaggataatggaatcatactgtaatgttaacaactaagcaaaaatgtttaagaaaatggaacaataatgtaatgtttagaagaaaaaaacaacatgataaattgatatgatgtcttgtgggttttaattaaattcataccgacaacctttttgacttgcttctctgtctttgtttctacccacacagagatcaaaacaccacattgctgttaatctttaaacaaaagaacattaaaaaaaacacttaatgaatattccttaaatctaatcatttctattcaaataagtgcaacacactccaaacacctaacctgccgattccttcatacgatataccttttgtattagattagattaattaatagttggaatagttccatgcgacagtaaatcactttgataccatcggctttttagataatagtaggctttattgaattaccgacaagtggaaaaattttgtatatgcgttttaaattttagatccttaatcttgtcttatgctttagtattatttatttatttttctttaatatttcaaaattattgacctctgcagcagaaggcaaagacgaggtttcaagtaaccattcccatgatttgatattgtgcatttttacccaagtcaacagccattattcgtcctcacattagccaaatctgatcaatccaaagaatctggaccgcttcgttgttttctactatctaagacaatgtttctctctcgcatttcttgctaaaaagctcattttctgatttgtgacaaaatgagattttttttaattaaaatattatgactaatctctttatttcttataaaatattatatcttaaacattacaatttttctaacctcttatatcacaatttatttaagcagttccgtaaatttttcagtcatcatttttcgtggatttgtttttttttttttacgttccaatcaccaaccactaccgtcaagcacccaagaaagttgcattagttttacactgacaaatcgtcggtaagcacgtcacaattttttaagtcttaactaagctttttgccatatacatttccacaaaaactgctttttattgtcattttccaaaagcatatatttgtccatacatatatatctatatcaaatgcatgcgcaaatgtatcatctaattagtatactgagcttgaaagaggataaattttgtaaagagagtcgtgtagaatgtggaacatgaggaaaaaccaaagtggcaacccataaaatgttagaatattgctaagaaaacggaatcgacgaccagatttcagtgtatgaacaaaagaggaagaaaaggaaagtgaaagacaaaactaagattaaaatgaaggaaggaaaagaaatagtacgaaaatggatgtacttaaccccaaaaaaataagattatgtagctaaattttagtttaaccaattattacaatattcgtaaattttaatgtagcactaatcaaattttttttgtgacctcataatttttaacttttgcatctgattactatattaacacatgaacataattttattgacactagaagttttacatgttttcgtgggcgtcgttaccgatcatgttttcatgtagtcaaatggattcagaaaaacatgaggtataaaatagtaactccaaaattccgaggaaaataattttcaagtggccaaaacaaatattttctagtatttaaattacggaaaatgaaaaattaatgacatgagtttagagtaaacccagcacatctaaaatgacaaagaaagcgggtcaatcatctgaaaactgcaatttagaagcactattaactagtatgattgggagctttactgttatttttagctagagaatttaaaattaataattttgttccggaagatttaagatgtttatcgtacaagaaagtgtttaataatgtgtatcatgtattagacctaaataaagtatgaagagacagtgaaagaaaaacagagtatgatagcacaacacaaaagcaatacaaatataattaacaccatccttatcaacaaatacactgcgtcccttaaatattccactaaattacaaccaaatactttaaacatgcacgatagtgagctgtatcttggaaattcataaaaatgacataaacttttgactcatatatatacgttgaaaaagtatttgaaagtagactgaccaacaagtaaccatcaagaagcataaaatctaaaatatctattgtatttaaccatcccttatgcccatcattttcacaaacccacacatatacatacttatatactttataacattccaaatttcaaccgatctatcataattaggcatcaaattaaaaaatggaatatttgtggtgggagagagatccacatcttttgtagaaagtgcgtgtggggctaaacttagaaaaaaaagcaggaatagtgagagaggagacacacggcgttttcgtttctgcctagaatctacacttagtgttatacgtaaggccaaagagtcaacgactttggctccctctcttcacctcttctctattataaattgaagggccaataacccaactctatttgtcctcaaagatagtaaagaagccaaataataaccaatctttcttctatcttctctccctcaatatctttctctcactctctgatctccctggcacaactaaagtagagatatagagagagaggaactttggattgtttgtgtctttgtgacag

SEQ ID NO: 5689 - DNA, 3000 bp, Unknown; identical to SEQ ID NO: 5682
  misc_feature (1)..( 3000): cDNA_ID_2993959_gDNA_ID_1620811_Annot_ID_169030 3000 nt of promoter + ATG

SEQ ID NO: 5690 - DNA, 2305 bp, Unknown; identical to SEQ ID NO: 5681
  misc_feature (1)..( 2305): cDNA_ID_2053753_gDNA_ID_1620811_Annot_ID_169029 3000 nt of promoter + ATG

SEQ ID NO: 5691 - DNA, 3000 bp, Unknown
  misc_feature (1)..( 3000): cDNA_ID_2053649_gDNA_ID_1620811_Annot_ID_169078 3000 nt of promoter + ATG
aacaccgtccgtttcaacactattggttcgggtggaggagacgcagcagttccaagagctagaaccggcatcaagtgatgaacggatccgatagggaacgtaagagctgacattggtgaaaagaagcgccaaaaagtcaaagaaagtttgctacgagaaaatcgtttctcattggctcaatttatactcactacttcgtggccactagccaccatggccatcaaaaacaagtaaagaaaaaaaaacatgtcacgagtggccatcaaaaaaacaaaacaaaaataaaaggaggatgccacgtgtaacccataacctgctacaagaggtgaaccgcacctccaatcatttgtctaatttcggtgtcgtgtccaagttccccggtggctttgaatttatccatcggtattggactaggttttggatggattcaaccctttgtcattttcattgagttactttctaatagtgtgtacttgttaaaaatctcaattattagtgttttatggctttgttcggaacttcgttgatatggacaatagagcaacatgttccttggaacacaagatagtagaaagcgaggtgttgaaatttctcccctctcccgctgttaaatatttttggtggtttgtgtattgtgattgtaatttaaaaatgattaataaggagcaaatgcccttagctttctcccatttcaaatttagggtttagacccataacctaaaatgtattattagaatcctggtcgtgaatccaatcttattagccaagttctactccacttccgtactacgctgtgtctaaatgacaaatcgtttatgttggagatagtccttattcattattcattatttcattattagagagaatgacaagaaaatcattgtgacgaatgataattgtgccgttttcaataggctattttcacacaaagtgatcagatctccccgtcccacatctcggcgacagatttgatgggacctttcttagaggtataaacctctccgtggacgtttctgaactgaggaatctcagttgaaattctctgtgtctcatcctctgtcaaagaccaatcaaatatctttagattctcttctaatctctctttggtaaagctcttcactaccatgctcactccttgttcataagcccatctcatactcacctgtaattacaactccaaatatgagctttgaactccatggatatagctgatgaatacatctcaaatttttctgttgagattcatgttaccaagatagtgactgactattgatggtgataaattgataataactgataaacgtccccactttttttttttgttgttgtaaaagttcatataaatgtcaccaattgttttttgtatttttcttgtttgatagtatcgtttaagaaaacttttgaaagtacctgggccactgttttttcctttgcttctgctatttctttgagaacatcagattccataattttgggagttccccaaaaagctcctctagatcccaacaccgagtacgctgtgacaacaatgtcgttcgatctacaaagctcccttagctttctttgttgccatattggactcatctcaaccttgttttcatccataaaaaaaaaagaagggtgaattggaattgtttgctgaaaaagaaatcaaagagtaaaaaagtagtgtttacttgattgacgctaggcgggattgtcgcgatagagagtatgtgttgaagcttcttacatgaaaaattgcttactcctatgcattttgcgagcccaagtctctgacactcctccatttcagaccacactacttcgaaatccattggcataaaatcatcttcatcaataggaaacttgtatttaccaggtttcgagctaaccggccaatgaattatataaagatcaagatagtccagtttaaggtttctgcaaaaccatatttgttacacaggtggtttacattaagttatgtcactcccaaaataatattcaatcatgaaacataattgacacggtgactgatagagaacctgatccatagagatatgtgaaatagttttctgtatttctcaatcggaaaagtgtttacaagtatgtttgtatacatctacactaaaccaactaaaccatatacaatcacaatttaacttaaccggaatcactaaaccggactatcatatatacagttcgaatagtgacacctactctcagtgattgaaaccgtgcattctaatttcatgtgaaaatcattaaggaatctaaatcttacttcaaactccgtttgatcgccggtacgacgagaccaccatgagcatcagcacaccaaagtttggtagtgacaaagaattcagatcgagatcgaactaagccgagtgaaaccgcctccgctaaagcttcgccgatcggctcctccgtttggtaccttggagaggtgtcgaaatggcgataaccaagcttaatagcctcaatcaccgtctctttcagcatcgttggttccggtagcggagaagcggcggttccaaaaccaagaaccggcatcgagtgatgaccggatggtccggatctgatggcgagcgtagggactgtggttaaagacattggttaaagagaagtcaacgaaagtgtgctctcagaaaatggtttctctcggtggcccaaagctttactcagtagccactgactaatgctagtgcctgataatattatattaatatactctctttgattagaaaagtacgtaagtcttcatattataagtttataacgctatataatttgactataaattgttaatagaaagtagtcatgatattatatacgaaaaatatttgaattagtattctttaatattgtttatttggaaaacttttaaagaataatatgttatgtaatttgtgctaaaatttcaaaattttaatatgtaaatcaataatgaattaatataagttgttttcagctttttctcaaaagcatgtcacgtatgagcattaacacccgtgtggaaaa

SEQ ID NO: 5692 - DNA, 3000 bp, Unknown
  misc_feature (1)..( 3000): cDNA_ID_1829042_gDNA_ID_1620811_Annot_ID_169076 3000 nt of promoter + ATG
gattgaagagacgttagtgtagaattttgctgagattggattcactgtgaagaagaagatcaaaatcgttagaagaagtgttctcatttttatagtatatttttgggaagaaaaaatatgggagaagttacagaaaaaaatgaagatgaagagttaacgacgtcggtgtgtttgttttatgaagctaaaatgcttagctcacttggctccatttttccacacgggtgttaatgctcatacgtgacatgcttttgagaaaaagctgaaaacaacttatattaattcattattgatttacatattaaaattttgaaattttagcacaaattacataacatattattctttaaaagttttccaaataaacaatattaaagaatactaattcaaatatttttcgtatataatatcatgactactttctattaacaatttatagtcaaattatatagcgttataaacttataatatgaagacttacgtacttttctaatcaaagagagtatattaatataatattatcaggcactagcattagtcagtggctactgagtaaagctttgggccaccgagagaaaccattttctgagagcacactttcgttgacttctctttaaccaatgtctttaaccacagtccctacgctcgccatcagatccggaccatccggtcatcactcgatgccggttcttggttttggaaccgccgcttctccgctaccggaaccaacgatgctgaaagagacggtgattgaggctattaagcttggttatcgccatttcgacacctctccaaggtaccaaacggaggagccgatcggcgaagctttagcggaggcggtttcactcggcttagttcgatctcgatctgaattctttgtcactaccaaactttggtgtgctgatgctcatggtggtctcgtcgtaccggcgatcaaacggagtttgaagtaagatttagattccttaatgattttcacatgaaattagaatgcacggtttcaatcactgagagtaggtgtcactattcgaactgtatatatgatagtccggtttagtgattccggttaagttaaattgtgattgtatatggtttagttggtttagtgtagatgtatacaaacatacttgtaaacacttttccgattgagaaatacagaaaactatttcacatatctctatggatcaggttctctatcagtcaccgtgtcaattatgtttcatgattgaatattattttgggagtgacataacttaatgtaaaccacctgtgtaacaaatatggttttgcagaaaccttaaactggactatcttgatctttatataattcattggccggttagctcgaaacctggtaaatacaagtttcctattgatgaagatgattttatgccaatggatttcgaagtagtgtggtctgaaatggaggagtgtcagagacttgggctcgcaaaatgcataggagtaagcaatttttcatgtaagaagcttcaacacatactctctatcgcgacaatcccgcctagcgtcaatcaagtaaacactacttttttactctttgatttctttttcagcaaacaattccaattcacccttcttttttttttatggatgaaaacaaggttgagatgagtccaatatggcaacaaagaaagctaagggagctttgtagatcgaacgacattgttgtcacagcgtactcggtgttgggatctagaggagctttttggggaactcccaaaattatggaatctgatgttctcaaagaaatagcagaagcaaaggaaaaaacagtggcccaggtactttcaaaagttttcttaaacgatactatcaaacaagaaaaatacaaaaaacaattggtgacatttatatgaacttttacaacaacaaaaaaaaaaagtggggacgtttatcagttattatcaatttatcaccatcaatagtcagtcactatcttggtaacatgaatctcaacagaaaaatttgagatgtattcatcagctatatccatggagttcaaagctcatatttggagttgtaattacaggtgagtatgagatgggcttatgaacaaggagtgagcatggtagtgaagagctttaccaaagagagattagaagagaatctaaagatatttgattggtctttgacagaggatgagacacagagaatttcaactgagattcctcagttcagaaacgtccacggagaggtttatacctctaagaaaggtcccatcaaatctgtcgccgagatgtgggacggggagatctgatcactttgtgtgaaaatagcctattgaaaacggcacaattatcattcgtcacaatgattttcttgtcattctctctaataatgaaataatgaataatgaataaggactatctccaacataaacgatttgtcatttagacacagcgtagtacggaagtggagtagaacttggctaataagattggattcacgaccaggattctaataatacattttaggttatgggtctaaaccctaaatttgaaatgggagaaagctaagggcatttgctccttattaatcatttttaaattacaatcacaatacacaaaccaccaaaaatatttaacagcgggagaggggagaaatttcaacacctcgctttctactatcttgtgttccaaggaacatgttgctctattgtccatatcaacgaagttccgaacaaagccataaaacactaataattgagatttttaacaagtacacactattagaaagtaactcaatgaaaatgacaaagggttgaatccatccaaaacctagtccaataccgatggataaattcaaagccaccggggaacttggacacgacaccgaaattagacaaatgattggaggtgcggttcacctcttgtagcaggttatgggttacacgtggcatcctccttttatttttgttttgtttttttgatggccactcgtgacatgtttttttttctttacttgtttttgatggccatg

SEQ ID NO: 5693 - DNA, 3000 bp, Unknown
  misc_feature (1)..( 3000): cDNA_ID_1829054_gDNA_ID_1620811_Annot_ID_169069 3000 nt of promoter + ATG
gattacaatttatctttaaatcaaaaggttatcgttttatactcaatcacatgcgtacacgtaggagtggaatagatacgctatccgaaattcaatgttatctaaaagaaatgagtccaacaaggaaattaaaaccctaatgggtcatagcacatttcctttactatataaacaatcttcatgccaataaaacaaagacccataacaaagactagaccaagaaaaagatggatcaagaggcttttttgcgtgagaggattgaaaaagcacaagcgcaattgcaaaagctgcgtgatgaaaatcgagttttgagggctcgacaaattatgtggggttgtatcgaaggaactattgatgtgtgtcaactcggtgaaaaggatcttcaagatttgagttctgttattgatgactatctcgatagccttaaaagcaggattgagtaccttaagaagaatggtgagccttcttcttctttacctcctcgtgttcttcaagatcttaatgttaaagaggatggggacattccttccatggatggcagccaccaccagtttgaaactaatcgtctcactaccatcactaccaccgctgatgcttgtgcgcctaacatcacaaataatccttagtcctatggggatttttgtccgattgaagaatttaataatttgtatttctgtttttatcattttaaaatttaaattttgaagttatgttttattatgttttctgatttttgtaataattaaagggttttcctttaaatccgtgttatgttatttgtgattattaaatcatgaatttgtttggaaaagttttaattttattcagagaaaatataatcatatagaaaattaatcaatagttgtaacaatttgtcttctataatatgaaaataaattagtagtactagacaatgtataccatgtaagaaaactcaagacgaggaagaaacattttcttttgattactgatttctgtatgtgggacttgaaccccaaacttcttggtgtaaaagcattaatgaattcttaatcaatcaatgggccaaagtggtttccatggaaaattattttccagtttacaacccaaataaaacatctttaaatcttgcatatgaaaatcaaagataactaacattttaaacaatgaaagcaatgagcctttgtataaacataacatacacctttttgtttgctcggcccatcaaggcacactatttgtaaggtgtcaaattttgttggtctagttatacatttacttttgtttaggcccactaattcaaaacatattataatttccaaatctcgaagtgcgtggtggtggatagtatttagcatacatttacttttgtctaggagcattagatcattagatagattatcatatctcgtctgaatcttagattaatgtttttgagtataagaaaccgatattgtaatttgtgaagtacaagttatcaacgttgtttgatggtgtgatgtccacgtattgtttcttattaagaaatgctttttctgtagcataaaatcacacccaaaagaatcatatattcatttcatgttttatttgttaaagtagcagtagctagcacattatagattataatggaagttatacaaatttgtacttacatctttaaaaaaatttatggagactgaggaggctgatgatgaagactgcccctagttaccctagttagtatggtcgacgaccaaatttgtttttacattatacaatgtcgtttatcaaatcatacataaaaatgtagtttttatacataacataaactatagttgttcatggatataaatagaatggtattatttatagaaaggtacatgagtatacacacatcattttaaacatactatcttacaatatttgtcacatagtatagtagtgacattatcacatgtattgatatgaaactactgtagcacaactaatccatttttttttttaccatttcttacacgtgagcgtcttgatctacatagctatttgatactagactagtacatttattagtttactaacaagtacaacgtttaaactggctatcttcttaaacataattatcaaaattttgatgtcgtccattaaatacaccctttaaaattaaggatcatcgcttcaatgtcaaatactaaagatttcgaaatctttaccacaaaaaagtttcgagaagtcttcttcgactttataacagatgaagatgggaccaaaatggtttttaataacctctacttctcaactaccgataagcaacaacgattcacaaaagtcaaacattccaaaattacatttacacttccgattttctcttccagatttcggtttcttctagaacatccacattacccaaactattacaattctcatttattctaaagcacaaaactgcaaaaaggtcacatgttggttagaacttagaacactgtataaagaactagtaaattggtaggtttaaaagatgtatgaatatataacttactcttaacataaattatgacttgattttgcgttcatactcacgaaaaagacataaaagtcaacgcgtagccgaagatttagatcaaagaagtcaaacattaagacatcttccgttccaaattcggacactaacccccaaaatccacgacctggtcaacgcgtcggaataatcaaaatgacgaaaacgcccttgtcgtttcacgtgtcaatgccgagtaaatggaggttgttttcgtaacattagccacgcttttgacattggaccatatctcatgtaagaaaagcttaatttttatttttgttgctttaccaaaaaataagagaggaaaacataaaaaccaaatcattaatgtgttaaatcattaatggttgtcatgttcatcaaaaatcattcccaacacatttcttcttcgttgtcaaaaatacatcagaacgttctgatttcgccgcgtgactcttatctccgtcaacgccgataaattctccggtaaagtaaccgccgcgatg

SEQ ID NO: 5694 - DNA, 3000 bp, Unknown
  misc_feature (1)..( 3000): cDNA_ID_3078100_gDNA_ID_1620811_Annot_ID_50588 3000 nt of promoter + ATG
agccattattcgtcctcacattagccaaatctgatcaatccaaagaatctggaccgcttcgttgttttctactatctaagacaatgtttctctctcgcatttcttgctaaaaagctcattttctgatttgtgacaaaatgagattttttttaattaaaatattatgactaatctctttatttcttataaaatattatatcttaaacattacaatttttctaacctcttatatcacaatttatttaagcagttccgtaaatttttcagtcatcatttttcgtggatttgtttttttttttttacgttccaatcaccaaccactaccgtcaagcacccaagaaagttgcattagttttacactgacaaatcgtcggtaagcacgtcacaattttttaagtcttaactaagctttttgccatatacatttccacaaaaactgctttttattgtcattttccaaaagcatatatttgtccatacatatatatctatatcaaatgcatgcgcaaatgtatcatctaattagtatactgagcttgaaagaggataaattttgtaaagagagtcgtgtagaatgtggaacatgaggaaaaaccaaagtggcaacccataaaatgttagaatattgctaagaaaacggaatcgacgaccagatttcagtgtatgaacaaaagaggaagaaaaggaaagtgaaagacaaaactaagattaaaatgaaggaaggaaaagaaatagtacgaaaatggatgtacttaaccccaaaaaaataagattatgtagctaaattttagtttaaccaattattacaatattcgtaaattttaatgtagcactaatcaaattttttttgtgacctcataatttttaacttttgcatctgattactatattaacacatgaacataattttattgacactagaagttttacatgttttcgtgggcgtcgttaccgatcatgttttcatgtagtcaaatggattcagaaaaacatgaggtataaaatagtaactccaaaattccgaggaaaataattttcaagtggccaaaacaaatattttctagtatttaaattacggaaaatgaaaaattaatgacatgagtttagagtaaacccagcacatctaaaatgacaaagaaagcgggtcaatcatctgaaaactgcaatttagaagcactattaactagtatgattgggagctttactgttatttttagctagagaatttaaaattaataattttgttccggaagatttaagatgtttatcgtacaagaaagtgtttaataatgtgtatcatgtattagacctaaataaagtatgaagagacagtgaaagaaaaacagagtatgatagcacaacacaaaagcaatacaaatataattaacaccatccttatcaacaaatacactgcgtcccttaaatattccactaaattacaaccaaatactttaaacatgcacgatagtgagctgtatcttggaaattcataaaaatgacataaacttttgactcatatatatacgttgaaaaagtatttgaaagtagactgaccaacaagtaaccatcaagaagcataaaatctaaaatatctattgtatttaaccatcccttatgcccatcattttcacaaacccacacatatacatacttatatactttataacattccaaatttcaaccgatctatcataattaggcatcaaattaaaaaatggaatatttgtggtgggagagagatccacatcttttgtagaaagtgcgtgtggggctaaacttagaaaaaaaagcaggaatagtgagagaggagacacacggcgttttcgtttctgcctagaatctacacttagtgttatacgtaaggccaaagagtcaacgactttggctccctctcttcacctcttctctattataaattgaagggccaataacccaactctatttgtcctcaaagatagtaaagaagccaaataataaccaatctttcttctatcttctctccctcaatatctttctctcactctctgatctccctggcacaactaaagtagagatatagagagagaggaactttggattgtttgtgtctttgtgacagatggcagagataaacaaacaaagcaacaaatgggaacaagaagaggttagtaatgaaaataattgggaattggctgaagaagaaagtgttgactggagagggagaccttccaaccctaacaagcatggtggaatgagagctgctctctttgttcttggtaatattaaaaaaactttcttagtgttaaacatttgtttgtagccttagatggatcatcttgtttttgtatcttggtccataagaactccactttttatccaaactttggtcccactatctaagattatatattccatggaccttggcaagggttagatttctcgatttaattatgtcttattgatttgtggtctttcattctatttttttaggactacaagcctttgagataatggggatagcagcagtagggaacaaccttataacttatgtaataaacgaaatgcatttccctttgtctaaagcggccaatattgttaccaactttgtcggtaccatctttatctttgcccttctcggcggctatctctcggacgcctttctaggcagcttctggaccattatcatattcggcttcgtcgagctttctgtatgttcatcatctctttccagtacttttttgacatatatgtacatacaattctccaagttacttggcttgcaatttaaaattaaaatctaaaccactttcgatatgggatttctaaccaaatctgtttttttacacgtaagtaatttacgtgagtatctccaggcaaacatgccttttgtgtgtgatcccattacgatttaattaactatttacaaaaataccagcctataaacatcaccaattactgttttagatcaaagtttctcattccgaaaactttctaataattttttttccttttcttttaacg

SEQ ID NO: 5695 - DNA, 3000 bp, Unknown; identical to SEQ ID NO: 5687
  misc_feature (1)..( 3000): cDNA_ID_1829097_gDNA_ID_1620811_Annot_ID_50589 3000 nt of promoter + ATG

SEQ ID NO: 5696 - DNA, 3000 bp, Unknown
  misc_feature (1)..( 3000): cDNA_ID_1829093_gDNA_ID_1620811_Annot_ID_50590 3000 nt of promoter + ATG
tgcacaacttgaattagaagaatggatagtagaagaaggatcaatgccacttcttgagactctcgatactatgttttgccaaaagttaaaaaggtatttcatgatacattacttctttgagaaaacttataagtagggatgttaatgatgggttaaaacccactgggtacccgaaacccatctaaaatttcaaacccattgatctactttttgtataaaataaaacgtgggttttaaatgggcaggtcccatttcgttaaagtcttacacgggttttaccctactgggttatgggtacccgtgagttttaacttattattttagtatgttaaaggcccaatagcccaattgccaattctattgagaaaccctaaattccttttcttccccaaaattttgccaccaccacaacagtctctctctcttctctcctcttctctccgtcggagtcaccatgagagtcaccgctggagtcaccgccgtctacaccgccggagtcaccgccgtcttcaccgccggagtcaccgccgtaagtctctcgtcatctccttgaaaaatcaaactctagtttcacttgatattagatgtcctttctctcctttgattttagccgtttagtactatcactacttacttttcaggtgtcaagtatcctactgctaacgtgtattttctgcaagtgtggaaaattgagcgtcttttgaaagactatgcagtttgtggtgattttagagtggaagagatggctagtaggatgcaagtaaagtttgataagtattgggatcagtacagtatcattctagctatgggagctattctagatccaaggttgaaagtgcagattcttaaatctgcttataataaggtggattcgagtagttcggaagaaaaggtcaatgttgttgtggacaatttgaaagatctttacaaagagcacagggaaaaagtttggacttcttccaccttctcaacaacccaaactccacatgaccttcttacagaatcaccactagaggatgatccaaattatgtaagtatttctccattccttgtttatatcatatcatctttattgtctaactagtgtctatactctatatcatacaggatgtgtttgagcttgagaggagcatacaacctggttctgacaacacaaagtccaatttgcaaaattatttggatgatccaaggctagatttgaggtcttttacagacatggaggttctgagctattggaaaggcgatgggcaacgctatggtgatttagcttctctagcttctgctatacttagcattccaatcactacagtggcagctgagtcatcattcagtattggaggtcggattttaaaccctttcagaaaccgccttctttcgagaaatgttcaagccttgttatgtactaggaactggttgcgtggttttgcagagttggaaggtaaaaaaagaatagtctaattttttggacttaattttttttcatttgttgatttatatcttctaattgtaggtgacattgaagaatactttgatgatggaattgaagctactacatcggtagcaagtagctctggaatatgagaagatgttgtatttttgttttaaattgattttcagatatttgattactttttaagtttttcttgtttaatttgacatacaaattattattattttgctatgaaaaaaatttacatgatatatttacataccagcttagtttataagcaaaatatagatataaaatatatataatagtatattagtaattaaacataaacactaaaaaaaagacaaaaatcaagttgggtacccacgggtagtatcagaacaatcgggttttttttgggctttcccactaatcaaaaatccatttgaattttctaaagttgggtttttggtgggcgggtttattttgggttcaggtcgggctgggcttttttacccaccacaacatctctacttataagtcaatatatgaagaggaaaatggacaaacagattgtctaataagggaggagaagaatatataaaattccaacatactccttacgtattatttctctagtaaagatgaagattgagatatttctaaaagaagagagtaccaggtaaattttagtctaagcacatactcacatgattatcaagagaaaggggaacacattctctttcttgtttatttaaaagtatatgtttttggaatttttttagtaaaaataaatttatatttggaaaggttttgtgtcaaaaaaaatcctccaacttgctaatttttgctactttaccatatatttccaaaaattgcagattaatcatacgaagtaaaacaaataaaataatatgcaatatagctttatacgtatattgtaaatgttttcacagccacatacataaaagtttcaaaattttaaaggtagaattgaagtcctcctagagaagacttcgatttgacatattaattgacaaaattttataaatttgacggtaacaaaaaaaatggttacattcttatttttttggatttaatatgattaatttgtatttaaaagaggtagaaaataaaattgtaaaatttggtgagtttgagaagtatttttttgcacaaaaacgttttgaaactaccgacatgaaatccaaaacgggtatataaaatttgcattagtctaaaattaaattaaaagatttaggtatgtaaattactacatacaagaaaataacaatgagagttatcttcctttcttctttttaaaagtttaacattcttatattcagaatgattaagttcataaattgagccaatgggaaaaaaatgaaccaacagctatcgtggagaaaataaaaacaatttgggccttaagtgagtaaacaaaattgggcttaaaggaaaccctaaaacgcagagtgacaaagtattcatcgtcttcgtttcgtgaaactcaccggaggaatcgtttctcgtcggcggaaaactaaaactacacacaccattctctcatg

SEQ ID NO: 5697 - DNA, 3000 bp, Unknown
  misc_feature (1)..( 3000): cDNA_ID_1829085_gDNA_ID_1620811_Annot_ID_50592 3000 nt of promoter + ATG
tgtgacagttgtagcttttagctcttttctaaatctagtttctactttctacaaagcataagtttttgtaattcaatgcaaagaaagccatgtggggagctcaattggtatatttgtcaagatttgacggagattaaagaatcatataatctattaaaaaatatctttatggatcttacgattgaaaactatattttaatctaccctatggtttaaaaccaataaaaaagttgaagatcttttacatgtttttagaaaaaaagtgaagggtttttaatccatgtttttttctaaccaaaaaaattaagttatcaaatgattagaaaataaataaataaactgcttcggaaacttttctaaaaacaaaaaagctttcagaattcaaatgtgtagatttttttatagtatagaaaaaagaaacaaatcactttaatatttttttgtttgaaaagcctcgtttatgaggtttaaaaaaagaaaaaaaaaaaaaagaaaaaaaaagtttttgagaaattagtaaaaaagcctaattggaaaaacaaaatgtgagaactttagactgcttttaaagtcttgaaagcatatagccaatcaccccctaacttctttaaaaacaaatgtgggacaacataatgctgtattattgttctacaaaaatgtgtaatgggtaaaatggatcaagtagttatattatttttcatatatactacttgacttgtatttgctagtattaaaattttaatacttggtagttggtatccactttgtttgttacggatacttattttcttcgtccgggtaaaagtcaagtaacgactatgaagcgagtgataactaatagtaatcgtgtccagccttttttgtttttattttttgtaatttgtcaagattaagatttaacggagattatggatcaaataattaaagaaacgttaaaagtaccggagtaaagatattggttttttatttattgaccccaagttttaacgtgcactgcacatgcacaacaaagtcttaactttttcccggtcttattttaatttaaatatcgtcaacttggctaccgatttcatacttactcccatatctaagaataagctgagacttcataactaaagaacaaagaacaatcatctttcttcttccaaaggacaacgagaaaaaagtggtttcgacaggtgagccagtttgtttgttattgatttttacttttctgtcaaagtttatttgttttctgattgcagaaggtcttttgctctgtccttgatttgtttccatcaattcgactctactcgttcaattagttttttttttctttcttaaacaatgcaaaatcttagatcatgtttgaagaaacttgaatcctcaaaagtttgttctgcttccttggccacctttgtttgttcacgtttttcctttttccgatttacttctataaaccctcgtgaaacctatatccctcaccggttttaaaaggcaaaacaatctcacggcagaggaagacggtggtggccggtgactactcttacgctcagctctctgcacgttctatttttgctgaaaccgttcccccactgcgatgcatctttaaaagttgaatattcttccatcacttagtttcctttctaaacttctggatctgctcaaatcccttcagaagaaatctcacactcgacttcgttgtggcaagagaagtctctcttggaccgtctatcttctgggtggtgattcattggctctccaatgggttttcattgacaaagctagtgagttctctcactcacaatcgcggaagctccaaacctgcaaaacctttggtccctaactattggtctcccacgacggcttgcatccccctccaagcagccctcaacttctggatctgctcaaatccctaattgctcagatggactctttctttgagatgggtttctcaattcttggcccactaagatatctttctcggcccatgtctgaaataatagggctaacccaattagcatcttggcccaggtctgttttttttataaatattttggcatttcctaatcctttgatgtctcttgacattgctgatattggtcaaggactccaatttcactttgtgcggacatcggtggttaggaaagctaataatttgttacgaaccttggaggaagacatccttagtgttgttaatcgttttatcttttctaagaactctatgttacaattatcctctttaatagaaagaaccttggtttggactctcacctccttttgaaggaaccgtttatgtactttacccagattcttagatgatgtggatattaagccggtgatattcaagttaaagaacctcttttcaacattattatgtctttattggaccgtaactaatcttcaatctccccaagtttttgtggaatgattttcgactcgccattctctcgcttgttgcaaactacgttcaagttcttgtctccgatgtttggatcttccgtcaaattatcgtatattctatctctaccattcacttgttagaatgctagtttgtgaattgtttggctaaaagtgatacttcattaacgtgaaaagatggctttaaatagccttacaaagactcaaaaggaacaacaaaacgactaaaaaataggaacagactccataactccactacacgaactgactcaattccacaactccactacttagactccataagactcggacgtaattgacttcgaaccatgtgttggatgtttgtttgaactttgtatttggtatgtggattaatggagtcaagtatgtttttgcccaaaaaaaaatttagctaagccaaacctattcttaaagaatcatgtgatagactgctaataatgaaaaatgcaagtatatattaaatcacttttatctttagcagtttgaacttatatataatatatgtgatgtaggttcttgctaattaatgtttcctcttcattataaaaaggtttcacctctactttcgtactattcatg

SEQ ID NO: 5698 - DNA, 3000 bp, Unknown; identical to SEQ ID NO: 5685
  misc_feature (1)..( 3000): cDNA_ID_1829073_gDNA_ID_1620811_Annot_ID_50596 3000 nt of promoter + ATG

SEQ ID NO: 5699 - DNA, 3000 bp, Unknown; identical to SEQ ID NO: 5683
  misc_feature (1)..( 3000): cDNA_ID_1829062_gDNA_ID_1620811_Annot_ID_50601 3000 nt of promoter + ATG

SEQ ID NO: 5700 - DNA, 3000 bp, Unknown
  misc_feature (1)..( 3000): cDNA_ID_1829058_gDNA_ID_1620811_Annot_ID_50602 3000 nt of promoter + ATG
gagtaaattttatttttaatttaacatacatatatgagaaagacgtgagattgtatatactgcaaaaaataaattgaatccctttgtacatcatcaataggataacaagtatatgataataattttgtcgaaatgcttacccacatattaaatcgtcattgatatgaataatgttaattattggattttaatatacacttggaattcttattattagtagttaaaaatcccactagcacggatcttatttgttatacgcaaaatatagtaaaaaaagaagctacatatttagattcatgtaaaaataataaccacataagacaaatttatgtagtagaaaaggttgaaacaattttgtacaacttttaagaattgtcaatataaactaaagcttcatattagaaaaaattgtttttattttccaaaacaaaaccaaattttcattagaatatatgctgtaattagaaagtgtcattgtattcttgctttttctaattcagtcttcttatttttgcaggagttcactaacaatagtgatcacaaatcaaccaacatcaaaattacacttatcaaatagaacatgaatctaaaaaaagataagaatactaacaaaatcgaaataaatgagaactaaagctcctcacatccttcttctctgcacatgtcaagaatatgacgtatattggcggtggcgttgatacaccaatttgaaaccaaccctaaacttaaaaaaagtttaaacgagatgaacacctctctatttaggagctcgttaatatcttgcttagacgtcacatgagattgatggtacatgtcatggagtaaaataaaatcttctcttctctgtgtctctgatgaggtcatggagtatgggtagctttatgataaaataggaacttgtttcagagtatttagaagtaagttatttctattttctatcatgaaaacatttcccaattttgaatatcttttatatactctcatggctgtgtttatcaagatcatcaaaggcgttttctttttccccaccaaaggctccttcatcaccaccaaaggtaccatcaagatcaaatcaaattcaaatggtatcaatggctccttctttcacctcactactaatgactttttcttcttcaccaccaaaagcctctccttgcctctccttgccaccaaaagcctctcctcggctctcctcgccaccaaaagcctctccttggctctcctcaccaccaaagccgaatcgtttgctctacttaccactatcaccaataaagtcagttatgtgtttcaaaacaaacgaggaaggggaaataatagacttctttgatatatttattgaccatttggtctcaaagaatcatcacatccttacctgaagagagagcgtgaagtatggttattgggttgagttggctttagaagcactgtttgatattgaagttgagtttgagtctagtatggatgaagataagatgaaaagtaaaagttgatttttcaaaatgaaaagtgctccgtttggtaatatatatatcttggagaaagagatagtctatatggagcgtgaagaacttttagaaaacatttcttatttcaatcttgtggagcaaaacaagaagaatggtcttcctcctcctcaagaaagaacatggaagtcactagagcataaaggagtcattcttccattgccttaccaaaaacacaacgttccccttatctacgataaaaaactcttaagaatttccaatataaactaaaacttcatactaaaataagatttgttttttctttcaaacgtaataaagaacacaaatatgtcaaaaaaaaacaatcgtgatatgttgataagaaaatatcaaaactatggtaaattttaagattatttttatagtttatttttttttgataatttcataaattctcaacttcattttttcttttattttcttcgttttaaaataaattctcagattttatttagggctcaaaagatccaagtatgaggagtattatttacataagttatattaagcggtttagtacgaatttttcgtgccaaattgttcgccttaacatttgtataattcaaaataccgaattaaaccaaatgtttttctgattcgttaagatatttgtaccaaaaaaaagaaataaccattttatttaataatcactaaaaaaacataagcttaaacttattattataaaaaatctttaattaaaaacctaatctactataaataggaaaattcaatttttcttgaccaaaagaaagtataaaaatacataaaatggcaagaaatctcatatgttttaatcccgaaagtataggtgataggatgataccctaattttgactgtaagaaattaggggaaatccattttgttaccaaaatctcttatcatgtttcaattactttaaatgcatgaatacatgccaaagattttgttattaacaacacaaacacttgattatatatctccttggtataatatacagaacagacacaatcttaggctcctccttctctcgctctcttccctctgttgctcggaaagctttggcctttttggttttcttatggctaattctcttctcaaaactattcgtatctgagagagattgagataataaatatagagagagatccaaaccagaagcaatctttttttgtttgtctctctgtgaagattcgtatcatttttctccggcaaactaacggcggcgatccactcttctctatagcttctattatgttggttttatcttcttctttggaagaaatgaacaagtttggttttttcgctttcatgaatgtgatccggtctatataaggtttgtatatataatcaaaatctagtttttgatttttgtttcgattttttggcgatagatctggtttgtgtttgttgtttaagagagagggaagtttttgaatttgtgattttaaacttggcttgttttcagggtacttagagtttggtgaagcttgaatctaagag

SEQ ID NO: 5701 - DNA, 3000 bp, Unknown; identical to SEQ ID NO: 5693
  misc_feature (1)..( 3000): cDNA_ID_1829054_gDNA_ID_1620811_Annot_ID_50604 3000 nt of promoter + ATG

SEQ ID NO: 5702 - DNA, 3000 bp, Unknown; identical to SEQ ID NO: 5692
  misc_feature (1)..( 3000): cDNA_ID_1829042_gDNA_ID_1620811_Annot_ID_50608 3000 nt of promoter + ATG

SEQ ID NO: 5703 - DNA, 3000 bp, Unknown
  misc_feature (1)..( 3000): cDNA_ID_1829038_gDNA_ID_1620811_Annot_ID_50609 3000 nt of promoter + ATG
ttgatcaacgttatcaacatgatactagaatatttgcctctagcataagataatcgtgtcagaaaaacatcatctgaccatgcgtcattacacatgtacatgtggttaactttgtagtgatgatagagatctttgtacatgcttgtgtagttgcagtttcagtaacatatataaagcaaaaccgcattccttctcatcggaagaactctttgtcgtaagagaacttcttggtgcagccatgtttggcatttgtggaagcagtcattgtgacatgcccaaatgccaacatgattgcagcgagaagttctcttatggcaaagatttagtccatgagaaagaatgtggttttgcttttgttattgaaattattgtaactacaccaacatgtacaaaacttcactacaatgctaaccataaagctaatgactcatggttcaggtgttgccattacgataatgcatgggtatgcattagtgaagagacttttcgtcattcaagaatgtgaaaatggtccaccaggtgtagttcagtgtttgaaggagccgcaaggtcattatatatagactatatacatgttcgaattcacgattgttgataatttcaatttactttagaatcccactattaattaaaacatagtatttattttaaataaaactacatacgtggatttgtgaaacattacaaaaatgtaagtggtgattatcaataaaaacaagtcttctcaaacaaattggaccgactaagagcaccattattgatagttgcttagcttaattcttaggaaattttggttacaaatttaatgtttttaatcatatatttgttaaaagagtctcttatataaaagacaaattgaagtattcttatcttttgttttaaaaaattaaaatcaattaaaaaaaatcctaagaactaagttaagactaacctaagaaactaccattaatgatgctctaactagtgttgtatgtgatgacttcgtaagtctatgagtcataactcattgtaaaactttaaagacctttaaaatttgtgaagaaaacttcaacagttttttgaccaaaaaatcgaaatattcaatagtctagcagaaacagatttacatatttcaccgaccaaagaaaaagaaaatcatattttacgacaacattttgttctaacgaagttttttctgacattaaatttaatatgcattaataaacaccaaaatccaatatatgaagaattttacaatttctctcatttccatgagaccatgaccccaaatcgttacttttccatcgataacatagaatcgttacttttagaagaaaaacaaaaacaaatcgattaattgaccccaaaataagatggaataaaagtataaataaaacctacactaaacagaaatcaagaatatacacgtggcaatcgatgataagctaatcatccaccctctccaccgacgaacgctatcaccaccggtagattgactctcacggctaggtttcgaaccaccaccgtctccattcggattaccaccgtacaaatgctgaatcccttcgatatcatccttagctaactccactttccgatctccaccagaaatcgccggaaacataatcgcatcttccaccgacgaatgacctagccctaaaagatgaccaatctcatgaacagccaccgattcaagatccaccaccgtcgtcaccggtaatatccgacgactaatttcaccgttagagatcaaccaatcctcatcaccgtctaaatgtaacatccccgtaggaggcgaagaagcatgcgctaatgttcccatagctccatcaaacggctctccatcaccatgttcaccggagaaaaatccgatcactatatccgcacggaggatagactcagagcgcgtgaaattcaacggagtcacctccgcccaacgcgtgaaggcgcgtgagaacacgcgtttaacctcgtctgttaaattattctgcggcgcaaacgcataagtcagatctcgtttccgtttcggccaccgtggcttcccggggaaaaacgagtatttctcagtcgtacggagtatcttaccaccgttcatctccgaaaccccgtcgatcaaatccggattcccgcatctcggtttaacgatttgccggagagtcgaggaatcgagttttccggtgactttgagattgaaatttttctggtaagtgttgatcgctgattgaagcacgtcatcgaaatcgtcagtgcaattaccggtggtggtgatataaccgaaacggcgaaagtattgtttgagttttgagaggccgttgatattttctccgatgtgacaaccggcgagtttggagaatgtttcccatgcgttttgcgttgcgtttaggaattgtaacggtgggattgaagagacgttagtgtagaattttgctgagattggattcactgtgaagaagaagatcaaaatcgttagaagaagtgttctcatttttatagtatatttttgggaagaaaaaatatgggagaagttacagaaaaaaatgaagatgaagagttaacgacgtcggtgtgtttgttttatgaagctaaaatgcttagctcacttggctccatttttccacacgggtgttaatgctcatacgtgacatgcttttgagaaaaagctgaaaacaacttatattaattcattattgatttacatattaaaattttgaaattttagcacaaattacataacatattattctttaaaagttttccaaataaacaatattaaagaatactaattcaaatatttttcgtatataatatcatgactactttctattaacaatttatagtcaaattatatagcgttataaacttataatatgaagacttacgtacttttctaatcaaagagagtatattaatataatattatcaggcactagcattagtcagtggctactgagtaaagctttgggccaccgagagaaaccattttctgagagcacactttcgttgacttctctttaaccaatg

SEQ ID NO: 5704 - DNA, 3000 bp, Unknown
  misc_feature (1)..( 3000): cDNA_ID_1989630_gDNA_ID_1620812_Annot_ID_57881 3000 nt of promoter + ATG
tcattttgttcttaaaatcaactttttgtttgaaatgtgatgttgaatttgagtttctgcattgttggttttgggaattatgttgcagattgatatcttgaagcgattacaaagagaaacattctcggatttgatgaaacttagagaaagacaagagaaagtagagcggatcatttcctcgcagaaattatcgaaaggaggtccctttcaagagactagcactcatgtgagaggtgaagttgatgtgcttggagctatattgctgatgggaaacactgacgaggaaagtttcaatggactcaacaaagaaggagtgagaccgggattgctttcaaggtttgtgtttgaaacgagtcttagggagacagataggcttgtggctgagcttgttgctggatacaatggggcaggaagtcacagggattttttaggaggagagttgtctttagccaaagtcttctacaaggcagatattaatgattggttctctgctattgctattcctgttggcgcgcatttcagagacattgaggcttctactgtgtcttcttaccaggtatccaccaatcgttgcagatttctgtttctatatttgttgtgtttctcataaataatcgttattgataaaactacaaatacaactaccttcgtcttgcagggaatgagtctcacagaagtttctgaacttggaccacctcttttaagccaacataatgggagcgccatagggttaacattcagaaagtcaaatatcacagcttcactggctcagtctatgtcaaacgttgaagttgaacagggtttgactgcaccgaatcgttgtttcagaacatttgggcaagtaacctgccacattctcagaagtttaaagctatctctattgggctgtcaccaagttttaacatcatctagcaatctccattctgttggagccattacagttccagtaagtttcctaaggcgccatactgctacggagcctgaaccatcagcaccgcctctggagatgagtagaaacatgaatcatgtgtcgtccagttccattgctttgaagttagactctctaatggacgagtctacaaaacttgggggatggattgaaattcagaactcaagagaaaagcaagtgaaatggtcagtgtctattacagacaacccagaggatgaagtgggctggggcatgagcgttgggggagttgttgatggttcaagaaatcatgatcagtttcaggtggaatcatatctgaaattcaacataggcgataggtttagattaagtccatgtcttgtttatcacacaaacagtgacggaagaaccataggtcttatgctaaagtctcactggtcgctgtgatctcaagtttactcattacttgtacattgatggttcgaattaccactgactgcagttttgagatttttgtgtctaatgcaatttatttgtctgaaaatatttaatgtagctgccatttttgtgccttgaagataaaagtttattgtctatcatcgcttagaaaaatctttgttgtcttgttagtaattgtttccatctgtgttggaatagtacactaatttgcttttttttttattgtaatggtaacaaatgtcgtaatgcttatttatgcttagggagaagtagaataactgaagattgatctatgattagtatgtcttgattgcaacgtaacataggttgtggcattttaaagattatttgaaagaattcttcttaaacaagatgtgactgtacaacagtttgattgatgttgtcatgttgagagctacgttgtgaccctctgtctcatgaacatacaaattctctagacttttcatctgtcgaagtcaatgacctttttctcaggtctcatttgatacaacaaagtcctatgcagaacgcaatggcaatatgaaaaaaaaaaaaagagaggtaattttgttctccatttcccttttatttttgctcaaagatttggcgttttgagtcaattagactttctaataatactagtttcggcttctgtcgttttagatgtcattactcatcagtcatcattgtgatttgtgaattgtgtggctttcattggtaagtaaaaaacttagaacgtccatacaaaaaaataacatgttaccaatataaaacaaattaggcttcacataacaattgtatcaagggcaatatccccacctaatttctctattcaattttttgtcaccatctaataattctttaaaaattgcaaattttggcctcgtggcacattgtctcgtatttgcatgcaaagtcaaaagtatgtgttgttcgatagagaccacatccttttttaatacaagataaatttgtttggtaaaaacctttctcatagtttaaaaaaaaactttctattccgtttcaactgaacagaaatcgaatcttttgtacacttcgtttaggcatttcatgtgatacattgtgtgcttgcctcaacaaattccaaattagctacccacaaaaagatttgcgacctaatccaatctagaacggcatgacataaacaaattcaactcaaattcctcaaactttaacgacggcaaaacaccaagtgggctgtgaaacacgcgttcgtttgtatcaccaagaatgagaacagaaaaaagtaatatttgttttcaaatgctataatctgcaaataaaacaagtgtactcgaaatgtataaacaatgaccccattgaaatcgcactaaggcaagtagtcctctcgctttcaatcgtttcctctgcatttaaagaaaagtcaagattggtggtttattccactctcactgctaattggtgggctattcaatgaatccacctaataacattattactcacaccaaaaacaaatcttcgttgaaacataaaacttttacatcattttctaagtcaagtcttctcatagagacagaaaaagactactaatttacctctcgtgtaggaaaacaaagcaaaactggagtcattctctgtttcaaagagttatg

SEQ ID NO: 5705 - DNA, 3000 bp, Unknown
  misc_feature (1)..( 3000): cDNA_ID_3078166_gDNA_ID_1620812_Annot_ID_57884 3000 nt of promoter + ATG
gcttcttgattccgggaatctggtgctaaaagaggcgagtagtgacgcgtatctttgggagagcttcaagtatcctactgattcttggttgccaaatatgttggttgggacaaacgcaagaattggaggaggaaacgtcacgataacttcttggaaatccccttcggatccttcgcctgggagctacactgctgcactcgttcttgctgcatatccagagctcttcattatgaacaataataataataacagtacggtgtggcgaagtggcccgtggaatggccagatgtttaatggtttaccagatgtttatgcgggtgtttttctttatagattcatagttaatgatgacaccaatggatctgtcaccatgtcatatgctaatgattcaaccttgagatacttctacatggattatagaggatctgtgatccgaagagattggagtgagactaggagaaactggacggtcgggttacaagttccagcaaccgagtgtgacaactacaggcgatgtggcgaattcgctacttgcaatccacggaaaaacccgctttgttcttgcattagagggtttaggccaaggaacctaatagagtggaacaatggaaactggagtggtggatgcacaagaagggttcctttgcagtgtgaaagacagaacaataatgggagtgctgatgggtttttgaggctgcggcgaatgaaactgcctgactttgcaagaagatccgaagcaagcgaaccagaatgcttaaggacttgtttgcagacatgttcttgtatagctgctgctcatggcttaggatatggctgcatgatttggaatggaagcttagttgattcgcaggagttgtctgctagtggattggatctttatatccgtcttgcacattcagaaatcagtaagtattattccacaacatctctcacattcttactttaatgattgcagttatattaattctgctatttcttgccaaatctcaaatagaaacaaaggataagcgaccaattttgatcggtacaatattggcaggcggtatttttgttgtggcagcttgtgttcttctggcacgacgaattgtcatgaagaaaagaggtcagactttaataaaattatgtttacttcttataaccgttggaatttttaattttagtaaaaccttgcatccggtctcagcgaaaaagaaaggaagagatgcagagcagatttttgagagagtggaagccttagctggtggtaataaaggaaagttgaaagagctaccattgtttgagtttcaagtgctagcagcagcaactaataatttctcgctgagaaataagcttggacaaggtggctttggtcctgtttacaaagtaagtatgacttttaaaggttatagcaataagtctttctattgggaatcaggtgtgtatcatattgacttttttttgttgcaggggaagttgcaagaggggcaagagattgctgtgaagaggctgtcacgagcatcaggacaagggcttgaggagcttgttaacgaagtggttgtaatttctaagttgcagcatcggaatctggtgaaattacttggttgttgcattgcaggagaagagaggatgttagtctatgagttcatgcccaagaaaagcttagactattatctctttggtaatttattactatctttgttcttaaactctgtttcaatgttatcaccatgtcaactaacagaagctaatgtgttgttcagactcaaggagggcaaaacttcttgattggaagacccggtttaacataatcaatggaatatgtagaggtcttctgtaccttcacagagattctaggctgagaatcattcacagagacctgaaagctagtaacatcttgttagatgagaatctgattccgaaaatatctgatttcgggttggccagaatttttccagggaatgaagatgaagcaaataccagaagggtcgttggaacatagtaagtaactccattcaaccatatgttacatctttttttccattaagatagtcctaaaacagagaaaatgtatcgtgcagtggctatatggcacctgaatatgcaatgggaggactgttttcagagaaatctgacgttttcagcttaggagtgatactcttagagattatcagtggaagaagaaactcaaattcgactcttttagcttatgtgagtctaccttaactctactaagtttcttaactctcttgaatttttctcaagccctaagagctcctctgttttataggtatggtcaatctggaacgaaggggagattaatagtctggtagatcctgagatctttgacctactctttgagaaagaaatacacaaatgcattcacattgggcttttgtgtgtgcaagaagctgctaacgataggccaagtgtttctacagtgtgttcgatgctcagcagcgagattgcagatattccagaaccaaaacagcctgcttttatatcaaggaacaatgttccagaagctgagtcctctgagaacagtgaccttaaagactctatcaacaatgtcaccatcaccgatgttacaggacgttagaacctgcagaaaccaaaatgtatgtgtaattcgcaaaactctttaagcattacaagagattatatcatctatctatatagatagtaatgtctcatacatctagtaatgtaaaagaaattatgtttatataacaaatcaagaaactcttatgcttttgctaatccttgtagatgcaagaaccagcttcttttctgaacatttccacttgacttgacttttcactatatcaatatttgacttttcttttgagaatttaattctcaccacaccatcagctaccaatgtttaatgctacattcaattctgagatcttgctacttagttcttgttgagtttggtctttttaggaaaggatattacaaagcaaaagctatatctaaaattgagtagtttttcgtcttgagaggctgggactaaaagatatg

SEQ ID NO: 5706 - DNA, 3000 bp, Unknown
  misc_feature (1)..( 3000): cDNA_ID_1989628_gDNA_ID_1620812_Annot_ID_57885 3000 nt of promoter + ATG
ctcaaattagttttctctcccggatatataatgctcatcaatgttttcggtggagggtcatgtcaccagtaatctccgcacgaacaggcaccgtttttgaaatggtgaaaccgttgcatgtctcgtactacaatttcccgtccggtcacaagggaaatgtactttgtagcattgtgacagtcagcacaaacccgcaggttctttcttacgtgaatagttgtacctgcagttgtattcagcaatccaaaagatatagccagcttctcactgtgggtactcagcagttgctccttaacatcattttccacaccgaggactaaattcgtgtcaggaacataaccagcttctttgatgtggcatatcagcttctcaagaaacgcataaatcttcttggaatcgggatgggctgtgcttccagagaagaagctatgcacctcgttctttatctccaccatactgcagccaggagttttgcgcagaccctgtctcaacattgaaactctcacttgtcccactttttcccacattgaagctgcacgatatatgtttgcaagaagcacatgatacccaccatcatccgggttcaactcaaacaatctctctgctgctttctcagcgaaattcacatttttatgaatctggcaagcacctaacatggcaccatatacatttacagccggcttaacgggcatctgcataataaagtcccatgcttcattcaaccgtccagctcgacctaaaagatcgaccatggctccatagtggtccattgacagttctatgctgtagttttccttcatcatatagaagcacttgagtcctgcctccaccaaacccgagtggctgcaagcagagatgacagaaagaaatgtgacaccatttggtttgatggtgcctttttgcatttcttcaaacaactccagagcagctttcccaaatccatgtgtcccgtatccatcaatcatagcattccatgttgtcacatgacgctcactcatcatgtcaaaaatcaatcttgcaatcataatagcaccacatttcgcatacatgtcgactagagccgttgtgacaaacacgttcttatccagacaacttcgcataaccaccccatgaatccacttcgcatgatgtgtaattgacagctctgcgatagcagttatcacactcacataagtaaatgtgtctggtttcactgtccgagaccgcatctggctgaagtaattcaaagcatcgatgggacgtccattctgtgcaaatcctaatatcattgcattccaagagacaagggttctgctctgcaatttcccaaacatagaagcagcagtatcaacttccttgcacttgcaatacatggagatcaaagagttcactacagaaacatttctatcaagacccaattcaacagataacttatgaatgaatcttcctctctcaaggtcacccaggtcagcacaagcatgcaaagcacccatgacagatacatcagtgggtttgactccttcgtccaacatcttttgaaaaattaacattgcctctttaggattctcattctgcacataggcatcaatcattgaattccatgaaacaacattcctttctaacatcccatcaaagagctgccgagcagtttccagagatccacatttcgcatacatatcaaccaaagcagtggagatattgacaagagaatcaaatcccgaccgcatagcatacccatgaatctccttgccaacactaatcaacctcaaagcagagacagcaggcaaaacagaaacaatagtgataaaactaggcttcagattctcctcacacattgacttaaccatttccaaagccattctcgccatcccattctgtgaatacccagccacaattgtattccaagaaaccaaatctctctcaggcattctatcaaacaccttgcgggcctcatttacctgcctacacttggcatacatattctcaagcccagtcatggcaaacaaatccaacgagaacccactcttcaccaacaacccatgaatttcctttccaaccctaagctctgcttcgtctccacaaactttgaggagataagtgaagttatacacaacaggctctacatcatcatacctcatccgaacaaaaaattgcaaagctttatccaagtctgaaactttagcaaaccctttaagcatggtgtgataaagaacattgagtttactatcaatgggttcgaaaacacgagcagcctcgtcgacactgccatagcgacagaacaagctgacaagctttgtctggaaaaaatgctcctgataaagcccatttttgaagacgagaggaagaatttgacgaagttctttcagagaagaacatctctcaagaagaagagccgctggatgctcatagacattagccggaatgtaatttctctcggagagaaagtgacgatggcgagacgggggattagggatttgaggaacggtagagaactgcaccaattgtgagctcatgcttttgttctgcaaaaatcaatcctttagacaattccttcttcgaagtatatactttatccacaatgtctggacttgattgaattgacagtgacgtgagcttattccggagaagaaggtgaagtgagtcactcttctcaggtgaattaagaccaagtcgtaatagacgggccaactttggtcaatcaaaccgtagaaagaccgccattaatagaaaaatgatgaatcttttagcttgcatcatcatcttagaggtaacagtgccacttgactttgacatttctaacaatatttggacttttctcttgagaatttaatcatcaccacaacattacagaatcacttaacgtaactcaagaccctaccattgttaattgttacattcaatgctgagatctttgctattaatagatcggttgtgtttgtgttgtttcaggacatattaagaacacaaaagctagctacaccaaattgggactgttcttgagaagctggtactgaagctatg

SEQ ID NO: 5707 - DNA, 3000 bp, Unknown
  misc_feature (1)..( 3000): cDNA_ID_3078130_gDNA_ID_1620812_Annot_ID_57888 3000 nt of promoter + ATG
gactgacgttaaattctaactacacgcatttaaacgaatataatactttttgtttataaatactagtgaatataatgctttagcttggtggtaacggatgaggtcaacaacccatagggtcctgggttcgaaaagcctacagatccctttttcatcttttttgctctgcaaatagaaaccctagccgccggtcaacagagtaacatagcttggattcatgcatcatagactagattccggctataaggtccagcaaagatctttaaaaatctttgatttgttaatttaaaattgctcaaaattttaaaaaatcttcccatcaattaaggttttacattacaaagagaaagagagaagacgaaaaagacggaagaaaaatttcagatccaatactgaaaatttaaggtcagatccaatactgaaaaatttcgtgttgttctttgtcagaggaagaagacggaagaaaaaaaaaacgaattttttttttaatggagtttcaatcccgggttcgactgttgataatacacagctttcaccaccagactacaacacaatatgccttaatgcatataaataaattgtatatatcagtttaaatacgtagaactgaaaatttaacgctagttaacgattttgtaacggccgttaacggacggtaagttacggagtcgaatctactaatattttaaatgttttgtatttttaaactaatctaaaagtattgggtattaaacatccaaattaaaattagttgatgttgtttttgggattttccccattttgcataaatttttgttgaaatttaccttgatctttttttttctttgagaaaacccagggaccatcttttcgttttacaaatttagtttatcatttatcattcgtacaaaatatcctgtattttctttatataaaaaagatcttgtctttatcatccttcactacgacgtttattaattaaaaatccacccaaaaatgtcatattcgtccctttgtccttggattttatattcactgctctagcaattactatacttcattttacacagatttttcaggaagtttgacaattatgttgttttggaatttcgcagtgagtttgaaattatgaaagttccatttggttgtgaattatcaaaagggggaagtgtacaggggtaatttaggaagtttgggttatgataaatgataatcatatgcaaatcttagttcagaagtgccgcgaatctgggaaaagaataagcacagctttttaaaattacctttaacccctttattttaaaacaatttctttattcgcctttacctttttttatcaaccaaattttgcctctttctctttactctgcctattaagcaaaaagccaaagattagatggaaaccaattaacatcaagtaagactgaagaaagaaaaagagtattttaaaattgcgtacatatgaatctgtcctataaattttgaacctatcctaataccacggacttatatatgtgaacgttaacaacactttcaaactcaaaaagaagatatatggataagcattccacgtaaccgtacattgttatgttcttttctagataaacaaaatctttgcgtggtcgaaattgaaaaataaatctttatatctgtaaagaaaatttcgatgtcactttataagaaaaaccaatgctgcatcccatgaaacaaattaattccaagaacattatccaaaacgaatttaatgttatccaaatagatcaagaaaattagttggaccgtcgaatgaaatgcgatccttgctgattagcacatgacgtgttcatttatttttgccaccattccaccgacctcaactcttcttttggtaaaattttatgtttatgatatcttgtgatacacaatttattactatttggtacattttgaagtatttgtttttgcatgatatatgacgttaatttgaactgatattagtcaatttatgggtacaaaagttgaaagtttagagcactatgttggatttattaaaaatgatatcatacaatggttcaatatatatatatttttttccacgtttttaataacatttttgtaaacaagtcttctactattgtctttattgttaatgagtttctagtacctaattaggaattttgaggatatacgatacattaatgagttacattatcccgaaaacaaaatcttgaaaacgaacaaagataatttggacattactcgttatgtatacgtatggaattggatagagccgttgaaccatcaagtgggtcttcaagtcaacgaactgaatttgattttacactcatgtacatcggccacaattttattcacacactactaacacctctggtgtccacttttttctttctctagattgatgtgttaagatttttgttgcaattcatttattcaggtatttttatatatatatatatataaattagaataaactaatttaaagaaagatatagcaattatgtttcacattttaacattctcaatcatttataaaactaatgtggtgatgaatggtatatatatatatatatatatatatatatatatatattttgttgtgaactaatggtaaatatttaaaataagacatacgtacataaatccacggactcttaaagtcatgatgcggttaataaatgttcacataacggtaaccaagtggctcaaaatcatgaaacaacgtcacataatttatcttataatgtggataattagtaccgcattatttgtaagaaaattaaattaattatagattcacagctaagaaaatacgaaaagacagctcaacacttttccacttctattccccactgtctatataactctgataaataatctctgatctctccatctaatatctctttctcaatttcggttccactttcctttcgtttgcaaaaacccatcccatcaaaaataaacaagagggcctaaagaagaatcctaaagactttacgggtcttgtttaggataaaagaaatg

SEQ ID NO: 5708 - DNA, 3000 bp, Unknown
  misc_feature (1)..( 3000): cDNA_ID_2174315_gDNA_ID_1620812_Annot_ID_57892 3000 nt of promoter + ATG
caagtaatgaagcaaaaagagatttgaaccataatacatctaatcagtttaagaaggagcctttttgattattaaaaaataaaaagattgttttcatcaaatatctaaatagaaaatgatataatttactaaaaatatgttttacataaagatggatgtcatttaaaaataataggcttgggaggagtctaaaacggttgttttcacttggctatccctagggcccgttacgtatggtccgattgtttcgtctaatttgcaacatgaaattggtgcacattatttcttcatatggagtttgtaacaaagcaaaacataatattcacgttaacaaaaaaaaaaaagattaaccacgattttagtataaaactttagaccaaaaaatataacatttattattggtcttatctggcaaaaggatcttatgtcttttattttgtgatcaaaatcaatcaattcttcttcttgatcattcttatctcagctttggttgctccaatgttaggaataatgtgaaaacatattgttgaatgacgacgaagacaataaacatctcctacttgtatgtgaattttgagttttgggcattgagctggtcttatttcgtattgtttgaatcttgcatatgaacaacgcgtaacaaattggaagagctaatggtcgaggtccttgtgaattgtgagtatagtggagatgtacgtaaaatctgagaaggatatgcagaaaatgaagaagggagcctcatgctcttattttcgataattcgatttataatcactgtaaaaaataaaaataaaaatgtataacgagaaatctggagccaataatcacgtgttagatgtgacacacacgagacatattttgttataaccctggactggacagtgaacggtgcttactgcttgcttagcaacgactcttcggtcgataatgacaccatctttacgtgcgatcgtattattggtcgtttaactatcgacggggaaaattaacaaaacgaattaattatggacgcgtccaactattggattttcttggattctcatccaaaagagctttcactcttttaggccgtgaaatctaacggtcgaacgtcagacaaactttgcgactcactctcaccatcaaagtcacatcacagggcagttggatcgctgttcttgttctgtatttcgaagaagtttcgtttgccacttctttttatgtcggtaatatattaactaaaattggaatttcgtattgctcttcttgtgctagatgagatgtgaatcaaatgaagcatggggatattattattattgtgagaacgtcaaaaataccttttgaaatttcttaccttctaatttgttaaagacggaatgtcattgtctgtaattttctttttataagtatataataatttagtacatcgatctttcaaatggtaatatttctaatttatatattcaatccaaatgaaaataaacaatcaaatcaaacaaacaaagtttacgtttatataacactgttaactatatatgtgtttgctctttcgagtcaagcaaccattataacatatccctttttaagaaatcatcaatgagatattaaagaaaaacctaagagcttttttagatatatcaaaagggtaagatccgaaaatgtaaggataatatctgtggtttgagcagtagtagtattttcatcattgctgtaagcgaaattagtagtggtcgacaaagaaaaagattaaatagtaaagagtggatggccacttgggacgagtcggagtcaaatatacgacgacagttggagaaacttgacatctaccttggcccgttcttacttcttaactcttaaaaataccttagtgggtttctgccgtcagggataatttttattatgaaatccttcattttaatccggtgacataaataagatactagatcatttgaaagataaataatgtatcataataataaaaatagtgtttttgcgtttttggcgatactcatactatggattaatttgttttgtggtaggatattatttaatatgagtaaaatacttaacaatttaattattttaagaaaagaatttaatgtcattttcttgtaacatcttatcaactagagattatacactataaacttttgtatcaagccgtttttaaaattatgtgagattttactttttctaaaaacaattcaatgatatgatttctcttgtttttacttgattgtccttatataaaccaaccaaaaaaatactatactttaatacttgttaagtaatattaaatatccatcttagatattttacaactctttttaggtaaagatattttacaaccttttcttttctttgttttgcaaaaggtttttaacaacgctttacatccaatgcagtttgtaatctataaaagaacatataaacttatactccgtaaagtaattagttatgaattcgctcaaaacattattctcgtttgtctaaaattaacataaaacccaatataccggtaaaagtaaacatacatgcaaggctaaaagacgtgggcataacgtgtgattgggaaaccatcggaaacaaaaataaggaattataacgaatggccatactaggttgactaataagagaattattatttgacgtatataagataataagacaattatgggataaaattaagagacataagtgtggacacgtgaagcttagagtacgtgtcaatattcaataagacataaacaacaacaaaaaaaagggtttattctctactcttgttttgtttatacaagaggatgcatctactgccccaaaacaatcctgaccgttcatgtctctattcttagatccaacggtatgtatcagctatctcattgtcccctctcatagctttctatataaaccgaaagaaagaataatagagtcagagctaagacttaagagcgtcacaacaatatcacactcagataaatatcaagagatagagagagtaacagtgatatagtcgagaaa

SEQ ID NO: 5709 - DNA, 3000 bp, Unknown
  misc_feature (1)..( 3000): cDNA_ID_1989621_gDNA_ID_1620812_Annot_ID_57895 3000 nt of promoter + ATG
cttgttcattatttcgggatttcttcaatttcttacatggcttctatgatgagatcacctgttaaccatctaaatatcaatgaaaaacttgcaaactacctaaaaattattctaacactttcacgtttcataagtattagtcttaacgttttatcccatttgccgttttggggtttctcaactttttacattagctcaaccggttagtgcaaaatgttgttggatctaaactagtaaatattcagatacatccaaccaaacaaaaaaagatcttctaaagaaaaaaatattttaatagagaagtgaatctaaactggaaaaagatctaaaaacgaaagatctataaacaaaagaaagaaaaaaaaaacgtaaacacgaattcggatggagccagacagtgtgtattagcaagtcgcattggttgcagaaatcaagaataagaacaaaaaaaaatggtttttaacttattgggtttcggagttgcgtaaggagtcaaccactatatagagacactcctgtctcaatgaagtaatggttaaaaataatggaagaacgcaaaacatggaattgtttttttttttttaataagacttctttctttaaaaaataaataaaattgtctcgtattaggtcgaagaatccaaaatttcaaagcatgattatttgatttatttagtttttgtcaaccttctaaagtatttgacataggagtaggacacgagtcactactaacttttctaaagattttttgctttttattactttatgattttattttatttttcttatctgattatgttacccgattcaactaaaatatctgttattaggtttcgtttcgttttggtttcaatggatcaacagtttatggaaattattcgtggctataaaaaactaatatcagttttgtcttcctttcatgcaaagcaaacaaaaactcttcctctcttctcctctgtttctctttctcttgagctggctcttgtcttgtctactttcattacagtgactctgcatgcttcaggtctcgtctaattcttgaattctcttcttttctgttccgtaatttactttctagggtctctagatttgtgtctcctctaacaaaagatcctatctttcgacaaatttaatttcatcattgacctttgtcgattccattctctctctatctctctgtttcttcgaaaacctagaggttttgaatttaatgattcctttttatgtcaataaatttgcaatcaatgggagctttttaaaatcatcgttatatctataaacaaaaaaacagtaattactcttcttagatctaaaacaattaataaatctttcccttttttctcatcataattttttcgtatttaactcttgtaaaaatttgcttagccgtttcgctttctcaggccccaggtgattcgtgtcttctaggtcagcttgtgaaacctgagagaagccatcttttgtttgcggttacaaactttgccgcttcaatatttcattgctgttttctgggaaaacctttttctagttttttcggcttattatgccttttaactttttgtgcatttaacatttattgttagtgctttgcttagtgtaaagtagtagttctctttgtaatattaccataaggttcagaagtaaatttttctaaaattgttttcttgtgggaaattcagactgatttcagcaacatgcatgggcttaaaatcagcttctaagactgagatttagtgaccagtgtggtggtgtcttgttctctgttcttgggagaacacaaaggcagtgtggagtctggtgagttttctgattcttgaaaagatttataaattttcttgcaaaattagtctttatgttgaattgtgttgcaggtaaaatatgatacatggtttgccatctatgaagtctatcaaatcattgaagtcacttgttaaaagaaaaaccaatgctcaagaagtggtataagcgtttttcctactatatagaattttcgattatgttctcatttatcctgccttcttcggtgactaaagctttggaacatggtacaattgcagagtaaatccgggtggaaaatgaagccctttttggctctcatgtgtacagctcttttgatcttttggtataagaccacaaatattcagtttgaacaaacagaggtactgttggaaccaatcctattaagtgagatgtggggattcgattattagagaagtaaacttctttcttactttgttcagatagaagaaacagattatccttttgacatggctaaggtaacgttttgatactaggagagtcatcatttgttgcgtgttaccggtttaatgtaaagttcacttgtggatggtgttcaggaatctgaagcagttaacgataaattaaaaggcttgcctcgtggaatcatacagtctagatcagatcttgaattaaagcctctctggtctagaggtagtctgaggtcaaaggttagaggcatcaagaatcgcggaatatattctttgaatatctatgtagcttgaggagtttctgatgtttgttgtgattatttaacacagggtgtggaaatgactaaccgtaacttgttggcaatacccgtaggacttaagcaaaagggtaacgtcgacgctcttgtaaagaaggtattgctatttttgctcgagttgatactaatcctaggcattgaagaagaacagaggattcctcttaacgtaaagctcttgtgtctcagtttcttcccgcgaatttcacgattgttcttttccattatgatggaaatatggataaatggtgggatctggagtggagttcaaaatccatacatatagttgcacaaaaccagactaaatggtagttatcttcctcattctctattccctattgttctgcttcaacttgggatatcgaattgtattggatgataactagtttttggtagagtttaagcatgcatatgcatctttaaagaaggtgacatagaaacaatgttttgtttagatg

SEQ ID NO: 5710 - DNA, 3000 bp, Unknown
  misc_feature (1)..( 3000): cDNA_ID_2993923_gDNA_ID_1620812_Annot_ID_57893 3000 nt of promoter + ATG
tgaatagatattttctcctctgcgtaaagccaaagatattagttaatgggaacactataattcaatctactttataatgctctttctttcctaaaataggaaaacaaataaacaaaggtacattatcaatcacgatggtagtggtaacataacaacattaacattcacattaaccaaaaaaagaagaagataagatcttctctggtctaaatttggaaagagtctgcactctcagaatcaatctctcttgttgaatctcatcttagcttcagtttctccactgtaaggagcaacgtgaaaagcgtactgttgaatgatggagaagacgatcatctcaagacatacaagcacattttgcagagcttcttcaagctgatccacctccaaccagaaatgatgcgacttaattaatcccaatcccaccaatatcttcaggactattccctgtgcaacacataattcccaaggtttaagaatggaacaaggcgaaaaattagacatgaatgctttaaacttgacccaatgtagcagtgatcctaaaatctattgagatgagacttttttgtgtctcaagtaccaaccaacaagctctaaacggttttcgttcgctacacaatcgaaagacttagattaaggagaaaaatctcaacgctcagaccatatgcacattacaaaaatcctagacaaaagagttcccctttaaaccttcagctctcaactaaatagcctacggtctgttgttgagctggcaaagctacaattccttgttaaagtagtcctgcaaaccttaatggtctaattcgtggcggtgaaatattataaggcgggaacccctaaaacatcttatgacattctagagactatatgtatctttccattgtctaaacagcagattgaagaaaaatttgaatgtttcctcatcaaactcagttagttgattgaagaaactagtaggcagagaacttgtgattttggcatttggcaggcaaagaaaaagttggaaattaagtatttacctgccaaaagcagaagaacactatccctttgacgcacatgaactttgtaagaggcttatgaggctccaactctttagcaaaaacatggtagaatttcaccaaagaatacaacgccagggaaaccgaaacattgagaatagcagtgaagatccagctcaaccaaactggataaatcccaaggatctgtaatgttatcatcaagatggaacacactgggcggataatacaaaactgccatgtccattgcttgagctgtttcagtgtgaggtaatccagatgtgtggtacggggcacgaaaagagtcattggaaacgaatggtggatttctcgccctttgaattcatctgggataatccgtgcactcatcgatatgtttacataactatacatcaaagccaagaatttagcaatgacctgaaacaaacagaggcaaatacaacaaatcaagaaatatccacacagagagagagagttaatgtagggaaaatgagacatgacagaatctagaaggaacctacaagtgcctcatagcattccttaacggcgtctagaaacatgaagaaaggtttgcttcctttagcatctaacaagcccacaaaagagttgatagcgtaaacaggagccataagcacaataataagaatggctctctgttcattaggtttcttccagtaaaacagatgctgggatacaagctgcatagtgaagtgcatcgagagcaaaacacagaacacggatcccatcaccgtgatctccgcaggagataaagtagataagtcaatcattctgcataaaatgaaacaagttaagtacacactgatcatcacgattcccaaaaaactaacaatggttgtgaattccaatcagatgtagcagctagcacaattatgaagtgtttctagactgaatagaactaaaacatcatgattcctgagatatagatactaattcagaaattcccagtacttaaatagtaacctcactactttgacatactttctttgtctaagtcacagatcttatactctagaaaccccagaatcaaatcattgacgaacgagctaaaagattccaaatttaactaagacacagcaaaatggggctaaaaggagtaactatacgccgaaaacccattactttcaagctcttcaggatcatcaaaatcgaaactttttgtgatactgaacttaagagatgaacaagaagaagaagtagagagaatcagaaggcaaaccttgattgaaacaagagggagattatcgaagaagacgattcaggtagagaacttcaccgagttgtttgttattgtacgattcatcaatggtatagatttgtttgattaaaagaattgtttttttgaccagaatctgttcatcattgaccggttcaaaatcagccgagtcctctttgcgaccaagaaatatacccaagtcctccgtcgttatttgccggccggtttggttttccgtttaaaagttcgaaccgaattgaaatttggttattcattaaaacaaaattggttaggacttaaattgcggtttggtttgatttattttgtgaaacaagcaagaacaaagaaaataacaagttaagaagatgcaaatgtttgacaagattaggcgttaattaaattattgtaagatatgccacacatgacacatggatgatgctgttacatactataagagtataaggaatgtgctttaactaataaattgacgactctttcatcttatgtttatactcgtgttctttttgtcaacttttatgaggaacgtatgagactcgcaatgtcttgcttgcacacaaactcaacatcatatatgttgcttccggttaacctaacttgtaagtccattcttgtctctctatttataatctctctgtgtgttttcttttcaaattcgatgaggttgttatagacaagagaagacatttttatacaaaagagtttatcattatataagtttcaaactttgaagat

SEQ ID NO: 5711 - DNA, 3000 bp, Unknown; identical to SEQ ID NO: 5710
  misc_feature (1)..( 3000): cDNA_ID_3078151_gDNA_ID_1620812_Annot_ID_169107 3000 nt of promoter + ATG

SEQ ID NO: 5712 - DNA, 3000 bp, Unknown
  misc_feature (1)..( 3000): cDNA_ID_3078155_gDNA_ID_1620812_Annot_ID_169106 3000 nt of promoter + ATG
ctacatatatcgaaacacaaaaggttcgagtctaattatgtttcataagaaatctcacatcggaaataagatgtgatataaggtaatatatatggtacattagtcaacccactaatcatggtaaactactattaattgactttgaattggaagttagtgaaacttaatcctatccaactccaaataaattaaaagtttaaaacctattattttattttcagtatctttgtaagatttttggaccagaaaaagtatcaaaatttgtagctagcttcaaacgagcgtcaagccaatcttaaaccaagtaatttaaaacttacttgtgtggacaagcgataagatcgttgcattctgtccacgaagatagatcgtcgtgccataatccctaatatatgataaccattataaagattcttaaaattatagtaaaatatgaataaattagtgtctattacattggtgatgttcttctcaagatcctcttggagaagatccaagttcttgtcgtagttttcttttagagccgtgagaatgatctctctatcccatacctacatattttgtttccttcgttaattttttttttgttttcatgatgaaatttaaagttgaaagagacaaaagaagaagcttacatgatgtagattggatttgtgtttgtaccaacgtaaatctatcgtgtttcctccttcatcacttgtgaatcccacatgcatcggctttttaaggaaaaaaaaaaaaaccatgttaattaaatatttaacatggaaatagagctatatgtgtggaggtgtgaaatgaatcgatgatgagtaataaacctgatgaatatctcccatgaaatgagacaagaacaaaagggcttcggtcatgttatctatgtgattgaacaaggatatattataattttaaaaacttaagttatgcatcaaaatacaaaatacgcagttacactttggatatcatcattatatgaaataaatgaaaatgatgacatacatctacgatcagatgttccttcaccgtaatgctgaagctgagacgtgaaattctggattgctccatccacacacatatccttcaatccatgttgatcatgacaatcccctgtttttaatccggtttggtatttgtaattgattttttggttaactccggttcaagataattagaaaacggattaaggttatctgaaaatgtctcggttgtgacttactagagtattcgtaagagcaggcttggtcgggagtgtcgatgtaatggagatggctggtccaacgatacttgtaccaatgtcggatctggtcaggccacacacacaatgctgataaatctcctttcacgtaatccggtaacagattctctactacatgtgctggtccggcttctaaaagattctggtcacaccacaaaaacacacacatacgaacttttgttatgaatcttataacggtcaaatgactcagatctctaccaaaaaaacttggaatttgatatgccattagacatgtttgtattcatgatcatctacatgagatgttaggcatggtaacgtatagcaatttaaaagtcaatcctaattaaaaatttgtaggtatatctcactaatacatatataagacaagaataaccaaaatagttgcttcaaacaatagatcattaacttaattacctgagcaattctacaagtaagaatatgaccttctttgctccagcttcggacagaagaaaccgaacacaaaatcagtatacctaatacaagaatcaacctcgtggatgatctaaaagccgatgccatatcttcaaagtttgaaacttatataatgataaactcttttgtataaaaatgtcttctcttgtctataacaacctcatcgaatttgaaaagaaaacacacagagagattataaatagagagacaagaatggacttacaagttaggttaaccggaagcaacatatatgatgttgagtttgtgtgcaagcaagacattgcgagtctcatacgttcctcataaaagttgacaaaaagaacacgagtataaacataagatgaaagagtcgtcaatttattagttaaagcacattccttatactcttatagtatgtaacagcatcatccatgtgtcatgtgtggcatatcttacaataatttaattaacgcctaatcttgtcaaacatttgcatcttcttaacttgttattttctttgttcttgcttgtttcacaaaataaatcaaaccaaaccgcaatttaagtcctaaccaattttgttttaatgaataaccaaatttcaattcggttcgaacttttaaacggaaaaccaaaccggccggcaaataacgacggaggacttgggtatatttcttggtcgcaaagaggactcggctgattttgaaccggtcaatgatgaacagattctggtcaaaaaaacaattcttttaatcaaacaaatctataccattgatgaatcgtacaataacaaacaactcggtgaagttctctacctgaatcgtcttcttcgataatctccctcttgtttcaatcaaggtttgccttctgattctctctacttcttcttcttgttcatctcttaagttcagtatcacaaaaagtttcgattttgatgatcctgaagagcttgaaagtaatgggttttcggcgtatagttactccttttagccccattttgctgtgtcttagttaaatttggaatcttttagctcgttcgtcaatgatttgattctggggtttctagagtataagatctgtgacttagacaaagaaagtatgtcaaagtagtgaggttactatttaagtactgggaatttctgaattagtatctatatctcaggaatcatgatgttttagttctattcagtctagaaacacttcataattgtgctagctgctacatctgattggaattcacaaccattgttagttttttgggaatcgtgatgatcagtgtgtacttaacttgtttcattttatgcagaatg

SEQ ID NO: 5713 - DNA, 3000 bp, Unknown; identical to SEQ ID NO: 5708
  misc_feature (1)..( 3000): cDNA_ID_2174315_gDNA_ID_1620812_Annot_ID_169105 3000 nt of promoter + ATG

SEQ ID NO: 5714 - DNA, 3000 bp, Unknown
  misc_feature (1)..( 3000): cDNA_ID_1989625_gDNA_ID_1620812_Annot_ID_169101 3000 nt of promoter + ATG
ttcgtttcgtttagttagcgggcttgatagattgacgtatgcatgtgggtgttccatttagtaataaatatataaattgtatgatacaaatgaggacatcaatttttaagacgtttttgttagggttacaagtctcatggtgacttcgtggtcccgtaatttatcacttacattattgacaaatgacaaccacaagttacttgattttggactttatcacgtagtgataaaatgaaataaaagatcttcgactctttcttttctggctcgaaaatatcttctacctaagagttaagataaatcaaaggcgtcttctaggcaataatcaatggatcaaacaattccaaaatgtttatttccttaagacgtggcgaaggtcgagtttcaattctcaacgaacatacatttgaccattatttaaggtaaatgtcgggtctaaagatctctcgtgtccctgtgctactagctgctctgatttatatcaatatatcaaaacgaaggatctctttagttattgtttaacatttgcagatgagttacaaaaaaaatatcaaaacgtgtaaactgtaacataaaatgtaagtagtaacgaactataccctccttgaaactatacaaagatttgttatagactgcaacttatgtgttacctacatatattatatataccatattcggtaagatttctatttaggaaatgtattgaactaaataattagattgaattctttttttagagaaagtcatacatatttgcatttgtattctatttagtgaaatattcatcctctgcaaatttgtaagccgtgccatgaggcccatgacggttgaaccggccttctatacgaaatcagatcatgttcgagcatatcttttttactgccaacttgaaccgcttctttaaatcgccaaaaccaacccctttgccgatttgtagccaccaaagcggttagtattcaaccgcagtaattgcttgttaccaatttaaccaaatttataggaagagttagtgatcaaagaacttggtgaacggtaaagtaagtgtaacattacagatttgattaacaaatgtgattgttacaacaaaactcaacattatccaattgttaccctccatttcaacagcagaaaaatatcaaaacgctcgagaatccgaatcatcagaagctctaaaagcatgcttttagaggacaacagacatttctactcctatcgcgaagtcttgatccctcttgcttgtttcttcttatcccttttcttcatagttttggtggttgaccgtctcctgctctgtttcatgggtttggttttcctcacaggcacaggctgctttgtggaagctttggccgtggaacctgattctgttgattgagtcttctccttgcgaataggctcttcctcttcacgagatatctcacttgttgtcacagttactttcaactcgcctgtatcatacatcgtcgtggctttcatccacaaagaaacacaacaaatatcagaacaaagccagtcaaagcaaaatcatactaatgcaaaagcaatcaacggagaaaaagacatcaataatgcttgtgttgcaaacttctccattccaatcaaccagctttcacattatggcgacaaactatcaatcattgcgtaatggaaaacaaaaaaaaaaaagattacaaaaagattaccagatgttgaagcatcaggctctgcttcttcatcctctgcatccacttcatcttcagcttccccatcttcattatcctcgccattaccagcaaccattagctcttccaatttcctctgcaaagctcatataccagattcagaacaataagagaaaagataggctcaagtccaagaatcaaaatctacataataaaaatgattgatcatcaacaatctctctgacatctcatccactattaatcactcatacatcacagacactatcgaaggacatgtaaaatttcgattaacaattgcggtcaaaacaaaagaagcactcaaatttctatagaaacaaatcagaacaagctcattgcacaacctcttaccaaaaagacagtgtttttaagctccagacaaatctaaatttagctaaacaaagaatttgagactaatctataacgcatatcagaataagaaggaacagttagatgcttacattcttacgggcctcgattcgtttccgcctaaaagcttcctcctgctgcttctgagcttcctttcttcttttcttcttcctcttgtgaaaaccagtcacaaaatccctaccaacaaaacaacacacaccagaaaactcactaatcatgcgaattcaaagattcccagattgaatcagcagtaaagttagaatttttattgtacttgagatctttctcgtcaaaagagacggtgaggcttttgttcttgcgagctctcttcccaatgtgcctagcactagtcggcgtagccagtgaacccgcctcctcattatgcaagcctcccgtcatcaccagatacttcctccgatcggaaacgaagcggttcaggtcaaaaattaggttttgcgaggtttaatcaaaacaagcctatgaagaagaagaagcaggaagcagaaaaaatggccttttaattgggctttaggctttaaggcttggcccattataagggtaatattgtctttgactaaatggagctaatttggttaagaaaaagttatgccattgactaaatttggacaattaccaaaagtggcttgtgtctctcgtttctaacaaaacaaaataaaccttcccacaaaactaaaagtttttctttttcactcatcaaaataaaacaaaaaaaaaacttcctagcatcttcttcctcttactcatgcagaggacgacgatggtgatgttcatcatcataatcaattgcttttgaacaaaaacaaaatcaaagaaaaaaacacataaaaccccaaaaaaaaaacttctgtacataattaagccagagaaagaaaataaagacagagtaaaaatg

SEQ ID NO: 5715 - DNA, 3000 bp, Unknown; identical to SEQ ID NO: 5707
  misc_feature (1)..( 3000): cDNA_ID_3078130_gDNA_ID_1620812_Annot_ID_169099 3000 nt of promoter + ATG

SEQ ID NO: 5716 - DNA, 3000 bp, Unknown; identical to SEQ ID NO: 5706
  misc_feature (1)..( 3000): cDNA_ID_3078166_gDNA_ID_1620812_Annot_ID_169094 3000 nt of promoter + ATG

SEQ ID NO: 5717 - DNA, 3000 bp, Unknown; identical to SEQ ID NO: 5704
  misc_feature (1)..( 3000): cDNA_ID_3078178_gDNA_ID_1620812_Annot_ID_169091 3000 nt of promoter + ATG

SEQ ID NO: 5718 - DNA, 3000 bp, Unknown
  misc_feature (1)..( 3000): cDNA_ID_1989620_gDNA_ID_1620812_Annot_ID_57896 3000 nt of promoter + ATG
agaaaaaaaaagaaagaagaagaagaaacgagaagccagtgattgctccatcatctctgccaaatgacgtcgtagaggaaatcttcttacgatttccagtgaaagcactatttcgactcaaaactctctcgaaacaatggagatcgacgatcgagtctcaatccttcgaagagagacacttaaagatcgccgagcgattccatgcacatcatcctagggttatggtgatcactgaaaaagatcccctaaaactattgcctcgacctcgtccagacgcagacattggttttaggttattctgcttggaatcgggttctcttctatcctttattcttctcaatttccctcaaagtttcgccaactatatctacgtttctggatgctgcgatggccttttctgcgtccattcaccgagatcgcaagccatgtatgtagtaaatccggctacacggtggttacgacaacttcctccagctaggtttcagattttgatgcaaaaggccacttatagagattggttagacatgaagtcagtctttcatctagcattcgtgaaggccaatgattataaattagtgtggttgtataattctgacaagtacaatgctgatgccttgagtccaaacgagggagttacaaagtgcgaggtttttgactttagggcaaactcttggagagacttgacttgcactccaagttatcggatatttcatggccaaataccagcatgtgcaaacgggtcagtatattggttgacggagccatataatgataaaatcgaagtagtggcttttgatattcatgccgaatcattccggttgctgcctaagatcaaaccggctattgctggttcagatccgatgcatattgacatgtgcactctggataatggtttgtgcatgtcgaaaagagaaccgaatacgttggtccaagagatttggaggttgaaatcatcagaagactcatgggagaagatttgtactatagatttgctttcatgttcttcttcccggactcagtttcgtgatgaattttactgggacgagcaggatttggttaatccatccacacctgtggcgttatgcaagaacaagacaattttgctctcacatcgctattcccgcggtctgctaaaatatgatcccctaacaaagtctctagcttcattttaccaacgtcctttgtctcggagaaaagtttcttattttcaaagtttaatctctcatatctaaacaaatctacctactgattttgacgtgtttggaagagacgagaagagcttttcttaaaatatatacagtattgggattatacatgaatactagccaaaacaagaagttagtgactactaaataatgaaagcaaaaaacaatctaaaactattttactatatcacataataaaattgtacttttcaatattcataaagtacgtttgagttgatttcagattttatgtcaatcaatctgtggaagtaacaaacatttcttatcgaaataaatgatcttctttttacttcaccaaataaagtcgttgattgggattgacccttattatgcaagaaaacttaaaacaccaaaacatgggaagcacttagatcatgttatgctcttgtccaaaagagagacaaattataacacgggaactagagtaataatttataactataaaaaaacaatttaatacaatacaagcaaatgtcacatatcataaaccaggagatcttcaccaaatataacttttacaaaccttgattccgtgattatctttttgggtttttataatgtgaaaaaaaaatatcttactactatatgattacattttggaagtgagaaaacagttgaccaaaaaagtgtgaacattgtattgaacgtttaaacgcaaatacatgtgtcgtaggaacaaaaacactcaaacacaaatattcaaaacgtgattaacagttgttaaatcaaacttcaatcaacctcttctttcagatcaattaatctacccacaaggccacaaccaaactttgaaattttcattgtctttttttttagaatcaagaagtggtagttaattagtcatttagtatgatctagttgtagtagattgtatccgtgtattattggttatacgaaaaattcaatgtggtataaaattcaatattaattcaggccgttgagttggttatattaaaatggaattagttgacgagtattttatttatttcaatcaagttgtgtgattgacatcttaaaaaaagtgttaaaacgtattgcgattaaccagtaatacttgttatttttctttttcgtcaaactgaacatagtactttttaactttgttttttttttttcctttcctgttactcaatcatgataaaaacaatattttaaaaccgacaataaaaaaacaaaacaatattttaaatttgtaatccgttagttgtgacttgtgagtgctatatttatatttaggttgatttatacgtgtagtagaaaaggaagggtattttcgtcagaaaaagtaacgacgagggtccaatattctgaagttttcaacgatttgtgtgtgtattattctcatcatcaatgacataaataaacaaaataaaataaaacataacaaccggaaatgtgtttttttttttaataaagaattgaaaatgacagaatctgagaaaaaggacgaaaaattcgtcgctttacttttttttatcttcgtctctgttttgttcgtctgctcgtgccactctttcaaaaaatctcttcttttctttctaagttcttctttaaatctctaatctcagcaggaagcaatctcttatgtctcaagtttctattttccgaatctcccagaaatcttcaactctgtcttgtcgtctagtcacattttgaatttttaaaccagctccgacatttttttgtttttaattcttttcgattcataacaaaggctggtgatttggcttcagcttcctagtcgcatgaatctactgaaatcgagtagaaaatg

SEQ ID NO: 5719 - DNA, 3000 bp, Unknown; identical to SEQ ID NO: 5714
  misc_feature (1)..( 3000): cDNA_ID_1989625_gDNA_ID_1620812_Annot_ID_57889 3000 nt of promoter + ATG

SEQ ID NO: 5720 - DNA, 3000 bp, Unknown
  misc_feature (1)..( 3000): cDNA_ID_1989627_gDNA_ID_1620812_Annot_ID_57886 3000 nt of promoter + ATG
ctgctcgtgttttcgaacccattgatagtaaactcaatgttctttatcacaccatgcttaaagggtttgctaaagtttcagacttggataaagctttgcaattttttgttcggatgaggtatgatgatgtagagcctgttgtgtataacttcacttatctcctcaaagtttgtggagacgaagcagagcttagggttggaaaggaaattcatgggttgttggtgaagagtgggttctcgttggatttgtttgccatgactgggcttgagaatatgtatgccaagtgtaggcaggtaaatgaggcccgcaaggtgtttgatagaatgcctgagagagatttggtttcttggaatacaattgtggctgggtattcacagaatgggatggcgagaatggctttggaaatggttaagtcaatgtgtgaggagaatctgaagcctagttttatcactattgtttctgttttgcctgctgtctctgctttgaggttgattagtgttggcaaggagattcatgggtatgctatgcggtcgggatttgattctcttgtcaatatctccactgctttggttgatatgtatgcgaaatgtggatctctggaaactgctcggcagctctttgatgggatgttagaaaggaatgttgtttcatggaattcaatgattgatgcctatgtgcagaatgagaatcctaaagaggcaatgttaatttttcaaaagatgttggacgaaggagtcaaacccactgatgtatctgtcatgggtgctttgcatgcttgtgctgacctgggtgaccttgagagaggaagattcattcataagttatctgttgaattgggtcttgatagaaatgtttctgtagtgaactctttgatctccatgtattgcaagtgcaaggaagttgatactgctgcttctatgtttgggaaattgcagagcagaacccttgtctcttggaatgcaatgatattaggatttgcacagaatggacgtcccatcgatgctttgaattacttcagccagatgcggtctcggacagtgaaaccagacacatttacttatgtgagtgtgataactgctatcgcagagctgtcaattacacatcatgcgaagtggattcatggggtggttatgcgaagttgtctggataagaacgtgtttgtcacaacggctctagtcgacatgtatgcgaaatgtggtgctattatgattgcaagattgatttttgacatgatgagtgagcgtcatgtgacaacatggaatgctatgattgatggatacgggacacatggatttgggaaagctgctctggagttgtttgaagaaatgcaaaaaggcaccatcaaaccaaatggtgtcacatttctttctgtcatctctgcttgcagccactcgggtttggtggaggcaggactcaagtgcttctatatgatgaaggaaaactacagcatagaactgtcaatggaccactatggagccatggtcgatcttttaggtcgagctggacggttgaatgaagcatgggactttattatgcagatgcccgttaagccggctgtaaatgtatatggtgccatgttaggtgcttgccagattcataaaaatgtgaatttcgctgagaaagcagcagagagattgtttgagttgaacccggatgatggtgggtatcatgtgcttcttgcaaacatatatcgtgcagcttcaatgtgggaaaaagtgggacaagtgagagtttcaatgttgagacagggtctgcgcaaaactcctggctgcagtatggtggagataaagaacgaggtgcatagcttcttctctggaagcacagcccatcccgattccaagaagatttatgcgtttcttgagaagctgatatgccacatcaaagaagctggttatgttcctgacacgaatttagtcctcggtgtggaaaatgatgttaaggagcaactgctgagtacccacagtgagaagctggctatatcttttggattgctgaatacaactgcaggtacaactattcacgtaagaaagaacctgcgggtttgtgctgactgtcacaatgctacaaagtacatttcccttgtgaccggacgggaaattgtagtacgagacatgcaacggtttcaccatttcaaaaacggtgcctgttcgtgcggagattactggtgacatgaccctccaccgaaaacattgatgagcattatatatccgggagagaaaactaatttgaggaataacaagacctggtctgaagtagaagcctttgtagagagctacaatttgctgtatcataaacaaggtttaagctgatcactacgaatagagagctacaatatgtgagcgaagtctcgtttgcaagcgtccaagtaaaaatttattcatttttgcagctctgtttttcctttctttcccagtacatatgaaagctgaaaagtgttgttgtggaattggtagcggaaaaaaaattatttcttgctacagagagtacaaaaatagaaaaattcaaatcattaagatatgttatgtagtgtgagacaaaggcttattttggacagggttgatgtaagatggagtttttaaattagaataaagtattacaaattttttatatggtaacacacctaaggacaagattgcatcttcttcatcatttcggtttattataatgcctattcaaagaacgaggtgtcaaatataaaacaatgctatatcttatgtgtgaaacagacagaacctctactacaaccagaagctctgctttctgcgtttggatctttaaaaccctaaagagagagacctaggttaaacacacatcacgacaggggaacaaagcgaatcaaatctgttgtgcagctgtaattgatgacctgcagtggttctgtctgtttcacattatgggtaataacattatacgatacatctagaggagtcattgttttcagtttttcaaaacaaaattttattcatacattcagatctgaaggagaactcttttgaacac

SEQ ID NO: 5721 - DNA, 3000 bp, Unknown
  misc_feature (1)..( 3000): cDNA_ID_3100768_gDNA_ID_1620813_Annot_ID_50610 3000 nt of promoter + ATG
aacatccgccgcgcgagaactggcgggaaaattcagccatcgcctcgaagaaaaaacctcccaaatctgagaaatcggaaaagatgacccacaccgaaaccctaaatctgctcgatgaaatcgagtcttttgtctccgatcagcttcaagtggtaattgccgatttccttctccatttctggattccttaatttaactagttagggttcttcgatttccacttcagtgattctaaaatttgtcgaaactcgtttatttatcatcggaatagagttaattgttgaattctgaagcttctgattgtagtttgttgttgtgttagtcctgagatcggaggtgttatgtaaaatcgagtcatttggttataactactgattcgctcaatccatttggtttcaggtatcttacaaatggctgagtcgaaatttctcgctttcatcaaatacggccaagaggtacattgttccattctctattaggagctcattagagtttagctacaaatggcagatttggttttttgtctaataaccgtgtctcgtttgttattaggttgctcaaggattttgtagagaaacatgggaagggtttggaagttgtatatattgtgtccggattgctaaagaacggaccttccgattaccacgcaaggcttgcttctagtaccgaacttccaggtctcattctcattcagtgacatgttttctctttgttatttttcatgactgtcttctgtataatgattaattttgctagtcttttggtttttcatcttactgattctattttcaccaagtagttgtacaagtaatttgctgcgttgtctgtagttcaagatactatctcagatgttgttttgattatttctctggtacaagtgagaagttaagtgatggcaaaagcgaaagtgatttgactcttccttgtcattacttctatgcagaagtagagaaagagttcaatggaaaatattcagtacatatctacagtgttcaagctagtattccaatggatccagcagccatatggaacactgagtttgtacaagcagaagaactcttcaggcagccttctgccactgataattgtttgaaaggcaacaggtacaacttttctgttattgtatgaaagctgtccagtactgttgaccagccttgcccattctaactagagaggtgtgacttttataccaggttttgtggcgtctccaattcttgtgtgaagcgcaatatagagggagccactgaaaatgttaccgccccgcgaactgaaagtgtgagaactacaggacaatctaaaagtagttcaaattttcaaaagagtacagtgccgtcaaaccagggaaagaatttccagcactcaagctctaatgttggccatcaggctaagagtgaatctattgctgctccagctaaaaatcagtctgcgaaatcctctttggataaagaaaaagcttttcatgtgcccgctaataaaaagaatggacagggcgagaagagcgtgactggaactggtggtttgttgaaaaatatgtggggccgtgtgcctgtgaaaacagaagatgattctccaacagtagatgtgaaaaatcatattactaatcattcgggtatgttttctaatctatccaccttggtactatcaatggcttgggtttacttggtgcctgtttgagctagttttgttcctctatataatgttatgtaattggtgcagaaccccaaaaaccttctcatgatgctgacaagaagggaggcagcgatgatgagactcgagacgccaatttcatgagagcgcctaaagataacagaaaaagaaaggtgatatttgatttttcagatgacgagtatgaagatgtaatcagcttagcatctcctagtagtccaaaggttaattcacgtccagatgtcgaactcagttcggaagattcaggtccagagaagcctgacgcagatgtttctccagagataaaatctgaggaaccagaggccagcaaagaagacaggcaaaacactgcttctgttgatgcttctacgactttgtcaacggagaagatccaggccattggttctgaagctgaagtgaatccctcaaagagaagaactactgcagttcctagttcgccgaaaaggaaaaaggtgttgaagtcacggattgatgatcgtgggagagaaggtatgctaagcatccatatcgttctaaatagtaacaaaaataaacaaacgtatgtcaatgtctcttacttaaacaattctcttttggctggatatagtaactgaggtagtgtgggaggagacagaaacgaacgcaaagaagaaagaggacactaatacaagtaagaagttagatgatggcaaaaccgcaaatgctgttaacaggtatgttttttggagatcattctgtaagcatgtttgttgtgaaacccgaatacaatattatagcatctatctgagtttcttatttcagggcggttgcacagaagaagagtccggccattggaaacacagcagcgacaaacgcaggaggaaaagcgggaagcaagaaaggaggaaacgtcaaagatccaaagcaagggaatataatgtccttcttcaagaaagtttaaaaaggcttcttttttgtatttattgtttgctaagtttgagttgaggatattataggaaaatcagaacttggattcatctgactgtatgttctgatccattgtgtctaagaaaaaaaacttttgagccgtttcttattaaactagtcatgtcataaaaaactgtattatttcaggtttgagtgtatcggtgatcatcgtcgctggcttctagaaccatttttttattctgaaaacatgggccccactctgacaggtaaattcgtaattaataaaaaataaaatacatatccacgtttttggtgttacaaataatttagaaagaaggtggattggttatggaagaatgtgcaaggagagtaatttgagatatacaacttgggcagaagaatcagatg

SEQ ID NO: 5722 - DNA, 3000 bp, Unknown
  misc_feature (1)..( 3000): cDNA_ID_2108291_gDNA_ID_1620813_Annot_ID_50613 3000 nt of promoter + ATG
gcggacatttgactttaagaaagaaaaagcgagatttgcgctgcggcggtgtaaaaatcagtcgtaaaatacacgcgtttgaggagcgcgtgtgaattttgacacttgtcagctgtgtgttagacagatgttgcggcccatgggccattgtcgtatcttattgcggaccacaggttcgtagaagcaacgcattgtataatttttcttcatgtttcataagtctaaaagtaaacaagcctgttaagtctcgctgtcttgtttaacagctaggccgatggatgcatttttctctagaggcttctaaattaaaattggccaccagaaacactatcttatgcaacgtcgagaatattgctaaagatgacaggaacaagacataataatgacaaaaaagaagaatgtattcgagaaaatcacgactcttcgacgacttctttctcaaccaattcttggtactttgttgttgccttttcttcaaacttttttcttacattttcatcactactttctctatttgctacataactttttttacatgttcttcaatttatgatgtcgcaatagaatttggacttcatgtgaaggaaatagaagaaatcacgtgaatggatccctaagcagaagaaattttataagtttctctatctacgggacaattgcaaaggcaaacttaattcacataaatatcatccaataattgctagacaatggtcccagaagttttttcccctcattgatgttggactactagttgtacacaacagagtataatttataacaccactgaatacgtaaggctgtgtttaacaatataaaaaaagaatctaacctcactgagaatacatgaccttcgtggcaggttttacttgacccagttctggagtataaactgttgcatcaaaatcgccacaatgcttcccaagcttatgttgatcacgttgactacatcattgtttagctacacatagcaaaatagtgactaacatgagacagaatacagtcgagatcattgcattcttgtttagttggtaactaattgcaaggaatggattcataagacgaaaacttcaaaattctgtattgaatggaaatcgttttccactcaagccagttatctatcagtctttctgcaagaagtgacggtatattcatttgattatcatcttcttgcattgacaacaagtagacagagtgagatcaataaaacaaaaagaagagagttcattgaagtgagcatacccatttgaatccttctttgtcttgaaaagaagcacctattatgctctctccaagattggcaatctgggaagctagtacacatacagctgcttctggaggagttatctgtgttcaagatatcaaaaggaaaagaagtttaaaaatcgtgtaatgataacagtctttagtagcataaagaagctgtgaagggaaattttggtagcaaataacactattacctgacccaggaagcagccaacagatgcaagaaaaaatgatgctaaaagtccagccaatgttccttcaagactcatagctccctctgttcctcttggtacaatcttaaatgtcgtagctaaatacctgcgaattggcaatggttagtaagatcatttcagttgtcgattggattcatgtcatgacaccacaagtccatgccatacatcagacagaaaacagacacagaccataacagaagaggctatagctggataacagtagcatactcacgttgtttttccataagctttgcctatctcgctcgagacagtgtcagatactttagtgcagaaactggaaacaaaaccaagccggaaaagctgggaaaaagctgctcctcccacttgatatattgaaagaaaagcacagacacaaccagcagcacttgaaccaatcacactgcgtggtcctcttctaccctttctcttttcggccacaccttgtgcttccttttgcgtcattttaaccttcgttgccgctgttccctgtgatattgtaaatcatctaaaccaacttcagcgccagaatcaattgcaaatttactgttactatttccagctctggggtgaaacacgatattgaaatctaaaacttaaagcattgcagagaaaagactaagtatctcaatgttgagcatgatcagaaaaagtagctccttaatctgtaaacgtgatttaggatctctaacacgtccacaattcctaaattaaacaataacacatctaaaatctaaggacattcttcattcatcagctcgaaatcaaaatcaaagcagcgaatttctacgttctaagagtcagttaccgaattacattcaggttgatcacaaatgcacttactatgacgaagtaagcagcgactaagaggaaaccagcagagccataagctctccaagttaaagtaccaagcaaaaacgcggcggcgatcccagaagcggacaatccggtaacaagaagcggtgaaccgagaacaaaaatcaataaattgttagccacagctgatttccaagttggtgacgccgattgaatcagtttcatcgcctccgtcatcactccttccatcgatgcagccgccgccgtagcaccgtcggctctacttcccgacgaaagcattccgttggaaagtggttccagattacgtcgtccaaatctgtaagatctagcgaatggagaggaagaagaaaatcccgagaattttgggaatcttagtggtaaagctgatctagaagaatttaagagtagagttgacgaaatcgttgccatgacttagcttgcttccgaagaagacctttctctcctattgagaaaaaaaaaacagtatttcgggttgaatccggagctccgaaaaaaacccggatccttaacccgtgttgtgtttatttttcggtcgtattcatcagattatttacggtgttgccactactactatttactgagaacccaatcttatccgagaaatcggaaagagcagaagaaatttgcagaagagagaaaaacaaaaatg

SEQ ID NO: 5723 - DNA, 3000 bp, Unknown
  misc_feature (1)..( 3000): cDNA_ID_2992588_gDNA_ID_1620813_Annot_ID_50614 3000 nt of promoter + ATG
gaaaagcgagatcttcttcatcatcaaaaattgcagtttccgcccaagtcaaagacgaagagatgggcttcagattacaacgaatgggctttagtaaacaacaatccatgagtcatgccgagagagtcataattagtccaccatgagtcaggttcgttgattcttaatttccttttctttttttttttttttaataaagattttgatttattttatgtttgttattttaaaagtttttatttttttggatgctaaatttatataatgatacgaaaactaaccggattttagatccagcattagtcgttagcgattccaaatattcaacttgttttcatattattatgtagatttagcattcaagtttttcattcggatttttaaagtactttttaaaatttagattttgtttattcggattttaaaaatcttttttcatgtgtttattttttaaaattatattatttaatggatactaaatttatataatgatatgaaatctaaccggattttggatccagcaatagtcgttagcgattccaaacattcaacttgtttttcctattattatgtagattaaacattcaaggttttacttcgcattttttaaaatagttttaatattatttttttggatgctaaatttacataatgatatgaatactaaccggattttggatccaacattagtcgttagcgattccaaacattcaacttgttttcatattattatgtagatttaacattcaagatttttatttggatttttaaaaatagtttttaaaattttgattttgtttattgtcggattttaaaaatcttttgtgtttgtttgtttgtttttaaatttatttggatgcaaaatttacataatgatatgaatactaaccggattttggatctagcattagtcgttagcgattccaaacattcaaattgtatttcctattattatgtatatttaacattcaaattttggatccagcattaaaaatttcagttttaagtaatgactcgattaaggcatgaatattagattttccttgcatctgtgatctcattgggaaggtttgttaccaattgaagaggaagtttttgttaatggtgactactgttgcttatggcatttgtattcattacatgtcatctttttcatgttgaagaagatattcagtagcaaaaaaaaataacgagaaatatttcaaattagaaagttttgtagcataacagagttgatagaagcgaaaacaagaatctgtaaagcctcctctggttttgggatgaagaaactacagaaacctgagaagaaaaaactctctgcgcttggcgataatggaacagtggtggagcttctatttttgcagctgtattctcttgtccctgataggcagatcaagcggtttctgggcctcgtgaggatggtcagggcctttgtacaccttcaggtgattgaacagagctctcccaagctgccacaaaatggtcagaccaaagttaagagggagttggaaaactagtaatcaatcaataccaatatcgcaacaagtagtttccaagttcaatccataagtttgaagaaacacggatttgctaagtgttaagacttaaaggagactaataaagagctgtggattatgtatctaacccgtccctttggaagcattccacgaacagcatgctcaacgattctttcaggaattctctgctgcaattgatcaaatgtctctactgtcataccaccaggtcgtcctgaatgcctcctgtacagcttttggttacgcttctttccagatacagcaactttctcagcattcacctttaaccaaacaattgaaaacagtattagaggtaccaagttacaagcattgcccaaacatctacatagaggctctacatcttgctgctaatgtgaatcttactaaaaccaaatcccaaggctcctccttcaggaagaaattaactaaagcagcacatcaaatttcttattctctacagatagctcaaagaaactcataccacaatcacaaaagctcccatgtcgacactaggagtgtaagaggcaagattcttcccacggatgtgattagcaattgtcgatgccaatctaccaagaattttgtcagttgcatcaaccacaaaccagggcttgtccgtgttcacatggtctgaagcttttggataccatgtcgtgttccagatgtcctgtaaaccatagaatacactcaataaaggtttcaagccaaagacttttaacttctctccaaccaaacattaataatttcataaaacgtccaagttaacaaattcagaagaataaacatcaattttcgaagccaattgatgcagacaacacagctaatgagtcaaaggcaaaatccactacttaataaatcgcaattgggagaagaaaaaaacaagccatacttcaaattcaaagcaagagctaaagtgcgacactttataaatgcgtagatgctaaacacagagggagatagaaaaattatcgttacagggccattagcttcttcttcgtcgaacatccatcgttgattcgccggaacaagagaagtcgtcgtcgtcggctcagcttcacacttcacttgcaatcctcttttcgaattcgcataaatgccgactcgtaccgacggcttcgagatagccgttaaagagaaccctaaaaacggagactttctctcacttccggaggatttcacggaagaagaagagagtatcaccgtcgaagacgagcaaagaaccgccatttttgtttttctctcttctgcaaatttcttctgctctttccgatttctcggataagattgggttctcagtaaatagtagtagtggcaacaccgtaaataatctgatgaatacgaccgaaaaataaacacaacacgggttaaggatccgggtttttttcggagctccggattcaacccgaaatactgttttttttttctcaataggagagaaaggtcttcttcggaagcaagctaagtc

SEQ ID NO: 5724 - DNA, 3000 bp, Unknown
  misc_feature (1)..( 3000): cDNA_ID_1829164_gDNA_ID_1620813_Annot_ID_50615 3000 nt of promoter + ATG
acattgagatacttagtcttttctctgcaatgctttaagttttagatttcaatatcgtgtttcaccccagagctggaaatagtaacagtaaatttgcaattgattctggcgctgaagttggtttagatgatttacaatatcacagggaacagcggcaacgaaggttaaaatgacgcaaaaggaagcacaaggtgtggccgaaaagagaaagggtagaagaggaccacgcagtgtgattggttcaagtgctgctggttgtgtctgtgcttttctttcaatatatcaagtgggaggagcagctttttcccagcttttccggcttggttttgtttccagtttctgcactaaagtatctgacactgtctcgagcgagataggcaaagcttatggaaaaacaacgtgagtatgctactgttatccagctatagcctcttctgttatggtctgtgtctgttttctgtctgatgtatggcatggacttgtggtgtcatgacatgaatccaatcgacaactgaaatgatcttactaaccattgccaattcgcaggtatttagctacgacatttaagattgtaccaagaggaacagagggagctatgagtcttgaaggaacattggctggacttttagcatcattttttcttgcatctgttggctgcttcctgggtcaggtaatagtgttatttgctaccaaaatttcccttcacagcttctttatgctactaaagactgttatcattacacgatttttaaacttcttttccttttgatatcttgaacacagataactcctccagaagcagctgtatgtgtactagcttcccagattgccaatcttggagagagcataataggtgcttcttttcaagacaaagaaggattcaaatgggtatgctcacttcaatgaactctcttctttttgttttattgatctcactctgtctacttgttgtcaatgcaagaagatgataatcaaatgaatataccgtcacttcttgcagaaagactgatagataactggcttgagtggaaaacgatttccattcaatacagaattttgaagttttcgtcttatgaatccattccttgcaattagttaccaactaaacaagaatgcaatgatctcgactgtattctgtctcatgttagtcactattttgctatgtgtagctaaacaatgatgtagtcaacgtgatcaacataagcttgggaagcattgtggcgattttgatgcaacagtttatactccagaactgggtcaagtaaaacctgccacgaaggtcatgtattctcagtgaggttagattctttttttatattgttaaacacagccttacgtattcagtggtgttataaattatactctgttgtgtacaactagtagtccaacatcaatgaggggaaaaaacttctgggaccattgtctagcaattattggatgatatttatgtgaattaagtttgcctttgcaattgtcccgtagatagagaaacttataaaatttcttctgcttagggatccattcacgtgatttcttctatttccttcacatgaagtccaaattctattgcgacatcataaattgaagaacatgtaaaaaaagttatgtagcaaatagagaaagtagtgatgaaaatgtaagaaaaaagtttgaagaaaaggcaacaacaaagtaccaagaattggttgagaaagaagtcgtcgaagagtcgtgattttctcgaatacattcttcttttttgtcattattatgtcttgttcctgtcatctttagcaatattctcgacgttgcataagatagtgtttctggtggccaattttaatttagaagcctctagagaaaaatgcatccatcggcctagctgttaaacaagacagcgagacttaacaggcttgtttacttttagacttatgaaacatgaagaaaaattatacaatgcgttgcttctacgaacctgtggtccgcaataagatacgacaatggcccatgggccgcaacatctgtctaacacacagctgacaagtgtcaaaattcacacgcgctcctcaaacgcgtgtattttacgactgatttttacaccgccgcagcgcaaatctcgctttttctttcttaaagtcaaatgtccgccacggcgcgcctgaagaagactcttgcttgccctttttcttactttttttcaatgttttttcacttttttggttaaattctctaacatgggtttactactgtctcgataatagtagtaagtttgtaactttcttatttctggaactgatctagttctaaaatatgcttaattctttattaagttctaaaagaactactttaaaaattaataacctattattaattacgacaacatctaactaagccattaaatacaatattcatcgttttgcgtgagtccttcatacatgtgacgaatgtcccttccccacaaaggcacaaacctaacctaataaacaataccaaaaatggaataatttgatttttttttgaaatactatatgctagcgtagaatcaaacaaaatatgtaaaacgatatccttaaaacaaaatgtatactaaacaaatattagtttgccaaagtttgacgaaataataaaaacctaaatggttcgccgtgagtaagttcccatcttcttctcgaactttgccaaagtttggtattgaaaaaataataatattaagacacagagagagagagggagaagaggatctctgtgtgtcgtccaaatttcaaagtgatgatgttgtagctgtgtggtagcgattggcttacacgcgtcatactttaattagataattttatttccttattacttaccctctcttttctcacaaagagtcatcaccagctctgatcaaataaaagcgttttctcttcttcttgctttcacagttacccaaaagtgtgattaaatctttcttttttttgctttccttctctaatcgttggtgtgtacgctaaacctagatttcgctggattgtttgagta

SEQ ID NO: 5725 - DNA, 3000 bp, Unknown
  misc_feature (1)..( 3000): cDNA_ID_1829156_gDNA_ID_1620813_Annot_ID_50617 3000 nt of promoter + ATG
atgggagttcgagctaaaaaagagtttgagttgacattaaagattgagccatcatgctaatcaaccattgtcatgcagttggtttagccagtccagtagaaagtgactatttaaatgctatatataccaattagtgttatgcttagaaaaaattatttacggcttgtaaaacacagccatatacatagtctgaagataatttggattggatctaagtaatattataaaatgaaagttcaattttatttctatttctgttgcagtaaagttttgaactttcgtgcaaaaactattcttaataatttagagctagctgttcgaaactttatagtttaaacatcccttaaaaactgttaaagcaaactcaaagctctaaaattttcagcaaaatattatagtactctttcttatggtccaaaagcttaatcatctggaaagttttaatgcatagaataatttgattggtagcatgagagaccacgacgaggacctttacgtcagcgtataacttttggttcatgggtatcatctgactcatcatcgcataaatttcactaactaaaccaaataatcgattcctattttgtagctattgctgttatatattaaccttattaatattatcttacatacggttttatatattcgttttatatttaatctgattgcgtcaacgtgttcgagtatacagttgcggacgaaattccattttcagacgactgatgagatttcaaatcgaatcttttacaaaggctgcaacttgtaaagtgcttagaaattttcttccccatggattctatgttgataaatataattaaattagagatgcttctcgtggtagcatgtgtaacttttcgctaaactttatttatctttcttaattaactttttgtatggcttttgttgttgttgtcgacgaccattttttattgctttaagatctaacttgagggttaagaaattaccagtggtttcgccgttgtcagtgcactaattttttgtgttttctttttctgctcttaaaatgttagcactatcctaaagtgtaaattaagaaacagatttacataactagctagtccatagttccatatgttatgactttatagatttaagaaacatcaataagttttgtttttgaagcttttttggggttttaagttgacctgttgatgggcaaattacttaattacttatccagagtattgtgtggtcaaggaagataacgacaggagttaaggaaaaaataatgatttggtttctttcaattcactttttgtccagttttgttatttgtacaacactttcttgtttcgaattaatagaaaaatattcaatgcaataatgagttttattaacttaatcagtttgaatttacctagttgagatatcttgagcctgtttaatattgggtcaacttcttcggcctatattttagttgagctttgtagttgaatttcactaatcactacgcgttggaaaatatgtgattgcaaatgcttagattaaatctaaattctaataagatggccaatggatgtggagattgtaccccacgcgtcaaaaaagataaagattagagaatggtcactatttgtagtttgatctttccatgcacgtagtgttagctttaaattattactctagttcttgcaacttttttgcctccttttcttttggttgataaaaacgaaaagatcatattgcttgccagcttctagagatttttattggatgagattcgtttatagggtaacctaattagtaaaaagatacgaaattaataatcgtaatttatttaatgttaagtaggattcatgaaatcaaaatttatttgattcaagggattcacattgtagaaatttgtttactctagttttaagaatttgataattaaccattcgatacagaatatggataacacaagaacaaagatagtttcgtcacttcttaggttaagaactaaataaaataatatatgtgaagcatactaattacctttttcttaggaaatgcgttcatgtacaatccacaataatttgtccgtattatgtttggtgacttgcttaggttatagcattgtttaatttcgtcccattttgtcaccattcaaaaatataatatgtggacaaaactataagttatgtcttaggttgttcaattaaagagctcgtacaatagcttactaaatttggccaaaggagagacaaaaaccacgtgaattcggatatttcgaggtcaaattcttaggttttgttggccactatatattacgctacgcagtgccaaaattatcaacatacgtggagcataaccggtccggttagatctcaaaacttaccccacttctgataagattctagaccggacaatctataaaggattgcactcgatacggaggatctgatcctactaagggttgttcccattaggcgagacgttaggaccggctttatatccaagtagtccagttagggttggacaggggaccggttaggaccgtctagtatataaattgaaatagacatatgcatctagaatatgacctcaatacggaaaaggaaaaaagatctcaaaatattgaattttatcaatatccagatttctaaaatatttaagacattacatatttttttaatatcaactttgatattcaaagtacaggaagcttaaaattcagtaacatctctaacaaatgaacattaaattgagaaatatcgaggtccaaaacctgtttttacaaggatcaaaccgggccagacttctagaattggtcgtaactgacaatgtgaaccggtccgaattttggagttaggccagtttagtacaataattgtagttgggcctattttgttgggctcgagacttttctcttttagagagaccctctaaacggaaaagagggccagtggtgacttcacgaatatctctcttcagacgtggtttgctccagtccggtgagcgcggcgccgaggaatagagattgattcagcgacaatg

SEQ ID NO: 5726 - DNA, 3000 bp, Unknown
  misc_feature (1)..( 3000): cDNA_ID_3078217_gDNA_ID_1620813_Annot_ID_169155 3000 nt of promoter + ATG
gattcttttgttcgatgatatagaggatgcattttgtaagagagacatgaatgaagaaaagagagtttgactcaaaaactaaggaaatggaagtatagcttatttgattttattgttgcaaagaggcacatcgtagagtatatatacacaaaaggcaattcaggttaattaattaccttcccgtttttcaattggagaattttgattattattttttgtctacatttcaaaatgagaaagaaaataatcatttaatacgtggaattatagtttagtaatacatggcatgaaaataattttatcaaattttatttcggcatcaaaatttgtgtgttttttttttttttttttgaaattaaacttattgttatgatgcatttattgagacattatttgatcgatagtagcaattttaggagagtgtctgttgtatatatatatgaactatgaagattgaaggctatttgatgtactgtatatatgtaatacttgggacatagctaaatatgcatattgtgtcaatttcttttacttatctagcgttttctgtcaaattcattttcagtttgtagattggtaaaagtgaactgagaaatacaaaatgtctttaatgaaattaggtgtttactatctagtttctaaacttttggtaattcagtagagcggcacaatttgcagtttcctacgaagagatgattatcttgacttttataattagcatcagatatccgatcgccaactaatccctacaagtaaatcagtccaaatagttaagtggtccgcacagaacaagtttgtttgcagtggaaactgaaacatcaaatatgtgcgagtttacatcctaacctaggttctttagtgaaattgatcctctcacaacttacaagtccaaacaaaatatcttcatcacttgagttgagtccatctatcgttactgttttcagacaaatccaatggtccccatatcagcggctgctctcatctccttcgacaagtccacattatatcttatatcgatctatgctattttattatacaaaattagaaacatttagtaagacatcgacacatcggtaattatgtttcatcttatcatatttatcgggaaaaaaaaatgattttctctattaaaaaaaaaaattatccttttttaccattatgtagttgaatttaggttgcttcttaattttttttaaaactgttcaatatttactcacacaattaatattgtgcctttttaaaaatggaagtcctaatttttgttaggctatcaattttgctgactaattaatatattatccataagaaattaacttttatttaggcaaatatctctgctaaacttggcaaacatttatcaaaatctacatttaatacctcaaaggatttcataattgtcttgccaactgaacccaattattagaggtcaaacttgtactactaactttaacaagtcaaagatattaataacttgtactctattcttatcatctcattgcccaaaaaaacaactataaatacttacacaaaacattaccaattcggatctacgattttcaattaactctcttcttttttttttttttttggtttttcatttaagtctattcaatcatggaaaccggtttaaacatcttaaagctatcgctatgcgtcagcctagtcgtggttggatcatatgctcaggctcccgcaccatggaatccatctaatgggtttcgtccggggacatgtgaccactacgagtgtcccacctataaattggtagaggccggatacggctttgagatccgcatgtacgacgctgccctatggatatctactagtcctatcccctccctatccatgactcaagccaccaaaaccggtttccgacggtaaatgaataaatcgaatatataagacttggtgttctttcggtttctttatattataaactgaagttgactacgtttttgggtttatagattaaataggtacatagaaggagataacaagagcaacgtgaagatgaacatgacagctccggtgatcgcacaagcaacgcctggaagatcagtctacacggtctcactctacctcccgaagaagaaccaacagaacccacctcaggccgatgatctccacgttcggtctacgaaaccaacttacgtagccgtgagacagatcggtggctacgtgtcgaacaatgtagccaaggacgaagctgcggctctgatggaaagcctccgggattctaactggattttgcccatcgagaagagcaaaggaaagttgccggcgtattttctcgctgtttataacccgccatctcataccacggctagggtgattaatgagatcatggttccgtttaacatgtagatcatgttaatgacgccctcacgatttgattgttacgtagcaattggattagaagaggtggtttagaaccgatcgatactgtaacagcagcttgcagcttctggtttaaccggtataaattgtatctctggttaagtggtgattaatattgttattttgtaaaggtggggaaaactgtaaccaaaaagtttgataaaagattaaataataactaagattattgaatcaaaattgaaaatcaaacctaaatatcatcgaatcaaaaaaaaactgtaaatgattttttcagtttcgctttttttttttttcagtttcgctttctagaacacttataaagctgtaaaagaaagcacctgatcaaaaccatgaaaaaaaagagtgaaaaataaatattaggaaaatataaattaaagcgataatttatgtaatttcgatatttttaatgcatattatttttgtcggccaacttgttatatttaatcatgtgtttacaatgcaatttaatcctatccgaagatgaaccacacacataaaaccttatctgttacaaaaaaaatgtttatgtttttcttcataaatgtataaaaccttgtatcagtttacgttgcatggccgcaacggaaaacaaatccgcca

SEQ ID NO: 5727 - DNA, 3000 bp, Unknown
  misc_feature (1)..( 3000): cDNA_ID_1829116_gDNA_ID_1620813_Annot_ID_169154 3000 nt of promoter + ATG
gtatgaggcaagagtcttcctgctacccaatagtttctaccaaactggagtctaggaatttcgagaacgacgttatcactctcacatgggatatattctatggagagaatatcaagacgagctgcacgcacttcaatgctatcaatttggttgcatgacatggacaagatccttaacgttttatgatcaatcttcaaatgaccactggggttgaagaaaatgatttgtaggataagaacctcgagggaggggcaagacgagatgacttcgttgaaaacatcaacctcagcaaagatttgaaacaggtcaaggtacttgagatttttacaattgttaaaagcttgtgcatcttgtaatatgtattgatatagcgagagtgttcttaggcttggatggttgaatgtctctgtggacagcttgagcacattgtcttcacctgttggtgcgaagcgaccattaaaatttgcaaggataagatttttggtgtgtttcatactagtcagtgattggatccaagaagcaagcatcccgtcttccaattggtatgaataatgggatattatgcaagtctctaaatggccattgtgcttgtttataacctgaaaaatgcaaaaatgattaagatttaaataaggacaaacaattatgaagagtctatgttttcaatttatacgtgtttctctttatatcgtatatatatgttgaattttatagaaaaattgttaatatgtaattttatgtatgtgtgtatttattaatctatgtagaaaaaggcatgagatcatacttctctagattattgatcataaatttgtttaacataagataacgtttcgggcgaaataccgttatttgttttaaatgtaacaatgtttcaaaaaaataccgttatttatttccctctaaataccgttaaataccgttatttgctatttattttattttttaaaaaaaacataaatttgatacatatacatgtctatgatttcacatttatatgtatgaaatttcttataagtcctcaaaggcaatataacaattttcatcttttaatccaaaattccttttatcaataactgatttaaacttgtaagattgaatattgagagaaaaatgaaaagaacctcggttataattgacaaaaaaaaaaaaaaaaaactcggttatctgattagcggcacgatctaataattgtggcaggacaatcccgttgatggtgatggtctttcgcatgtcaaagcaaagatttgacacttgtttccatgtatccccccattgtttggacaaaacacatgtctttatcgcttcttctgtggacaattctgataagattttggacaacatatcgtcaggaagttgattaacattatcgattgcatcgatactgattcttttgttcgatgatatagaggatgcattttgtaagagagacatgaatgaagaaaagagagtttgactcaaaaactaaggaaatggaagtatagcttatttgattttattgttgcaaagaggcacatcgtagagtatatatacacaaaaggcaattcaggttaattaattaccttcccgtttttcaattggagaattttgattattattttttgtctacatttcaaaatgagaaagaaaataatcatttaatacgtggaattatagtttagtaatacatggcatgaaaataattttatcaaattttatttcggcatcaaaatttgtgtgttttttttttttttttttgaaattaaacttattgttatgatgcatttattgagacattatttgatcgatagtagcaattttaggagagtgtctgttgtatatatatatgaactatgaagattgaaggctatttgatgtactgtatatatgtaatacttgggacatagctaaatatgcatattgtgtcaatttcttttacttatctagcgttttctgtcaaattcattttcagtttgtagattggtaaaagtgaactgagaaatacaaaatgtctttaatgaaattaggtgtttactatctagtttctaaacttttggtaattcagtagagcggcacaatttgcagtttcctacgaagagatgattatcttgacttttataattagcatcagatatccgatcgccaactaatccctacaagtaaatcagtccaaatagttaagtggtccgcacagaacaagtttgtttgcagtggaaactgaaacatcaaatatgtgcgagtttacatcctaacctaggttctttagtgaaattgatcctctcacaacttacaagtccaaacaaaatatcttcatcacttgagttgagtccatctatcgttactgttttcagacaaatccaatggtccccatatcagcggctgctctcatctccttcgacaagtccacattatatcttatatcgatctatgctattttattatacaaaattagaaacatttagtaagacatcgacacatcggtaattatgtttcatcttatcatatttatcgggaaaaaaaaatgattttctctattaaaaaaaaaaattatccttttttaccattatgtagttgaatttaggttgcttcttaattttttttaaaactgttcaatatttactcacacaattaatattgtgcctttttaaaaatggaagtcctaatttttgttaggctatcaattttgctgactaattaatatattatccataagaaattaacttttatttaggcaaatatctctgctaaacttggcaaacatttatcaaaatctacatttaatacctcaaaggatttcataattgtcttgccaactgaacccaattattagaggtcaaacttgtactactaactttaacaagtcaaagatattaataacttgtactctattcttatcatctcattgcccaaaaaaacaactataaatacttacacaaaacattaccaattcggatctacgattttcaattaactctcttcttttttttttttttttggtttttcatttaagtctattcaatc

SEQ ID NO: 5728 - DNA, 3000 bp, Unknown
  misc_feature (1)..( 3000): cDNA_ID_1829148_gDNA_ID_1620813_Annot_ID_169141 3000 nt of promoter + ATG
aaatgattattgacgatttttaataaagtcaatgaagttaaaaacaaaattaggtaagtaaaacaagggacggttggctacagtgcgtttacgtttgcgattgtggtatacgtgttaggtaccatgtgtggctctcaacttctcaaacctttcatttacgatctagggtcattttcgtcattagatagcaatcgaatttgtatttgtaatgatattcttactatattttaataatagtcttttaatatgggatatgtaatcatttattgcacttgcccatatgcttaattagagatcaccgacacattccattattgtcacttgtgatcttgtgagagtgaatgattaactaaaatatttgtaattgatttgattttcctaatttctttgatcattaacatctaaagacgccttggatgatttgtgtgaaaaatagtttaacgggggtagagtagagaaacaaatttaattcagggaccattttagcaaacaacgtgtttaattgacaaaaggcacgtgagaccacgtgagtacttgttttggtttcttcttcatcggtccgatcagagagagagaatcgccggtgagaaaagaaaatggcgtcggcgatttctctttctctcttaaacggagcaacgcctttgaaatcgaattcgctccacaaatctagactcactccacttcatcttcgaactatctcttgttctagactatcttactctccctcgagtcgcgaaatttctctcaaaactcaatctactgttcctatttcgtgtaggcgtagtaggtttgacttcgttcctcgttgcggcatttcgtcgaacgatttgcctactgagaaaaagaagagctttggggagtgggttgagtttgtgggagaggcggtttcgacggcgtttccgatatgggtttctctgggatgcttgttgggactgatgagaccaagtactttcaattgggttactccaaattggaccattgtaggtcttacgatcactatgcttggaatgggaatgactttgacccttgatgatcttcgtggcgctttatcgatgcccaaggagctcttcgctggctttctgttgcagtattcggttggtttgcttctcaatgctctatctttagtgttcgattgttacgaattatgcacaagttagaagagaaatcgagaaagatgagatcttgaaggaaccggtatagatgatctgataataggtttgtttggtttggtaacataatcttgtggagtagttagagttattgcttgagctcatgattcctgttttatgatcttaccaaattatagttttgaaagagtagtattagagcatggataagttcatagcttgctgatgaatagtgttgcaggtcatgccactatcagcattttttgtgagtaaactcttaaatttgccaccacattacgcagccggtctcatattggttggttgctgtccaggcggtaaaatacaattctttacttgattgcattatattaacacttgtatggtgctctgatgcttttccgtttgttgtttgaaggcacggctagtaatattgtcacatacatcgcgcggtttgtaatccaaacaaaaagaaacgacttttgagttccataatacaactggatgatctgagtttcttttttttcattgtacagtggaaatgttgcgctatcagtgttgatgacagcagctagcactgtttcagctgtggtaagttactagattatgacattggtttttctattcttcttgtagataaagacaccccatttaatccattccgttttctagattatgacaccgcttcttacggcgaagcttgccaagcagtatatcacagttgatgctcttggattactaatgtcaacactacaggtttggttggttcagtctgtttcttattcggattagaacgagcgagtttttgttcattgactttacccttcttggctcctgtttgtgtgtggtcacaggtggttcttctcccagtgttggctggtgcatttcttaaccaatactttaaaaagctggtgaaattcgtctctcctgtgatgcctccaattgcggttggaacagttgcaatcctgtgtgggtatgctatcggtcagaacgcatctgcaatactcatgtctgggaaacaagtagtcttggcttcatgccttcttcacatctctggatttctctttgggtatctgttttcaagaatactcggaattgatgtggcatcatcgagaactatctctatcgaagttggcatgcaggtaactaaacagtatcttaaatgaaacggtaaccagagctattgaaaactcaatgtcaactgaggctttttttcttttcattttgtattggtgaagaactcggtgcttggagttgttcttgcgacacagcattttgggaatccactcactgcagtaccgtgcgctgtttctagcgtctgtcactcaatcctcggtagcgtcttggctggaatttggagacgcagtgccccaaaacagcttgaagactaaaaagaaagcaaaggaaagttcatgaagtcctcactgtgttactcaatttcaacatctttcaggaccatttagttaagtttgttgaacaaatgaaccaaaacgggttatgtcttgtaaagctttggaagatttttttttttttttctatgtctgagatttctcttgttattcttcaaagaattttgtgaattcgaaacatgaaaatcatattttgttcatcgtgaatcaagtgatgaggttgaaaaggctaatatgtaatttctaacatttgtggagggtagttttggggttttcaattaggaacagctagtcttggtcgcagaggataaaagacgttttaagtcgtcttctccaaatcgattttctttcacctttctctctgatttcaatttcaatttttgttcgtttttttcttccggaaaattggttgttgggtggatcaaagcttacgagatttgtacttttgttctggtgctacaagtcca

SEQ ID NO: 5729 - DNA, 3000 bp, Unknown
  misc_feature (1)..( 3000): cDNA_ID_3078234_gDNA_ID_1620813_Annot_ID_169140 3000 nt of promoter + ATG
cctgtaacacattcgtaatgaagattagcatactaaaaaagaaggagatatcgataaagctagagtaacagagcaagaattagttataccatggctttggttttcgagtagaaagagccagtgaagttgggtgtgtcttcctccttgaagccaattcctgaaccttccggatgcttgtcgtcatattcgaatatacaaccagtagcgaaattcatcattaggagtccgtgctctctgcagacatcagctagagtcaatgtgccagctacattggcacggatagtctcggtcttgtgagactcacaccagtcaacattgggtctcccagtcacaccagcggaattgaaaacatgggttggcttaacactctgaatatcctgcagaagagaagatcgatcctccaaccgacctttcccatactcgtaagcaattccttgcttatcacatatctttccaagcagaccaccgatccatccggtctttccatatatcaggaacttcagcgaaggcttttgaggtgtgccgttgctcctttggcttggaacaaccatatgggtttgacttggtttttcagataaagtagctgccagcgaattgtcctcggagccatcaaagtgtcgcccaccaggcatcatcagcatccttggatgaggaagcaatgctccagaaacatcaccccaccactccgggttctgtgtgtaccaatccatagttttcttcaacccttcttcccacgtggttctctctgaccatcccaactttttgagcttctgatcgtcaaggaagtacctctgatcgttaaaaggtctgttgtcgacaaacttgatgttcgcctcagggtccatgttgaagagtttgcagatgtctttggcaacatcattcactctcctctccttcttcgtcccaatattgtaaacatggccaacttctcccttgtgaagaacaacttcaaaagcctcagcaacgtcttcacagtagaggtagctcctgacatttgatccatctccatgaatgggaagaacctgccctctcattgccagcaaaatgaacttaggaatcaacttctcaggaaactgattcggtccatagacgttattcccacgagtggtaataacaggcaaaccataagatctaccataagccataacaagcatctcagcaccagctttcgtggcagagtaaggattcgtcggaagcagctgagaagcctcatggttaccaacaagagcatcctcatcagtttcaccataaacttcatcagtactaacatgaataaacctcctaatctgaccagtaactttacaagcctcaagaaggacatgagttccatagatattattcttagtaaactcgaaactgttaccgaaggaattgtcgacgtgagtctgagcagcgaaatgcatgatggtgtcaataccttcagtgatgagaagatgattcaccaagtcagcactagcgatatcacctttgacaaacttgaagttcggagagtgcttagaaggattgagattcttgagatttgaacagtaatcaagcttgtcaagcacaacgattttgtaatcaggatagcttcgtatgagtctgttggcgacatgagacgcaatgaaaccagcagctccggtgatgagaatgttcttgggagtgtacgaagccatgatcaaacgctgcgtttaagaagaatgaaatcataaacactcaaatacgcagaaatgaatcagtagatctaggaaatcaaacgcataaaagcttagatccagatccgaaatctcgattctgtgattatgaccatcggatcaaagagagagagtacgaaagggtaaatgaaactcagtgaagcattatgatcaatgtaaaattcgagataatggagtataaaggaagacgagagattcaggaaacataccttcgaatttttcagatcttcaacgatcgcaagagaattggagaagacaattggaaaattccgaggaaaacgtgaagaattttcgacggtgacgaagctgaggaagtagcgaaagaaacggagaagaagaagaatcaaaattcaaaaaagagtcttctcgttcgtcacacagcaaaaatagaagaagaagagaacgaacactaaagactcctggagagggaagagtctacgggaattcattatatactgcttgcacttacgaaaatacccttctcgttttcactcttttacaatagcgggtaggtacacgacttgactcgcgtgttgatgatcgcgcgttttgtcaaacattaacttcgcatgtcagctaattactaacatgttatagtctaaaattagtctagatttgatttagaaaatggaattttataattataaaagactaaaaatgtgaatatgaagtatgaagtaacgattgtacgaaaaaaaaacaagaatagaaaatgattattgacgatttttaataaagtcaatgaagttaaaaacaaaattaggtaagtaaaacaagggacggttggctacagtgcgtttacgtttgcgattgtggtatacgtgttaggtaccatgtgtggctctcaacttctcaaacctttcatttacgatctagggtcattttcgtcattagatagcaatcgaatttgtatttgtaatgatattcttactatattttaataatagtcttttaatatgggatatgtaatcatttattgcacttgcccatatgcttaattagagatcaccgacacattccattattgtcacttgtgatcttgtgagagtgaatgattaactaaaatatttgtaattgatttgattttcctaatttctttgatcattaacatctaaagacgccttggatgatttgtgtgaaaaatagtttaacgggggtagagtagagaaacaaatttaattcagggaccattttagcaaacaacgtgtttaattgacaaaaggcacgtgagaccacgtgagtacttgttttggtttcttcttcatcggtccgatcagagagagagaatcgccggtgagaaaagaaa

SEQ ID NO: 5730 - DNA, 3000 bp, Unknown
  misc_feature (1)..( 3000): cDNA_ID_1807002_gDNA_ID_1620813_Annot_ID_169139 3000 nt of promoter + ATG
agagatagttctcgatgatgccacatcaattccgagtattcttgaaaacagatacccaaagagaaatccagagatgtgaagaaggcatgaagccaagactacttgtttcccagacatgagtattgcagatgcgttctgaccgatagcatacccacacaggattgcaactgttccaaccgcaattggaggcatcacaggagagacgaatttcaccagctttttaaagtattggttaagaaatgcaccagccaacactgggagaagaaccacctgtgaccacacacaaacaggagccaagaagggtaaagtcaatgaacaaaaactcgctcgttctaatccgaataagaaacagactgaaccaaccaaacctgtagtgttgacattagtaatccaagagcatcaactgtgatatactgcttggcaagcttcgccgtaagaagcggtgtcataatctagaaaacggaatggattaaatggggtgtctttatctacaagaagaatagaaaaaccaatgtcataatctagtaacttaccacagctgaaacagtgctagctgctgtcatcaacactgatagcgcaacatttccactgtacaatgaaaaaaaagaaactcagatcatccagttgtattatggaactcaaaagtcgtttctttttgtttggattacaaaccgcgcgatgtatgtgacaatattactagccgtgccttcaaacaacaaacggaaaagcatcagagcaccatacaagtgttaatataatgcaatcaagtaaagaattgtattttaccgcctggacagcaaccaaccaatatgagaccggctgcgtaatgtggtggcaaatttaagagtttactcacaaaaaatgctgatagtggcatgacctgcaacactattcatcagcaagctatgaacttatccatgctctaatactactctttcaaaactataatttggtaagatcataaaacaggaatcatgagctcaagcaataactctaactactccacaagattatgttaccaaaccaaacaaacctattatcagatcatctataccggttccttcaagatctcatctttctcgatttctcttctaacttgtgcataattcgtaacaatcgaacactaaagatagagcattgagaagcaaaccaaccgaatactgcaacagaaagccagcgaagagctccttgggcatcgataaagcgccacgaagatcatcaagggtcaaagtcattcccattccaagcatagtgatcgtaagacctacaatggtccaatttggagtaacccaattgaaagtacttggtctcatcagtcccaacaagcatcccagagaaacccatatcggaaacgccgtcgaaaccgcctctcccacaaactcaacccactccccaaagctcttctttttctcagtaggcaaatcgttcgacgaaatgccgcaacgaggaacgaagtcaaacctactacgcctacacgaaataggaacagtagattgagttttgagagaaatttcgcgactcgagggagagtaagatagtctagaacaagagatagttcgaagatgaagtggagtgagtctagatttgtggagcgaattcgatttcaaaggcgttgctccgtttaagagagaaagagaaatcgccgacgccattttcttttctcaccggcgattctctctctctgatcggaccgatgaagaagaaaccaaaacaagtactcacgtggtctcacgtgccttttgtcaattaaacacgttgtttgctaaaatggtccctgaattaaatttgtttctctactctacccccgttaaactatttttcacacaaatcatccaaggcgtctttagatgttaatgatcaaagaaattaggaaaatcaaatcaattacaaatattttagttaatcattcactctcacaagatcacaagtgacaataatggaatgtgtcggtgatctctaattaagcatatgggcaagtgcaataaatgattacatatcccatattaaaagactattattaaaatatagtaagaatatcattacaaatacaaattcgattgctatctaatgacgaaaatgaccctagatcgtaaatgaaaggtttgagaagttgagagccacacatggtacctaacacgtataccacaatcgcaaacgtaaacgcactgtagccaaccgtcccttgttttacttacctaattttgtttttaacttcattgactttattaaaaatcgtcaataatcattttctattcttgtttttttttcgtacaatcgttacttcatacttcatattcacatttttagtcttttataattataaaattccattttctaaatcaaatctagactaattttagactataacatgttagtaattagctgacatgcgaagttaatgtttgacaaaacgcgcgatcatcaacacgcgagtcaagtcgtgtacctacccgctattgtaaaagagtgaaaacgagaagggtattttcgtaagtgcaagcagtatataatgaattcccgtagactcttccctctccaggagtctttagtgttcgttctcttcttcttctatttttgctgtgtgacgaacgagaagactcttttttgaattttgattcttcttcttctccgtttctttcgctacttcctcagcttcgtcaccgtcgaaaattcttcacgttttcctcggaattttccaattgtcttctccaattctcttgcgatcgttgaagatctgaaaaattcgaaggtatgtttcctgaatctctcgtcttcctttatactccattatctcgaattttacattgatcataatgcttcactgagtttcatttaccctttcgtactctctctctttgatccgatggtcataatcacagaatcgagatttcggatctggatctaagcttttatgcgtttgatttcctagatctactgattcatttctgcgtatttgagtgtttatgatttcattcttcttaaacgcagcgtttgatcatg

SEQ ID NO: 5731 - DNA, 3000 bp, Unknown
  misc_feature (1)..( 3000): cDNA_ID_1829152_gDNA_ID_1620813_Annot_ID_169138 3000 nt of promoter + ATG
attcgattttgctctgtttgaataagtttccggaatttaagtagaatttgatatgcaagtgattgtatttggatcctagaacttgatcttatgggatcataatccatataaaaagtagactaatgctaatttacgttagattagagtgacacatcttgtttcctgtttaaggcgtttactaatcttatttggtttacttactgatgacttatgagtgatgaccaccacatacataaatttaaaattataggatgctttctgtttcaatatccaaaaagtatagtaatgatggtgtgtgttggttgagttataacatcatcaactattgattggataataatctcgtattttttagcactaaaagactcatttgcatgtaaacttttccatagaacaaatcacaatcttttttagtgataaatattgttacatctttttcaaaagggatatttttactcaatatagaagatctttggtagggtcctagtgattgtggattccgtgcctacttgaatgaggtcactgcagtcttcacgggaaaaagcattttcattcttatgcaatctctcgtttatctatctagtttggttgaaacagtgccacttggttacattttagtcttagatgttattagaacagatgcaaggtgtaagagattcttgttgcatagtcatgggagttttcttgtgtgtgtttttgtttacttcactcacatgtttcttggggtttcttaacttatatagttagactttcaactataaatttgtaaactacaggacataggcgtaaagcaaaagtgagagagcaaatcgtataactttatttttgcataaatatatgatgcccttagatttgctgtcttattaggtggaccaccggtttcttatactttacttttccttgttttttttttttttaattatcgacacatacaattggacgcattatgtgttgtccacgcacacacactaatactactgtgtataaacactaagtcgtcttcttcttcttctaccataaaaaaaggaacatcgtgtcctcatgcttgttgttagcttgggaaatcatgcgacagtttttgtttttaatctattttcaaagtcaatatatgaacagtaaggtttataacaaaaataattgcatccccgacaagaaagacgttgaatgatcgatcttttgaagccatttcttacttactgtacattgttttctaatgtgcatatcattcaaaagtttgacatttgttatctctgcaagagagtgtgttgtagaaagtcagttgtcgaatttacccccctttttcaaaagtcacattcaggtcactgcttggaaaagaaacactttttttctttctgactcgggtatccgattctcttttcttctgttgttactaaacaagagttaatttgcttgacagtagtcttataatctttgggaaaaaggttagttaaattgtattttatctggtgtctttgtgcaacattatagaagacactaacttaagcatcctcctttatgcataatttgatttgaccccttacttgttagtggttgaaagctataacgaatatcaaattggagtttaattaatcttattttcacacgtgtttttgacattgtggctaccaacaacatctctgtccataccaagtgcttgtttaacgtttacatgagacttcagtttgtttgttttttggctagttaggggtaaaaattccattcttcttttttattggtctgtaaaaaaaattccatttcaagtaagaagaaagggagatgtttctacgttgtattccccatagtcaaatctaacgtcagcttcggccgagtgagaggggtcaatttcattcagcttaaatccaacttttttttctatgtctcataaataaatttctctttggttacaaaaaaaagtaaaaaagtttggtcaggaagagaggagcgaggacccaccgattacgtcatctcgtctaagaagtaatcagaaaaaaaaaaacctaatttttaaaataaaaacatcttctcgtgattgcgaagtttgtttgtgtgtgctgtgtggtgaagggtgatctctctctccgccccgaatctccgggcgatgcgatttttatcactgttggtttaataatctacttcacggtggtgtgttttaaaataactgaaatagttccggtcgaaatttgtaggttttcgagattttttttttttttggttggaaaaataaaaagtctctgttttcagaccgaatcttttgatgtatcacttgcatggctgtgaaggctctgtgtagcctgtaaagcttacacgaggattttgttgctccccttaatttccctctaatatctctccttctctctctctctacgataataatgtcttctctgcaccgtttcctttcgccttctttctgtccgtttccaaatttctttcgtttcttctttttggctctatttacttgccatctctctcgatgataacgacatgaaacccacctcaaacaaaaccacattcacttattattagcctttgtttttttttgagtggccgtgaaggtgtgtgattctggtgccctttcttcctttttgtttccctgcttaaggtattcctgatttttttccgtttcttgggatttattctgtgccattttttttgtttctgtttccaaattcttggctagttaattacgacctcaggatcatgtggatcctgttctttttgttatcctcttcatcagtgtttgacactatcttgtgttttttccctctttttcaataaccttagatgcttattccttggcctgatgggacacaagtgatatcagtgtatggtgatagacaacgacattttcatattcttccttttttttttttcttctttaatgttatttatgtttttttacttgacacttggtttcttgatatgtcctgatttgctttgacaacaaaaaatgcaggttaccgttgatagagtggtgttttggttctgttttggtgtgagcgt

SEQ ID NO: 5732 - DNA, 3000 bp, Unknown; identical to SEQ ID NO: 5725
  misc_feature (1)..( 3000): cDNA_ID_3078241_gDNA_ID_1620813_Annot_ID_169136 3000 nt of promoter + ATG

SEQ ID NO: 5733 - DNA, 3000 bp, Unknown; identical to SEQ ID NO: 5724
  misc_feature (1)..( 3000): cDNA_ID_1829164_gDNA_ID_1620813_Annot_ID_169134 3000 nt of promoter + ATG

SEQ ID NO: 5734 - DNA, 3000 bp, Unknown; identical to SEQ ID NO: 5723
  misc_feature (1)..( 3000): cDNA_ID_2992588_gDNA_ID_1620813_Annot_ID_169132 3000 nt of promoter + ATG

SEQ ID NO: 5735 - DNA, 3000 bp, Unknown; identical to SEQ ID NO: 5722
  misc_feature (1)..( 3000): cDNA_ID_2108291_gDNA_ID_1620813_Annot_ID_169131 3000 nt of promoter + ATG

SEQ ID NO: 5736 - DNA, 3000 bp, Unknown
  misc_feature (1)..( 3000): cDNA_ID_2160275_gDNA_ID_1620813_Annot_ID_169129 3000 nt of promoter + ATG
gcatttatgcgaattcgaaaagaggattgcaagtgaagtgtgaagctgagccgacgacgacgacttctcttgttccggcgaatcaacgatggatgttcgacgaagaagaagctaatggccctgtaacgataatttttctatctccctctgtgtttagcatctacgcatttataaagtgtcgcactttagctcttgctttgaatttgaagtatggcttgtttttttcttctcccaattgcgatttattaagtagtggattttgcctttgactcattagctgtgttgtctgcatcaattggcttcgaaaattgatgtttattcttctgaatttgttaacttggacgttttatgaaattattaatgtttggttggagagaagttaaaagtctttggcttgaaacctttattgagtgtattctatggtttacaggacatctggaacacgacatggtatccaaaagcttcagaccatgtgaacacggacaagccctggtttgtggttgatgcaactgacaaaattcttggtagattggcatcgacaattgctaatcacatccgtgggaagaatcttgcctcttacactcctagtgtcgacatgggagcttttgtgattgtggtatgagtttctttgagctatctgtagagaataagaaatttgatgtgctgctttagttaatttcttcctgaaggaggagccttgggatttggttttagtaagattcacattagcagcaagatgtagagcctctatgtagatgtttgggcaatgcttgtaacttggtacctctaatactgttttcaattgtttggttaaaggtgaatgctgagaaagttgctgtatctggaaagaagcgtaaccaaaagctgtacaggaggcattcaggacgacctggtggtatgacagtagagacatttgatcaattgcagcagagaattcctgaaagaatcgttgagcatgctgttcgtggaatgcttccaaagggacgggttagatacataatccacagctctttattagtctcctttaagtcttaacacttagcaaatccgtgtttcttcaaacttatggattgaacttggaaactacttgttgcgatattggtattgattgattactagttttccaactccctcttaactttggtctgaccattttgtggcagcttgggagagctctgttcaatcacctgaaggtgtacaaaggccctgaccatcctcacgaggcccagaaaccgcttgatctgcctatcagggacaagagaatacagctgcaaaaatagaagctccaccactgttccattatcgccaagcgcagagagttttttcttctcaggtttctgtagtttcttcatcccaaaaccagaggaggctttacagattcttgttttcgcttctatcaactctgttatgctacaaaactttctaatttgaaatatttctcgttatttttttttgctactgaatatcttcttcaacatgaaaaagatgacatgtaatgaatacaaatgccataagcaacagtagtcaccattaacaaaaacttcctcttcaattggtaacaaaccttcccaatgagatcacagatgcaaggaaaatctaatattcatgccttaatcgagtcattacttaaaactgaaatttttaatgctggatccaaaatttgaatgttaaatatacataataataggaaatacaatttgaatgtttggaatcgctaacgactaatgctagatccaaaatccggttagtattcatatcattatgtaaattttgcatccaaataaatttaaaaacaaacaaacaaacacaaaagatttttaaaatccgacaataaacaaaatcaaaattttaaaaactatttttaaaaatccaaataaaaatcttgaatgttaaatctacataataatatgaaaacaagttgaatgtttggaatcgctaacgactaatgttggatccaaaatccggttagtattcatatcattatgtaaatttagcatccaaaaaaataatattaaaactattttaaaaaatgcgaagtaaaaccttgaatgtttaatctacataataataggaaaaacaagttgaatgtttggaatcgctaacgactattgctggatccaaaatccggttagatttcatatcattatataaatttagtatccattaaataatataattttaaaaaataaacacatgaaaaaagatttttaaaatccgaataaacaaaatctaaattttaaaaagtactttaaaaatccgaatgaaaaacttgaatgctaaatctacataataatatgaaaacaagttgaatatttggaatcgctaacgactaatgctggatctaaaatccggttagttttcgtatcattatataaatttagcatccaaaaaaataaaaacttttaaaataacaaacataaaataaatcaaaatctttattaaaaaaaaaaaaaaagaaaaggaaattaagaatcaacgaacctgactcatggtggactaattatgactctctcggcatgactcatggattgttgtttactaaagcccattcgttgtaatctgaagcccatctcttcgtctttgacttgggcggaaactgcaatttttgatgatgaagaagatctcgcttttcaggtctgaaactctgaaccaccgaaaccccagatctcgtcgtcacgttcactcgcgattctctttgcccgaaatagatgcatccagattttgcgtcacgtcagactcgtttctagaactcaaagtaatcttcctgtataattagcccgtgatcgtcaaaaattgatcatacacgagagacatctctcgacatggcgttggaccaacgcggcaacgccgttggtaccgttcagcgatgtatccggatcatcaatttcacggtcacgagatatcagcgatcgtatttgtaaaacagtcgcagagaaagaaaatatttttttagggtttagaagaaggagtaatgatttcttaaggaaagaagaaaagatg

SEQ ID NO: 5737 - DNA, 3000 bp, Unknown
  misc_feature (1)..( 3000): cDNA_ID_3078252_gDNA_ID_1620813_Annot_ID_169126 3000 nt of promoter + ATG
gaaggagatgcttgagaatgtgctcctcaacagagctttttgacagagtaagccgttggcaagcatcgctcttggtcagttccttcttgatggtccagtactgttgctcctcctcattttctttttcctctttcaagataatctttggattggtagttgtaggcacagtctgaaaatttgctagactggtatcgtgagtatttgtcatcgaacttgtgtcgacaaatccaggattagggatcatcaaaaactgcccagagattctttgtgagccaagcgaaaagttagtctggtatcttctagacagattacctgcaaacaaagaagaagtgatgttatgaattatatgtgaagcatatctttgatttgctagctgcgatgttattactttcgatgtaatttgggttctgcgagaagctatgatgactctttaaggcttcgtctgtgttcaacggagacgtcccctgctgctcttggctcataaacgtctgactcttctttgctgaggatttagagaggacgaagagaggcattttcgtattattttatggcaagagaaaggatcttgagtggtcttttcgtggtgcttggctcgattcttctttcacggagatagagatctatgttccttggttatcaagaaagatgacttctgcgattcttggcttatattcttccgactcttcttcgccggagaaggaggtcactgtttccttggatgctaagaaagaaagaccatctcttgcgcttcttcgtcggagaatcacagtaacttcggagagttatcgttgagacaattttagagagaaactttgatcgatattgatgggagggacacgtattacgtatatgtagacgtatttaatgatttttttttttccttttatactatagtaaacataaatgtaatttggtcaggggggagggacaccagccgtaattctctgtttttaataaacatattagtcacctgaaaacatctttaaaaaacacatttaattgattcattcacaaaattttaagaaaaaacttttcaatgtcaatcattaacaaagaaaagaaaaacaccttctcaataataactaaggtaaaatggagagtctgtattttatctaggtaaaaaaaaaaaaaaaaagcaccttcattatctatcgagagtctgcaaacacgatctctctagctagttagggatttttctctcaagcacactaaagtggattctagagtcaacattaccccaaaagagtccaatcttgtctccttccttcaattctctcctcccaacaaacgctttagcccagccaccgttgaaaacatagctttttgatgttttgacgtgtctcttgaaaaccatatcgtgctcagtgtacgtgtcgtggtcgtacgctttaacatcgactccaatgccttcttggattttcttttggtcatctgtagggagatgtctcatgatgtggttctcggcatcggttgtgttcagcaaaagtcggcattgatgattgatatcactttccttcagtgtcttcttgatggtccatgtgtagggaggtagttccgtcaagactctggttcccttctcctctactattttctctttcgaaagagatctcatcttcttaaactttataatatcttcagttaaatctttgtttcctgcacaagtaacattggaattaatattagggttgtttcctaaaatccccatatagggatctacggggaagcctttctccgaggattccgcgtctaacgagcaatgagtcgtcaagtcttccttcgccggagatttaggaacgtcgacaataggcatcaccgtttcctcggattccaaagaagaggactccacataaattgttcttccgaacaggaccaggtatacagttttttgttcttccttcttcgtcggagatatagaaacgttggtgagaggtattgctgtttccgcggatcccaaggaaacgttgttctcatgagaaatctctcgctgttcttcggccataactcttcttcgactgagatttaggagcttaattaggagagagttatcgtccgaaataattatagagaaaagactcgaaagattatttgtgagtaaaagggattgatgagagtagtatatatagaagaacggtcaaggatataggttttgtaatgaataagacctaatttggtcaaaactctatccccctaataatttattccaatagaaaatcgtattttttgttcgcagaattctcttccacatatttttatgtttctcaacaaacttatttttatgttgatcaacaaaaaataatggatattattacatgggagaaatggaaattctctggagatattggaggagctcgaacgttaatctgcaattttcagtttatcacgacgtgaaatttgaaatagactcacacaactagtctacgaggcccactggaagaagaagtggattgtataaggtgaaacactcactaaaaaatatagatagtataaaccaaaccgaaattttggctacttcatttcggttttattgggtgaaaccgatggccaaaaggaaagatgaaaaataataatcggttccgttcgattcgaaaccaccaaaccaatattgtattctaactttatccgaaattataggaatgtaccaaatttaatcgaaatcattgaaaaattacactttatttttcttacaataaactgaaccgaagttggttttcagttccaaatggaaaccgaatttcaattctagaccccaaaatactattcgaagaatgtacaagcccactaagaacaaataatagcaataagaagatggctctcgcggcccaacccaaacaaaatcgcgtcatcacgtgagtggcacgggcctacagcaattccacaaccacatcgaatcgatgacatttccatttgctttaagaacatccgccgcgcgagaactggcgggaaaattcagccatcgcctcgaagaaaaaacctcccaaatctgagaaatcggaaaagatg

SEQ ID NO: 5738 - DNA, 3000 bp, Unknown; identical to SEQ ID NO: 5731
  misc_feature (1)..( 3000): cDNA_ID_1829152_gDNA_ID_1620813_Annot_ID_50618 3000 nt of promoter + ATG

SEQ ID NO: 5739 - DNA, 3000 bp, Unknown; identical to SEQ ID NO: 5730
  misc_feature (1)..( 3000): cDNA_ID_1807002_gDNA_ID_1620813_Annot_ID_50619 3000 nt of promoter + ATG

SEQ ID NO: 5740 - DNA, 3000 bp, Unknown
  misc_feature (1)..( 3000): cDNA_ID_2992506_gDNA_ID_1620813_Annot_ID_50620 3000 nt of promoter + ATG
acgttattcccacgagtggtaataacaggcaaaccataagatctaccataagccataacaagcatctcagcaccagctttcgtggcagagtaaggattcgtcggaagcagctgagaagcctcatggttaccaacaagagcatcctcatcagtttcaccataaacttcatcagtactaacatgaataaacctcctaatctgaccagtaactttacaagcctcaagaaggacatgagttccatagatattattcttagtaaactcgaaactgttaccgaaggaattgtcgacgtgagtctgagcagcgaaatgcatgatggtgtcaataccttcagtgatgagaagatgattcaccaagtcagcactagcgatatcacctttgacaaacttgaagttcggagagtgcttagaaggattgagattcttgagatttgaacagtaatcaagcttgtcaagcacaacgattttgtaatcaggatagcttcgtatgagtctgttggcgacatgagacgcaatgaaaccagcagctccggtgatgagaatgttcttgggagtgtacgaagccatgatcaaacgctgcgtttaagaagaatgaaatcataaacactcaaatacgcagaaatgaatcagtagatctaggaaatcaaacgcataaaagcttagatccagatccgaaatctcgattctgtgattatgaccatcggatcaaagagagagagtacgaaagggtaaatgaaactcagtgaagcattatgatcaatgtaaaattcgagataatggagtataaaggaagacgagagattcaggaaacataccttcgaatttttcagatcttcaacgatcgcaagagaattggagaagacaattggaaaattccgaggaaaacgtgaagaattttcgacggtgacgaagctgaggaagtagcgaaagaaacggagaagaagaagaatcaaaattcaaaaaagagtcttctcgttcgtcacacagcaaaaatagaagaagaagagaacgaacactaaagactcctggagagggaagagtctacgggaattcattatatactgcttgcacttacgaaaatacccttctcgttttcactcttttacaatagcgggtaggtacacgacttgactcgcgtgttgatgatcgcgcgttttgtcaaacattaacttcgcatgtcagctaattactaacatgttatagtctaaaattagtctagatttgatttagaaaatggaattttataattataaaagactaaaaatgtgaatatgaagtatgaagtaacgattgtacgaaaaaaaaacaagaatagaaaatgattattgacgatttttaataaagtcaatgaagttaaaaacaaaattaggtaagtaaaacaagggacggttggctacagtgcgtttacgtttgcgattgtggtatacgtgttaggtaccatgtgtggctctcaacttctcaaacctttcatttacgatctagggtcattttcgtcattagatagcaatcgaatttgtatttgtaatgatattcttactatattttaataatagtcttttaatatgggatatgtaatcatttattgcacttgcccatatgcttaattagagatcaccgacacattccattattgtcacttgtgatcttgtgagagtgaatgattaactaaaatatttgtaattgatttgattttcctaatttctttgatcattaacatctaaagacgccttggatgatttgtgtgaaaaatagtttaacgggggtagagtagagaaacaaatttaattcagggaccattttagcaaacaacgtgtttaattgacaaaaggcacgtgagaccacgtgagtacttgttttggtttcttcttcatcggtccgatcagagagagagaatcgccggtgagaaaagaaaatggcgtcggcgatttctctttctctcttaaacggagcaacgcctttgaaatcgaattcgctccacaaatctagactcactccacttcatcttcgaactatctcttgttctagactatcttactctccctcgagtcgcgaaatttctctcaaaactcaatctactgttcctatttcgtgtaggcgtagtaggtttgacttcgttcctcgttgcggcatttcgtcgaacgatttgcctactgagaaaaagaagagctttggggagtgggttgagtttgtgggagaggcggtttcgacggcgtttccgatatgggtttctctgggatgcttgttgggactgatgagaccaagtactttcaattgggttactccaaattggaccattgtaggtcttacgatcactatgcttggaatgggaatgactttgacccttgatgatcttcgtggcgctttatcgatgcccaaggagctcttcgctggctttctgttgcagtattcggttggtttgcttctcaatgctctatctttagtgttcgattgttacgaattatgcacaagttagaagagaaatcgagaaagatgagatcttgaaggaaccggtatagatgatctgataataggtttgtttggtttggtaacataatcttgtggagtagttagagttattgcttgagctcatgattcctgttttatgatcttaccaaattatagttttgaaagagtagtattagagcatggataagttcatagcttgctgatgaatagtgttgcaggtcatgccactatcagcattttttgtgagtaaactcttaaatttgccaccacattacgcagccggtctcatattggttggttgctgtccaggcggtaaaatacaattctttacttgattgcattatattaacacttgtatggtgctctgatgcttttccgtttgttgtttgaaggcacggctagtaatattgtcacatacatcgcgcggtttgtaatccaaacaaaaagaaacgacttttgagttccataatacaactggatgatctgagtttcttttttttcattgtacagtggaaatgttgcgctatcagtgttg

SEQ ID NO: 5741 - DNA, 3000 bp, Unknown; identical to SEQ ID NO: 5728
  misc_feature (1)..( 3000): cDNA_ID_1829148_gDNA_ID_1620813_Annot_ID_50621 3000 nt of promoter + ATG

SEQ ID NO: 5742 - DNA, 3000 bp, Unknown
  misc_feature (1)..( 3000): cDNA_ID_1829144_gDNA_ID_1620813_Annot_ID_50622 3000 nt of promoter + ATG
cgttttctagattatgacaccgcttcttacggcgaagcttgccaagcagtatatcacagttgatgctcttggattactaatgtcaacactacaggtttggttggttcagtctgtttcttattcggattagaacgagcgagtttttgttcattgactttacccttcttggctcctgtttgtgtgtggtcacaggtggttcttctcccagtgttggctggtgcatttcttaaccaatactttaaaaagctggtgaaattcgtctctcctgtgatgcctccaattgcggttggaacagttgcaatcctgtgtgggtatgctatcggtcagaacgcatctgcaatactcatgtctgggaaacaagtagtcttggcttcatgccttcttcacatctctggatttctctttgggtatctgttttcaagaatactcggaattgatgtggcatcatcgagaactatctctatcgaagttggcatgcaggtaactaaacagtatcttaaatgaaacggtaaccagagctattgaaaactcaatgtcaactgaggctttttttcttttcattttgtattggtgaagaactcggtgcttggagttgttcttgcgacacagcattttgggaatccactcactgcagtaccgtgcgctgtttctagcgtctgtcactcaatcctcggtagcgtcttggctggaatttggagacgcagtgccccaaaacagcttgaagactaaaaagaaagcaaaggaaagttcatgaagtcctcactgtgttactcaatttcaacatctttcaggaccatttagttaagtttgttgaacaaatgaaccaaaacgggttatgtcttgtaaagctttggaagatttttttttttttttctatgtctgagatttctcttgttattcttcaaagaattttgtgaattcgaaacatgaaaatcatattttgttcatcgtgaatcaagtgatgaggttgaaaaggctaatatgtaatttctaacatttgtggagggtagttttggggttttcaattaggaacagctagtcttggtcgcagaggataaaagacgttttaagtcgtcttctccaaatcgattttctttcacctttctctctgatttcaatttcaatttttgttcgtttttttcttccggaaaattggttgttgggtggatcaaagcttacgagatttgtacttttgttctggtgctacaagtccaatggaggcggaaggagaaaaacagtggagttctctcatagtaccttttgttctagagatagtgaaagagaagaacttcacaactattcctccgaggtatgttcgggttgatcaagaaaaaactgagatcttaaatgattctagtcttagttctgagattccagtcatcgacatgacacggttgtgttctgtttccgccatggattccgagctcaagaagctggatttcgcttgccaagattggggattttttcaagttagtctctttacacaccttgaatctttgtgtttctcgtaaaacgtgacttctgtttttgaaaatgctctcttgctggttacagttggtaaaccatggaatagactcgtctttcttggaaaaactagagacagaagttcaagaattcttcaatctccctatgaaagagaagcagaagttgtggcagagaagtggtgaatttgaaggatttggacaagtgaacattgtctcggagaatcagaaactcgattggggagacatgtttatcctcaccactgaaccaattcgatcacgtaaatctcacttgttctccaaattacctcctcctttcaggtacgagtcttgttgtagttgtgtgattacgaattagtctctaacaactgtaaactgaaaaatccgtttttgttttcagagaaactttagagacttactcctctgaagtgaagagcatagctaagattctgtttgcgaaaatggcgagtgttctagagatcaaacacgaagaaatggaagatttgtttgatgatgtttggcaatctatcaagattaattactacccgccatgtccacagccagatcaagttatgggtttgactcaacattcagacgctgcaggtctcacaatactcttacaggtgaatcaagtggaaggacttcagatcaagaaagacggcaagtgggttgtcgtaaaacctcttcgagatgctttagttgttaatgttggcgaaatcttagaggtaagagagattactagaaacctcttcccatttctatgaagaagtttttgctactgcattcttctgatgtgagtgttttgtttgctattgtaaagatcataacaaacgggagatatcgaagcatcgagcatagagcggtggtgaattcagagaaagagaggttatcggttgcgatgtttcatagtcccggaaaggagacaatcattcgtcctgcgaaaagccttgtagataggcagaagcaatgtttgttcaaaagtatgagcacacaagagtactttgatgccttctttactcaaaaactcaatgggaaatctcaccttgatcttatgcgtatttaaggaaaaagactctcataaaacatgtttcttcgtaattttgtaattaagagaaatctttcatcttgcttcttgtcattaaagacattaatacacacgctttaattaaggcagttaatgaagaaaagtaagaagaacaaaaagaggtgtagggattggctgactattgggcttttctatggacgcgaagcagcagattatagcactcctctctccccacaaaacacaactcagtaaaccaccggaagacgatacgaaccgttatattaacagccgtcgacgaagttcacaagacgcgacgccggagagaaaaagtcgagggatcaacactttcgacgatttttcatttctctttttaactaatcgataggtctgtagttgtaaccagcaaaaaaagagagggttttcttggtttataagggtttcgtatacaaagtcgagtttttttggggtgaagta

SEQ ID NO: 5743 - DNA, 3000 bp, Unknown
  misc_feature (1)..( 3000): cDNA_ID_2785812_gDNA_ID_1620813_Annot_ID_50624 3000 nt of
ctcatgcctaatgggagcttggattcttttctacacggtacacataaaacagagcattaagcacaaaacgtgtatttgagtggtttctttagccacaagttttttttgttatttgcaggaagaaaagctttggattgggcgtcgagatatagaatcgcagtaggagcggctagagggatttcgtaccttcaccatgattgcattcctcacattatccatagagacatcaaatctagcaacatacttcttgatcacaacatggaagctagggtttctgatttcggtttagccactttgatggagccagacaagactcatgtttcgacttttgtggctggaacattcggatatttagctcctggttggtacacaactgatagattcaaatatataaaccaaaatttggattgcatttcgattttgttcatgtttgtttttgttataaacagagtatttcgatactggaaaagcgacaatgaaaggagatgtttacagtttcggagttgttctgttggagcttttaactggaagaaaaccaacagatgacgagtttttcgaagaaggaacaaagcttgttacttgggtataaagttatctatctattttccttgtataagttattaatcttgtttggtttcaagcgacgtcgttgtggtgtgtaattgtatacaggttaaaggagtggtaagagaccaaagagaagaggtggtgatagataaccgattaagaggatcatcggttcaagagaatgaagagatgaacgatgtgtttggtatagcgatgatgtgtcttgaacccgaaccagcaattagaccagccatgactgaggttgtcaaattgctcgaatacatcaaactttccacacgttcctctttttgatgtttctcttgtcaagaaaaataatcaaattcagttccaaaataaagttttgctgaagaaaaagatttcgagatctgcttctttgaaaagctaaattgtaatttaatactccatattagtatagtaaagattatttataattgatttgttttagtatggaataaaggattattacacacaaaaaagccttatatcaactattcttttttaagattctcgtacaaagtgggcattggatctttaatttttccctaatttacagctcagctcacgttttgatgtcttgttatttgatcccaaatgttctcactactacattaaaccttttgaagcaattagcaaccttttttttttgttacttagcaaaaccaaaccaaacattacgtttatataacgacacttttgctaaaacggttacttttcctagaagcaatttgctggattattcacctcaaaatcctaaaaacattaattagcattagatatctaaaaaaagtgaaatacaaatctttgtttctttttaaattgttttattttataaaattgattcacttgctcatcatttatatacaccaaagagtgtagaagagttctctcactcaaacaaaaatcaaacaatggctaaagcatggatctgcctttccttcctcatcttcctctaccttgtctcaggtatataaattaccagtttaccactaatcagccatcctagtttaattaatttaataatcctaattaacagtatcatcctcatgttctttccttttaacagaacgaaacttcatcaacgtcaacgcagaggtatttgcttagaccaactatcaaattgctatctgatttttttttcttactcaatgagtttttgttctaagttgttgttatagaccaagacttggtgtgtggctaaaccttcttccgatcaagtagcacttcaagataacataaacttcgcatgttctcatgttgattgtcgtgttcttttgagtggatgtccatgttactcccctagtaacctcatcaaccatgcatctatcgccatgaatctttattaccaagccaatggaagaaactattggaactgcaatttcaagaactccggactcattaccataactaatccgagtgagtttgctctttctctttaattatgctatcgaaaaacacttctctatctatatatagagagaagtggttttaaaggtaatttcatttttacctttaagtatctggttaattatattaaaggtaatttcattttttctatatgtgtaggctatggaaactgctactatgaataaacatgagcaagaaaggaaaaaaaaaaaccatatttcttacaagcaaacagaagaggaatgtgttttcttgttgttgcaatgtttatgagttataatttaaatttccaaagttcgcagattttgattaatcaaatttgataacataaaagcaaaaaagaaagtatccaacacttatcaaaatttgatcacaattattccatctcattttcagtaatgacccttattacgtactgaccgtaaacatagaacttaccgtaattaagcttttaaaattgaattcttcaccacatgaacatttggaaatatgtagaacaacgtaacgttttcttttcttttttctttggtgtcagaaactaacgcatttctaaagattttttttttttataaaggtaacgtatttcgatatactcgaatgttagtatgttaaaccattggataaatgacacgtggtgaaatcttagcctcaagattagataagcgtagactaatcaatcgtttccctcttctccttggtattgaacaaaaacacagtcgtcactttcgtgcctcccgaatgatctcatgtgggcttgtctcgtccacccaacaaactatagaaaaaaaactcgatcggctgatacttaatcacccacttgattttgtatttttgtacctttttttgttgtaatttttccatacacccaatttcccgtggaagaaaaggagtcagctttttcgtttgctttaaagcttgaatctttacatagttccagttactttctatagagcttcataatccctagttgcccaaaaggattctgggttttgtgagaatgatgacgtc

SEQ ID NO: 5744 - DNA, 3000 bp, Unknown; identical to SEQ ID NO: 5727
  misc_feature (1)..( 3000): cDNA_ID_1829116_gDNA_ID_1620813_Annot_ID_50629 3000 nt of promoter + ATG

SEQ ID NO: 5745 - DNA, 3000 bp, Unknown; identical to SEQ ID NO: 5726
  misc_feature (1)..( 3000): cDNA_ID_3078217_gDNA_ID_1620813_Annot_ID_50630 3000 nt of promoter + ATG

SEQ ID NO: 5746 - DNA, 3000 bp, Unknown
  misc_feature (1)..( 3000): cDNA_ID_2992558_gDNA_ID_1620814_Annot_ID_50631 3000 nt of promoter + ATG
gtgtttgttagtgaaattgtttaatgcatgaaaaactcgatatcttttcctgactttcttaatagttttatatttgtgagttaatatctttctatctccatattatttgtgtgttgtttttgtgttgtcaaaacaaataaaatcatgagagatagcttaaacataattttgttaccctttttttaaagtcaattaagagtaagcaaatatttaatctttttgttattaagaattgataagattttattgaatatattaattcatctgcatcctagatttttataaaatagttcattgtaaaaagtgaatcgccgagttatatatgcgtatctaatctaagtatcatcacgacgttcagctctaatctaaatcaaaccacaaagtaatcaatattgtaattttctaagtttaaggacttcttttgttttggaagcgtgtaattaattaagggccaaacatgtttttccattggctcttctttgccaccagaagcaagttgcaaaagagagtgaagcacccaaattgattaaaaagaattaaaaaaaaaaaaagggttcaaatcctttccatcgtgctgcaaattgcactttttgttggtcatccaaattgctcattaatcttcgttaaaaaatatataacatttgggtgatgattaaaaaagtagactgtagtggacccgccacacctaatcgtacccaatgataatccggtaaggttcggttccatttgtccgcattcccaaacttagaaaatgaaacggaaagaaaaacataatgtgttttagtttttatcttaaaaaactatagacaaaaactcaaaacatttttcggattgtataccaataaatagagagaatgtagttttaacctcgcaagtctcaactgatgatccgactcgtccaaagcatgtttatagatttaactagtttagctaccattcaaatttgatttttaggttaccgtccatttttataggaccaattctataagaagtggtttagatatcgggtagattttcattttccgacttcatgcatgatttagttcttaaaacttgcatgtttggcttctactaagacaaccctcgtttttctgacgactcacgtggtcaaacggtgcacaaaggtcacgtgaggcacgtgcgttctactgtttaaacgcctcttctcttttgcttcttttttgccaatttgaaagagataagaatacaaattaaaaagatgtttcttccactttcctcatcgccgttctatgctcactttctttggtcggatttccaattacattgttaactattagtggtcacataattttttcatgacgtggatcacacttctctttttacatgtctatctccttaattagtatctttaattgctttcgacatcaaaagctaatatctatgttttacactctattagttgtttaatattcacaatattcaatatcaaatctcaccgtatttggaaaatgtttattagttcagtacatgacacactcgtaatcaacattttgaattttttaaaatgttttatttgttcagtacatgacacactcgtacatttcgaattgcttactttttttgctttaacaacgtccaagtacaaaggagattctctaagactacaggatttgactttttaccagagaatctatcaggttaaaaacgatacacacacacacacacaaatttacaaaaacaactctagtctctctacttctaaaagtttaataatttgtttttaactttgaactacaaacgaactccatttattgtttcttggatcacgttaagtaacgtggcagctgaacgttgacctatgactcaaagtgagtcccactctaactatcatcttgacggctcagagttctccacgagtgtgaagtgtcaatcggaggagggggtaaaaccgtaaaagcttccgacacgtcccacgaaaaaggataatacgagaaggctcttctcatcatccaacggctcacgatttaacaagactagtctcgcttctgtctcttctcatacccgtcgatctgtcttggcttttcagctatcgccacctcttctctcttttttgcttatctcttcaattttcggatttaaattttacgaaaaacaaagaattaggataatactatttgtctctctaattctgaccataattaatttttattttcatatttgacttttacaaattcaagtgtgggagttcctttattcttgttgtatcactctcaatgcttaactagatttgacatccacatatgtgtttgtccgcttattatacatatgatgatatgaaaatatatcaatcattatatcattcgtaagctgaaaaattagtatgctatttttttctatgtcgaaacgtaattatttatgaccatatttgaacaataatatcgcattttcaccttttatttttaaccttttaagactttccttttaggtcttctagatgcacactggacagacacgcatattcaagatacgtgtgtttttggaggacttcaaaaaaaaaaaacgagataatgattttcccaaattacataaagaagaaaacaaattgattttcccaaataaaggagtcagaaaaatataatttaggaacaaacaaaaaagatacctttaataataaacaaaaataactctaaaaatattttaaaatgaaattcgtatgaaatataaaccgcataaacttatcgtgaccgccttcaaataaaaataaaaccctttattttctctctttcagccgccgctttcacttacctcttcctcttccttcttcttcttctaccttcttctcgtaaaggttttgctacacactggagctcgcaaatctggctatcgaaaaccacaatcacaaactcaacttcggggccttcaaggccaatcacaagaaagtcatggtgagtcttatttttaattctttttgtttgtttttaccttgctatcaatcttctccagattctgatttggtttcgttttgttcagggaccaatg

SEQ ID NO: 5747 - DNA, 3000 bp, Unknown
  misc_feature (1)..( 3000): cDNA_ID_1829219_gDNA_ID_1620814_Annot_ID_50633 3000 nt of promoter + ATG
gtagtagtcgaattatagtttgtcatacgaaagaaataaattagaaacaaattataaaaattagagatagaagagaagtgattagtgagtttatggtccaatccattgaactcgactttccgtaccaactcacagctatttccctttaacctttttccactttaaattaatataattatgtacataaatgtatacgcatatatataaccatcaaaagttaacgatcagcttacaaaatgatgacatctttagagaaagaaaaaaaaagaagcaattacactctcttttatttttgtcaactcttaattccactatattacaatatgaatggtttttgatgattaattttgatgaagaatgaagagagtgaaaatattagattttttcaaatgtttttctagatattctaattagttcttaaaacataattttagctaccatttcatctaacatattctactacaattcactctctgtattttattcatctatcattcttatactaaaacttatctatataaaattttcttggtaccccttttcttcttttttattcaatatattattaggcatataaagacacaaaagggaaaaaaaaggattaacatcaccattagtaaggaatgtaagaatagatgtagaagtagaacgaataaaaggttgacacattaataaaaaaatgagacacgattaacaacgatagattataataatgttaaaaatactcataaagagcgaattaataacaacgtcgttttatggaacaagaagagaagaagaaggacaatgagccacttgcatgcgcgtagggacgatacataaaacccgtacgtgtgaggtgtggcctctctatctcttgtcttgtccaatctggtgtactaatgtcttgaggagtgttactttcgtagttattcagattccgtatgggtaatgatgtcgtttcacttatcgacaggttttgggtgggattgtttttttcccttaaccttacgtgatcgcgacgacttctccgtaacgcggtgtcgagatctaagcttcgtacgtaaactaagctcttggaatttaaatgatatatgtaaacacgaaagatatttctaagttagtttttacaatctaaatttcaaaccgaaatctaaactaatcttcgaaacgtatacaaaaaaactgagtatgtttatcatttaaaacctataagtaactgatatacttcttacataagcttctgtacatctcagttctataatcgattagacaatttgttaggcaaaaattgttagtaccatgtcctaaaagaaaagtcgacgatcgtttcgttatcactaaccacttaggcatgttacatgttcataactaaatagtacaacgattaaataaatatagatatattacacgggatatgagttataagatagttggttcgtgggacctacattaaaagatggtttataataatgatttggactgttaaattctatatttttagcccgtagaaatcattctattcgataaaaacgtaacagagtgatataaagaattaaagatcgatcgaggttgaggttcgaaataacgtggtcaagatatgggaagaatatataattatagaagaatttagaagaatattgataaatgttaatattgaaatttaggaagtttaacattatctttaaatatattatttatatttatgtttatcttaatctctatacaaaagaatgtaagttataatattatctttatgagaatctattacattttttcttataaacactttgtgttctttacttttattaaacttatcggttatcattaatcaacttattatggtatggtaaattagtgcagtaatgcaagacttaccttcaaatcaaaagacaatagttcgagtttttctttcaattttgtttgatatcatactggttttaaataccaaaactactaagattttcacatatgaaaagtttaatctaaaattttagtatgaaatcctccaattatattttagaaatgacaaaaaatattttctcctaagaaaatgttctatttcatgatataaacttcatggtaattatagacttttacattaactataagaaaatacacaacatatgtgtcaatgttttgaatcttaggtacacatatcccaaaactcaactatataaatcaaacataaaatacatcaatgatctaaatatctcctgccacatgaattttttaaaactcttttaacaagaattgactagaaagaaaactctttaaaaaatatgttgactagaaagaaactcgttaacaaaatacataaatggtgtgaaaactaaaatggatccgttaattcagggtacgagaatttaaagagaaacagtgttgaaattacttttaactagataaaaagcaaaatgaagtatcttggatccttcgactacatatctctctcatatgggcggctcgaataaatatcagaaaaataccctcactactcttcaaatttacacaatatgccatcaccgtagaaaacaaataaggaaaaaaaaaagctatcgtagaaggtaaggacttgaagacatcagagaccaaggaccaaaaaaaaaagaaaaagctttgattaccagaagaagaagaaggacaaagtttgagactttggaagatttgaagaaggaagctctaagctggtgaggagagaaaatcaaatccttttctcttagtttccttgattggatcgggaaaatctacaagttgaaagattcgttttttgaaatcatttcgaatctgaacattcgatttcgagtcatgttttgcttgatttgtcttaagctttcgttgaatcgaagaagcgtttatgcttgaaagctcagattttgtgtttactgattagctaagagttagatatgatgagtagctacgttggttcgttcctcccctagagatctccaactgaatcatcttcttcttcaatctacaaaaggaggactttgaaaaagggtcagactcagatcgagagatatg

SEQ ID NO: 5748 - DNA, 3000 bp, Unknown
  misc_feature (1)..( 3000): cDNA_ID_1829215_gDNA_ID_1620814_Annot_ID_50634 3000 nt of promoter + ATG
catgtaagcacctattgcggattagagggagcatcgatcatgtgacatagtgtggctccattatctttaaagttttgccggagttaattatttatgacaaaattggtgtactttattccaagatttaataatattttttattatttatttgttttacttaataatactttttattcaaaagtgtaaacacaaagtaacaatgcctatgctgttttttttcctatcaattatttaaccgctgcatttgattagtatatatggaaggaatatttaactaccgattatcacttacggttgttaatgacaaatttttacaagtaacaattgatttgaaaaaggtcattcagaaaatcatcgctagtctgccacaaaattcaaatgtgttacaatgtatcatagttaactacaaaatcctttattataacaataatgggttgaccactataaatcctttatcttgttttatacatttcggaggctaattgacattttggtctgaatatatccatgcataattaaaatttcgagtaatattgtctcaatattccttccatatatactatgaataaactattagagattttaacaaaccctagaaagtccaaaatacgttttttgtgaaacatacgaagaaaatagataacatatatgaataatatgcgtagaaatattgacgaaagtgacgaaatgtaacagttttcgtatcatgtatacgtgaatttccatgtcaggaaccgctactagaattgataaggtcaaaagatgaagctcatcgtgacattccaccaaccgaaagtactctcaccgcttcacgcatgacccaaatatatacaaaagtagaaaaaaaaaagcacaaaaacaacgtgtagaggcgataatcataaaattgagttcttatacctatacatttgaaaagcttgatataaagaaaaatatgtatcatagacggatatatatagctcgtgttgcggcatatattgtcagttagttcatgcctattgattgatttatttgtgtagctgtctctttgacgaattaactcaagttggtatattgttaattagttttaccagctactcactttattgtcgatctagtgcttaccaaactaatggcaactacaaattaaagtcgtctccgtatattaacgtatttttcaattctatttacgcgtataatatatcttcgtcaactattgtggagtagatctaaataaacaaacagcggaaaactaaataaatgtcataatatgtaggcaagaaaacaaaagagccattagataatgtgtgtcttgtattgtatttattgaatcttaccaccgaaaccgacatatcattagagttttagtaagcacgtcattttcagttagtaggttggaaaagaaaaattctcatcttcaatatgaaaatataggatgagtatctttttatgaacgttaatcgcttagttgtggttaagttatttaaagtaaattttaatcaagttaggcagtaaaaaataaataatgaagaataactatcttctttacaatatgcaatttaaatttctatagggaaattatttttcggttatagtagtagcacaattgaatcttattgatgtatttgaattatactaaatattttcattgtatcacccaataaaaagctttaatgaaagagaccaaaattaggaggttagatattacataatcatcgttaatatgcaatcaatataattcatgaaacgagagagttaagaatgagaacgtcgttttctaatgtggaacagaaatcgcatatccgttttcgtaatagcaaggcccatcccttctcacgcgctactttatccgacccgatccaacctgatccggataatataacgaattatggtaaatctttgaattagtgttaattaatattgttggctaaaatctaactaaaatactacaacttgctatggtgatgtcaaaaactgcatttcatcctattaaaggatgccacgtgtatttatcttattaagtccattacaaaatgtgatctttttacctataatcatggatgataatttttcaatatattagtatttttaaacatattttgaaaaattattaattcttatctcaaacaccactttaatcattaagaagctcctttaattttcccttcggagttaaattatccttttcactttaaaaattagaaagtcttgcaaaataagaaaatttctgaaacttatagataattgatttgtcattttcaacaaaagttctattaatcctcctttcataaatataaaaagatgaaatccttttcttcatggataaaagtatatttggatatgatattaatgtttaatgacgtcattaaatagtagcaattagtaataatgaataatgatgacaatcataaacagaacttgaagttaacaattttaacactgataaaaacatttggataaatctctgtatccaagatttacatgttccaacaatatacgctactatatatatatttcttactaattaaaatgagttttaatgctaatctatgctaatcaaaatatgaaaaatacaaagatattggttaatcgataaatacaataaatcagattaacgaagccctctgttcaacaaagaggcttctcgatctcgtccttaattccttccttctctaagccagctgttttcttcttcttcttcttcatctctctctctctctcgtctcctactctctctttgctcggaccaaaatttcctcaaattcctcctctgttaatcgccggcattgtctttcttaccgatccgactatctcagcattcgaaatctccggcgacaaagcctgatctcaaggttagttgcaaatcgcttttttattttccctgaaatttctctgatctccgtccatgtcggtttagttttttatggtcgtgaattttcgttagagctggctgcaatttcgtttgatctgatttattcttacgcctttgattagcttatcgttcgtgaagcggtgaaaatg

SEQ ID NO: 5749 - DNA, 3000 bp, Unknown
  misc_feature (1)..( 3000): cDNA_ID_1829211_gDNA_ID_1620814_Annot_ID_50635 3000 nt of promoter + ATG
ctataaccgaaaaataatttccctatagaaatttaaattgcatattgtaaagaagatagttattcttcattatttattttttactgcctaacttgattaaaatttactttaaataacttaaccacaactaagcgattaacgttcataaaaagatactcatcctatattttcatattgaagatgagaatttttcttttccaacctactaactgaaaatgacgtgcttactaaaactctaatgatatgtcggtttcggtggtaagattcaataaatacaatacaagacacacattatctaatggctcttttgttttcttgcctacatattatgacatttatttagttttccgctgtttgtttatttagatctactccacaatagttgacgaagatatattatacgcgtaaatagaattgaaaaatacgttaatatacggagacgactttaatttgtagttgccattagtttggtaagcactagatcgacaataaagtgagtagctggtaaaactaattaacaatataccaacttgagttaattcgtcaaagagacagctacacaaataaatcaatcaataggcatgaactaactgacaatatatgccgcaacacgagctatatatatccgtctatgatacatatttttctttatatcaagcttttcaaatgtataggtataagaactcaattttatgattatcgcctctacacgttgtttttgtgcttttttttttctacttttgtatatatttgggtcatgcgtgaagcggtgagagtactttcggttggtggaatgtcacgatgagcttcatcttttgaccttatcaattctagtagcggttcctgacatggaaattcacgtatacatgatacgaaaactgttacatttcgtcactttcgtcaatatttctacgcatattattcatatatgttatctattttcttcgtatgtttcacaaaaaacgtattttggactttctagggtttgttaaaatctctaatagtttattcatagtatatatggaaggaatattgagacaatattactcgaaattttaattatgcatggatatattcagaccaaaatgtcaattagcctccgaaatgtataaaacaagataaaggatttatagtggtcaacccattattgttataataaaggattttgtagttaactatgatacattgtaacacatttgaattttgtggcagactagcgatgattttctgaatgacctttttcaaatcaattgttacttgtaaaaatttgtcattaacaaccgtaagtgataatcggtagttaaatattccttccatatatactaatcaaatgcagcggttaaataattgataggaaaaaaaacagcataggcattgttactttgtgtttacacttttgaataaaaagtattattaagtaaaacaaataaataataaaaaatattattaaatcttggaataaagtacaccaattttgtcataaataattaactccggcaaaactttaaagataatggagccacactatgtcacatgatcgatgctccctctaatccgcaataggtgcttacatggatgtttaaaccgaatttaggcggacgagagttcttagttgtttatatatacgtaatttgttttgttgtatatgtgcagtaacaaaaataacatcgctttaaaacaaaaaaaattgaagtggtttagcataattttagatattaattaatcttggtaaactcttaaaaaaacagttttgttttagaatattaaacaaaaatacataattgaatatgatgctcttgttacgtggatttccacacatggcctttttgggacattttgattttccacgtctcaatatttcacacgcctacttatgtgatgactgatgcgtgattagtcaattttctgtattaaattactgttttgtttgtttgtcaccattctctgtatttccttaaagagtaaaagaaagtaaaaatttagtcaccggttgagtttttttctttccaaacaagagttttaatgatggagtgagtttttcttgtactttgtcatgttgttatggtagttgattcttgttatatcgatatataacatgagaactctttttaatacaaaactataaattatacgtgttgcatgtttgaaaactatattatcactaagatcaatagatctctttagagatttgacaaaaataaacaaagacatatatataaattttttggatatttttatggactgcccagttttcacatgataacacatgaaccttcgtctcatatacatgtgccatcttttactaatctaagattgcattcaaagtaatcagcctccatgtcattgtcaccatttaaagtttttcccattccttgttcattattacacacacattatatttgtcagcgattattaatgttgaggtattaatattttgacaattttaattcttataataaacaaaaacacttgcattcattctcaaattaacaaacgcaaaagaaagcatgagaccattgtcttattacgttgggcttaggaagtatgtacaggcccagcccaatccatgtacagagtcggtttcgttattggatccatagtttcaaaacggcatcgttaaagttttccaccttaaggcggtatcgctagcttatagaaagaattcgcagtcgaataaacgaaggagtgtctcctttagtcatttaggtcgattattaggagatagaggacgtgagaagggagagatctgagtctcctactagggtttcttctactggattgattcgttgcagagagtgaagctaagaagagattttcgtagctgtttctgtaagttttttttaatctccgtttcctcgatttgggtgtggttttattagggtttatcatctctgggagcttcttcgtttcacttttggttcgtttcttcgatttgaggttaacattgtgtatttttttttgttcctgtttgatttggtttctaggttttcggattggtag

SEQ ID NO: 5750 - DNA, 3000 bp, Unknown
  misc_feature (1)..( 3000): cDNA_ID_1829207_gDNA_ID_1620814_Annot_ID_50636 3000 nt of promoter + ATG
acccgtaaacatgtccgcttgactgctgtggatctgatggcttattctcacatggataacccgcagagtcctgatttcttgttagggaagctggaagaactggacccttttgttgaacaaatccgcgaggaaacactgaaggagacactgtgtcatggtattggatacttgcatgagggtttaagcagtctggatcaggagattgtgacacagctctttgaagctggacggattcaggtttgtgtgatgagcagttcattgtgttggggcactccattaactgcgcatttggtggtcgtaatgggaacgcagtattacgatgggagggaaaattcacattctgattatccagtccctgatctgcttcagatgatggggcgtgctagccgaccacttcttgacaatgccgggaagtgtgtgatcttttgtcatgcaccgcggaaggagtattacaagaagtttttgtacgaagccttccctgtggaaagtcagctccagcatttcttgcatgataatttcaacgcagaagtggttgctggggttatagagaacaagcaagatgccgtggattatcttacatggactttcatgtacaggaggcttccccagaaccctaactactacaatctccaaggtgttagccacaggcatttgtctgatcacctatcagagctggttgagaacaccttgtctgatcttgaagccagtaaatgcattgaggtagaggatgagatggaactctctcctctcaaccttggtatgattgcatcctattattacatcagttataccaccattgagcgcttcagttcactgttgtcttctaaaaccaagatgaagggacttcttgaaatcttaacatcggcttcagagtatgacatgattcctatacggcctggcgaagaggacaccgttcgaagattaatcaatcaccagaggttctcttttgaaaacccaaaatgcacagaccctcatgtgaaggcaaacgcgcttcttcaggcgcatttctcaaggcaaaacattggcgggaacttggcaatggatcagcgtgatgtccttctatctgcaaccagacttcttcaagcgatggtcgatgtgatatcaagcaatggctggctgaatcttgctctgctagctatggaagtaagccagatggtgactcaaggcatgtgggagcgggactccatgcttctgcagctccctcacttcacaaaagacttggccaagaggtgccaggagaatccagggaaaaacattgaaaccgtattcgatcttgtggagatggaggatgaagaacgccaagagcttctcaagatgtcagacgctcagcttctagacattgccagattctgcaaccgcttcccaaacatcgaccttacttacgagattgtgggcagtgaagaggtgaacccagggaaagaggttacattgcaagtgatgcttgagagagacatggaggggaggacagaagtgggacctgtggattcactgaggtatcccaagaccaaagaagaaggatggtggctggtcgtgggcgacaccaagacaaaccagttgctggcaatcaagcgtgtctcattgcaacggaaagtgaaggtgaagctggatttcacagcaccgagtgaaccaggagagaagtcatacacactatacttcatgtgtgactcttacttggggtgtgaccaagagtactcgttctctgttgatgtcaaaggatccggcgctggagatcgcatggaagaatgatttgttattcaggttagttccacagttttctggtcatagttttcggatttagattctgtacatggttgtagtttttgtgttacgaacttggctttactagattctgctatgtgcattgaccaactcgctttcatctattgtttgagtaatttgttcatcaatctgctatttttctgtttcgtctgttttctttttgcatgagctatgtattaggttttactcttgagcattgatttacttatctaggtattagaatacaggtatgctcatggtatatatatacctagtattgtgaaatgattgattgataagttagtgaacaatgttgatcagcaaattgttagaaatctgtataattggatggtgatttgatgtgtgctttggatggtgatttgatatgtgtgcatcactgctatatgaaaactgctttcttgaatcatgtctcataaaaatctcacatgatgttcctttaaaatagctgataatagattttgtattttgaaatccagaaaatgacacataatttctcttctttgcaggctatgctgattctggagagtgtgacttgtcttccaaaaagcctccgtaccgtttgggtctctgcaatcttagctctctgagaatatatattaaggtgtaatcgtttttttctggtcttttactattccaattactctttttatgtcgtgcatcgatttttaatcctatgtatggcttgtttctagttttgtttggaccaaactcgacagaggagccaatgtcaaaactacaatttgagtttgtgactttgaaagctgagattacttgaaagaattttaaatgcagcagtgttcattttgtaacatctgagttgtgtgatactggcttattgagtcaccgatagtttttccttaaaactaaaatgtactattgcaagtaaaaaccaaacaaaaaaaattcattcaaacttgcattataaccaagtaaacgtgatcaatagaaacttgcaaaatcacaaccaaaatatttgtccaaacaatatgtagtcaaaacagtctgttgtgttcataaaaaagtcatataacgatacaccaaaaagaaagaaacggaggtgtttggttggtagtatattcctcctcctcctctttcttcttctccctcctcactatatattttgaagtttattaacaagaaccaaaaaaagtcacactcgaagtctcacaccacaccaaccacttcttcttcttcttcttcttctacataaaacctaacgcc

SEQ ID NO: 5751 - DNA, 3000 bp, Unknown
  misc_feature (1)..( 3000): cDNA_ID_1829199_gDNA_ID_1620814_Annot_ID_50639 3000 nt of promoter + ATG
gaagcttaattatgaaaagccaatgcctattcaaacacaagcactccctatcatcatgagcggtcgagactgcattggggttgcaaaaaccggttcaggtaaaacccttggttttgttttgccaatgctgaggcatattaaagatcagcctcccgttgaagctggtgatgggccaattggtcttgtaatggcacctactagggagcttgttcagcagattcacagcgatatcagaaagttttctaagccattgggtataagatgcgtccctgtgtatggaggatcaggagttgcccagcaaattagtgaacttaagcgaggtactgagattgttgtgtgcactcctgggagaatgattgatatcctttgcacaagcagtgggaaaatcactaatctgcgaagagtcacatttttggtaatggatgaagctgatcgtatgtttgacatgggttttgagcctcaaattactcgtattattcagaacattcgaccggaacgccaaactgtgcttttttctgccacttttccacgccaagttgaaactttggcacgtaaagtcttgaacaagcctgtagaaatacaggtcggtggaaggagtgttgtgaataaggatataactcagttagttgaagtcagaccggagagtgataggttccttagacttctggaacttcttggggaatggtctgagaaagggaaaattctggtctttgttcagtcgcaggaaaaatgtgatgccttgtatagggatatgattaaatctagttacccttgtctgtctcttcacgggggtaaggatcagaccgatcgtgaatcaactatatctgattttaagaacgatgtctgcaatttgttgattgccacaagtgttgctgctaggggtctagatgtgaaagagcttgagttggttgtaaactttgatgcgccgaaccactatgaagattatgtgcatcgcgttggcaggacaggcagggcagggcgtaagggctgtgctgtgacatttatctccgaggatgatgcaaaatatgcaccagatttagtcaaggccctggagctttctgagcagccagttcctgatgatctgaaagcacttgctgatggtttcatggtgaaagtgaaacagggtattgagcaagctcatggaactggctatggtggtagtggctttaaattcaacgaagaggaggaagaagttagaaaagcagcaaagaaagcacaagcaaaggagtatggctttgaggaagacaagtctgactcagaagatgagaatgatgtagtaagaaaggcaggtggtggtgagatctcacagcagcaggctacttttgctcagatagccgccattgctgctgctgccaaagctgctgctgctgctccagtgagtgctcctgtgacagctaaccaattactggcaaatggtggcgggcttgctgccatgccaggtgtccttccggttactgttcctacccttcctagtgaaggggcaggccgtgctgcagccatggttgctgccatgaatctgcaacataatctggcaaagattcaagctgatgcaatgcctgagcactatgaagcagaacttgaaatcaatgacttcccacaaaatgctcgttggaaggtcacccataaagaaactttgggtccaatatcagagtggactggagctgctattaccaccaggggtcagttttatcctacaggacgtataccgggacctggggaacggaagctgtacttattcattgaagggcctagcgaaaaatcagttaagcacgcaaaagctgaactcaagcgtgttcttgaagacattacgaatcaggccatgtcctcacttcctggaggagcatccgggagatactcagtcctttaatgtaagtcgagaattctagtccaatttacaatctttggtgataaatttatgctaaatgctttgctttagccttgcatgcagactattttctttcttacataactcttttaatctcaaagttcagacttatggatctttagtttctgtcttttaacaggaaagcaacaatgaggtgtgtgattataagggattcaaatcactgagagttttattaaacaagtattattggttgatgttgtggaatacaatctctgcacaattgctaaatctttttacagacttgaacttgtcgtgattagagacatggtctcataatgcttgttgtttctcatcccgcaactcttttcctctttttaattctattctctttttctttgtcatgtttatacaatgtcctcgatgggtttgctaatgagcattaccgcgtggtggctgttaaatgatgggtaaaatctagtttgatggaggttgtgtttggcactatgcttgttagtttcttgcatcaagttccccgttttacagcttttggcatcttttctgcaggggaaatctgtgaaacatgaagctcccggagagatgatatgtaattttttgtgatagacaaggcaaagcttttcttacctctccaatgggtaagacttggagcttattcagttatgtttctggatcctatgtctgtgaagctccgactatatctgcttgaccaatattcttttgagggaaaagtttacatctactgggggagttcatggacttgcgacctacttaaacgctgaaggatgctttccgagtaatggtaaaaggggatggtgcattcagtatgtagtagacataggatttatgaatcaagatagtagtactcaagttttgtggatcaaaatttaaaactaatgcttctgaaacagtgaaacagatggtctattatgtgttgatgataaacggctattctcgtagacaatagagaagcttgatccacatgaaaggttgttggtggccaaagtcgatttgtgtgaccgcacctttatcaaacaatgaacataaagaagtgtcagaatgttaagagtaatttctggaaaagggatggaacattctattcactccaaatgttagagtagcattgcacaactctaatg

SEQ ID NO: 5752 - DNA, 3000 bp, Unknown
  misc_feature (1)..( 3000): cDNA_ID_1829191_gDNA_ID_1620814_Annot_ID_50641 3000 nt of promoter + ATG
ttctaggatttcacccgtggtagtatttaattgtataattatattttaattgtcattctaggatttcactcctaattctatcgcaaattattatcaacccaaaccagtcaattctaaaatatcacccgtagtaaaccatcccatattaatatcgattcaaactcgtcaattataggatttcactcgtggtagtatttaattgtataattatattttgattgtcattctaggatttaactcctacttctatcgtaaattcttatcaacccaaacagtcaattataaaatttcacccgtagtataaagtttaaatatttataatgtttaaatttattataaaagaatcaaaatgtgttttaaaaaaattaaagttttaagttttttttttttaatattgttaattttgtttagtgtttaagattatgtaattatattatgattgttattatatgtttttttccatagcatactatcccatgttattatccactcaaacccgtcacaccatataaccccgtcccgtgaaattaaacacaaatttgtcattttattataaattttaaatatttataaaattagaaacttcaaaaaagattaatattgacccaaacttcatcattgaattttgagtgttatatctaagatttctctcgcagtatatcgtcccgtattaatatcttttatattgtttaaatttcttgtaatatttaatttataattttttaaactttttaaagtttcaattttttaaaataaataaccctagtaaaacaaaccattttaattttggacacctcataaatcaagtttcatgctcattcgtaatcgaaatcattttggtcctttttatagtatggctcttgaccattgtccaatttttttaagcgatatagaacattctaaaatcgtaattattatccacccaaacccgtcctaccatataatccagtcccgtgaaattaaacataattttgtcattttcttataaatttcaatattataaaatttgaaacttaaaaaaatacaatatcgacccaatttttaagatttttcctgtaatatatcatctcgtattaatatattttttctatatttgtaatgtttaaatttcttgtaaaattcaatttataatttttaaaactttataagttttaaaattataaatatttaaagcattttttaaagataaactttataaaaagtttttaaaattataatatttaacatttgataaagttataatatttataattttttgaaacattttaaagttttaattctttaaaataaaaaatccgagtaaaatcggataactattttaattttggacgcctgataaatcaagcttcatgctcattcataatcagaatcattttggtccttttataatatgggtctgaaccattgtccaatttttctaagcgatgttggacattgtacacatattatttcttcataggttgaataatatatgtccgttttaaaaaatttgaattacatcatattcagaaaaaaatataatattttattaactatatatattttatataaattcaaaataaataaagtataagatcaaataaaattgaaagaagaattatatatttatgtttaaattaggtagaaatattttaggaaattagttaaggtaaataagaaatatggttagtttagagatattgtttatattaaatttggtaattaaatcattaattttcgtttttaattattagtttttaggtaacttttccaaaaactaatgttatccaagatcagaactgaattaaacatgttatccaggatctgaacagagttaagccgagtaaaacccacccatttgaattaattgttgaattatggctcaaatcttcaacattatcttcaaaaatcccctccaaacatgtatatatagatatttccattatgatatagttttcacatcttaactccaaatcatgaaacctaaattttatttccaagtctcaacatcatatattttaattatcatcttgaacttcttgttaaaaatataaaattaattcataaacttttctataaacctaagttttttaatattttttgtatcgtatttatactaatttcgatcttctttgtttcctccgtaatcgttgtcgtaatttcgtaaacctaaatttcatatagctcctttcttctatgtatatatgttttgtacaatgtttcatatatataataacaccctttggcaaaaaaaaaaaaaaaactttttcaatgtttatctttcgtggttattacatatagtagaaatcccaacattcaacaacaataaaaggttacaaatcctatatttaccaaaaattaagaaagtctaaaaagactaatagatacaaaaagaagaaaagaaattgtttactttttgagtgtaaaacaaattaaagttaaaaaccacataacatcccccatcccatcttttttactaataccttcctccattaacataagattgtctctcctctttcgaattgtctctcctttttcagctctctctctgtatctccttcttcttcttcttcctccagcttctttcaatttctccggctgctaaaccctagcgcgccgtcggagtccctgcgttctcataccaacctttactcgccgtcgccgtcgctgcagaactggtaagcatatgtttttttttgctgctctctgtattctatggaagctgaaaggtcttctcggcttgtttatctgtggtagttttgattaggatgaggttttgtagtaatagagtgagtgagtttgctccaattcttaattgcgtttagagatagaagagagagagagagagaagctatagtttccaggcggagaagaaagacaattcctttttgtttaatctggaatcaccaatagttagttatatacagtttttttatcttcttcgtttttttcttctggatttgttcttttgtccttgtcttgctgtgactgactactccacaacagaaatcgaagcttaag

SEQ ID NO: 5753 - DNA, 3000 bp, Unknown
  misc_feature (1)..( 3000): cDNA_ID_2168553_gDNA_ID_1620814_Annot_ID_169170 3000 nt of promoter + ATG
catgcatgcacgtttttggttatttagaaatacggatatttcagttaacattacagtgcagttcgattcgattagttcggttaaagtataattcaagtcttacaggaaatgtttttggttttctttacttcagattcttttcgtttaatttggttctgctcctaagtcctaattatgaatttatgatcatcagattatactctctagctgcttttgtttctgcaccttcgagagttttggtgtctattataattttctgacggatgtgttacatataaacttttttaatcctgttttatcttcatttatcaagtacatgtagatcaaactaactcgcaaaattcacaccaagaaaaaagaaaaaaaaaaaactaactcacaaaagtgccctttcagagagagttgaggttgagggcctgaggcaggttcaattgggcttggaagaacgcttaatttggtttgtaaagcccataatatgtcattacacaatacatgacccagacggatgtagctagctcgtattagcccatacggatcaaataaagtaataaactcattagacgaagatggcagtttcgtaaatacgaattattttacgttcgttatatgtaaaatagggatcgatgaacctggattgatcctagtactgttaaagagacacgtaggatagtgactcttgtcggctaaatacttttatagcgtaatctttgtccgtatacttggtttggttcctttgaaaagctccttcccgaaatcgaggacctaactccgatgaatgatgtcgatcgtatcttcatgcgtattcatagtttattcatttctctgagattatatcattcattcaccttcttgtctttacttttttgctccttgtctttacccttatacgaagagtccttttaaattttcggatgacaatttcgaattgataagtaacttccatacaactcctcaccatttcggagggttagtcgaccatatcactactctaatggctatgcgtggtttactattcgtatgtatgcttgtggataattctacaaacaaaaaaaaaaattgttacttcaaatttaaagttcgttacacttgggttatactattagggttaattactcgaacttatttcttttaacaaaacctagagtttttcttgtttctattgtaccatatatataaacgtgtttgttagtgaaattgtttaatgcatgaaaaactcgatatcttttcctgactttcttaatagttttatatttgtgagttaatatctttctatctccatattatttgtgtgttgtttttgtgttgtcaaaacaaataaaatcatgagagatagcttaaacataattttgttaccctttttttaaagtcaattaagagtaagcaaatatttaatctttttgttattaagaattgataagattttattgaatatattaattcatctgcatcctagatttttataaaatagttcattgtaaaaagtgaatcgccgagttatatatgcgtatctaatctaagtatcatcacgacgttcagctctaatctaaatcaaaccacaaagtaatcaatattgtaattttctaagtttaaggacttcttttgttttggaagcgtgtaattaattaagggccaaacatgtttttccattggctcttctttgccaccagaagcaagttgcaaaagagagtgaagcacccaaattgattaaaaagaattaaaaaaaaaaaaagggttcaaatcctttccatcgtgctgcaaattgcactttttgttggtcatccaaattgctcattaatcttcgttaaaaaatatataacatttgggtgatgattaaaaaagtagactgtagtggacccgccacacctaatcgtacccaatgataatccggtaaggttcggttccatttgtccgcattcccaaacttagaaaatgaaacggaaagaaaaacataatgtgttttagtttttatcttaaaaaactatagacaaaaactcaaaacatttttcggattgtataccaataaatagagagaatgtagttttaacctcgcaagtctcaactgatgatccgactcgtccaaagcatgtttatagatttaactagtttagctaccattcaaatttgatttttaggttaccgtccatttttataggaccaattctataagaagtggtttagatatcgggtagattttcattttccgacttcatgcatgatttagttcttaaaacttgcatgtttggcttctactaagacaaccctcgtttttctgacgactcacgtggtcaaacggtgcacaaaggtcacgtgaggcacgtgcgttctactgtttaaacgcctcttctcttttgcttcttttttgccaatttgaaagagataagaatacaaattaaaaagatgtttcttccactttcctcatcgccgttctatgctcactttctttggtcggatttccaattacattgttaactattagtggtcacataattttttcatgacgtggatcacacttctctttttacatgtctatctccttaattagtatctttaattgctttcgacatcaaaagctaatatctatgttttacactctattagttgtttaatattcacaatattcaatatcaaatctcaccgtatttggaaaatgtttattagttcagtacatgacacactcgtaatcaacattttgaattttttaaaatgttttatttgttcagtacatgacacactcgtacatttcgaattgcttactttttttgctttaacaacgtccaagtacaaaggagattctctaagactacaggatttgactttttaccagagaatctatcaggttaaaaacgatacacacacacacacacaaatttacaaaaacaactctagtctctctacttctaaaagtttaataatttgtttttaactttgaactacaaacgaactccatttattgtttcttggatcacgttaagtaacgtggcagctgaacgttgacctatg

SEQ ID NO: 5754 - DNA, 3000 bp, Unknown
  misc_feature (1)..( 3000): cDNA_ID_1829187_gDNA_ID_1620814_Annot_ID_50643 3000 nt of promoter + ATG
cagttactgtcgcgtggaattcaatgttagagaactcattagagaaaactaagttaagttcttggtatccataagagtttatatatttaccaaacatggaataaaagcagttctaaattgttccgacaaacacgtaaactgatcaaaacatatatatattttttttttttcccaacgaccaaaatatctcgtaaggatgcagtagatatgtgaggttcggaggcactaaagaatatcaatttggtttcggttcataattgatcccttgatgatcttgtagctgttattgttcttctttttattgtggctagctattgcttcttcagcctacgcccctactccatatatgtatctccccagtctgctctcatgcgatcacgaaagggtatctcttttagggaaatccaacaactggtgaataaaatgctggctctttatatctagaaaaaaaaacatcaaacaaaaagtaaaggtcgtgagactaaatatcataccctctttaacaataaataatatgggcaaaaaattgtgatgatttagggataccgtacccatcaatcagtatgctaatttaacttctatatttatgttcttttgttttttttgctttcttttctcatcaatcaaaataccacgagccagatgtatataagatattaatgccatccttaaagtttatacttacatagcgattctattctctacagcacctttaaattttgtttttatagttttgaaagtgtaagcaatgagttcgctgtatataaaatgaaaaaaaaaatctagctagtcttgaactctcagttctcattaattttatgtacgttagttaaaaagtattgatttatcaattcgtggctttttttaaaccaagtaaagaacatgtattataacgagtttctaactcagctaagtttgattatattttctccaaaaactcgaacatcaatcgggtgaagactttcccccttctatcaggaattcagaatttaatttactaaatatcatactttggaaatattattcattgatagttcatagttgataatgaatatatggatgcataaaatccttagataagaaaacaatcaacaagtctaatcgagctctttatatcaaattatcaatcaaatcatactttttagtttgtcgcacggaatctaacatgccccgcatgttagctttgtacaagaagaaatacgtaacgatgagttgcacattattagagtaaattaaattgctttagttaaaatatttggcaatgatcttctgataaagtggatagatgaaaacgcccctgatattcttttctattttttctatattaaatcttaaaattgtgcctcatttgttttggtaaaaaataaataaattatttttatatcttaaaaaaaacgatttgattccattgacctacagtattgcgtattgtatgtcgtatgataataaatctacattactcgaaaaataaatatgagaatctaagtaccatgatatgattaatggtttgtgataacattatcactatgttatcatttggattcaaacctaaataaaatacgtgaacctaactaagtattcatcaatctatttatctaacaatataatggactgtaaatttgttctacagatcaataattacatggtcatatccttaatcatagcgttttgtggccatctcttctatttctctatatattattaagctatatatgaaggtatagtatatatatttataaataactcttacgactttgacttgacatttgattctacatagacaactctaatagtatgaattgaaaccagtattttattgctcctatcaacctggagaccttggtttcccaaatatacctatgttactataaaaataatatgtgtataataatattttttacctacgtaatgatgctcacaagtcacaagtttttacaggaactagtaaaaatcaatttattatcagtggtctccagactctccactatatttttttttataaacaaactcaaaagtagtgtgatcaatcagaaattacgggtcaactttttcgataatgcccaatcccattctcacatctttggcgacttgtgatctaccaccaccccatccaccaatttttaaattattttataataataaaaagccggagaataaaacaaaaccaagtgtcttttcaaaactaaatgcctatttattgtttttttctagtcaatttgtggagaaaacctatcaaactaaaaggtgttagaaaatattgttggattaaatattataatttgtatatagtaaacattaaaaggtgattttattgacgtataataatctaaaaaccaaaaataaaggtgatatattgaatagaatttaactatttagtaggaaggaagcaacatgggcaaattgccaatttggtttataaaggagcccacatgtttaccttactattttggactttctgagttagtgtcgaaggcctttgggcccataaatggaccccacaaaaagacaggacaaaatatccttagaactcgccacgtagatatctcgacgtggagatctgaccacgtgtacagtttatgtcctgattttcgcaagagtgacgtggacgggtcatgatccgcttatattttcactttgtctacaagccaagtatattaaattgggcctcaaattagcccaatcaatatatcagtacattattaatcaaaggcccaagtctcacgctagcgatcgtcgacaacgattttgagtctttctccgaagtcgccggaatcgtattcgccgatccaattgtcgcatagaaactgtcatctccggcgagagactgatctctggtaagtcaattcgatttcgcgcgttttataacttctggtattttcgtattccgttgctgagagaaaatattgcagagattgcttaacatgaagctgatactttaaccgattcatcaaattgacaaaaatcgttttcttctttagggattgatacagaactcgtagg

SEQ ID NO: 5755 - DNA, 3000 bp, Unknown
  misc_feature (1)..( 3000): cDNA_ID_1596158_gDNA_ID_1620814_Annot_ID_169187 3000 nt of promoter + ATG
aattatttttaaatacctttctattattattcttgcgattatcattgaaatatcaaactagttaatgttcatttaagatggaagaattggccaagaagatggacaaattaatctgatgttattgatgttaaattaactaacaatttttaattttagttaaaacgagagtttaatcgccgacactaaaaaataaatattcataaacgacaaaactaaatatcataatttatcgttgcttgaaaatttaacttgcatggaataaagaacaacgaacaatattatttaagttggtagaacccgccaagatgcgtcgttaaaaaaatagttaaattgattgtcttgatgttaaactcactaaaatactaaaaagtacaaatatgtaaaaatgagttttttcattcataaaaactaacctaatatttgtcacatttaatttatatttaaataaatcatttttagcaactaatacataaatatgctaaatttatctcaaaaaatattttgtttcaagattatattgttatcttttttaaccagcgtaaatatccagcttttttgtataacgttaaaaacagtatttataacactgtttaaaatctgatcactaatcaaattcttttttagttttttttttctatatcgcgagttggaaaccttatgaaattagtagttgttgagtactactccctctttttcactatactggatgttttagagtttaattttttttcattatataagatgttttacaaattaatgtatttgattttttacgactttttagattatgtagtttttttgtgattggttgaatttttaaaaatttaatattgaattattgttttagaaaaaaaatcttaaactatctgcttttaactcaaatatcctatatattgaaaatgaggatataatatcttatgatatctcaattagcagaagggaccaaaaagaaacagcaatgaaggtgaaaaacattaggaccggattagtgtggaacatgcaaatacagaggatccacgttataaatcaccgtcgtcgcaggttaataacgtgttcattgttatttttccgtaatcttatttgcttactcatttcatttttcgaaagtcagtatatgtcacacactttgaatcatagattggtgattggtggggataaaaatatcgtgcgaatatcttacaggaattcacatgtaatcatgtggcttaataacctcagctataaacataaaacacacacacacacaatagtggatctactataaatttgcggctaaaaaatattatagattttggaaggaaattacaaagattactatacaataataacaataaaactactatttaaaacaaaaattaaaaattaagagacagatggggtttgatgcaataggagacgaacatggcgtcaatgagagggcatgtgatttataatattagtgctttgtcactttctcacgtacctttttatgccctaccaattacttctcctctactagtattttttatattaattacaacacaatcaattttagaaaaatgcaacattgatagcatatacgtatagttttctaattctgtgacaagttgatgattttcttttctcagcacaaggctatttgagaatatataaaaatatctaacgtcctcttcatatttattaacgctggaatgagattttatgtgaaaaaagaaaactttggatagatattacatatgtacgagtacgacctagaaaaatatgacaatggtctttttcttgatagagttcgtgctcccaaatcatttgagcatttccgaccacgtggctccacctcaaacggatcttatgatatgttttattatcattttattttcattcttatatattttgttgattttttccctgcataagaaataacaatcatttatttctttttgtacaagcagtcaagtagatgtcctgtaaagttagaaccagtgagttttcaactgtaactttaacatgattcatgttttaaatgaatccactttatgaaaaatatggtgttaatttagatcatacttcgtagtggttggtgggtcatcattataaaaatcaagtttttacgtattaggttcttaaattttatatatcttattcaacaattagctgattaaaaactaagtaaaacgaagatccttatcctcctgacattgttatcagaaatcttggtggattgacaggtcaaactttgttctttacagaataaatatcttataaaaaaaaacagaaatatacttcaccgtaatctcatgttttgtgaattttatattgtctcattaagaattatgtttaaacaatttagaacagtgaacaaaagaagagctaattataatcaactaaacttcaacattcattcataccataaaaggttagtgattatgggccgcaaatccatgatttgtatattgttcaattaagattggtgatcaaaacatttttcatcagttaattacatagttggcccacttttgggctttcttattgttgaggttggcattttatcattgaggccttccttaaatgattacctctgaccgagacagaggtttctagttctgcacataattaaacaaaccatataccgcagggccggctcagaataataaaggacctagagctggaaaaaaaaattagttctcatttttgtgttttgttatatatcaaaatttttggaccctaactataatagatttacttttaaaaaaaaagaaattttgggtagaccctgtgcctcagctcctccagcacatgtgtaaagccggcctgcatatacgattagtacttggagtcaaagtaacctcatggaaagacaaaactaagcttaaagacacagactttacacaagttacagattcagactactttactctaaagcaaaaagagcgacctctatcgagtctccagcctatataaacaggctcttctcttccatttcctcttatcaagtgacaaaagaaaaacaaacgtactcaaatg

SEQ ID NO: 5756 - DNA, 3000 bp, Unknown
  misc_feature (1)..( 3000): cDNA_ID_2990593_gDNA_ID_1620814_Annot_ID_169184 3000 nt of promoter + ATG
aacctatcaaactaaaaggtgttagaaaatattgttggattaaatattataatttgtatatagtaaacattaaaaggtgattttattgacgtataataatctaaaaaccaaaaataaaggtgatatattgaatagaatttaactatttagtaggaaggaagcaacatgggcaaattgccaatttggtttataaaggagcccacatgtttaccttactattttggactttctgagttagtgtcgaaggcctttgggcccataaatggaccccacaaaaagacaggacaaaatatccttagaactcgccacgtagatatctcgacgtggagatctgaccacgtgtacagtttatgtcctgattttcgcaagagtgacgtggacgggtcatgatccgcttatattttcactttgtctacaagccaagtatattaaattgggcctcaaattagcccaatcaatatatcagtacattattaatcaaaggcccaagtctcacgctagcgatcgtcgacaacgattttgagtctttctccgaagtcgccggaatcgtattcgccgatccaattgtcgcatagaaactgtcatctccggcgagagactgatctctggtaagtcaattcgatttcgcgcgttttataacttctggtattttcgtattccgttgctgagagaaaatattgcagagattgcttaacatgaagctgatactttaaccgattcatcaaattgacaaaaatcgttttcttctttagggattgatacagaactcgtaggatgatcgatttacgctataaagaatgctacttgctcatctgtcttatcgtcttcataaattttgtgacttgttatagcgatgagagactgtaagtgttgttgaaaaacctcacattatccccaaactcatcaatttggattcttttattggtactgtagaaatgatgttatcaggtttctcttaggtttggtggaaaaactttatatgctgggaaggaactttggaaagagacactgccattgaaatctggatctcgagtttacaaattacaagggcttaagtcgaactcttggtatgaagtcaagatatcatacccagcttctgtatgtcaaatttgttatcttgttctatgttcttatgtttccaaggttcttgtgcttgttaaaaatctcatccttttttgttatgataacagataccggctctattttcgctgcaattactgaagaacggtgtaatgggtttgaaggttaaccatatgaggagattactaaacactgagaagttgatcttcaaaacagaaagtattgaagaagttgataacaaggtattgccatcttcttcagttagttcctaaaacttagaaagaagaacgaatacaagtttaggagtttgtttctgatttaggagggattgtatgttttggtgacggtggaacctgaaggaatcgtggctataccaaatgttaaagaaagaccgtccatcatttacaacataggcaagcttttttttctacttactatctcatcaatcttcttcttttcacaacataagaacttgtattaagtgtagtgcttcttctagagtctgaaaactctcatgttgacagtttgtgaagaacagctcttaggcatccctcactcaagctggtcagtggtggttttagtagttttgtgtctcgttgtcgcgttgattcttccccggttcctcccatcttatcttctgatcaaagatgtagatcgtgatcgttaagaagaagcatggttaatacagtttcctcacctctttgttttgttactctgttcgcattttgatgtttgttcatctaattttgtatggtttttagttcttacatgtccactgcctcattcatataccttaccttaccacaccgcactcaaagaagagtatataagtctacatgtgttagattgatttcatgtttttcagacgcgggaagtcctattctgaacttgtatggtttgatcgtatatagttaagtaacgcttatccgtttgaatttcaatccaacaaacaacattccacaagatgaataactctaaagtacaccgtattatcttttgggaatagggagtaattaattaaaagcaaagaggttacacatatttttaataaataaatgaatttttttttgttcatataatgtatgaaataaccgttaatttcccggcagtaatccgctaaaataactccaaccaactgtgataataaaagaaccaaactaggattcggacaaaaccacaatttgtgttctaattaattacagcgttaatcataattactagatgatttcgagtgggacccagggtgaagaacaactccttttgttttctctctctctcgaagaatttatgaatcataatcacgcatcatcgtcttcgtcatcaccaacttcttcaccatcatcatgaatgttaaaacttccataaacaaatccttccttgtccccttgtatttttctatctaaatccctaaaaccactcaaaatcatccctctttctctcctccccattttccccaacgcttgattcgaattcgtctctctcgttttctgttgttctaccaattgagcaaccctagaatcattcttgtgtacctaccggaaccgagtcttctcttcttccgtggcacatctttcaaagttttaaaccccttttcccctaacttcttttcatttttctgtttttttcccgggaaattttctctctctctctctattttttgtttctctcgtcatgatcattacttgtcaagtatgatcctttattaggtttctttggggccgatctcactttttctgtttctcaccctcttctcttcgaaggcccttgtaaaccctagaatctcctcttttcaaatttatatgttctgtttcttcatcttcaggtttaatcattcaatctatctctagggtttaccgggtcaagtcttaggatctgtctctatccatacttcatcaaagtttccgtctttggttctaatcc

SEQ ID NO: 5757 - DNA, 3000 bp, Unknown; identical to SEQ ID NO: 5754
  misc_feature (1)..( 3000): cDNA_ID_2168580_gDNA_ID_1620814_Annot_ID_169183 3000 nt of promoter + ATG

SEQ ID NO: 5758 - DNA, 3000 bp, Unknown; identical to SEQ ID NO: 5752
  misc_feature (1)..( 3000): cDNA_ID_2168576_gDNA_ID_1620814_Annot_ID_169181 3000 nt of promoter + ATG

SEQ ID NO: 5759 - DNA, 3000 bp, Unknown; identical to SEQ ID NO: 5750
  misc_feature (1)..( 3000): cDNA_ID_1829207_gDNA_ID_1620814_Annot_ID_169176 3000 nt of promoter + ATG

SEQ ID NO: 5760 - DNA, 3000 bp, Unknown; identical to SEQ ID NO: 5749
  misc_feature (1)..( 3000): cDNA_ID_1829211_gDNA_ID_1620814_Annot_ID_169175 3000 nt of promoter + ATG

SEQ ID NO: 5761 - DNA, 3000 bp, Unknown; identical to SEQ ID NO: 5748
  misc_feature (1)..( 3000): cDNA_ID_2168563_gDNA_ID_1620814_Annot_ID_169173 3000 nt of promoter + ATG

SEQ ID NO: 5762 - DNA, 3000 bp, Unknown; identical to SEQ ID NO: 5747
  misc_feature (1)..( 3000): cDNA_ID_1829219_gDNA_ID_1620814_Annot_ID_169172 3000 nt of promoter + ATG

SEQ ID NO: 5763 - DNA, 3000 bp, Unknown; identical to SEQ ID NO: 5756
  misc_feature (1)..( 3000): cDNA_ID_1829184_gDNA_ID_1620814_Annot_ID_50644 3000 nt of promoter + ATG

SEQ ID NO: 5764 - DNA, 3000 bp, Unknown
  misc_feature (1)..( 3000): cDNA_ID_1829176_gDNA_ID_1620814_Annot_ID_50646 3000 nt of promoter + ATG
atgttcccattttcctacaacttcctctcgtttaaaagaataagctttatcaatgagaataagacatacaaaacatttgggccttatactttttaaaaggcccaaaagtgcttcaacaagacggcacgtggtgagccaggtgacaagtgatacctccaaatgcggttatttgcgggacccacgtggtagccacgtgtagcaagcaaaggacccccatcctcttttgcatttttctccttacaccaaacatttctttctcgcagagaaatctctcttctcttcacctccatcatcctcctcaacccaaaaacatcacgacgaaattaaaaaaggtaaaatctgccactgagaattttctgtcatgcttaagcttcgaatttcttctcgttttttctccatgaatgttgcttgaattttcacaatcgctggacttgtaaggttgaaattgcataatccctatttatcttctgtggtgggaacaatgtgggatcgatttttgctgtaaaaagtacaaactggttcgtattcaagcgtagtaacctttagatttaaggaaaattgttgactttgagctaactagtgaaaaattgttggattgcgatattttctgggtaaaaattggttttttttttttttttgtattgtgaagagtatatatgaagcagagttactaatctttctcaaaatatcaacatagtcttttcaaatgtagattttgctgttaataagtgaagtttttagggtttaatttgaagatgttttctccttagtaatgataaggcaaaacattatggagactaaagtcattgttagaaaagggttaaacttaagagatctagggactaaaatgatggagattttcaatgctatgactaaattggcaaatttgagacacttaattatgtcctgtaactatgtttttggaatgtccttattgcttccatttgtgacaatgttgccactttcatatgtaatgcaggttcattgatatcgaagatatgagtctgtatagcgacggattatcgagtgatcagtatttcttggttaatttcatcatgagcaactacttgggtcctgatgtctattctgataacccaagatgttcatcttctcaaagattagctagaggtttgccaccttacactttgatgcacattggatcttcctctctaactgtttcccagctacagaacttgtactataatgtactcagaaacgccaagtccagcctccttcttcatccagacatgatttatatgtatctcaagggatatctaccattggaaccaagtggaaagtttcctcagttcacgcattttttcccgacgaatcttcacccgcagaaaaggtattccccgagccacgagattgtgaaaggaattgttgttattgatgatcctgcagtagggttcataaacaaggaagaactccaaaggttcagatgcttgtcgcgtttggacgacctgaaaatcgatagagtcacgtctttatctcctcgggttaatctggatgaaagccgggaaactgagcaggactgttcaagaaatggtgatgcgacagctaatggagttgtcactaacgaggactacaattcatctggtgagcttcaagaaacgtgcaagagaaaggaaggggaagacgcggttgctagttgcgtaatcagtgaaccagaaagactttcgggagacataccagaaagccagggaatgaagcaggactgttcaagaaacggagaatctgcattcagtggaattgtctctgaccaagactactattcatttgtaaagcttccagaaacatgcaagcgaaagaacaaggaagaagaagcagttactggtcatgctgttagtggaacgagtaaaacccctgaaagatttcgtgagacatacaagagaagacggttcaagaactcatcaaaaaaggcaacaaacaagaatggtgaaactcttatggaaagagaaaaaacagataagcctatacctttttcttcggagatgaaggaaagcgatgcagaaccgtcggttgtaactactggaacagccagtaaagaaactctaggatcatctgttggtgttgttgacattggtgtcaacaaggttgcttacttttttcaggttgctttgcccggtgtccgcaaagattacggtattattacactttgttgcacatctaactacttccatacacgccacatcgggtctaagtgctaacacatgaattggtttggtccttttgtgtgcaggtgaattcagctgtgagattgaatcagatggaaaggttatactggagggatcaactacaagaggcgaaaaaaatatcaagagacattctcgggtgttcgagatgaatatccggaagctgtgtccgcctggaccattcaagctgtgctttaacctcccgggaccagttgatccgcggctattctctcctaacttccgatcagatggtatcttcgagggagtcatcatccgacacaaaaactcttaattaaaccggaggttcctatacaagtttagaacttaggatctatgtagatcttttatctttatgttactggacatagaaggaaagcgaatcaaacagcatgcaaggataaatcttttacttttaggacgtgactctgtagattttgcatgattttgctaaatatccgttttcacaatgatttcatcaaactgagaatccgttaatattgtttctgtgttggcagtgttgctgttacttgttagtagttactgttctcatttctcaataagtgatcaaaccgaaactaaaacagtactgaaccgacggtttaatttggctagaaaaattcaaacaattatgatgttgtgccttaatgtgacaacatagataaaaagaagctcttacaaacaaactgactaagtcttcctcggagtcaaaatcataagcatattccatgctcataccaataaagtaatgaaaatgacaaagagacttattaatcgttataaagatccttgttctgtttcactcatc

SEQ ID NO: 5765 - DNA, 3000 bp, Unknown; identical to SEQ ID NO: 5755
  misc_feature (1)..( 3000): cDNA_ID_1596158_gDNA_ID_1620814_Annot_ID_50647 3000 nt of promoter + ATG

SEQ ID NO: 5766 - DNA, 3000 bp, Unknown
  misc_feature (1)..( 3000): cDNA_ID_1829172_gDNA_ID_1620814_Annot_ID_50648 3000 nt of promoter + ATG
ggtacgtgagaaagtgacaaagcactaatattataaatcacatgccctctcattgacgccatgttcgtctcctattgcatcaaaccccatctgtctcttaatttttaatttttgttttaaatagtagttttattgttattattgtatagtaatctttgtaatttccttccaaaatctataatattttttagccgcaaatttatagtagatccactattgtgtgtgtgtgtgttttatgtttatagctgaggttattaagccacatgattacatgtgaattcctgtaagatattcgcacgatatttttatccccaccaatcaccaatctatgattcaaagtgtgtgacatatactgactttcgaaaaatgaaatgagtaagcaaataagattacggaaaaataacaatgaacacgttattaacctgcgacgacggtgatttataacgtggatcctctgtatttgcatgttccacactaatccggtcctaatgtttttcaccttcattgctgtttctttttggtcccttctgctaattgagatatcataagatattatatcctcattttcaatatataggatatttgagttaaaagcagatagtttaagattttttttctaaaacaataattcaatattaaatttttaaaaattcaaccaatcacaaaaaaactacataatctaaaaagtcgtaaaaaatcaaatacattaatttgtaaaacatcttatataatgaaaaaaaattaaactctaaaacatccagtatagtgaaaaagagggagtagtactcaacaactactaatttcataaggtttccaactcgcgatatagaaaaaaaaaactaaaaaagaatttgattagtgatcagattttaaacagtgttataaatactgtttttaacgttatacaaaaaagctggatatttacgctggttaaaaaagataacaatataatcttgaaacaaaatattttttgagataaatttagcatatttatgtattagttgctaaaaatgatttatttaaatataaattaaatgtgacaaatattaggttagtttttatgaatgaaaaaactcatttttacatatttgtactttttagtattttagtgagtttaacatcaagacaatcaatttaactatttttttaacgacgcatcttggcgggttctaccaacttaaataatattgttcgttgttctttattccatgcaagttaaattttcaagcaacgataaattatgatatttagttttgtcgtttatgaatatttattttttagtgtcggcgattaaactctcgttttaactaaaattaaaaattgttagttaatttaacatcaataacatcagattaatttgtccatcttcttggccaattcttccatcttaaatgaacattaactagtttgatatttcaatgataatcgcaagaataataatagaaaggtatttaaaaataatttcttagtatttggggagtaaaacataaatactattttttttttgtcaacacattaatactagtattaaatttgccaaattttatgacacatattggagtgttcttccattttaaatgattttttgttctctcacgtaaattgtttattaaagaaaccacaaaatatgatatcgattcttcattttctggttttaactattgcaccctcatttttaagtaaaagaaattgctaatataacttttttttttggtaatagtttagtttataaagaaaatctaccctttcaattatctatcaatgttgctttttaatcaatttttggaaggtgtatctctgcaaaatataaataaactttgtttttctagtaaatttagagaaaacaatgactaaaaaggtccaacttttacacgaaagtgatagacatccggaccactcttaactcttaatataaatttgaaaaatctgactttcatattattttttatctaaacgaaaaaaccaaaatgttagtcgtaatccatgttgcaatgaacggaccccataaataattatcctcccaaaaatctactcataaacgagtcatgacaatgattttttaattaatattcagatattgtttcctcagatctctaatttttccccagatacttccatccgaaaaaaattgataaaataaaaaagctagattttattaatttattttaactagtcaattttttttcttttatgagtttctaactttctatataaagtttcgaaaacattaccaataatcgtcgtaaatcactccccacctcattcatatttttagccgccagaagaactgattggtgtaaaatccaattttcttgctgttgtgagttttcacttctccgaggtaaaaaaactaatcccggcggtgagaatctcttgggaacttgctctgaacgaaactttttgttgcaataattgtaaccaaaaaataaagaagacaaaatctttttgtccttattgtagattccatcgccggagcctgtccgaaaataaaatttaactaaacttggcaaaattcattcaaaacgagtccaaatcaaatcaacccctatttcaacgcctctttttctccctgatttatatatcggagagatttcaaggcaaagctttctcatttcctcgtaattgccggcgaattctactaaaggtgagacctttttcattttcccagaaagtgaagcaatctttttggggttttattctctttagctttcttaactgatcaaactaaaaaagcaattctgttttttctttcttccctcctataggttagttactctgcatttttgattactgtttgatgatttttatgtttagggtttttaattgagcaaattcttctgggtttatcagattttatatttttgtgaattggttaagatttagatctggatttagatttttctttgtttcatggttgactgaaagtttgaaacttcaaatggagaatcactgaatctgactgatttgaattttggtggtgtttctagagtttgttgagca

SEQ ID NO: 5767 - DNA, 2702 bp, Unknown
  misc_feature (1)..( 2702): cDNA_ID_2053825_gDNA_ID_1620816_Annot_ID_169250 3000 nt of promoter + ATG
gaattcattgagatttgggagggaactactagagactggcgtacagagaagtattggtgacggacaaaaaacagccttaaagagaaccttggttacctacaacaccaccgagagcacctaaactactatatttgatagacccgaatactaaggtggctgaactcctcacaggacctccacaacaatgggatgatcaataggtacatcaatacattgattcgtcggaccattatcccattcacaaaattttcattccttatgatctcaaagatgactcatatatctggaattacatgaaagatggtaatttcaccgtcaaatcttgattggagggctcttaacctcagtcttgaagaagacacatcacaagctctgcttacagttaacacagatatcccccaaaaatatggcgtctccaaattgttcaaaaacttaagcatttcttgtggagattttttcatccaaagcaattgggatctctgaaaatttaagacgacgaaacattaatgtcaacccatattgtccacgatgctgcaatgaggtagaaacaaataatcatgcaatgttcacatgtccacaggtgaaacaaatatggagagcttcaggaattcccacacatgtactttgagcccagacgagacaatgaagaataaagtccgctatttattaacgttgcatgaggatacaaaggttgagacaaccggacgacttttaccattttggctaatgtggcgtatttggaagagccgaaatgatttagtcttcaacaaaagagcaaaggatacaactgatatagtcaaacaagcgtccctcgacacaaaggaatggctagataacatgcgacccccagaaagaaatacccgagaccaactatcatctacatcgagaaaggctaattggcaaaagcctccagtaggatgggtcaagtgtaactacgatgtctctcactatgaaggaaagataaccgcgggtcttggctggatcatcaggaattcacacggcacatgtatggactgcggaatggggaaatttcaaggacgccaaacaattgaagaaggagaatgtactgcactcatttgggctatacaatgcgcatagggacttggttataggaaggtaatattcgagggtgacagcgtcactgttactagtatcatcaatagcatagagcccaatccaagattacgacattatcttgatttcatacatcaatggcgtaaagcttttaacttcatcgagttcaaattccgacatcaagaaaacaacgtctatgctgatgtcttggtcaagacagctaccaagagtaatacaaactttgagttatatcgaatatgtcctaggtttttatagccgtttgtatacaatgatgtaaaacatttgcattgataataatattggaaggaaaaagaaaaaaatctaaacgaaataaaaaatattaattctatatttctaagtaaactcttattcattatgtttaatattttgttactacatttatactctaaaacttcaaaaagtatttaagttaattatcttatgcttttgctgataaaacaaaaagtaagaaaataattctataggattttgtttactcacaagtgtaaaataattctttatgttttgtagtcaattttaacaaactttaattacaatgaagtaactaacgtcattacatacacatcttgtacaaaaaagaaatatcaaatcatctctctcttaactttattggatgaaagttcacatcaacaaaacaaacaataattattaataatttgtatgtagtaaaatcttataaatacaaaactgtaaagcaaactaaaaattatggaagtaagaacatatcaattattatgtcatgttaaaaccgattgcaccattttattgtatctatgaacatcatctattagttttttttagctggcaaacaagatcctaatttttgtataaaactttagcaataatgcattacaaaaaccttctgattgtcataaaagattaaattaagaaataagaatgaagactagagagaataaaactcgaaacaagagttttcttattgctttctctttctcttctctttttctctgttttctctatatcttataaatgaatgaaatgagttatatatagtagagcttacttagctaggaagtaaattacttagagaatagtaatggataaacatcatccatatcttaaagatgaagtaatggataaacatcatccatattttaagaaggaaataatggataaacatcatctatatcttaaggaagaaataatggataaacatcatccatatcttatggatagagatgaatgatggataatgacatccatacttatccggtttataacactgatcaaaataataccattattctacgttctctaatcgtgaatcctcataattgagatatacagttttattttttctgaagacaataatctacacttaatatacttgaataaaaaatttatttgtcttaccataaaaagaaagagtaaaatattgattttgatctcaacaaaatcatataaccgaagccgaaggatgtgaaacaaatgggcttctagtttgggcccaaatagcctaaagcgaagataaagcccataaaaacctaaaatgtaagcgagcttgcttgttgctcctataaattcataaaccctaacttcgttttcctctcgcagacgcagccatg

SEQ ID NO: 5768 - DNA, 3000 bp, Unknown
  misc_feature (1)..( 3000): cDNA_ID_2053800_gDNA_ID_1620816_Annot_ID_169260 3000 nt of promoter + ATG
ccaagcaaaggttttctctattaaagacgaaggttgtatcacaggtttcttagatggattaacacgattgacaacattaaagatatctttcaccaggattattagatgaatttgaacaagcctatttatcaatgtcaaaacaatgcaagaatggagtccacgaccattcttctcagcagagttaggtgacttaaataagcatttaattactatatgttagtttcttaatcatgatcaactaattcgggttcaaagacggaaacgtattgcgtatcaaaaagcccatgcaccatagcgtcatagcgacatagatatatataatcttcgttcactaggcgagtcaacattatacactacaagagtttgccatttctcggaggtaccaagtggcgaacagctcctgatgaaggagacctatcacctatgtgtagctgctagcgttgaatgacacgcagttatctataccagatttgctgattgtctcctagcagtaatcgtcgaagatgagtgatgaccaagcaacaagatgcacgttgtacttccaaatggagtgtcttgtgatgatgaccagaagagatcatattcatatcacatgttcatggatctactccgtttctgtagtttttaaatgttaaaattcaaccgagcactaatatattttgaactatttatgactaaaataacaaagtctcttgcccaaggtgtgtgtgccattgttgaggatttatcaattaacttattatcattaaaaatagaaattaagactaatgttctgttaatgtttttgttgcatcacaagttcaccacttaattcaaatccgcatattcatgttttagaagaaataaatagttatatatatctttagttatatttgataaaatgtattgataaaataattgtttgtgaattgcgaaaaaatgatggaagttttttcctccactttctgactaaaattttaaataatgtttcgattccagagataagttaaattctcagaatttttcgacatggtgtagattgatcatagtagtctcatgttctaaaaataaaagatatccattttggtgaactttagtcgcgtgtttgaaattagagccggtcatctgagtctaaaggctaaaataattaattttataaaattagaaacgacttgtagaagaaaaaatcgaacttggtacttagacaccaatttgaaagaccacttttactcactataacaactttttgtcaattccataattgtttgtaccgaagtcgtaacaacgaataagtaaagaattttcggggagacgaaatatcttttcttagctgacgaacgagaacggtaaacaacagaccgatcgaatagttacaagtaatttctatcgatcggcaacgtaacatgactcgaattgagaacaaaacgaaccgtcaactgaaacgaaccgagaacaaaaacaaaccgagaacaaaacgaactgagaacaataacaaaccgagaacaaaaacgaactgaatgacaatgcgttttagtccaaatataactctgattctctgagtatcatcttgtgtgccactatttcggaaatagtgctttatttataggacaagctttctgactttcttcggcaaattaccgttttgcccttcaggtttagtggactgatttggtggagaaattgctcattaaactcttaaatattagtttgggccaaataatatggagagggtgaagcccatgtccaacaataagccccccctagttcatcagacgagaattttgttgagtctggtgagcgtgtttcttgagtcggaatatgtcgatttggtcttaaacagagattacgccgtaaatatatttttttgaattttatgccttgtgcacgtttttctaggagcacggaactctgatgatttatgtcgtggatacgctttctccagagtgcataatttttttcggtggacaatatcccaagaatttttactgtagataatttcttcactatatatatctcatccttttcacttctcaccatttcaccaaaaggtaaatcatctttttctctcttctttatctctttctttccttcttgcgattggttgtggttcgtttcctccttagttcggcgaagcttgattcaaactgtggttcagcttgaatttcggatttggtgtgatttgttgagacattgatttgatgaggctggtttggcaaagcgttggtttgcagcggctggttcgttgagatggagactttgatttggaggttcaattgccgttcggtttgaagaggaggagcttcgttcggtttacagcggcttggttcggtgaaatccttgttcagcgaggagaagaagcgtgcggatcggttcggcgagagggagaagcttgaatcggtgaggagcttgcttggtgatctttagttcgggcctaaggtcttggtttggcgagaaggagaagtttgcggttcgatcggggagcttgtatcggctagttcggtgagaagaggagaaagagctggttcggttcggcgagaagggggaacttgaattggcggcaaaatttgacaatctatttggactctcttggttcggtgataagaggaggagtaagcctggttaagaggaggaggaggaagcttggttcggtgagaagtgagaagaaggaaccggtttggtgagaagaggaagaaacctaccggttcagccaaagaagaaggaaaccggttcggtgagaggaagagatttgcggttcggtttggtaggacaaccggtctggtttgggacgatggaccgtagttggtttgatttgaatggttatggaactaaccaagatgcttatcacgtgataaatgacggtttgtcgattgaagattttgaagggcgtgatttagctggttttctggcgaagttgatgatgggaatttgggagacattgaggcttttttaaatgtaaatcatgcggttataagtcatggtatcgtaaagactatgagtcagcttgaagattaccgtagagaa

SEQ ID NO: 5769 - DNA, 3000 bp, Unknown
  misc_feature (1)..( 3000): cDNA_ID_3078389_gDNA_ID_1620816_Annot_ID_169266 3000 nt of promoter + ATG
ccttttgcctatctgaaataagagtaaaaccatctccatcttgcagttttaaatcacttttcagcttcttaataaaccacaaccaagaatctatgttttcagtttccacgactgcccacgcaaccggatagaattggttgttggcatttcttcctacagctgctaagagttgtcctttcatattattttttaaaaaacatccatctatgccaattattgggcgacaatacgcaagccaagttttccggagagcatcaaagcacacatagaatttatcaaacttgactataccatctatagtgattatctcaacttccactgttgaaccaagatttgttctacaacaacaaatttcaaagttagataagcttgtaaacaaaaacaagaatcaaattcaaaatcgatttaaagatattttacttactccaaaagttgttccttgtaatcatgtattctagcaaactgctcatcatattcatcttgaatcattttcaatgcttttcctctagctttctgacactggttactggaggcaattagtgagtaccgctcttcaatagctttttgcattgctttcactttgaatgttggatcttgcctaatgtcattcaagaacatatctgcgatgatccgactcttaagaactttgcaaaacccgtcctttgtacatgcatgctcatcaatgaatgttttcaccatgtacactccaattttttcatcataagcacaataaattctgaatttgcagttacctccaatagaacaccttacttcagatttctctgatccccatcttgtgaacttaatattgactccttccttaagagcatagtcaatcacagcttccttaaactcagctatactgtcaaagacttgctctattctaatatcgccactacctttcttgcatctaacatatcgtctttcaccttcctcacaatctgagttcagaggggtactttcatcattatcatgctcttcttcatcaacaaagcctgctaagttctgctcaactcttgcttccatgtcaataaaaactctatcacactcagaaccatccccaacagctccatcaccagcagctccatcaccaatagaaccatcaccaacagctctatccacatgagaaccatcaccaacaactctatcaacatgagaaccatctccaacatcaccattttcttctttctccaaaaaaatatcgacagcttttgtccaaactgcggcaagacacattctttgaaagttttgatctccattgcacaattgcttaagctctgaatattcctcatatggaagcttataccaaattcgtttatgccaaatagattcgttcaatgactccatcaaattagtcaatactgcttgtggtttgctttcaaggctgagaatacctcctccaacataactaactttaatcccattctctacaacaaagttcccaccgtagtagcattgaaaaactgcatcttcagtgctgaataagaaagaaataaagtgagtttttggttgtgacattttatcgaacacttggtgttcataaaattacatatcgcttatcaactaaaaaaactccacaatctcatctaaactatagaaataccaaaggaattcattacattttataacaatacactcgcaatttgatgatttgataaaaaaaaaacctaaattttataaaccataaatttgaatgaaaattacctcattttccttcctcacaatagagattatgagctggaactcctattccactaatataagctcttcacgatagatgcttatggaacattgtcgtcgtgaaagaaaaagaaagaaaaaagaagaaggtgatttaagacgtcaaaaacgacgtcgttttacaaaaatttgtttgtctcttctttcatctaaaacgacgtcgtgtcatacgtggcctccacgtgagcaaccgttaacggtcttataacaccgtcacggcttaggcatgtattgacatgaatggtgtgagtttgggatttgaatttgaaaatttggtttgttaatgtatggatttgcacaacaataaacgttgggtatgaattgaacatactactttagctggggtatgaaatgaccgtttttcctagtatcaacaccatataaactctaaaagtctctcatgtgctgacacatcagctttttcaagtattctcagcttgacacctctgcaaaatcaacaaccaattagaacatttcatttaatacagatcatttgtgttgaccaattaaatcttagtatttgtaaatgtcattctattattaaaactaaattaaaattagcccagtccaaattcttttaaaagtaaactttctatgttacaacaaattttacattagcccagcccaagttgtttaaaaactatttttcctatgttattaactacatgggcctatactttctaaaacatgatatttagagaatctaaaagaagaaaagcaaaaacaaaataggacacctacaacacgtatcgtagatagagcgttaggttggttcaaagctctctcaacaacagccaagcccgcggccacacgtatcgtagatgacgttaggttggttcataaagggtaagttactaacacaatgttactttggtatggaataaacaaaagtgattgtacctaaggttgtaaaaccagggtcaatccttgcacgggtcaagagggtcttgacgacttcatctcagctcatgtacagctgaagacacatctttctatcaaattttggacctgcatcaatcatttagaaaatgttttcttaacaaataattgaaaacttacaagaaagtctatacacacaaaaaaagaatagttcatcatcattcctcttaactctattaaacgaggttttaacgcgccctcaattgtttctctcgtgcgattccgaaagcgaaaatctaggtcaccccattttcttcttccgccgctgctcctagtctcgttcccttggttggtccctcgccgactggtgggtctcccccg

SEQ ID NO: 5770 - DNA, 3000 bp, Unknown
  misc_feature (1)..( 3000): cDNA_ID_3593709_gDNA_ID_1620816_Annot_ID_169277 3000 nt of promoter + ATG
acgggttttattttgtaattgggttatatggtggatgtatttgaatcaatatttataaaattttaaaatattattaatatgctgttttaacaggggttaaaacttcagttttttaacaattgtctcatggattcgtggtataacgttacttaataacaattataaactgtaaaatataaatattttataaaaataaaatttgcaaattttaatatatattactttcaaaaaataaatcgtcccgcggtataccgcggattaaaatctagttcgttttattcttataacatagggaaatgtaaacattagcatataatttattgctgctaacaagcgaagcatgtttttgtagtttttttttttttgaatgaaacaatcttttgtagtttacaggtacccctttgcttgtaacttctagcaatttttctttctttattgtctgagttttgaaaattattaattagtgcagtgccttctactagactttactaaaagttaagagagcattattgtcaagtcatttctatcgatttcatgctttttctacccatcttatttggtcggtaaacaaaatgcgtagccaaaataatctgtttgattaaaatctcttatatgtttttatcctaatataaattcattgtatccgatacttgatacaaaatctgttatgtaaaacttcatttaacatatagtcaagcaaaagcaataaacgataacgcttgttactctttgtgatactttcatacattttttgtaatgctattttcttggtgatattaatatattataactagtttcattactttgtttttatttttgtgattgataacctactaatggcaaaccttttaagacaaagccaagaactctaattggtgagagaaagctctctaagtctaaaagtaatagtaaacaaatggtaacttacaaaattaactttactcaaactgacatatgcataaataaagtgaaagttataaattttaaatttacctaattttaaagtgttgatattgacctaatttttgttcagttagaaagatagttgataatattttaatcatatacgtatgtaatacatcaactatgttcacgttcacgtacgtatttaaatattcactttcataacaatacttgaatattttactctaaattggtttcgttgacatgcgggaatatagttatcacgataatcatatgacgcaattccatttaaaagtattaatatatttcataacaatgttaaataaataatcaatgataacatcatatatgtatgattggattccccaactatggaatatgattttctttacttgcttgcctaattttaatatcttttaacaactctcggttacctaattttgtaccaattattatgatttatgttaatagttaaccacaagaaaattttgtcttctgatttgcgaaattagttaactttgacttctgatttgcgaaaaaatatcagaaatatataagtgaagaattaaacaaatttgattagtattctcgaagaattgtaatatttactgaatgttttggatctgtttcatttgacccttgatgtaacgattgggacatagtcagccatctcataacccatttcatcatgtacccaattttattaaatatttttttctgacaataatctatcgtttatgatcaaatcttaacatcatttaaaactatttaagttctttaaattgttatggtcaatcgagaagatatatttgtctaattatatcaaatatatcatgtagctgtcgttctttagtataatcccaaacaatattgttctaaatcaaacaattttatttttcaataatttattcaaagaacctacattttaaaaacatacataaaatcaacaaaatatcgtggagaaatgtaataattgaaatttaatgattttatatcaaccacaaaagaccaaacccaacaaagacgatgtcgtgctacttctttgtcctttctcctgccacaagataaaaaatgaacagagacaaacaacgtaccagaaaaaaaagtttaactattcttaaaaatagtttcaactccaatccttaattgttccattaaatggattctgatatttttctctcgtcgctccattagctacttctccggtggatactttagccagcttttctcgagcgtttatccttacgtgccatttcaaaggtctaaatctttctctctctttatacatgtaagaagaatatgattggtctgtgacaagatctaaatgaaagctgaagagaaacctttcttgggttctgtcttttttcctttctacttctgaatccaagtaaaccaaggtttttagttcttgatataaaaagtaaaaaaaaaattgtgtaaaattggtcgtcactttttcacttcgggtgatatgaagatttttgctcctttgtctcaaatttagaaatttttatcttatcaaacttatttttgaagcaaatctatggagattaagagtgtttgcttcttttagccttttaggtgttcatattaatatatagtattaagcaacaacatgctgagaaagttctcattttttttgtttcttgttagttttccctgaaaaagcaaaagagaagaatcttggaatcttgcaacttgttttacatttccttattaagaaatatctctagatgtgttttctttaaacagaaactctctttcccttcaagtcaaaatcatgtacatcaaagataaatcttagaagcttgtttcaatggaattccatgtcagacttatgaatattccacttgaagttcaatttttgttgttgtttttcaaagtgtctagattctcaacactatgactcatcttcttacttttaagatttaacctctgttttatgatctccttgtagcactatcaaagtttctaaagaagttttggtttcttgttttttaaggatcatctgaagcttaaggagaaagtttctcgttgttgcttgatatattaatcttttggggtatttaaaagatg

SEQ ID NO: 5771 - DNA, 3000 bp, Unknown
  misc_feature (1)..( 3000): cDNA_ID_2033485_gDNA_ID_1620816_Annot_ID_169271 3000 nt of promoter + ATG
ctatggatacactatatgatttttaaaacttaaatacgcattccctcggaccagtctatatgttacatatggctctttttatgctgtccctaagagactcaactcgcaaaacatttcaagatgttttctaaaataaagtttatgtcattcgtttctaagaaaaaaaaagcaatttttcgttctttatgcacatacattaattgttgaacacatacatgaacttgagataatcaaatattttttcaaggatacattaacatatctttttagtctttttagcaacctgaacgtatcaatgaaaataaaaccatatattagaagtatttttggaatctctcaagatttttggtgaaaataaaacatatcaattgtttataacttttcatactccttttttttgttactatattaaaacatgaaaggctattcaaatcaacgaaatttaaagtgtagttgattgaaacgcaaccttttaaggttggagtggttgaaacattaacttacatgaacgtaaaatcgaatattgacctgaggctgaaaatcgaataagagacaggaaagtgccaactaatcgcatattaatttcccagatatcatccgttcaatcattatttaaatattttagtgataaactagatattgaaaaagtctcaaccagtcaccttttcatgagtgacattataaaccaagatatatattgagcatcgtataaatggccagcctatattacctgtacaaaaattataaatataagacaactatataaaagttaaagatatatattaaacgtacggactatcttattcttgagattaagtgtgtattgacaggtggtggaacaaatatgagttttaattagtttctctaattaatatataaactcatatttagttctatctcctgttgaagcacacattaatttaaataagattttcaatagtagactagcagccacatagatatatatgtatataatacaaataaagttacaggcgtcttaataaaatttgaaggataatgaatttattttttaggataaatacaaacttagtagtcattagcaacatatgtgactaatgaataaacttaaagatcagtccacaaatttattttatcagtaataaataacaaatgagaagcgatttatactgatatgtaaagattttgtgcaaaatgaaacttaaaaatcgtctattaaagtttaaaaaatgtaaatcaatcctatgaaattcaaaataataagcaatatatcatatttttataattttatatatattgtaaccattttcacgatcatatatatttgtttttaagatattgttgaactcttcatcttaaggggttcaatttgatatattatctatcaaaaatttaaaatttgataatagtaaaataaaagtatattacgtattattttaaacttcataagattattttatattttttgaggtgaaaaataaaaattgccagacaaatttaagagttttttcaataattatgctaacgtattacgaaaaagaagtatatctacattttaaattttcaacaatccagatagaagtttggttacgtatgcatgtctgtctaaagaaaatgtcaaacttctgacgatccgatccgtacacgaagtacataaatttgagtatgtaaatatttaagttttaaaactgagaaaagtattaattacttttgttagaacttatcaataataggtgcatgcaataaatagtaaatataaaactttctaaccttatcttaatacttcaacgaaacatcccaacgtgaaagcatggtctatgctgttacttgtgacgttgcaaatgcaaactttccaacaaaattttcagattaaatttaaaatatttattaattattgtttacgtaattttaccttttatatatgaaaaatacaaaatctttatataaaatccaatataaaatataatataagtatataactcatttttataattttatatacgttttcaccattatatatatttatttttaaaaattttaaaaatataactaaattttttatctcgaaaattttgatttgatatattatttattaaaattttataataataataataaaaaaagattatattatatattattttaaattataaaattattttgtactttttagacgtacatatatatatataaaattataaaaataaacgtctttgaggttttttttttcacaaaacttttttagataactgtttacacgacatcgtttttaaaatagcaatttgtgatctgccacgacgatgtcgcgtactatccacgtcagacaaacgaatatgatttcttcaatatatttattttttaatatatgcttttttggacaaactaatattttcgatttttatcatatagttttgggtcaaacagataggtacggtcgatgcacgttacgtgggtcccgcaagtggtgcagacctaacttcggtacagttatgtaataatcacctgctccaaatcctctgctcctaacaataaagcctccataactaaccactaatatatatccacgtggataattaaccacgcgtaaagatctcaaactccaaaaaccaaacacattgtttccgtactagtaagattaggggtgttttcgtcatttcgtgttattcctgtcacgcttctttcttcttcttcgtcttcctcatttttttcttctcctttatatatcagaaaaaataaaaatttagagagaggttcggttttgttttttcccaccggaaagtctccgactaatcggcgtgatgaacccgaaactgcaaaccgttaacccaattcggatcttagaaaaaccggttcaccactctctactctatctccgagctgtgtttctctttattccgacttaaaaaaaaagcttcaaatttttccgatttcgaatccattagagaaaacacatttctttctccttaaaaagtttctttttgttgttgttgtgtgtttatttctggttctgttgcaaaaatg

SEQ ID NO: 5772 - DNA, 3000 bp, Unknown
  misc_feature (1)..( 3000): cDNA_ID_2053783_gDNA_ID_1620816_Annot_ID_169264 3000 nt of promoter + ATG
tacttttctttttcttattaatacattaaagtgataagataaatttggaactttgcctaaacttgaatatggaagatcttaaacaatactgaatataaaatggagggtgtaccaatttataaaagctattactatgttataaatgttttcctcataatgttcatgaaggattaatctatatatatatataataaatataatttatatcgatattattaaaattctaaataataataaataattttattaatatttaatttaatattttttcaaaccaaatttcaatcttacacattcaattttttatacactttatattccaagtgtattcagtgtcattaaatactacctattgaaaatctaatttaaatgtaaacataaactggtgtacgtaaaaaaatcaaacagtatagatttcaaaagaattatatttaattgagaaaaagtaaagtcctacccgctctctggctctctgtcgcacaacttccttcgcacggcagccctccgccgcctaatgggctctccactgccttcggtggggactccgtcctcttccgttcaaccctctcagacttcttagccttctcagacagcctcacatgttcgaagtagtgactgggtctctaaggtaaaaggccatcctatgtctatctctgattttcagcctgatttttgtgtgaaaaacggagctgcaagtgttactatccctcccgaagtcgtaacgaattcagtgtcattgtggaagtgttttgtggttggttttttcatgggggatgccccacatgttggatctgtgcacgctactgtaaaccgaatctggactgtccttgaaaaatcttcaaagattgatgtttaattcttaaacaagactactgttttgtttagaatagaaagtgagaggattagagaccatgttctgaaacgctgctactggcatattgcgaacattcccttggtaatcaatgagtggaacccaacgtctgctaatgcactgccggatctttcagcgatgccattgtgggtggatttgaaagaagttccagcgcatctctactcccatgaaggcttgagttttctctctagcacgactgggaaatttgtcaagcttcatcctaatactgaacgatgtttaaggttggatgtggctagaattctagtagaggtgaacctgcagaagcctttggttgaacgtatatgtttttcagatgagtcggggaatgaaacaacagttcatgttgaaaaagtcaacaaaaatccagttaaggcagtcgaggtattgatagcagcagtgacatcagaggtacatgatagttctgacaaatctggccagtggactgaggtgcctcgcaaaagcccgcatacatctcccagtcgggacagtggtaagaaagaacaaagtcatggagtcattttctctaattgttttgaggctcttggtagcatcggagaagagggtaaagcttgagagaaacagtgaagaaggtgtagtgaacgtctgtcatccaagaagaaggggagctggttgaatctggctctgaagatgatgcaactgtaaaagtagtagcggatgatggattaggggaagaccaaggaaaagagtttaccaagaaggttcattcgggtgtcggacgacacagaaatcgctcttgtggccctcctaagcctatagtgaatagaaaggatccaaaaacaacaaaatccactttctcacggaagtaatgtcgtcctttttctcttggaacacgcgggggttcaatcaacctcgcaagcataatattgttcgcagttggattcaagcagttcgtccttcttttggtagtttcctcgagacaagagttcaggaaaccaactctctatcggttttacaatctattttacctggatggtcatacctcacaaactatgatcaccaccggctaggtcgtacctgggtagattcttctgatgttgtggtaatgactctcctcacaaagagttctcagcacatcacttgttctgtccaaattgtgggtacgagggagcaatttatttgttctttcgtctacgcatctaattttccttcagaaagacgtattttatggggggacttgtgtcaacttcgttctgctcttattcccccaacaacttcatggattgtctctggagatttaaatgaagtgttatctttctctgaccactcacgtgtgatggatttttctctcaatgattcggggatgagagacttccagaatgtagtgtcttactgtgatttggctgaccttcattcttcggggccaacttttacctggacaaataatcaagaggagaaccctattgggaaaaaacttgatagagctctgataaatccaatatggttatccactttcctttactcttatgcggcctttgaagcaggaggcatctccgatcattcccggtgtgtagttcatctctcttctccgcttttttaacttcctggcaagtcaccaacagtttctttccacagtggcgcaagtctggtatgccactccttcgcttttccattttcgagtggccatgtctctgatccataaaaaattaaagagcttaaaagttcaccttagagagttgaaccggactcagtatggggacctgcctcaaaagacaaaagacgcttacgggaccttctgcactttacaaactgaaactttacatgatccttccccgagcaatgtggcagcagttaaagaggcctcagaccgctggcacactctagcaagcctcaaaccttgaagaaagtttcttcaaacaaaaatcttgtgtgaactagctgagatgcgggttccaaaacacttcgtattttcaccgggttgctcaagccaatgcttcccgtaatgctatcaagtcgctcacgacggtttctggagaagtttgcacaaatccagaagctatcaaagcggaggctgctcgccacttttgaactttcttcaatcaagaagatcccagtttatccacgtctcgccggacctcctctcagatcta

SEQ ID NO: 5773 - DNA, 3000 bp, Unknown
  misc_feature (1)..( 3000): cDNA_ID_2053810_gDNA_ID_1620816_Annot_ID_169256 3000 nt of promoter + ATG
ttttgacagcctttcaggcagagatgggcactaatgcaaatgagcacggcttatcatcctcagacagatgggcaatctgagaggactatccagacgcttgaggatatgttgcggatatgtgtcttggattggggaggtcattgggcggatcacttgagtttgcttataacaacagctatcaggcgagtattgggatggctcctttcgaggcgttgtacgggaggccatgctggacaccgttatgctgacccaagtgggggagaggagcatatatggtgcagcttatgttcaagagaccacaaagaggatctgggttcttaagctcaacatgaaggaagctcaggatcgacagcggaattatgctgacaagaggaggagagagcttgagtttgaggttggggatagagtgtatctcaagatggccatgttgcgaggtccgaacaggtctatctcagacactaagttgagtccaaggtacatgggtccgttcaggattgttgagagggtgggaccagtggcatacaggttagagttgtcaaatgttatgcttgcgtttcacaaggtctttcatgtgtcgatgctgaggaagtgtcttcacaaggatgatgaggtgttggctaagattccaaaggatcttcagcccaacatgactttggaggcgagaccagtgagggttatcgagaggaggatcaaagaacttcggcggaagaagattcctttgatcaaagttctgtgggactgcgatggtgtgacagaggagatttgggagccaaaggcgaggatgaaggcaaggttcaagaagtggttcgagaagcaggttgctgcatgagtttgcctttccttggtttccagttttagtgttgttgagtttttgagcttctgagttgttgttcttatttctctttcatttgtattttcgtttggagttgtaacgattatgacatttgatgatttataagatgggtatttttttcttcttatatttgacttgagttgtcttatttaagaatgtgttgtgcggtttccaaaaatggaaagtttccaagaaaggacttgtctatttttggaaagtttgagtaaacaacctaagagagaggtgtgtttacgagatggtcgggggttggtcataaggatgttctcgaggggatatgatggatggtgaggcataaaggtgtcttacgcgaatccatgagagagtctggagatatgctcggaagcgtttagtattgtttgctcgaggaacatgagggtcccaacgacttgtgaggagcggtttatgctcctgaggtaccagtaacttgagggacttggtgtctttagagtgcgaggggaacggtggcttcgggtgacgatccgagagcgagttttgaggtactattttctccaagtatcgtaactcgatgactttgtggctgagagtgagccgacacaaatcagggtttgactttgagtggggaagataatacgtgtgatatccaagataccgtaggccgaggcctgagagtgacggtttatgctcgaagattgcggtctgagagtggagagtgagttgtaagcaacaatgactagtaaatcgtgagtataacgactggatagagagacctagaggggtcgggttggagggagtgcggaccgtagtgatggttgcacggagttcctcggagtggaagggagaagctagattcgaggacgaatctatgttagtgggagagaattgtaacgctcgtgaaccggaaaatcggttagggtttgtatttaaatcgtccggtttaatcagttgagttaattggaaagcctagagtgtgcctataaaagaatgaaactcgaaattagggctttacttagccctttttcgttttataaaagagaaaaagagagagaaggagaagaaccataatcgttagggtttgggaggaaacggttttgatatatcaaatcgttgtcaaaggtaacgaaatttggtagagttattaccaagtcttttatcgtcattctccatattacagaattggattcggatttatattcgttgagttatttgcagtttcgtgagacacgttttctcagacgcgaattaggacaagcggggattgtaactgaaatcgtggtttcgtctggtttccgatcggcacgaaattttgtgacgtctaaggctagcgtttcaccggagggatatgatagttaacagttggtttgtatttttagggtttcgtctttgagactgtttgtttctgtttttcatgtccagtttgcttcaaggttgcttttggttgtgacttgttgtaggacgtttttggactgtttcagacgcaaggagagtctctcccgggtttaattgttgttagaatcaatttgttaaggtgagtgcgtgaccatgagcttatctgagcgattggattgtatgatttgttttgtgtgatgatatgtaggtgcagtgaatgtgtttttgggtgaattgttcaatgactggtttgtttatgttgtatttgtgattataccccttttttttgcttgtgtgtatagctcgtagatgagaggatcgcctcactaagtatttgtgataatacttacgcatctctttctttttggtgcagataaagataaagtgtgatcgtgaaatcatgatctagaaactcatttggtttattttagtgttttggttattagaaccgattagggttgtgttaggattgttagtcatttttggttttgttggttgaattatttatttattcataaaatagtatttttgatttgcggtttaattgttgctttattggttggcttaattaaatatttatgaaaatatttaattatgtttttaaaaaaaaatggtcgggttgtttcagttagtttctagttcccttgtctaatctctttatatattgtaaaattctcatcccagtgatataacaaaatctctttaaaccttaatacgatatgtcgatctctaacctaaaacagtagccgacccctttatatttttttacaattcccatg

SEQ ID NO: 5774 - DNA, 3000 bp, Unknown
  misc_feature (1)..( 3000): cDNA_ID_1020960_gDNA_ID_1620816_Annot_ID_169251 3000 nt of promoter + ATG
agtcatcagattcaccttcgacggtagtaactccttcaacttctccaccagctggtcatcttggttctccatcagatacaccttcatcggtagtgtctccttcaacttctctgccagctggtcaacttggtgccccaccggctacaccatcaatggtagtgtctccttcaacttctccaccagctggtcatcttggttccccatcagatacaccttcatcgttagtttctccttcaacttctccaccagctggtcatcttggttctccatcagatacaccttcatcggtagtgactccttcagcttctccttctacttcaccatcagcttctccttctgtttcaccatcagcttttccttctgcttcaccatcagcttcaccatcagcttctccttcagtttctccttctgcttcaccatcagcttctccacaaagctcaatcggttgagatggattcgaaaacagcggctaactagaggtcatgtgatatgtgattcctactctaaaagccaaaaaaaaaaaaaaaaaaaaaatctagaaggtgaacaatatttgacaaacctcatttttggttttaatatatttaggaaaactttgagaacttcagattcagtattatatggtctgccaaattaatgtgaatatgagtagctttgtaaattcatgttaaatatcgtcatgtatatatgttgtaaaatttattaaaattatttagtacatcttgtttccgatgtatcttttgcactttttacgtttgcactttattcatatatagaagtttcatacaatatacaacacttaattttgactgcaccatggtgtttgaggacattcgggtcccttagcaagtaagtaatagactcatgcagcaataacattgtcataggattctagagatgaatatgaggtatttggttgtcattgtttagctaaaaaattagcaaaaacattaaatgtaaaattcgttaaaagcatttagttgtccgatgaatagcaaaaaaaaatattattattaagagagggatttattaatacgaactaaaataatactataaatatagctatttagcttaactaaagtgacttccacttcctgcgattaacaattcccataaaaaatatgtcattgtaattcttggaaacacttttgtataccaaaagaccaaggagaatattccatgatgaagcgtttaacttgatcacatgttatcatcgtcattagctcaaatcttcaaagatctaaaagtactacatctcttatgactcaaacttggcaatcactatgtatagtatatattctgatttagccactacacttagacgtatatgcttgctttgctttagtttaggttgaacctgatgttattgtgtatgattagaaattttggatcatgtatgtcccttgcttggatcaacatacataacttctttacaaaagctaatcaacgaatagaaatctgtttaaaaaaaatgatttggtcacctaagtcaccaaaattcggtcaaagatcttaagagaaccccacagttaagagtgtttggatggaataatttcaggataggtgaccttcctgaataatttgtagggccaataacaaatctttaaaacttcttagaacgtgacacgaccgcccaacagtggtgtgtccatatattcgagaagacgtgagatccactggtaggaattagagcagcagcaatggtggtatctattgtgagtcccttataataaaaataattaaaaagtgagggacagaggagagaggggctccaaaaacccttatttaaggaacagtctcaacaccaaatatatacatgtagcttttttagtagtcaaactctattaaaaaattaaaatataataacaacattagaatatatttttttattttttttttagggactctcatagtccctcccgttggaggtggtcttacaagttgtcttcggaaaaaaaaagttaaagaacagaaaattgatgttttcgtagtaaaagaaaaaatatatatactaaatgacctttgactgcaagaatgaagtaaataactatggttgaaaattatgagagaggaaaacacttttagacacaatatatgacatttttatcctcaaccacacatgatcttaccttcttcttctttcttgcttgcaaacttccccttccatcgcatatcaacaacatacttctctattctttctctcaccaacacaaatctctctctctctccaacaaattttctcgccaatatttctgaattttctttatacgtatgccgtcgacgaatctctccacccatctccttctagttctccctcctctatcacgaatctcttcatttctttgaaactttcaacctttgttgtttatttgtccactggatctcatattattaatactccatgctatttaacaaagtcacatataatatttgtctaacaaaaccccatgaaatatgtaaatatttatcatgttatccaataaaaacccatgtaattttgtaacaattctatatatttgctaatatttcgtgttttataagagaattgcatgcattttataaatatatcatactatttcagaaaaacacattattttagaaaaatatatatatagtgtatatatatcgtttatgtatttaaaagaattacataatttttgtaaatatatcatgctattttaaacaaatacatataaactttataactaaagctaatgctattttctgacacaagatcattctctcaattcttttccatttcatagttagtttgtaatattaccctaaaagaaaaaagaaaagggcaaaaaccctaaaaattcaataaaacggtaatagcaatcaactccttaatctcttaatgatttataaaacgtaccgaaacaaaacttaattattataactagcccctatagttattttaaataaatatctgtctaataaatttgaccaaacccttaagatctaattttctctgtttgatttgtcctctcaacaatg

SEQ ID NO: 5775 - DNA, 3000 bp, Unknown
  misc_feature (1)..( 3000): cDNA_ID_2053819_gDNA_ID_1620816_Annot_ID_169253 3000 nt of promoter + ATG
tcaaattttttactttctttgttttgattgggagaaaaatacccaaaaaagaaatagaatgacaaaaaatggtctatgaactgtaaagaataacaattgttttccttatatatatatagatattttcagatatatatattcataaaaagaaagcttgaatagcttaagtgttattttttttcttaaatgagactactgaactatatggtaaaatatatccaagatacattcatgaatgctgacgtattcccacaaaatattcaagttacattcaacattttataatttttcaaattgtaagtctgtaaataatttaatctgagatgattctatttaagcttaaatacgaagatgatcaaaaaaaaaactaaggggagttttttttttcagtgaaacaaattgtttctacctattaggaagagattttttaaatatatttgagaaatcttatgtcgtccattatttctaaagattgtaagtggtttcattaatctgttttataatacttataagatagttttatcgaaatacattatatatttaagctttatatatctagcaaccattaattttctattttcctctttacttgacctttgctccaatataccaaatttttctttcggttactattgtgaaattatcattttctattttcacataattagaagtttagaacaaaaaatcgaaaaactaatgactctctctctctctctatatatatatatatatatatatattagaaatgctgcatatctatatataaaattagaattaattattatcgtgaaatatataaatttcttgtttgtttaaatgtgaaagatgtccatttagaagtttaaaacaaaaaatcaaaaaataatgacttctaaaatactttctcgagaaagtgtccatatatagtggtattttagacttctaagattttagacatgtttgtttgcacattcagattgtcatctgaatgaaactgctaattgttgttcgtttttgtgtaaaaataagcatcaccatatcgataatttgaaatcattagtatagttaagactaaaaatatgagcattttagttatattttaattaaactcatctagacggaaatatacattaaccaaacagacaaaggtttattcagatcaacaatcaaaaattgaaacgaacaacggttagataaagcatcctgttaattcatttgaatgaaccatttagatggaaatgtcagaggagcgcttagtcgattttcaactaaggataaatatcaagcaatatagttagaggttatatatgtacatcaaagtcaatatgagacacatttaaccaatgttggtttaatgtgataataagcctgcaaaatcaaaattgtcaacaatttaatattccatgaaatttaatgaccaaacatatccaaattgattaccacttaatttgagacaagatgaccacaatatatttcaaaacaacaagcctcatcttaacaacaacattctaaccaaatcactaagcaaacgagaaattgacatccttctgtttgagaagaacattaagaaccttcgtgccctatctttgaggagatattgtaaagtttggttaagtttgattttattgattcttctttactatattttcatcttcaacaagtttggtattaattgagttgtaggggtgggcaaatattctgtaatccgaaaagccaaaccgaaccaagcagaaataaatgatttggtttggttatatagtttagcctaaaaagctatttggttgtcagtttcgttcgattttctgtttaggtttgatttggttaaaacccataaaatcgaatggttttttttctgatgaaaatttagaataattatatataattatattttttcaatttatattttgttaataatatccttcatattttttttattgagattagaattatttggattctattctttgaatattttgggtttacgaatctaaacttagattttgttccttgaattatgtttaacttattatttctatctacgatttcttttatttatgcagcaatagtttttggtggaaacatggattaagttttttttttaaaatcggaagcaaaccaaaaccaataactaataattttggttagctattatgaaaattctccagaaaagaaatgactttcgaaatccatttggttgtcaattttgttaagttttcagttttgatttgatttggttaaaaatcataaaattgaatggttttgatgaaaatttggaataattatatataattatatttgttcaatttatattgtgttaatcttcagatttttctttattgaacttataattatttggattctatttttttaatactttgggtttaagaatctaaactttgattaattttgctccttgaactatgtttaacttattggttgatgtattatttctatttaggtttgcttttgtttatgaaataattttttttctgtaaaaacatggattaagttttaaaaaagtcagaaccaaaccgaaaaaaataattaattatttggattagttatgaaagttctccaaaaaaaatatgacttctcaattttttttttttatgtccaccaaactatgtgaacaaaaaccttaaatttgattataccttaaattaagataattattaaattaaatttccaagtttagtaatttggaagaaaaccacaaacctattttggtctgtctctcacattcttaagtcaatcgactttcccgccaaaccccatatatcaaagcacccaaaactacgaaactctttatctatcataagcaaaactatccttgtaaatatttccaaaattatgcagaattcacactcctaaagaggctacgtaagcttcaaaacaacaaacagctcttcaaaaaacaaaaaaaaaacaaaaaaatcaacaaaaacgagctgttcatatatattttaaagaacaaaaactaaaaaaaaaaaaaaaaaaaaactttgacaaaaaaaaaaaatg

SEQ ID NO: 5776 - DNA, 3000 bp, Unknown; identical to SEQ ID NO: 5590
  misc_feature (1)..( 3000): cDNA_ID_2156314_gDNA_ID_1620817_Annot_ID_169292 3000 nt of promoter + ATG

SEQ ID NO: 5777 - DNA, 3000 bp, Unknown
  misc_feature (1)..( 3000): cDNA_ID_3078418_gDNA_ID_1620817_Annot_ID_169319 3000 nt of promoter + ATG
accaagctgggacaatttcttggccccagcttccccagaatacaaattttttctcttcactggatggtcagaatcaggctctttcttctttttctttttcttttttggctctgaaggaggattctccgagctcatttcacttgaagatcgtttagcaactttgactttcttgattacagaccctgtggaacttttcccctcagatgctgaggtatgagactcaagcagaggctggagagaacttccagctgatccaagatctgttccagcttcttctttaggtttaagactcgccatagcttcagatttcccatgctctggaagtacagcagctctttcttccattctctcctttgatttttcagctagacccttttcttcatcaagagagggctttgaagctgaaaattctttaccaggaatagctgtatttgaagaggcaaaatccatgctgacgatcccagacttctcatctttcattggagtttgaagcgtcggagctcttctctgcagcccaaaatccccatccaaagatccatcaattccctggatatgagaagcttctgaacttgcttcaatttcgccaaactgaacagacttatcaccagcttcatcccttcgtttgagaagatacttgtctttttttttagagaccttaacctttgtgggttttttagagctcttaaggtcacctagcgtttctgctatgaccagtgggccactcaagggagctggaaataagagaaattgaaacaacacatcacccaccaagaaaatgaacaataaagcaaacaaggtaaatgtatgcgggactctccatagtagaaagaggcgcagaattgttatcaggccacgttttcgaatgcacagtttagcatcaatgagacttcactattctttcaagcatgctatgtaaagaattcaactacaaagatataaatcctaaaatcatgagcacagaggatctaaaagtaaaaccctaaaaccaagttacagtatctaatatctatgtaacacatatgaaagctgtttcaagtctacaacgaaaaaacccatatacaaacaataacatgattttctgaaaagtggctaatacctcgaggcggtgctctattatgaggttccagcgtactcactgaactgcggggtgattttgtcccaaaggcctgtgcataagtttcatcaaactcctcaaacactgacttgcggaaagcaaaaaccactgctttcttcttcataaactttaaactgtctggatcacactcttgaggtgctaacgccaattgcttcacaaacgaaatggtttcagcgggtaaaaacttatccctagaattcttaatctgatcaacagagtaaacggcttgaagctcgtaatcaggcacatcaacagcaaagtaatcttccacattactaggcctaaagttataaggattccgacatttacaagtcaaaccaagagctgaccttctactcgcctcatccttggcttcctccacagctctcacaaaatgcttcgaaaccgtctgctgtgatttctcctctaaattcggttcgaaaggaataagctcagcaggatcaaaccaaccataactactatcaccgaaaaacgcaacaagaacatgatcaatcctcctcatacgacgaacagaaggagacgcaaaagcttcattgaatatatgaccaggccaccaaggatgagactttacctttccccaaaccaaatctccaacttcaaacccataactcaatgccctcgaaactccagaacccattttctcacttgcaacataatcatcaaactcagataaaagagatttataatccgaaactccttttttctcttccttcaaacccaaatctaattccttctcatcagcttcagaaccaagctcactagattgatcatcagagccatcttcttcttcttcttcttctttaacctcagaactctcatcatccttatcaattaaaacatcctcgcttttaatctcatcttcctcctcactccctacgacaccatctttctccgatctctcactttcgagaaccctagcgtcatttgtaaccgccgaatctagctccataggtgaagaagcttcaacatcatcatcaatggcttcgtgaacatccccgctcgaatcaactacagtatcatctggagttaccttaggatcctgaatcgaatccgtttgttgaacaatcacagcatcctcgttcatcaccgggattaatttagttttgtacattacaaatcgataagaaccctagcaacaacaacaacgatcctccgatgagagattatccgaatttggttctcgaggacaccaaatgaaagagacggattattgttaaaaaaaaaaaaaagctaatcgagagaaagacaataaattagatctactgattactattgaattgggcttacccggcccatataaatatttataagcccgtttaaggaaccgacgtcgtatgatccaaaaagacctgaaaacaatcgctccttcttcctcaccttcaagcgccgtcttcttctttgttttttgctctcggctgatctctgtattgggtacgtttcttatctcgatttcagtgttcatttgttttttttgtcttttcttatgtagctatgagacaggatccagaacgatgcaatagatataagagagccttcaggaaaattttgccatttttctccatttcacctgttgttgggttctagattaaataaaactagagtatagttaataatttctataggcatggttttagatttacattatagtgggagtgatgattcaaagttttagtctttgaacatttggccatggtagtttgttgttttaatacttgtttagggttaacaaaaaacctacttttagatctaaagactcagatttttcacatttatttatcgacttaaagttggaatgtgttaaagactgatagctctctctatatggctttctttggcagatttttgatataaggtttgaaatcatg

SEQ ID NO: 5778 - DNA, 3000 bp, Unknown
  misc_feature (1)..( 3000): cDNA_ID_3447156_gDNA_ID_1620817_Annot_ID_169323 3000 nt of promoter + ATG
tatacgttcctacaagaaaggagagtgtcaacattgctaagtatctttgtggggttggactgaaagctgcagcttataatgcatcggtatggactgataaatcttcttactttttcctgctataagaagccctttgcactgttttttaggaatgaaatttgtcaacctttgttaacttggttgtagaaattttgtttccaatttctgatggaaaaattttgtattccaaattaagagctgttctttttaaatattggtatggatgtatgaacagtttgttacgtttcacagttgccaaaaaaacatctcagacaagtgcaccaggactttcacgataataagctgcaggtatatacatagaaaagaaaaccttaatgttctatatgtgttatggctcaaacttagtgatctactctgttatccacttcgctattcctgcttctttttattggaatactacgtggaagatcactaacgttgttttacgcctctgcaggttgttgttgccacaattgcgtttggaatgggaattgacaagaaaaatgttcggaaaatcatacattatggttggctgcaggtctctcgaagctcttataagatttctatatttaacatttcacatctcctagaattacgtgctattcaaatttgttgagctctctaatactgaaataatgaaattttacagagcttggaagcatactaccaagaagctggtcgagctggaagagatggcgaattggctgagtgtggtgagttgattaatgatttggctgtgtaaatgtactcttgtttgtcatggctgatggaagtaactatctgatatttacagtgctctatgctgatctatcgagagcaccaacgcttttgccaagccgtaggagcaaagaacagacagagcaagcatacaagatgctatctgactgtttcaggtctctatactagtcagatacgtgggagtgcatattcacttatcgttctatattcttttatattcattctcctttcttatgcagatatggaatgaacacttcacaatgtcgggccaaaatacttgtggagtactttggggaggaatttagttccaaaaagtgtaactcgtaagtcctatccttttatctaaaacccatcaagtcaaactaccaaatagttgtaaaacctttccaatctatgaaacagatgtgatgtttgcactgaagggcctccggagctagtagatgtacgagaggaagctaatcttttgtttcaagtaatcactgcttttcatgtaagccatttgattaatcccagaacttcatttaaaagtttgcttgtttcgtatgagtgatatacaatcaaacatatttctatttagtatttgagatttcgtctactactgtataacctttctttctgaaacttaagccgctagtatattagttgcaggtagacaatgactctgagcatgcaccatatgaagattatggactcggcaacagcaaacaaaataaattatcccacaagccaaatcttctgttcttcatcagtaaactcagggaacaggtaaatcttctgtttcaacaaattacatagtgcattatgttcttgatgatattaatgtgatgcctttggttagtgtagtgtgaaaaattcaaggaaacagattgtctttggtggaaaggtcttgcccgtatcatggaagccgaaggatacatcaaagagatggataacaaggtacactagtaaccaaaaaaccaacctttcttatgatccatttatcggtaaaggcgtaaagctacgatcacatattcggttaaaaccatgttactgatctgtgttgcaggatcgtcgagttgagattaaattcatacaaccaacagaaaaagggaagaaacaactagatttccaagatgacaaaccactctatgtttatccagaagccgacatgctactttcgttgaaacaagatagaacatacagtggattctctgaatggggaaaaggatgggcagatccagagatccggcgccagcggttagagagaagagaaagaaagcctcgaagagaaaggaaaccccgaaaaaaacgaacacgaggacgttcttcgacgaagttacatccatggagaagcaaagaataagaatctcaaccctctttaagtaatgaatccactttatattcttttaccaaacccattattccattcatggatctttatggaagcataatacttctttctacaattgctatatcaggctccttctttgctctgagtcccatcttgaggcatagataccgcgccatcgagaagctgaggcttgtaaacgaggctttggtaacggcggaagagaacgtaacaaggcttcaagaacgtcatgatgtgattctcaaagagatatgttcttattatctcgttaacaccgagctccatgaagctttggtttcatctcgtgcagccattaatgatgcttcttcatttgtcatggagcttagaagattacagttgaatatcttaaactctctttcttaatcacattttttgtacttattacactaattaaaaccagagtttgggtaataatttttgtttccttaattttccgaattatccgctaattttctactctaattctctggatattttaaataatagtaataatctgctgtcaaaataagataagaaaaagacataaagctgattatcttgtagaacgtgtggggaatgaatctaacggctgatatcactcaagtgttcttttccaccttccttttacaacacccacgtgtaatgtcatacaaagaagtcattacgaccgttagatcaaagccaacaagatccaatcttaacggctaagataaattactacacggatcgccaacgtggcaatacgtggtatatacatacacgtcgttctttcctcattttaagcaaatcgtaaaccgccacaaaaccgaaaaaaacactaattgtgctttccctttagattcatttgtattttcttttggagcttttgaacaatg

SEQ ID NO: 5779 - DNA, 7 bp, Unknown
  misc_feature (1)..( 7): cDNA_ID_2166952_gDNA_ID_1620817_Annot_ID_169324 3000 nt of promoter + ATG
ttcgatg

SEQ ID NO: 5780 - DNA, 3000 bp, Unknown
  misc_feature (1)..( 3000): cDNA_ID_2166946_gDNA_ID_1620817_Annot_ID_169321 3000 nt of promoter + ATG
tccacaacattatctaccttcatggatttcttgtctattaggctgaaagtctcagtctcatagacagagatagtgtttttgctaagcttggcaaagtatttatcatcttttccaccagcccatctgtagaaaaagtttacaagatatcaacatatgtccataatagtggagaagatgataatattggctgtttatttttaggacattgacatgcagttgaaagaattacctgaaaacaggccaagaggcaccagcaacaccaccaggtcctccaattgaaaactcatcagcactacccttgaaatctctcatcatcctcccggttctcacatcaaaaaccttaatctcaactttctgaaagtttgacagaattcagcgtcacaaatagtaaaagttgaaaagaacagaagaaaagatgcactcacacttgcatctcgcgggttgcttggttcttggctatggtaagttacaagatatttctcacctggcgagaaatcaactagttttacctaaaacataatcaacaaaagatgcaattttcaggccaacagaggaaaaacggaagtaatatgtagcaattgaaaggaaattcaaaccatagaatgctgataacgcatgagacgcgtgaatgtatcagcaccaccccaaacagctgccccctgcttgtggagtgtcacaaggtatgtacctaaaggagaccactgcacataactctctgtccaatactgcataggaagagaacatcattaattcaaatgaaggtaacataacatataaaagtgctctaaacagtcaagtaaacaaataagggatattaattcaaatgaaggtaacataacatatacattgctctaaacagtcaagtaaacaaaagggatatacacacaggaagtaacttacaggacgcttatgaacaggttcaggcgccttctgcctagtatcattccagaaaacttcagtatcagggccagaacgaatgactagctggtctcgggctttttcatcagtaagccatttttgcaaattttcctgaaaaaacaaacaccatataagtaacgacaattagcaccacaaaaggctgcaatgaattaaaatatatacatgaaacaagagttatgaaattatagttattagttagtatacatcaattacgtaaaaagatcctaaccctaacgcagcaggcaaacacaaaataaatcagcgaattaccaaaataaagaagtgattacacagacacaatggaagttattcaaagaaaattattcaaggtacagggagtaacatgatgaaaactacacataccccagggacgtagggcctggcctgaggaggctcccactcctccttcacattcatcaacctgtcaaaatcatcgaacatgtttacagcaaagatgtgagacttgtccaacttgtagccatgagacttttccttagcgttttgtgcttcctgcaaagagccccagacattgagagaaactcttaggaaatactcaaccattaagaacaacctagtttgggctcctttctaacaagagaaataaagtattgaaacatatgacgccgacattattgcttcagaatccaacaaaacagagattaagctaatcaagtagataaataacctgaggagtgttgaactcaataaaacagtagcccaatgtcatcttggtatcgggatcaacaggcatccacagtccattttccttaatcacacctaactggttgtaaattttcttgacaacaccttcaagtttctcaaacttctccttgggaacaacagggaggtgatcgaccacgataatgttaccgaatccagtgtcgaattcagactggtcatcctggtaaacagcttcatcatcactacaaccatcacagaaaaaaaaagtgtataacgaatcagttccatttttcatacgttcatagataaaatgtataaatataataagctttgcaccatcaaggaaagagataaaccaattcgaaatacacaaaattttcatacatacaatagcaaaacctagaataaaatcatcccatcgtataaacacaagaagattagaaatagaagtgaccgtatatgaacaaccagagatctaaaggaaaatctcacctctcgatcccaaagtcttctccaggaggaagttggatggaatcaaaattaacctgagaccaatcaatccctaacttagcagctcgggcatcaatatcaacgacctccatgatttcaaaccttatatcaaaaatctgccaaagaaagccatatagagagagctatcagtctttaacacattccaactttaagtcgataaataaatgtgaaaaatctgagtctttagatctaaaagtaggttttttgttaaccctaaacaagtattaaaacaacaaactaccatggccaaatgttcaaagactaaaactttgaatcatcactcccactataatgtaaatctaaaaccatgcctatagaaattattaactatactctagttttatttaatctagaacccaacaacaggtgaaatggagaaaaatggcaaaattttcctgaaggctctcttatatctattgcatcgttctggatcctgtctcatagctacataagaaaagacaaaaaaaacaaatgaacactgaaatcgagataagaaacgtacccaatacagagatcagccgagagcaaaaaacaaagaagaagacggcgcttgaaggtgaggaagaaggagcgattgttttcaggtctttttggatcatacgacgtcggttccttaaacgggcttataaatatttatatgggccgggtaagcccaattcaatagtaatcagtagatctaatttattgtctttctctcgattagcttttttttttttttaacaataatccgtctctttcatttggtgtcctcgagaaccaaattcggataatctctcatcggaggatcgttgttgttgttgctagggttcttatcgatttgtaatgtacaaaactaaattaatcccggtg

SEQ ID NO: 5781 - DNA, 3000 bp, Unknown
  misc_feature (1)..( 3000): cDNA_ID_2166934_gDNA_ID_1620817_Annot_ID_169316 3000 nt of promoter + ATG
atcgtaatcaatagcaaagtaacaggaacagaaattcaacggactctggcactgcagcatacttccgatgcgcaggtaactaaaaagtctatgcctgtggaaactttgtctttagattgctcatgttcgaataagtatagacttattttgtgtactctttttgctaatagtaacagctacagaaattcttttctcatgattctgctttccaggaaatggagccagaaatgattgaaattgtcattgaatcaaagtcaatagcgcaagcaatggtggatgcagctataaaggtatttataatatatctagagacttcagagtcttctaaatacagagaagccaaattcatacaactctaacatcttttgtttaaatcgttgtcaaccgttttaggctgcatcgtcggggaagaacaatgaagactcagagaatatggttcaccaagctttaagctccattggcgaacatcagccattagacaactctatagtgcctggtatcaagcatcaagagtataccaatggcagcttggatcatcattccttaaacacagcagagccgatgagtaacggtttcatctcacaggaaggatcaggaaaaaacaaaacaccaatgccttcagagcttatcacctcttgtgttgcatcttggctcatgatgcaggtaaaggaaataattttgtcttggactaacgaaagtgtaatctaaatcaagaataccaaagttttcacttgatgcggttttgattagaactctttgtgtgttatttacctgcagatgatctcaaagaagcagtacccaccagcagatgtggctcagctaatggatacagtagtgaatgacttgcagccacggtgtccacagaatatgccgatatacagagaaattcaaacttgtatgggattgatcaagactcaaataatggctcttgtaagaacgtcatgaaacatttgtgtcctttgtaattaacctgacatcgaagataacacttggagatcagatttaattgtttggattgtagaggttagtttagtttatagttagttaataatttgaacagctccaaaggctgttgataattagttaccattgattctgtaacttttttttgtcatcattcattgtaactttggttaccttttactttggagctgttttttttttctttctttctcagtgattattttcttgggtcattttggatcctaatggctgaaataatttattcccaccttaatacaaaatctcaaatatatactattccttaactaaaattctagaacaatgccaaatggatatgtttgaaatacctttaataacaactaggatttaacctgtggtgtaccacggacaaatgttttattcatatataataatattaaattttacggtttttaatttagtatttaagttttataattttatattaatgttataactaaaacaaatggtgatgataaaataataaaataaatatttaacatgtgctatatcaatccaaactcgtcccactatatttcatatcaatccaaacccgtcccgctatatttctcatctcatgatatttttttataagtttaaataataataatgttttataaagttaaaatatatctataatatttaaaaataataattattttttacttaagttggaaagatttttggaaacgtttgttgagcgcaatataaagtatttaaattttcaaatctgaataattaataccaattatatatcttgaaagatctttggcaactattgttgaatataatatcttgtatttaattatcgacaggaaatatttaatgtcaatggcatgacattgtaaatacaagtacaaaatttatttgctaaaatggctgcaaaaatgtatatgtagatttacttctaattttaatgtttcaaaggacaaaactaggcatgaccataaaatccgaagcccgaaaaacctagttcgctttggttcgagtggatctaaagtgtttattttggggttttggtttggttcgtgtaggatctgaaacctgaacagatacctgaaatatcgaaactcaaacggatacatgtaactcgaaataatacgtatacataatttgtcggtaaattcaggttcaatatcaggtttcaattaaatttgagaaccagcccgaacccgaatagacctcaaccgatattttcagttcctaaatgtattttcaatctctttaccaaagtaacccaaaaacccaatctaaacagacccgaaaatccgaatgtccagacctaactaaaatcgtgagtcaaactcaaaaaatgattgattaacactatattatacttttacttagattctataaattggacacatgtatgggtgttattaagggttggaaacataaatttaagccatgaccttatttttggttggaaaattcttgttcttttttttgttagtaaagggctgttaataagggttttaatgggttagcgaacgacaccgtttataataaatatgtttgctaaacgacatcgtttgaccttagggtttattgtttaacatgaaagaacgtcgtttcaccaacgtttcttcttcctcgcaagtctcaaagccaggaacgatctcgccgtatgagcaacttccgacattaacactgtattgctctgccgtactctcctctttttcccttcatactcgtcttcacatctgaattccgacaagatattgcgtctgctctcctctcttccctcattctcgtcttctcattaccaaaaacatcttcttctcgtagctaactcaatccaattccaatctccattcaaatcgagcaccagataattttttctcctaaattctaatataagccctaaaattcaaaattgaaatatctatagaatctccttccgattcagacggataatcgccatcaacagcgtgtgaattcgatcaaaaatctgaactttccacaaagaaattcgaaagctcagatttttcgatttcgaaaattttgaaaactcagtta

SEQ ID NO: 5782 - DNA, 3000 bp, Unknown; identical to SEQ ID NO: 5588
  misc_feature (1)..( 3000): cDNA_ID_2156350_gDNA_ID_1620817_Annot_ID_169302 3000 nt of promoter + ATG

SEQ ID NO: 5783 - DNA, 3000 bp, Unknown
  misc_feature (1)..( 3000): cDNA_ID_3078433_gDNA_ID_1620817_Annot_ID_169304 3000 nt of promoter + ATG
agggtctctcctagatcggcagaactcggactaatctggacaaacattaatgtcttgcaatctccacctgtataagtcacaatgaaatagaaacaccatggagatgaaaaataagatgtcttatgaatcatgtggccataacaacggaagaaaataggacaaatgttactttacccaaagagttttgcagcatatgggtcagctttgagtttctggagtttgacaaaaaggaaggaaaaaagtgtcatcaacatcaatcagaaaatctcatatgcaaatgtcttaacaaaggggaagaaagaagggaaaaacctgtaaggaatgtggcttgttttggatgcaagggcagagataacatcaccgagtgctgaaagcgacttattgataaattgagattctttcagcctttctccttcaacttctacctttcctactcgctcactgccagccaagtccactaaccaaagatgacttctcgttctctgaccatttatcaaattctctcccttcactgtcactcgcagcaagctgaacaaaaggaaatctcttgttggtataagtatggaaaaggtttagtttcacatgaatttagtttctaaactctagtttgcttaccaatgagagcggctgctttgctcatttgcagcagttgaacccacagatcgaacagcatatcctttcttgagcagatcccacactccatctgtattgtaaacttgagcttcgactaatcctgggacttcttgcgtcccttctgctgattgcttaacctccaacctttatcaacacagcacatagtgttattttgctttttaacaagaaagatagaaactgtaaggcgatttattctactaccaaataatataatggaagacctactttttagggggctggtttgagttatctaccaagaggtcccttatcttctcattataaacctccaacatgctaactgatagctcaaacttcatgagatgacttttgctttctgaacagcgaaatagttcttctaaggtcctatagttcactcctctattctctggtgttccctccatggtaaatgtcttgccagttcccgtttggccataggcaaatatgcagacattatacccatccagcaccgaagtaactataggttttgtctgtgcaaaaacagtctctgcaaaagaaggtacagtcagataagaagactcgttggtgtagtgttcaaagagcaaaggtttagcgaaataaagttgcaaaggtagcgtctcaattaccttggccatcgtcaggcttaaagacatggtcaaatttaaaatgcttcttggaggaatcagatgaaagtatctggagctcgttttcctgtgttgtatcaaactcagctacagaagcacaaccattggctatttcagcttggtttagaggtctgcatctgcaaaagactctgatatttcccttgagttcgatcacttcattgtataatcgtttcctctctgatgactcttccaagtactgtttttcaagagctccaagcttagtagcttccattaaaacacgttgaggcatattagttaaccaaatcaaacaagttttgtatttagagaatctttgtcgaagaaatcagattcaaagtactcactgagaagctggagagcccttgaaatttctggttctactaaggaacaattcttgatctcttgcacttggtttgataccaacgcatgttcatccttcaagatctaagacatgatatagaacataaaacactagcagagactgaaagcaaatctgttgaaaattcatatttaagttcatcttgaaataacctcaacttactattgcaactgagaactcagaaggaactattgtaactgtgtttattcaagaggatgacaaagaaagtagtagtaccttaattttgtcactgcagtcgataattttctgcaaaattggaagtgttggtccattggcaggagaaacttcttggtttccacttgtaatagtatcctcactttcttccactatttcagccaaatcagtaatgcatcatatcagagtcaaagacacaagtgaatctaaaaatacatactacagtctactaaacaaagtacttgttaacagagtttcagattcatgggataagttagggacccaaaacctaaatcgttgataactgaaggtgaaccaatctttctgaattccaaaacaaaatgctaaaacctaattggattctcttcagaacaaatccaaaagaaccaggaatctcagagatataagtgtttgagatgtcaattcacaatcagagactaccaattaacaatcgaacgacttgtacactaatttttcaattcacgacgagaaaaccccttaccagcgtcggaattgtgattgttgacagaaacttccttcgattcacacaacaaaccaccatcgttgcaaatttcttgatgttgatctggcaaaaaccgaagatgatcagcgaaacattaaaaaaaaaaaacagatcaatcaagaaaaccataaatctgtaagaacatgaatcagaagagcgacgacagaaacaaagtatagtacctctttccatggcggatttgtgcctagagaacccaaagaacgttgaatccaaaattctgaatcaaagagagcgagagagagaccaagagagagtgagagatttagagagagattgagaacgagtgtagacgaatttgaatttaggagaataagagccgttggatctaaagaagctttgtaacgtctatattttattaccattcgttccacaaagaggagcgtcataatccggatccgaattcgtttattattcgtttcacttgaagtttcaaacctctcttttccagcagagagaaggataaaagttttcacaaattaagtaagacccctaaacttctattttatttataaagagccacaaatattataatttcacaaatacacccatgtgttccagttgtttgagtaaaatctacttcaattgatttgccaaaggcttgcctc

SEQ ID NO: 5784 - DNA, 3000 bp, Unknown
  misc_feature (1)..( 3000): cDNA_ID_1829294_gDNA_ID_1620818_Annot_ID_50650 3000 nt of promoter + ATG
tattcttaacgagttagttactgcatattttcttattttatagaataagttgaattcgatcgtacttattatctgtacgaactactggttttcgatgtaatgcagttgacaacaccataagagtataaaacctaaagctgtcaattgggcttgaccatgaccaaatggtcttgtccagttggacattttttttctcttcacaaaaatgaccaagcccaaagtgaccaagcccaaaagtgaccaagtccaagagtgaccaaaaccaattatatatgtccatggacataaaaaaaatgtttaacatcacaataataatctaaaatgaccatgacaaacattgtaattagacatcataaaaacattttaagacaacattcttaagactatccataaagttcaacatgaccatcattcttcaatcttctcttctttctccttctcgttctcctctttgttctcttctaaatctgcagttacaaccattaaacaagagagtaaacaaatctctaaagcttaaaacaactatacaaacaagaacttgtttcatttaccttaagcttcttctttctcttcttctttctcttcttctttctcttcttctacttcctcttcttctccctcttttggaaagcctcgcagccaattccttgtgcagattaatgcttggatattttcaggaagaagactactcctatatttactaaggactccgctgcctatgctaaatgacgactcagaagcaaccgttgttatcggaatggagagaacatcacaagccatgcttgataactccttaaagcgacaagagttatctttccaatatgctaggacattaaaatgtctaaaagcagccatatctaatgttggttcacctaaatatatgtccaattctgattttccactactaccaactttttgagagacaaatgcataaaatccctgagaaaaaattcacacaaatggagcatatgagatacaaagctgccagatagaagtctaaaaccaagcaatatataacacttcaagtctatcaagcttaaagcaaatcaagtgcaaaaacagattaaaactacaaaaacagtggctaagtaagaatttacttacactgtaacctgccggaatgtcttcttccaaagtttctacttgtgaagaggaggtgatgctacttggacgtttcttgtaagctttaaaaagcttatagatcttcgaacgcacatgagccaatctggacttactagttaatcgatctagagtactgaaacaatattccaaacatttcaacttaagtcttggatcgaatacagctgcaattgcgagaatgtcactatactcttcccagtatttttcaaacttaagagtcataatttccaccatttgacaaatagtctcatcaactgaaaactcatgagctctcaaccaacactctatcttccaaacttgcataaaatataagttggctgtaggataagaagaacccgaaatcagatttgtcatttcagaaaatggctttaagaattcacatatcaactctcctctactccaatgaccaactagtcaaacccgtttctgaccgtggatctatttaggcgtagtccattaaaaccatggtttagttgggctagaatttaattgtccacaacaatattggttgggctaagcccatggtccttttgaccaattgacagctctaataaaacctgtagataacaaaacaacacaagttttatatactataattaattgtcttctcaaagaacttaataggaagcaaaaaccatgtttgtttcatcccatttaaccaccttaaaatcgagatcaaacaattttacatatgcaagttcaacatacctccaaacatttagactcaagacgtctatccctacatacaaaatctccttgccctctttttttttgggtatgccaaaattttgaatatacgccaaactactttccaaatcgtttgcataacaaagatgaccataatctttttccttacgacgtttgtgaggtccactgtaatcatctggatcaagactctgatatagatatcttaaaccatatactatcgctaaaccatttagagtatcagtagtccatttattatttttaatggaccaaacacataaaattgagctgaaccgtatcaatccattaaaacttctgatatccaatattattataaataatactaaaaaactccttatgatactatatgaatatcacttatatacatgctcttatatggtgtgtagttttcatcccatccatgtagtcttctaaaggcgctgaccatgtcagtgatgacataagtccaacaaaggacatggttacgttggtctcgaatatactccgagacatctttgagcctttctctgatttcctcgtctagtagtagaaaattttctagtactcctgtctcctgatatcgtctaatatataataatatagttaaccttaaggcagtcaatcatcaatacgccatttatcctactaatttaactcatccaattggtgctacactattgacgtttgaaggttgggatgggtgtaacatatatcgcggacatgccttatccataaatacacttaaaattagtataaattttctgacttgccttacctgagtttgattattttcttagtaaagtattttgatattataatttggtagtaatataatcactataacatgcaagaactacaaaaccagaggtctctcaaatggacactcatttaattgttacgatagtaaatgtcacccatcaatgaaacctaagtcaattggatgatttgggcccaattggacctaattcggcccatttaatattccctcttttctaacctttgtttctcctcttgcttgctcacccttttccctgaatcttaagaattactaattcccggcgagttttcccggcggcggctagataatactggtttctgccagcaagatcgaaggagataaacttcgtaatcaaaaagtctccttctgataaaaag

SEQ ID NO: 5785 - DNA, 3000 bp, Unknown
  misc_feature (1)..( 3000): cDNA_ID_1842487_gDNA_ID_1620818_Annot_ID_50653 3000 nt of promoter + ATG
ggtggtttgtcgtattatggttttaaaatattcattgatttttggttacacgtttaaagaaccacttaaatagatgttttacgtataaaatgaatattgactacataattgacttcaggataatagatacgattgcgtaacaatatcgtattattgtatgccgacacctttgacagcatatcttcctttacattatttgtgaaccttatccacttattttattagagtatagaattgacttaaggatcggtttaagtatactgtgtgttcatcattggttttcatgtctgtaaaccaaacctctagctcctactatacaagagaggatgatgtaatcattttgactaaaaagaagtaatgagaataagtttgttccttttgctttcttaacaaacttttcttgatttcgtatttttattacgaaaatatataacttcttattaaactagatataaatatatatttagcataactcgctattttaatgcacatatttataaaatatataacttcttattgaactagatataaatgtatatttggcataactcgctattttaatgcacatatttataaaatatatatttgaaataatagaaagctatattaatttttaacatgttaaatttctagataaaacattatatctatttataacaggttaaacaaaaaaataatacacataaattgtaaatatatatatttacgtacgtcgttaagtagttaagtttgagctaacggttgtaaccgatctaaaatgaaaaaatgggtgacgattttcacctaaacttttcggattcttgctgaatcttaactagagtttggtaactatatggccggatgtcattgtcgaagccatctaatattgcgagattttggcagattttcaatggatctcaaccaaaatcatagtaactgtggtgtctagttccacatgaacaaaaaatatcatgcatttcccctaacacgtagaagtagaagaggtaacgataaaagttttgcccagataaaaagataaaagagagagaagaagaaataaatgtgggatttttatttaaaaaagaattaaatacgagattgatcagattggtggaacaaagctgtataaatttgttagttgttaactagagagataattttttacgaaatagcgtaaagctgtacagaatttgatgttacttttttgattggtaactatcaaagcggtatgccctatattaaaattgtattaaaattgtatgaagttatcattcaaattcctagtttaacttttggtctatgggaattagatccctaagttttacatcaacatatcatttgatcatggcagtgtacacaatagatttttcatatacttttgatcaattgtcaaaaaatttaataataaaatttaaaaataaatgaaaaatggttgacacacttggaccattacaaaaatgaggagctcaagaatcccaagtggttttcactttattctttacaaatttgtaccgccataggacaacttatgtttaattataaatattagcagatcaatttttttttagttgaatcgtgttgggacaaacatgtaatatgattttgagacaaactgttttgaattaatgacacaatttcatggtaagtaacatgccttattatataatctatgaaaaatatttggattatattcacctcctttattttatccaattagaatctgacacctaataataagaaaaagaacttaatttaattataaatttaatttgccactaaaacgaaattatttatctgtttgggtttattagaaaaggtgagagtttagattttatgattaaacaatataaatattagtttgaatttatatttaaattttacaattaaacgaggttaaatgtttgggtttagaaagtacgattatgatttagattttatgattaaataaggttaaatattagtttgggtttataaatagatttaaattttacaattaaacgagggtttagtttttttacgattaaatgagtttaaatgacggtttgagtttacaaagaaaaattaaagtttagatattggaattaaacgagttctatatcgggttggatttacaaaaaagtggattttaatgattgaattttttttttaatcagataacatgacaaattcaaattggttattaaagagggagtaaatgaattaggttcacctaaaggtgaacccaaaaattattcataatctattagatgattttatatttttcttttctttctctccctccattttgtttgaaattatggatttgattgctaacttgtataatagtaaaattggtgaattgacgatttttaaatgcaattcaacaagtattttatcaataaaaattatataatgttaaacaggtaaaaaacgcataactacgagtccctctgccgtagctattaaagcaaattagtatgtatgtaatagctattgaagtaattaagtaaacactacgagtccgacgttgtgatacaaacaatcccataactaaaatgtacttaggtctaagccagtaagttcatgtatataacttagaaagtggtcaatttgagcaattctcctcttttccttttgtactctaagaatcaatttgattttggtgatacaaaattaagtatttcattttcagttgtatattgacagaaataaaaaataaatcaattttatattattttatcttaacaagctcacttcagggccggtattgggctgagtaaggagtccaatgaaatatgtgcttcgacccttagattatttattgtttacaaatagacccctttattttgtaaaatagtaataagctctcttttttccctgtcgacgatttctctctctctcattaggctcgaaccctctttcactctttgtgtctgttaccaaactctacccctctctcttatccgctctattcagagaatcttttcttcaatggactttctctgaacactcaaatcgaacagagagtttaataaataaatg

SEQ ID NO: 5786 - DNA, 3000 bp, Unknown
  misc_feature (1)..( 3000): cDNA_ID_1808768_gDNA_ID_1620818_Annot_ID_50656 3000 nt of promoter + ATG
ttactcaccaccaccaccggttcactcaccgccgcctccggtttattcatcaccaccaccaccacatgtctactctccacctccaccagttgcttctcctccaccgccatcaccaccaccaccagttcactctcctccaccaccaccggttttctctccaccaccaccagttttctctccaccaccaccatcaccagtatactcaccaccgcctccaagccactcaccaccaccaccagtatattctccgcctccaccaactttctcaccaccaccaacacataatacaaaccaaccaccaatgggagctccaacaccgactcaagcaccaacaccatcctctgaaacaacccaagtgccaactccatcatcagaatcagatcaatcacaaattttgtcaccagttcaagctccaacaccggttcaatcctcaaccccatcctctgaaccaacccaagtgccaactccatcatcatcagaatcatatcaagcaccaaatttgtcaccagttcaagctccaacaccggttcaagccccaaccacatcctctgaaacatctcaagtaccaactccatcatcagaatcaaaccagtcaccaagtcaagctccaacaccaattcttgaaccggttcatgccccaacaccaaactctaaaccggtccaatcaccaacaccatcaagcgaaccggtctcatcaccagaacaatcagaagaagttgaagcaccagaaccaacacccgtcaatccatcatcagtaccatcatcttctccttccactgacacatctattccaccaccggaaaacaacgacgatgatgatgatggggatttcgtcctaccaccacacattggattccaatatgcatcgccaccaccaccaatgttccaaggatattaaaaccaatgtagtagtgacagtgttacccatttttaacatttctgtccattttttccatgtgaattatttgtatcaaacgaaaaagatattacaaagatgaaaaattaaaatgccaataattatatagtagattatctttcagcagatttttttttgttgaaattgaagtattgaactataacacgatgcgatttgttttttcggggtaaagaagttatcatttgttttggccattttatgacttctattctattatttgagaagcaaaacataaatatctatatttgtaaaatttaatatcttactagctacatatagtttaatattatacacatttaatctttcataactatgtcatgaattatttgacatttttcataagtcatgataaataaaattatgtatgaaataattgaattagggtttcatgttccaccagatgattgaacttgttctttattcggatagaattatgaaatttttatcttctattaaaaaatatattaacaaaattagatttaacatatattgatatctcattaatgtacttaacatgtgttaacaattttaaatttttttactttatataataaaattagaattttattaaaattatataatatctaaaatttgtactaaataataattcttgctgaattataatctagtttttttttttgatagcataaagattataatccgttaactttaaaaaaaaagcaagaaagggaaataaataaattattatatcctttaaagaggacaaaaatattaattatattgcgaaaaaaggagataaaaattaggtggaaaaggggaagatggtggggacgataagtttttaattagctaaccaaaaaacaaaaacacgaaacgagtcaactcaccggttccattacgagtcaaggagaaacacacattgacacgctcaagcttttttttttcaaggtcaagttggtttttttttttctttcttaaaaatatttatgttgggtcaggcttaaaccagagagagagtgtgtgtggtcgagccatttgaccaaaagcaaaaacttaaaactggtttcagatctgaagtaaaagggttttgcttcggattctccggcgtcgtttaaatgatctctgacccatcttccttggcttaataattctggtccctccttttatctctttttactgttgatttatctgaatatgccacgctctttcttccacatgtttattctctcttcctttcttcaacacaagcgtctggtaattgatctcttctctctcaaattgtgtttcgttctttttggttctgtatttggtttctgacaaaattgaggaaactggtgttgggtttgagtctagaactgccaaagatgtgattttgttttttgggtactgaaaattgagtgagatgaagtgataaagtgtcttttttttttggtaaattattcgaatggaacttgggatcggaactctgtttctttgttagggttggttgaaatctgaatctagtcttgatttttgtggtgaaatgagaggtgagtcagtgaaattttgaaatgtctttgattcaatttgacatcagaatactgctcaggttgtgtcttttgtcagatttattgagaattatcagcttccgactgtagatttgactttggtctcagtttaaagactatgagtggactttatagatctagaagcatgcgttgttttgattataagaaataaaaagagagtttttgctttaagctgtttgactaataacttgacttgggattatgatttaaccagcaaaactctcttttctccagccactgtgttttatgaatgtttgttgattccaaataatagtatgtgttgatcaaagtgaagtcatttggtcattacttggttctgagctttcagttgtttttgcacttacaatacctgatggtcatgtttgcatgtaggactaaggaaagccaacaacaaaatctggtttcaagacggttggcaggagtttgtcaaccgtttctccattcggattggtttcagatacaaagttacagtctacattttcaatttatcctccacactctgagatcaaccaccattctagtagtgaagctctt

SEQ ID NO: 5787 - DNA, 3000 bp, Unknown
  misc_feature (1)..( 3000): cDNA_ID_1829228_gDNA_ID_1620818_Annot_ID_169367 3000 nt of promoter + ATG
aacgcaaaaacttttgcgctggagtgacaaagagttggaccgatgtttgcactcgagcattctcagatttatgcgagacagctcataggatcaacagggagaaacaattggctttagagagagagaaattcatagaggatatgaagaaactcaggttgagtctccaacaagaaaaatctaataggttaagtgtacaacaagtaaaaattgcttctcctcctcctcctcgtcctcatcctccagttgaagacgaaacagaaaaggcccttagagagaaagagacaatggaggtaaaagagaaggaaggtgtgctggcggcagatgatcggacggttttcctgacgttttcaaaagggtatccgatctcggaagcggaagtaagggtttacttcactaggagattcggggaagtgatagaagcggtagagatgcaagaagttgaagcaaacgagcagccattgtttgcgaagatggtgatgaaactgcagtgtgcgtcgatgatggatgagattgtgagtgcgaggtttagaaacaagttcaccatcgatggcaaacatgtttgggctcgtaagtacgttcgcaagaatccttatccagcttcatcctctactcatttttgagtgtttctgaacttcttatttacatgttgtgcttgttgatgttgtcgttgttgttgtttatctaataaaattgtgtcgtcaatcttattattgtgctacacattaatatatgtttaaattggcgagtacaattacttttttactagttggtgttatttttatatattttgaatcatacaatgtttgagaaatataacgccggaaaacttccaagaacaaatgtatatctatgtataattaaattcataagataaaataaaaaaataatatatgattggctaattatcagtttctatatatttaattattattaattaattgatagttttttttatttgtttggtcttttgttataggatatttgatttagtatagtctgtcaaataatcaagaagatgttgtgccaacatcctccattagcatcatcgctccgaaatgttttatctaaggtcatgttacttagaatttgtgttgaatgatttaattacaaaatctacatcgtaattatatttgagttttaaaaatgtatatttttatgttgtatactttttaaaatcgacgtagcaatttaattattagtcaaaataaaaatgaaaatatgattagttcatagataactgtatcgttgtcgtttttagaatttttgttattacgtgggatatactccatccgttttaaatgaagtgttgttttagaataaatgcagttttaaaccgattaatatactacaagaacaaggtttttcttttccttcttcgatgaaaccatattggtgttaccctttcttctttggatttggattcaaaatggttttagaaatagaaataaactatcattgactcatccatctagatggaaggtcgggataccttaaataataaaacacgtagaacacgtagtaataataatgattagaaactaaaagttaatcgtaatgatcaatagtatcttgccaaggttagaacacttagatgaaagtaagcttgacacatatggtatctgtggttatgaaaaacattatgaaaaagttgtgcacatgttgaatgaagcagttgcttatcttctttcacctatatttatttaataaaatgatgataggattaagttttagggtaaaccaaacaaggatttagaaagagtaggaagattttgttttataccctaaggatgctagtagctcatgccacgatataccacttatggcgtgacaatcagcaaagactcatgtaccgatcattttcaagataattgaccgacatgtgttcgtaatgccaaaccgaagaaagtttagaaaactcatgggtttgtggcttccatgggagtgaactccagatcaacccatctcaaacttgttttgtactctatctttttggcaaggacacagttaatctttttgtataaccgctacatttcattatttatgatatttacatttttatcaaaaatgattcacgaagattaggaatatgttttcttatcgcacttaccattaagagggacatcgaaaacattgcatagaagaaaacaacacaaatgatggtttgattaagtaacaatggcgtgaacctctatagcaggatttaggctaaatctttgctgcgagtacatcatgtgacccaaatttttaaaaacgtatcaatttatcaagagtatgaacttataaggggtaagtaaatgagagataacatgtttatcagatgaaatcaaccaaagttttttttttttttgttgcttccacatgcgcatatgtgaatacgtaaactgccgacaaaaaaaaaaaacattctttctttattgcgttttctaagcgagaatgtcgatgtgatcagttaatgcgaacgggtaaaattagatcagtatttataaaaacaaaaaggcagtggaaaatctagggtttctaatattaatagccttgtaatcagcattaacttagagatatttaaatctcaagtttcattgtcaacagaacttattagttattattactgttgagtgatgactgatgaccaacaacgagtacttgatctttattgaagaacacgcaaagaacaaatagctctcgtagctcagttggttagagcacccgtttagtaagcgggaggtcttgagttcaactctcaacgaaagcaattttttaaacaaatttacattttacaaacagaaaatctagcctgtaacggaatattgtcgttgtgaatattttctttttgcctggctgtataatccccaaatatagaaataacaaaagaaatattcgaaaactttcttaaaaatagattttgagaaaagaaaaaaaatggttccttgttcctaggagaacaggaacagagttgggtgttccttgtttcatctcacattgaaaccaccggagagagagata

SEQ ID NO: 5788 - DNA, 3000 bp, Unknown
  misc_feature (1)..( 3000): cDNA_ID_1829236_gDNA_ID_1620818_Annot_ID_169362 3000 nt of promoter + ATG
cgttcatatatatgttatcatttcatgtcctcaaagatgtagcaaatgggaaacaaccaaatattgtcacaataaatcaaaaatatttgagaatggagataaatatcagtattcaaatattgtcgtttatatttttttgtcctttcattcattttcctttaatatatctaatcacttgcttggcagttaaatccgaaagcaaaactacaatatttttggggtggtttagctcataaacaaaatgaggtaaatatttagctaagatataatagggttctttatcaaggaaaaaaattaaagaaacgttacaaaaaggtctaaagttcgaaataataataagaaaaccggcatttgcttttgttttgcggttgtgataccttcgtcagttgagtttttgggcgagagaaggaatgagttgctagatatttaatgcttcaagaaatacgagctcacatgtatttatataatctccaataattgtctctatttttaaaaaaaaatataaatgaaaaatagagatttctatttttactctgatggtttctcagatagatatttatttgttagaaaaaatattaaaaaaaatagaaatctctattttgttttttttatctatagagaaaaaaataaagatgtgttggagtaaaatataggtaaaaatagagtaaaaaaataaaaatagagatgggttaaaaaactcttatttgatatgtttgtctcatgtattatgtcggaattgattcaaaactgaaaaatcgtgtgagattaatttaggcaaaatatttacattgttttggactttgtattgatttaccgtaaaactaattttttctgattcatcttctcccaaccaatttactcatatttttgtttgcactctgcaatttcctattaatgtcacacaatttattttcttaaaagtatatgaatgttagacataagaaaagcagatttcaaacaaatcttgacaatggattaaaacccttattagtttgctgtgattttcggcacattaaaattctcttaaattcgttattctttttcttttgtaaaataaaaccgcacatccatatgctaaaaacagattccacgaacatgaatattcattctgattttcttcttcttatttttttgcaattcggatgataaaacataatggatgatgtattaaagtcaaagattttatatagtgggttggttgtcgccttaggattagagtgactatgtaaaaaaaataaaaaaaataagtcaatgatactgcgactaagttcaatgaaagatcaatgagctttttattcagttattttttcttattattatttgtggtcctaattaaattttaaaatatactttttattgttttaatccttttcaattcaccaaaggtccatcattcacattgtcaacaaaagatttattgaaaagttataccacaagacttcgtaaaaatgaccaactttcctatatataaaaaaatagaatcagaatcattaatacaaattaagtacacacgcatatatatatgacatatacatatatataagagacaaatttgagctacacaaaatatctacaaatttataatatggaagccgtgattttttttttaatttataaaaatattaatttatacagcgatttgataaattttttaatttttaaaacttttctaaccaaaatcgttataatcaatatatttttaagacttattaaaagtaaaaaagaataattctgtctaaaaacataatattgttttgatgaaataaaaatattagaaatgaactctaacaataactacgacaaatttaagaaaaaccaacaataatatatagtcatatttcactaaagttaacacaattgttaatttataatatcgatgaaagtatgtatttatataacaatattctaaaaaaagtattatcttattaatttatcgaatcgtattaaatgttaaaatagcataactcagactagaattttttttttatttacagtaaaatgaatattaatttatcaaatatcaatctataaaagttatactgtataaatcatccatcacaaataaatattagtctcaacttcatttaacaggtttctaacctctccatcatattttttttttaataattcacactcacaatatatcaacacatacttataataattttgagcttctttttttctttttaaatatacaaattataatttttacttcatctactgagatctgaacctattatatatttgacgcaagtatcgaaaagttttttagaaaacactcattgtttcttatggctgattgttttttgtttacgtatatccatatatataggccttagcgttgaaccccgatagatcgtagagactacaagtaaatgttgatacccaattttttgcacgtataatataagaattattttccaattaaaccttactatttacagatgagtctagaattctctatctatttttaaaaaaatgattacgaccacaactaatatacaaacaagattcatttctttctttattttatttttatttttcaattacgacgtaaaggatgatccatgaactatattgtttgtattagagaatccaatcaaaccaatctctttggattaatatcaaattattttatccccgtatcttttacagtttcaatttagatgacgatttaagaagctgcaggcgtagcaattattttaataattacaaataaaattgagtgaaaactgtcaacagtctacttatgtgtaaaactaaataaatgaataaatcctcgaaatttaaaaataatgaagaagtcagcatcttcataatggattattataaatatacacatagatggatgttcagacttcattgagatctaagatcacttgaacacttataaaaaatattttgctcttctttctatatatttatataaaaagtcaaaatatcaagaagaggaagaagaagaagaaactcattttctccgcagagaaaatacaatccatg

SEQ ID NO: 5789 - DNA, 3000 bp, Unknown
  misc_feature (1)..( 3000): cDNA_ID_3078480_gDNA_ID_1620818_Annot_ID_169359 3000 nt of promoter + ATG
aaaaatagtagtagtaaataaacatccataatcatatgttaaagaagtaatgaaataataatatcttgtaagagatttattaattgaactatagtctcattcaatcaacgattaagacattattccttttcagcggtacaaaaaagaaaagaaaagcacgaaaatctaatattcagaaataatcaaaactaaagatctgaaaaatagctgtctgataactgtatttcaaattttgaaaataggtctataattaagttttatccgaatcttttgtttgttaagatttctgcttttcacataaaaaccccacaatccctacttaatctccattttcaccttaatatttatttcccttcaatataaaaaaataatcgtccaatagtttatcaccacgtggcacaaactaaagtattttggacaaattttgaattaatttaaaaattcaaaggattttaacaccgtaaaatgcgagtgtatgtatttgcataacagaaaagattctattttcttatcattttctcagtattttctctccgatttttccgtcgtttttctcgcttctctaaatgttaagagtgtacgatccatcacagtgaccaccacgcataaaagaaaaacactaacctccatctttttccttactttgtcttattcctttccgtcgtttcatttcccccaaaaagccatgacgaatcagtctcatgatgatgacgatgacgatgagcagcttcctcgttcgctattcagactcgtttcgcttccccaaaaaaccatgacgaatcagactcatgatgatgacgatgacgatgagcagcttcctctttcgctaaccttgggctcaacatcgtattcctctcagatccgtcctgtgaagtcaccggttcctatagctccaccaccggaattccctggacctgtgacaacgtggccaacacctgctgattttctggcgacgcggtctatggtgcctgatccccctccgccgtctcatcagatacctttatggatgagcaactattttcaacagacaccgaatccgcctcagctggttactcatttcttcccgccgtcaggtttagctccaccttcgtcaaatctaactcctccgccggtgaagagaccagtaaccggttccgttcgtatttatagatcacgatcaaccgtaagtaagaaatccgatacgatttctccgccgtttccatgggcgactaatcgccgtggggagatacaaagccttgagtatctcgaatcgaatcagatcacaaccatcaccggagaggtacaatgtcgacactgcgagaaagtgtatcaggttagctacaatctaagggagagattcgctgaggttgtgaagttttatttgacggagaagaggaaaatgagggacagagctcataaggattgggcgtatccagagcaacggagatgtgagctttgtggccgtgaaaaagctgtgaaaccggtgattgctgaacggaaaagtcagattaattggttgtttttgcttttgggacaaacgttgggtttttgtacattggagcagcttaagaatttctgcaaacattccaagaatcatcgtactggtgctaaggatcgtgttctttacttgacgtatatgggtctctgcaagatgcttcagcctaaatctgacctctttacctgtgtcgccggaaagcggtgagttaggttgattctcctatcctgggtttgattcaatttcagactacgtttggttgaatatcgtttgaactttgcttttacaatattttgtactgttgcttttaggtgatgaataattgtgagagaaatatgcaattgcattgcattgcatggattatcttttgtcgttttctgcttcgttgtatgtttcctctggactttgttttaatatctcattaatatagtatattatggtttttatatatgaatcatgaagtctataatctgttacatgtgtttatttggaattctcgattaataattgatagatattggtactggatatgattttcttttgaatgtgtatctcaactgtcaactttcattattattttttaatttgtctaaactaatttttaattatagtcgatttgaatattttgattttaaataatcgcgatttgaaattaaggaagatatttagaatgttaacaatacttctaaatctaaacgttttttttattcattctaatatgtcgcaaattcaaaattgatttttgtataacctctaatttctaaatatataaatcaaaattgtggataattctccaacttcaaaatatttatcatctctctatatatatcccataaatatgattaaattattgactaaataaattaaactgtaaatcatgtatacttgaatatatttcatatttaattgagaatggaaagataagtcagctcacaaattaccgaccctttcttcgcctaaaattatgaacatgtacgcatgtttttaactaccaaattcacaattcttgagtcaaatcttttgaaagttcaccaattgataacaccacatcgtgtcatcgttcataaactcaaataaataagatcgtgtttcaaccaaaaataaaataaaccgaatataacgtcgattttgtcagaccggttataccgatttggtctaagaacctatgagtattttactaatttaccccttcgtacatcctccacaacggacagaattatcaacccgagagcggagaagaaaagagagagaaaaaaagaaagggaagggacaaaaaaataaatggtgactcaggcgacccacaagcccttccatggctgcttcttcttcttcctctcacccagagacacgaattgaagaaatttgaattctaccaccaattttctacactcacatttatgattttcccgttcttgttggatcctacgagattttgactcgatcttcagaggcagatctgatcgcgaaaatttcttatttccagctaattttcccgtaacgttgttttttttgtttaatcggagatg

SEQ ID NO: 5790 - DNA, 3000 bp, Unknown
  misc_feature (1)..( 3000): cDNA_ID_1829251_gDNA_ID_1620818_Annot_ID_169357 3000 nt of promoter + ATG
ttctatcttgctctatgctgtctttttttgtgtgtgcaaacatatgcatatgcatatgctgtctaatgtctaataataattagttcatttaattaatatacatgtttgccaataaataccattaagtttattctatagatctctataaataagtaattccattctgaatttgcttgaggttcacatagacctatttcatagctacaaattttcaaaatatttattgactatatcagaaaaatgggtgggtatgccggcgggtatgtgattggtgcatttttatatattattgtttaaaattttcattatcaattttttttttttttttaattttctttttaacagaaagatttcttcttcagtcgattttctctcttctctctcatgaatatttcagagagcgatcgactgaactttttgttaacgtccggatcttttccggttatccaatcccgtttagcgggctatcttccaacatgcatcagctcgtattgtgatggatggttggtttgtgttcggtatcgatttgactttcacagtctcgatgatcggttttcgtcggcgttttcctgccgttttgctctcggttgttcatgaccgaataaaggttatgtcatgatggccaattttgggtcaaaatcacaaacttttgaaatcaatttcaatccctaattatcctaccttcagttttagcttctcttcccaaggccttcaaccgattgatcccaatctctcatctatgagatggccagatgggtgttgttgcggttaggcagttcttgtagcttctaccaacaagaattcacaatcagatttggatcaagatctgaaaggtctatttctgcttatccggtcttctgtcgagtaagtctagagatacatgtgtcaacatatcattgatgattccaaagcttcatcatcaaaggttcatcaagttgggtttgcaagtagatgttttagggggtgttattggtttgtgattttgaaagagttttaatgacttttaaaagatatagaatccaaaatcttgtaaagtctttctagaatcttgtaaaatcttcctgaatataattataaactttgatttgtgatttctccaaaattataacatatctccaaaatattgtatactattctctcctcttctataaaatctatctccaccaaagtgaaaatcacacgcataaacacaataactatggtattcgtaagtaagctacatgaacatggaactatccatgaagaacttgaagttttattttcaaatattttgttggatatttacttttcatgtgttggattaaaatgctttgttctaaaaattgtttgtgtgttaatttttcacaaagattatagaggagcacgtgtgggacctgagccataatatatatacagtaaaacctctataaattaataatgttgggaccttgaaattctattaatttatagaggtattaatttatttataaaataataattattaatttatagagaatttaggttaattttgtaatttttttaaaaattatgtttgaaataattttattttatttataatcattatctttctagaagtaactgcaaataaggataaattattgtgtccaaaaaacaacaaaaaaacagtttttgatgtagtaaaaatattaaaattgaactttactaaaaattagtataaattaataaaagtaaaataatagcagattcatatttcactaattttcttacatataacatatatatattttaagaagttcttacaattattaatttatgatactaatgggaccatatatttatataagattttttaaaaaattattatcttattaatttatcaatttgtgtcattttttacactggtcccaactcgggaccagaagaatttattaatttatagaggttattaatttatcgaatattaatttgtagaggttatattgtattgttcattactgttaatgagatttctgcatctgttcgtatcattggtttttgtttatatccaaagtcatgattcacaatctctctctttttatgatacttttcatgattttaatttgtgaagaaaagagtataaaatcataatccaataacacaaaattttaaatcattaacaatcatgaaaactgttgtttaagttaaataacacaaaatttgtaatgactttattagagtatgaatccaataagttcagatttataaaaaatttagattatttttttacaaatcaaaatttaataacaccaaaagtcttataaaatcttaattaaataacaaaagatttttcataacattttgtcactaaaaatccatataaatcacaaaccaataatacccccttaatttcttaagtcgctttattaactagggaggacgagtagatcagagttttccggtggtatggcgagttccgtcatcaacagcaaaattccgttctcggaaaagaagtaattaggtgttcagatgcttttcaaaggataattaggggttaattactagattttgcttgtttaattattgttttgtgcctgtaattggtatatgttttggtactttcggtttgtgttttagtttcgaggaattttcgttttcgccggcgaaatatccggagatttacatgtgttctccgatcaatatcgttgtatttgtgtttctcttttttcgtttgaaggattgaataaaagttacttcctttgttccttttagtttgattgtttagaaatttttttttttttaaaaagattgactttttaagtttttcatgcaatatttattagttaatattggtgaattgtaattttaaaaaagaatagttaattatcattagtttaaagttataaaaaactgtaaaacaataaaaaataatatatttataatcaatatttaatatgttttttttttaaacagttaaaaaaaaaaaagagaggaaatatattgtaaaaagaatgaaataatatttttaaccgcgtagtgcgatcatcttctccggccctaata

SEQ ID NO: 5791 - DNA, 3000 bp, Unknown
  misc_feature (1)..( 3000): cDNA_ID_1829259_gDNA_ID_1620818_Annot_ID_169352 3000 nt of promoter + ATG
cggaaattggtttttgaaccggtttaaatgtgaaacccgtttggatttttgttttgtttttttatctcatcttcttcttcagaaaaacacaagataacagaattgccaccaaagctccatttttatccccacacagaagaagcttggggaatgagaagataagagctctcaaaattccccgaatttcgaatatgattgtaacactaaaccctaagattctccatttctccaaaatccatcctttttctcgaccttcttcgtatctctgtagaactcgaaatgtgtctctgataaccaattgcaagcttcagaagcctcaagatggtaatcagagaagtagtagtaacagaaatctcacgaagaccatttcactttccgattcagcaccgccggttacggaggagaccggcgatggaattgttaagggaggtggtaatggtggaggaggaggaggagacggaagaggaggattagggtttttgaagattttaccaagaaaggttttgtcagttttgtcgaatttgccacttgctattacagaaatgttcaccattgctgctctcatggctcttggtaagtgttagggtttttgtagatttgaattggtttgttgcattagagttgagaaaatgattaaagtttcatctttttagggactgtgattgaacaaggtgaaacccctgatttctatttccaaaagtatccagaggataatcctgtactagggttcttcacttggagatggatttccacacttggattggatcatatgtactctgctcctatttttcttgggatgttggttcttttagcagcttcacttatggcctgtacttatactactcagatacctttggttaaggttgcaagaaggtttgttttagttcctttgttcgttttgtaactccttctttctactgaagagcactaagggaactttggcaaattgcagatggagttttatgaagtcagatgaggcaattaaaaagcaggagtttgcagatactcttcctagagcttccattcaagacttgggaatgattttgatgggtgatggatttgaggttaggattagttttctacttttcaagttcttttatatgtgtctgtgaggtttgtcttggtctagtgatagtaatttttcagtttgtttgttctgcaggtgtttatgaagggtccttcattgtatgcttttaaaggtttggctggtcgatttgcacctattggagtacatatagcaatgcttctgattatggtgggtggaactcttagtgctaccgggagctttagaggctcggtcacagttcctcaaggactaaattttgtcatgggagatgtcttagcaccaattgggtttttctcaattccaacagatgcttttaataccgaagttcatgttaatcgattcaccatggattattatgacagtggagaagtgagtcttttgttttgcttccctgttctctcattttgtcttcatgattgcaatgtcttgtgattaaatagagttctgtttgatttatcttgttttgatttggtgtaggtctcacagtttcactctgatctttcactacgtgaccttaatgggaaagaggttttgagaaaaacaattagcgttaatgatcccttgagatatggtggggtcaccgtataccagacagattggagtttctcagccttgcaggtgacaaaggatggtgaaggaccattcaacttggctatggcaccaattaagatcaatggagacaagaaattatatgggaccttcttacctgttggtgatactaatgctcccaatgtcaaaggaatgtaagaaccctcttacctttgacgaacctttctttttgattaagccaaaggagcgtataacagatgaaacagtttcttagattcttggcatagagatacattttggtgtcttgtattggccttaacgttgctccagttgagtttttttcagatctatgctagctcgggatctacaatccattgttgtgtacgatttggacggaaaattcgctggaataaggagaccaagctcgaagcttcccattgagatcaatggtatgaagattgttattgaagatgcaattggaagcactggccttgagttaaaggtaaaaagactttataaaatgtcacagggcacaaaaaaaggaagagttatcctagtttgtaatattatatgacatctttgttcttggccttgtttctcagactgacccaggagtaccagtggtctatgctggttttggtgctctaatgctcacaacctgtatcagttacttatctcattcacaggtaaaagtaactctcaaaatcgatatccgatcaaaaagtcttgttttataccaatgtgtcccattggcattttgctctactagatttttgtctttcatcatctaactcttttcttttttttgatattcaatctcttatgttctgtatgaagatatgggcactacaaaacggaacagcattggtcgtagggggaaaaacaaacagagccaagaaccaattccctgatgacatgaatcgtttgctcgatcaagttccggagttaatcaagaagaatacttcagttgtctctgagcaatcttgattagctcttcgactctgatacatttcaaaccaatatagttgtacagaattatggaacaggtatagttttggagaacacatacacactctacatgttgctaatcatatgggaagagagagtcagagaggagctataaaaactgaaacttcaaattgatttgtatggaagttttgtttgaagagtcttagcttccttgtttgtcaagttatttgatctgtatctgtaacttcagtttcctatgtttttagtcgtagttcaaaatttagaagaaaaaataataataatttgccgacaaaattaataaaataatgccaaaccgacgacaaaatcaagattcttgtctgttgtcccaaattgctcatcaaattcaagatcctgtaaaatcagtagcaaccatg

SEQ ID NO: 5792 - DNA, 3000 bp, Unknown
  misc_feature (1)..( 3000): cDNA_ID_1829266_gDNA_ID_1620818_Annot_ID_169346 3000 nt of promoter + ATG
tggtttcgatgagcttaatagctccacgtcctttggaacagagtttgtccatcactttctcaggactgcagcaaaccactttgattgtgaccgtgttggtttcttcttcgaacttttggtctcttacttcttttgttttcccaaaaaaatcacataaaacaaattattattatgagtttttaatttcaaaccaaaagagacgtaaaaggagagaaagatataacaataacatacgaggtatgctcgaaagagccttcttgactttcgagaaattcttttcgttactaagaggctccgtcttcaatttcatccatgttacctagtttaatttcatcatataatgttctcatagcttttaatacaacttttgtaacaattagtagtaacggtttcaaagagaagcacaaaaaagaaaaagaagagagcgtttatttaccttctccttacccttctcggccatggctttgaaaagaaaaatattttcagtgtaattgcttgtatatactaacactactatgcagctatgctatatatttggagtttcacgagagggtttccaaggaaaaagaagttgaatattgtacaatttacttttctcttagaatgtataatttccatagctattattccatattacattgtcctaaaacaatgtaaattttcttttctttttttgtttaaagtttttcctatcttgtttttttagttgaaatttcaaatttccttttgttaacaaaaagaaaatattaccaaaaaacaaatgatggggcttagtgggggttctaaagagagaaacaaagcatagttctattcttttggaagaggactaaaccctgctgtttttttcggagcgaggatttacgagttttggccaagaactttcggttttttttttttttttgaatagtcctagaactttcggttttttaaaaaataatactaatgtaatagaaaaaaaatggtgtttcttcggagaaaaatgacaacgggtggcaaaccaccttcgaagctatcccttgagcatgtgcacgccagtgtacttaagtgagacattaagttccaaatcaatgcgaacgagctgagaggaggagatcccattacgactgtgtcgactcaaatttctcttcttccataagtaatagatcactgattggaaccaccttgtgatacaaaacattataatcccatttgatgtattttacagagattagatgagaaaccgtgtctgaccaatgatagtcggctagaatgtgaatgtgtaagaacacacaaaacaaaataaaccttggtggaaaaattattattcaagcgttaatcgtgagaagaaaataatattctttcttaaagtattgtgaaaacataaacttttcaaaatctaaaatatgttaaatatttatttgaatttactttgtagtttaaccgtgtaaaaactttttacctataaaaaagaaaaaaaaataatagggataagttttttttatatatacccataataattaaaacatcgttcaaatttggatattttccttataaaaagttaaagaaaaagcatgtttttgtaaatttaattcatagaaaatgtctgaaattttccattatttataaagattatagattcgccgaaaattaaattgttaaggctggggaagaattattgttcacgccaacaatcacgttatgacataagattcgaaagttagcgttaaatttgatgtttccactgttaccaagcaaaaaaataaacatgtcaaacaaaagaaaatggactacaaatttgatagaaaaaaatgtgaataaaataactgtagtcgtttatttacttagagttgtatacatattgactaaacacaataagaaaacaattttatagaatactataggtcttaaaagatagtatattttattttcatttgatgaaattacatatttgactatgtttctaattgaaaaaaaaaaaatttattaaaatatccataaaaatgaaatgataaaatttattaaaattaaatgggctgaccttgtaataatatagggagcaggtcggagactcagagagtgagcttttcttgctcgtccatttattaataatttcattaaagagaaaatctgtagagttgacactttttaaagtctaattattagggatatatacgtaatttggtttgaaaataaatatcaaaatctagctaacttgatatcagtatgggtaaaagataggagtaccttttgttgttgatttaattgacgatctagtgttaacccagagaattctaattagattagcctctttctctcatccgaaagttgaagtttaataagttaatctgatatttgtaaataacttgaacagtaaatcataaacaaagaaaaactgatttggttgcacaatttaattagtgaggtgaggtctatcacaatcactggttactatagtgataaagatcctgattatgacagtgactgtgagctggtgaggtctaagagtacaaaaacaaatgatctaagttatcaaactataaactatataattcgaaatatattaattttgttaaatccaaaaccaaattgcatgcaaatggtcagtttgtaaatagtctacgtttggtccaattactctttactcttaaggttctttactatattcaaacccactaaatctacttgcatataacacatagagacacaaaaattagtatttaaaacatttagataacaaacaaaagaaagagaggctcctaataaaggcgcaattaaaaaccggtcagaaatacaccaattgtgagactcaagaagttattgctcaactacttcctctaactcataaccacaatctccaaacttcaccaccgattcacagagacttttattaaccttcaaaacattatttattattccaatcttcaaagagagacactcacactccttatcttcttcattcctccatcctatttttcttcttcgccaaagtgttattcctcaactttatatattacacaaatg

SEQ ID NO: 5793 - DNA, 3000 bp, Unknown
  misc_feature (1)..( 3000): cDNA_ID_2992566_gDNA_ID_1620818_Annot_ID_169341 3000 nt of promoter + ATG
ttggttcgcctttcgaatctaatttttttttctttattcaaattatttcaaaatacaattatatataatttattttttgtttgaacaaaattttacatttattccgaaaaaaaaaactatgcaaaagaaaattttaatccaacttctcatcatcctcaaaataatgataacaatatatccgcttcattagtaactgtaaccttcttcgatcaaacaactcatctgcaaagactagactatttcatttatctaacattaccgttaacaaacaaaaaacaaaaatttacttgggagtcgaagaagtcaaatatctagaagaatacttcttcttacaaaattataaggaaaatttcccctactgcttcgagaaatacctttttccccattcacgttatgttatgcaacgtgtgaggataacgagcggacaacacagcccttatccttattttattggtcaaccaaccccaaaacagattttaagacggagtgtatttcttttgtcaactgtttacatgggttaaataaaacagtttcactaaaacttattaaattatcatgtcatattgtcatgtatataagctatagcatatatacggatggaatatcgattaaaccattttctttttcaccattggaccataatcagataatatacatagattgggaaccccaaatattttcacattttgacatatttagtagcgacattaaactacttcgtgaaaatacataggatattatgtcaaattgtcaacgaaactttttatatttaataagaaaacgaaattaaataataattaacagaaaatactcacaagtgactttcaatgattttgtctctaacgttttcaatgtttattttttggtctctgactcttcaaggaaactggtaaaaccggtgtcccggtagtcatcactcacatctcgtccaccacgtgtcactcttacacgttcataagttttcccacctttctacgtccgattctgtatttatataccctaaacccatcgtcttctatacatgctcttatttcacaatcccaccaaaacaaatctcaagaacatttcaagattcagaaaaaagaaactcgcaaacttttttcttttgtttctgtcaacgttcaaataatcaagcgattgttttttttaacctagaaaaattatggctatagaagaaaaccgaagtcacaacgattatcttaggaggatgacttttgcagcgttcttgaaatctggttctctcgccgccgaggaagaaacttaccacagcgacggtgatcatcataaccaaagcacctttagcagcaacagcgattctcagcggccaagcaacgcttcaagtgctagtagcgattcgtcatcaccaatctacccattatctccatggaaccaaacttactacccaagcaacgacaacacgacgtcgttttcatctgttactcaatcaccatggaaccaaacttactctccgtaccacaaatctccatggatttaccaaaccaggaacagtgatttcgaggatgatcctgataacggtttgatcggtacggtcgtgagacaagaaggacacgtgtactctctcgctgcttcaggtgatcttcttttcaccggttctgattccaagaacattcgggtttggaaagatcttaaagatttctccgggtttaaatccacaagcggttttgttaaagccattgtagtaaccagagataaccgggttttcaccggtcatcaggatggtaaaatccgggtatggagaggatcaaagaagaaccccgagaaatattcacgagtcggaagtttaccaactcttaaagaatttctcaccaaatcggtaaatcctagaaactacgtcgaagtccgtcgccggaaaaacgttttgaagatccgacatttcgacgctgtgtcttgtctgagcttaaacgaagatctcggtttgctctactccggttcttgggacaagactcttaaggtctggagattgtccgattcaaaatgtttagaatcaatcgaagctcacgacgatgccgttaacacggtggtttccggtttcgacgatttggtatttaccggttcagccgacggaacgttgaaagtatggaaacgtgaggtacaaggcaaagagatgaagcatgttttggtacaagtgttaatgaaacaagagaacgcagtaacggcgttagctgttaatttaacggacgctgttgtttactgtggttcgtctgacggaaccgttaacttctgggaacggcaaaagtatttgactcacaaagggacgattcacggccaccgtatggcggttttgtgtctcgccaccgccgggagtttgcttttgagcggtggagctgataagaatatttgcgtttggaaaagaaacggggacggatcgcatacgtgtctctctgttttgatggatcatgaaggaccggttaagtgtttagcggcggtggaagaggcggaggaagatcataacgacggagacgacggtggagagaaaggggatcaacggtggatagtgtatagtgggagtttagacaactccgttaaagtgtggcgcgtgacggattacgcttcgtaagcgcgtgaagaagtatacgtgtggacgacgtaggagcgtgaaggaatgtttcccggccatgtggttgtatagcgttttatcgtcaaaggaggaattgattgggaggcaactagtaggtagatttggtacttgtgatgaccaatagtgtattgtcacgtatcatgtgactttgtcatcttctttggaagtgtgaaaaagtcttttgttgttgcgttagatcttttattgtctcttgtaatggcatgcacttattttaaatcatgtgaaactaaaagaggaaagaaggtggagaaaaaaaggaaagtaaagattccgctacaatgagaaacaaaaaaagatataagaaatgtaataaatgtgactatgtaaaagttgtttgttatcgagtctttattctctatggttgttgtcaatgttgaatg

SEQ ID NO: 5794 - DNA, 3000 bp, Unknown; identical to SEQ ID NO: 5786
  misc_feature (1)..( 3000): cDNA_ID_1808768_gDNA_ID_1620818_Annot_ID_169339 3000 nt of promoter + ATG

SEQ ID NO: 5795 - DNA, 3000 bp, Unknown; identical to SEQ ID NO: 5785
  misc_feature (1)..( 3000): cDNA_ID_3078447_gDNA_ID_1620818_Annot_ID_169335 3000 nt of promoter + ATG

SEQ ID NO: 5796 - DNA, 3000 bp, Unknown; identical to SEQ ID NO: 5784
  misc_feature (1)..( 3000): cDNA_ID_3078455_gDNA_ID_1620818_Annot_ID_169332 3000 nt of promoter + ATG

SEQ ID NO: 5797 - DNA, 3000 bp, Unknown; identical to SEQ ID NO: 5792
  misc_feature (1)..( 3000): cDNA_ID_1829266_gDNA_ID_1620818_Annot_ID_50662 3000 nt of promoter + ATG

SEQ ID NO: 5798 - DNA, 3000 bp, Unknown; identical to SEQ ID NO: 5791
  misc_feature (1)..( 3000): cDNA_ID_1829259_gDNA_ID_1620818_Annot_ID_50666 3000 nt of promoter + ATG

SEQ ID NO: 5799 - DNA, 3000 bp, Unknown; identical to SEQ ID NO: 5790
  misc_feature (1)..( 3000): cDNA_ID_1829251_gDNA_ID_1620818_Annot_ID_50669 3000 nt of promoter + ATG

SEQ ID NO: 5800 - DNA, 3000 bp, Unknown; identical to SEQ ID NO: 5789
  misc_feature (1)..( 3000): cDNA_ID_1829243_gDNA_ID_1620818_Annot_ID_50671 3000 nt of promoter + ATG

SEQ ID NO: 5801 - DNA, 3000 bp, Unknown; identical to SEQ ID NO: 5788
  misc_feature (1)..( 3000): cDNA_ID_1829236_gDNA_ID_1620818_Annot_ID_50673 3000 nt of promoter + ATG

SEQ ID NO: 5802 - DNA, 3000 bp, Unknown
  misc_feature (1)..( 3000): cDNA_ID_1379064_gDNA_ID_1620818_Annot_ID_50674 3000 nt of promoter + ATG
ttcatcgaagaaggaaaagaaaaaccttgttcttgtagtatattaatcggtttaaaactgcatttattctaaaacaacacttcatttaaaacggatggagtatatcccacgtaataacaaaaattctaaaaacgacaacgatacagttatctatgaactaatcatattttcatttttattttgactaataattaaattgctacgtcgattttaaaaagtatacaacataaaaatatacatttttaaaactcaaatataattacgatgtagattttgtaattaaatcattcaacacaaattctaagtaacatgaccttagataaaacatttcggagcgatgatgctaatggaggatgttggcacaacatcttcttgattatttgacagactatactaaatcaaatatcctataacaaaagaccaaacaaataaaaaaaactatcaattaattaataataattaaatatatagaaactgataattagccaatcatatattatttttttattttatcttatgaatttaattatacatagatatacatttgttcttggaagttttccggcgttatatttctcaaacattgtatgattcaaaatatataaaaataacaccaactagtaaaaaagtaattgtactcgccaatttaaacatatattaatgtgtagcacaataataagattgacgacacaattttattagataaacaacaacaacgacaacatcaacaagcacaacatgtaaataagaagttcagaaacactcaaaaatgagtagaggatgaagctggataaggattcttgcgaacgtacttacgagcccaaacatgtttgccatcgatggtgaacttgtttctaaacctcgcactcacaatctcatccatcatcgacgcacactgcagtttcatcaccatcttcgcaaacaatggctgctcgtttgcttcaacttcttgcatctctaccgcttctatcacttccccgaatctcctagtgaagtaaacccttacttccgcttccgagatcggatacccttttgaaaacgtcaggaaaaccgtccgatcatctgccgccagcacaccttccttctcttttacctccattgtctctttctctctaagggccttttctgtttcgtcttcaactggaggatgaggacgaggaggaggaggagaagcaatttttacttgttgtacacttaacctattagatttttcttgttggagactcaacctgagtttcttcatatcctctatgaatttctctctctctaaagccaattgtttctccctgttgatcctatgagctgtctcgcataaatctgagaatgctcgagtgcaaacatcggtccaactctttgtcactccagcgcaaaagtttttgcgttgttggttgatcaatctgagagtaaactttcctccagtaatacgtaagagcaatggtatcatggagttatcatcgttgtcagcagcgaagaacgttgatgcaaactctacgttgtataacaaatttatacacacaccgatttcgttagccaccgcgtcgacaaaagcgtttggtaacgagacaaggtacgcgattatgtcgcgggcataactggattgctcgaggaacaagagaaaacacatggctagaaacgactggtcaacgtctcggtttagattgaagacaagacgactgaacaaggttctgtcgattgtgtgaaaagcattgaactcgtctcgtgtcaccacaattgaagataaaggattgtttaagacagacggatacaaaggagaagccatgactgattttttatcgatatgtggtggtgatgggtgatgttatctatgtgattagagagggtttataaagagaatccattgaaatgttgaaaaggtgtaatcatatttttccttaataatttgtatttcattcctaaagagtttttgtcctcgttcatgtatctaattaattacatacaacagtcataaccttaaagaggcttggtatcgttttggtgtgagacattgtgacccttggatcatcatcattcttcacccataacccttcgatcattatcgtcatctatcacccttccctaacatttttgtttctttatgaagggagcctaaattattaagtattactattttctgacgctttactgtttttttttaaattaagataaaatatacagggtcaaacatttgataaggatattttaatcttgtcattaaggaaaataaaatatttgactacagtataatctcgatttaattaaatatattaattgtacatcatttgatttctccaaaataaattatatttcataaaggttttgtagtcaaaaatacttattttttgctaatagttaactgtatttttatttatttttataatttaagaattaaattttttatactttttcgtatatttccgtacatttcctatcttttaagttatttacattgcgttaatataaattaaaagaagaaatttagtagttagttaactataattataaaatggtaaaaaccgatatttgataaaataatatgtcattgaacgaattagcaaatacgtatcgtaaataaaatgtgtacggctccgtactgttttgataaataaaataatatcaaacaaaataatattatttatttaaaagtaatcacaaattttttattaaatctgaagataaaattctggataaaccataagattctttacctaaaataaaggtcaaagttttagtatgaaaataaatagaaatgttctgtataaggttaattagttggatatactgatatacatacattttgttaaaatccataaatcatcaccactaaatatctttgaaaataatattataaaaaaaaatgacaggtcagcaacagtataatcaagggggcagagaagaaagaaaataatcggaaacagcgtcttctccataaacccagaaaatcgcagagagctttctcttgtctttgtacagatctctcccatcatcgttcgtgattcgatg

SEQ ID NO: 5803 - DNA, 3000 bp, Unknown; identical to SEQ ID NO: 5787
  misc_feature (1)..( 3000): cDNA_ID_1829228_gDNA_ID_1620818_Annot_ID_50676 3000 nt of promoter + ATG

SEQ ID NO: 5804 - DNA, 3000 bp, Unknown
  misc_feature (1)..( 3000): cDNA_ID_2041423_gDNA_ID_1620819_Annot_ID_169380 3000 nt of promoter + ATG
ttaagttctcactccttctgtatccatttcatctcatctttctttgctggtttaatattaccaaagctgctttcagaaaacgaagaagcagagtacaacaactggactcaggacctgcaataacatattggcaatgacaaaggtgaaaaacagagccatattttcttacctctttatgtcccttgctttctaggtaacttgtatatatctgtttaataaatcaagggtgttagccaatatgactgtttggtatgttacagggattgcatgcaaaagcgccttcatttatcggaaacaccagtgttactctttcttggaaagaacccacgaaagtgacgaaaccgttagcctctacaacgactgggtacaagccaaatcaactttgttagttttgcaggtttcttttcttgttttgcaaatgtggaaaaactaatgtttgtacgtttcatgtggctctaccacagaggaaaacggcctgcaaatggagccggtaataacgtgggtgcaaaaaaggctcgtgtgcagaatcaacaacaggttgtgaacaaaagatctgagggaatctcacacggtggtggtagaggcagtcacagaggccgaggccggggccaaggtcagggaagacacagtggtggtggtggcggccgtggccgtggaagaagaggcttctggtaatttcaaaggattctccatgacactcttttttgtctgttcttgtataacagagtatgtttatccttcttgttttggctcttttaggctcctaacattcgacaaacaaattaatctcttttgcgatttctttggcttctcctttatatgacaaattctttgttttcttttctctttaactaccctttctgggaagtcaactgtcctaaactcataatgcaatagtcagaaatgattaatgccaaagtaacagtaaaaaatattaatttataaataaccccttcaaccttctctgtatttatcaacttaatgtcactccatgttatatattcgacaatgtaactctgtgtttcaacgcccatgcatccttccaatggcacaacttgttctgtccctgacttctctctttctagcctctaatctttaaatgatctcatgaaactggtgtgtaacttcctacagaatccaacgaagccaagcccagagctattaaagagacttggtgagtacgtaacatgatggtgattctgttttgtggtttctgcagatatatgaccttcttcggattatttttcaatctgcagaagcaagtgtggaaacagatcatgcttctcacattaattcctttcctcattgtgaaactttcagagctattcgattcacgatcttggagacactattgttctaatgacgctgatggctgatagtttccacttctgcaactcttttgcttttggctctttcggtatacatatgtacataactttatagctttactgaattaagttcaagattttgtgtctaatctttgacatattatgaatctctgaagcttttggatacgagtggactaaagaatagcttggataagcgaggatttagctcatgtccgaagtgaaaaagaaactgcagagagatattcgcttgaacgcattctgcaagatggacaactcactagggaaagcttgaaaaagtaaaccactgatcgattgttttgctctggttcttgctttggtttttaatagaaaactaactgactttttacaggctaagggaatcacttgcgctgtaagtttttaaaagaagaacattctttctgttccattgctcttactggttctcggtttttaactttcaagagactaaaaactgctgtgtaggcggcagctgttgctccgagtctgaaggtgggaaagcagaacaaaagtgttggttagaaacataaataacgctttgtctagaaacctaaagaacgctttgtctcttcacttctgtgccaaaaaaagaaaagcaagaaacagcatctctcacattttcacaggtacacataatcattgattcaatcttggttctttagattttttctttctttctttcttgttgctgaatcttgaagttttcgggttcagatctacagggatgttacattcaacaatttgatggggatgtcgagaatcttagtgatagtgtacgccaaaagattgacatggaattgttcaacagagaaaatcttgattttgtttccctgcttcttcctttgtatcatatcccttcaatcattgtctttactacatttcaatgtctcacattgtaaaaggaaaaatgtacagagaagataaaatcttttgacatcgatacatagttatctttctatgcaagtaactctggtacagtccttgttctactaaacaagtatacaagttgtattttctagttccataactctgataaaacaaaattggccttggtgtctacattgacgtttaaagttgtataatgaacattattgatacacatattaaactagaaaattagaagtttgttcaaacgattttaaaagtcaatataatagtcaccaaccaatcatagatgcataattaaagaggtgtcaattcacgttcttctaaaatccagcctcagcttcatcaattttataattttaccaacctcaacaagtatttatttattctaatatatgataataaacctcgagggatattatgataaaactatataataatcaccggcttataataattagaaaggtggaccatttccgttttttaaaatcagactcaataaatgtgaaagtccagtgtttcaatattttaacctcagtttcatcaattttatataccttattgtctttcattattcttttacgtaaaacccttccaaaaatcatgttacattgcttaatttatgtgtgtgtgtgtcagtgtattgcttaatttatgtgtgtgtcagtgtatataaatatatgcagcgtaagaagagaaggatcagaccaaaactattgacttaaaacactgtttcaagtttacttcc

SEQ ID NO: 5805 - DNA, 3000 bp, Unknown
  misc_feature (1)..( 3000): cDNA_ID_2041419_gDNA_ID_1620819_Annot_ID_169381 3000 nt of promoter + ATG
atgacaatatggttttggtcacactcatattctctggttctgcaactgttctctactttgtttatttggtaatgattcacaccttcaaaaaaatgatgtaaagcttcaagattcatatctttttgtgcctaatcttttttttttcaaaacccgcagtattttgataaagcggaccaagtgaagagcctagaatacgcgaagtttgagctcatgtcagaagttcataagcacttgcagaatttttcgcctcaaagccttataagaaatggacaactatgtcaagagagcttgaaaaggtttgtttctacattttttcctttgttattctaattttaagaaacgctctttttatttgattctgtttctgtattcttactggttatttttattcagtttgttcaaaaagtttgatgtcaacaaagacggaaagatccaagtatcagagttaaaagatctgacagtggactttggggtattagggagagtgaagtgtgatataaatgagcttgccactactttgcttgctgatttcgacagtaatagagatggtgagatagatgagactgaattcgccattggtatcgaaaaatggctgaaacagtacaaatttagcttcaatggcaccgagtcacaaggagaggacatagccgtaagtgcagcacaatcttctcataacattttttacatgtttgatcagattaagaaattgggaagtgttaactgcaggaggatgatggagttttgaaggtggaacaattactaaagggatgtctttttactaagttgcttacaaagagaaccttgaaagctgtcattgaagtcattatagggattactattgtcagctttcttgcaatgcctttcatgatgaatatcgaacttttgtcggtatcagctggagtgccttccttctatgttgtctttgcagtgatccctttggcaagaaacctaaagaacgctttgtctgctcacttctgtcgcaagaaagagaaagcaaaaattacatctgacacattttctgaggttagttttcttgaaactcacgtttattaactcggtatcaatattacccttatgatctttatcagagctcaaaggtgaatgagttttgtggttcttttcttttgtagatttatagagatgttacattgaacaatctgctggggataacaattatattggcgattgtgtacatcagaggattgacttgggattattcaacagaagttctcattattgtgatcgttggtctcataataggtgtaccggcctatgtgagatcgacttatccattttggatatgtgtcttggcctttgctctctacttcttctctcttatcctaatctatctccattccaagtctacctttaatgaataatcagtgaatatttccaaattgtttttttttttgctttcaagatttcatagttactattccgatttcgatacgctatgtattttgaaagttccgtcgacgttttatgtatatgagctctttgatgattgttaagcatccggagctagataagaattttaaatctttgatgttatgaatatctatgaaagtttgcagaaattgtgaaaatggacgttcaatgttgacactaagtaaggaaactactatacaagtttgcattctcacttggagacatttcaacgttttcagataatacttttctcaaaatcactattcagaaatgaatgttgaattcatatctgttagctataccaaaagaatatgaatccaaaaaaaatcaagttctaccatataattgacacacatgtgttgaactagttgattctgtatttctttattttttccaacaaatgcatttttgtttttatcagcgaaagaatgtgaagtacagtaaaacctctataatcttatgatcgtgaaattttattaatttatcgataaattagtatttattaatttatagagatatttgactaattttgtaatatttcaagatttttctttgagaaacaaagttttttcattataatcaaatatcattttataaccaattacaagtaaaaaaaatcattattctgtttagaaaacatcataaaaagttttcgatgtagtaaaatattatagacgaattccaccaaaattaaatgtaatttttttaaaaaataaataatactagagaatagagtcctattaatttatgatattgatgataccatatatttacatagaattttcggaaaaactattatcttattattttattaaattacattaaattttacagtgatatgattcaagagtgaagaaatttaattaatttataaatgattattaaattatcaaagttttgtatttagatttttactgtagatcatcaatcgtcaaacattccatgcctaaaaattaattttccaaatattttcacgaaatgttaatggtagacatcacatcgggtgcttatgtaaacaaagtcctccccattggctctatgagcctttctaataatataagttgttgacaaaaaaagaatgacatcggctgcttttcacgcaagtaagggcattgaatacgcgttgtggtctattgtgcaactgtattttgacgtcagttcctatctaatatttggggttaaggtgatgtactggagattccacacctttaaactaagcacactagttcttatttaaaccaaaattcaaaagtcaatagtccttaacaaatctatctatattctaccccactgacccggccaatcataattagagaggtgtaactcacgttctaacatttaacaataattcagaaaacaaagtctttctttatttactaagagctagtcgtaataacttgttcaactctagaaagtctttcttaattctattacgtaaaaactaaacagtaagaaattgctatagtaagattatgtttctgttggtttctgtgtatatatatatatgttggagtcagaagagacaaatacaacaaaagtgctcattataaacactgtttcgagtttacttcc

SEQ ID NO: 5806 - DNA, 3000 bp, Unknown
  misc_feature (1)..( 3000): cDNA_ID_3078515_gDNA_ID_1620819_Annot_ID_169385 3000 nt of promoter + ATG
cactggtacagagaatcagttgtatggaatgttattgtcttgttgtctggtacaagttatcaaatagtggaagaagactagtctaggaaagcatcattcgaaaaattatgttcattaaggcatacaagtatgtttttctaccattttagggtacttaaacttcgggcactgctcgataaaagcaggtggtctttcataagtcacagatgcagctctgatcaaaatcccagcagttaaaccccatatcatataatccttatctcctgttctgtagtcaaagtaatggatcaaatacttttcacccatccactctctctcttcagatcttcgattctcatcctgaaacaaaaaaaaaaaggttcaagtaatgatgcttgagaagggaaaaaacacaactacagctaaagtaacttggtaagaaaacaagagcaaccttaaggaacatttccaagggtgcatcaaacacagcttccacttccccaggatttggtatcggattgaatttatttttgtccctcaagatgcctatcacaggaattactctaagaagatgctgtaagacaatgacgcacatgtaagaaaaatatctatcagaaatgttgacataatccagataacattattcttccgaattaacacctagtcctacttaagaacatccagaatcaaaactagatagcgatcaagaacgtcactttagctaccagatctctgctactatgatataatacagctgacatggaagttcaataaccaaagttctatagaaccactagtaactcatactataacctcgatgttcaagcacagatcaacaagatagtctatataacctcaactttaatgccaatcccaaattctgatctcactaagagcatgcatcaccaccaataagacatggagaattaacaccatttattaataccttagacagaaatggttcaagagaagtaacaacatcaacaagagaagggtccaatccaatctcttcctcagcctctctggtagcagtcatcccatcatctttatcatcctcctccgctttaccacctggcaatgaaacttctcctgcaaccacaaaaaaaaacaaccacctcaaattcaacactaaaccatactcattgaccaaaatcaaagaagccaatgatttcaaagtaaaaagacgaaaactttaaatcgcaaaccatacgaaccagagtgagtagacaatttggaagatctcttagtaagaataacacgcaaatcaccatcatctccttcaaagagacagatcaacacagcggctctcttgggtttaaacctatcagggtctttcgaaagaggagcaatagattcctgaaacccaacctgagaaacgactttcccagcggtctcctgatctgtctgcatctcctcggagtcatcgaacgatgaagaaggtgggggcttgtattggcgaagttgctgggctaaagcggcgagacgagaagagccaccaccgaaagaagaagaagaagtcgctgttatcgcaggctccatagatttgcagagaagggttgttgttgttgttcgtgcaaatgaaggaagcctacgataaagcaaaaacatgaatccgatttgcggaaatggattctgtgtagatcaatcatatgatttcaaagaagaaaaaaaaaactcaaatttaattagacaaaatcagacacctcctcgtgtgagtgtccacgtgtttctccttttttgtgacttttttttttttggcttttctttcgctcatgtgaaaagctttattattggctttattttttattttttttttattttttttattttttttagtaaacacgtattattgcagctgtgggtattggtatatactattttttatcgtttttgtaattgaatcacaaaatccgtattttttagatgttgatactgttttttgtatcttatattttatttttattttattttaaatttgcgaaaagaattttaccgttttgtgtactcatcgatgtaatttattgtatgcgatttgtaaaaacatgtggacaaaaaaaatcgcttggatttcaatctttaaaagctacaaatccaaatctttgcgattgtaataaatttgatgtaaacgattttgtgttttctttcatttgttaattatcataaatactttcaaaattgaaggtttgcatacgaaacaaataattgaccattttcaaatggtttggaatttggatcatcaatgatcaaacttcaattagttggattttcttttttttctttttggagcttgtggctctagttcagtttaaatatcatatatgagttatgtgtcttaggtaatcattttcacatatataatttgttagctagcttatttaaactaaaatacgaatatatagcattggaactggtaaaccaccttttacaaaattcaaccaagtaattgaagggttggcacgatcaaatggactttttcatatataaaaccatgaccgttgagatttttcttgtattctgttatatattaagcatgacagtgatctaaattctgagaaagtacatatcttagtcctcttgttcgtggctcataaacatatgcatcggtggtttaaaatagcttatagacgtggttatttgtacttcgttaaatatagaacgtgaatccctataccatgccatgcattggaacatatatcttgctgttctaagtttttccgtttgtgcagcacacgccgcacacccatgaatgtttttttttagtaaccaagtaaatgaactgaatctataaactcaaaccaaacctatttaacgtgtcaaacaatttgtcatttttcaaattacattacattagtttatatgatcatatcagattgtttcttgtcgtgattatattgaagtcctaatttcctttctccttggcgttttctacgtgcagttgtacagaccaaagaaaaactatacaacataataataatcgtatcagtcaaaactaaaatttagagttgtagaacaaaaaaaatg

SEQ ID NO: 5807 - DNA, 3000 bp, Unknown
  misc_feature (1)..( 3000): cDNA_ID_2053844_gDNA_ID_1620819_Annot_ID_169397 3000 nt of promoter + ATG
gcctccgggtaccaaaaatgttttgccccctaaatcaatcaaatcctgtagttttgtgttaattttttaaaatataaaacacaaaatataatgtgattattattgtgactggagggcaatgttaagatttgttaccacaatagcagaagaaatagctttgacgattagaggaacaagctctttgatttcattgatactttttccttcaaaaaatgggtaattatagtcgtttcctccaatctctcccatgagtatcagcgagtctccaagcatctctttgcaatctagacaagaaacgaaataaaccctgttagaaccaagctagctagactcatcatcatagtccatagacatagaaaagaacaagggcacgtttctgttaaaaaacaaaacaagacaaggctaagtttctaaccacgagtagacgaggcgcataagttaggcaaaatctgcttgaaggtgtcaagctgaacacttaaactaacattggtgaaatcagattcaattccttttcccaaaagaaacgctcggtccaatgcggttgctccatacaccgcaaaattgatcccttgttcgaagctaacgttttgggatccaaagtaaggcggtacgtatggtagtcccaagaattcggctgttcaaatagtaagacaacataagaaaaaaagatcaggaagaagtataacttgctgttcacgtaagaaagacttagagcaaatgataacaggtggttttgcctatagagatgaaaaaatagctaccaatgaagtcgatgatgagacggccattagaggcacgaccggagggaggatggaagaagctttcgccataaggaagaaaggcggattgaggaaggtgattgacatcagagagatggagataatttccggtgtctgcgatggaatcaccaaagctgatgatcgatttaaaacgcctacatcgagattctgatgaagcaacaatgatggtggtggagtataagacaagtagaaagcttgagataagcttcttcagtgaagaagccatgggaagagctaatcgtggtcttcgttcgtctttgtcactcaatttttaaagtctttttggatcactgaataatgcaagagatgaggccattattggatttcatttattatgccagtaagaaagagagaaattataaaatttggttatttgttattttccaaaaagaaattttgcttattggttgaaaacgaagtaacttcagaaatgtcagacaagttggagactccatcaaaaaattggattcttcgatgatagaaatcgtgaaaataataagggattacgaaatattccttcaatgcttttttcttttgggttttcgcaaattccttaccattttataatcatataaatggattctttacctatattctaatccattacaagacgagcgaaaaagaaagaattgattatggagatgtgtgagtagtgtgacgcacgcgatagtctgcgactctgcgtgatctatatctttatggagtcagtttttatgtggaatcttattatagaaatcaaatatagctatcattcattttggaataatatgaatatctttcttagagtatttacctatttggaagaagaaaaaaatgattcgttatagtctacataattttatatttgattagtaaatactctaataatgatattcgtattattccacagatggacgaatcgaaatcaataataatgacgttgcgattaacaatatcttgtccgcggtgccttgaaagcctacatgttccactttttaggcttttggttggtgtgtcaaagtcatctattttggctcactttaaaaaacgattatattagtactactttctaaattcttttataaatgatgttttaagctttatatttttattctttaataaatgatgttttaaacttttaatgcagaattagttatatttttattgattttgatgatttttattttttagattgtagttgattaaataataaatgatattttaatttagaaataaacaaattttttttttttttaatttgtatgtattctgctaaacatcaagtaaaaaaagacggagggagtatgaaattctagctgaccattccaactgctcctttatttttatttttttttgtcggcaccaattgctcctttatagtatctctttaataatcctattcgaccttgaagaaattccactacaattttcaagaaatctcacatttgattagtatgaattccacttaaatctcataaattaaactaagctaggagtataatatacagtggtttaacaaatacatgacaatactgacctaaccgaatttatattccaattttctttcaaaaataatcatcaatcataataactttgcaaacagcaccagtcaagtaactattaaaaaagtgtagtggcaccacgtgtgttttactaatgaaccaatcaaccatttagttccaccgacttccaatagctctcgacttctaatttataattttgaaaaaaaaaaattatagtttcttaccaagaaatttttgttcactagtcaacatttttccctaatcagattcaaaattggtctttccaccaattgtattattgacgctagattctttttcttacaattttcgaccacaactctatcttacgcacaaaaaaagaaaaaaaaatactaatcttgtggaggagaaaaacagtgaagactgaagacaagaagcatgattgaattttgaaaagactcatacaaaactcgatcataaaaacagtgaagacaagtatgaagtatggtatgaataacaaaaagactaaaatgattttgtttgaaactgttgtaggtgagaaatttggacatgggacttgaccgtttggtagttggtgaagcctactctcgtgagctgtgtcccctcaaggcattgattttgcttctcttataaatatggaccccaaaacttattttggaagtaacaaagacccataccattcttattattaaggtatg

SEQ ID NO: 5808 - DNA, 3000 bp, Unknown
  misc_feature (1)..( 3000): cDNA_ID_2041489_gDNA_ID_1620819_Annot_ID_169399 3000 nt of promoter + ATG
ttcttactggcataataaatgaaatccaataatggcctcatctcttgcattattcagtgatccaaaaagactttaaaaattgagtgacaaagacgaacgaagaccacgattagctcttcccatggcttcttcactgaagaagcttatctcaagctttctacttgtcttatactccaccaccatcattgttgcttcatcagaatctcgatgtaggcgttttaaatcgatcatcagctttggtgattccatcgcagacaccggaaattatctccatctctctgatgtcaatcaccttcctcaatccgcctttcttccttatggcgaaagcttcttccatcctccctccggtcgtgcctctaatggccgtctcatcatcgacttcattggtagctattttttcatctctataggcaaaaccacctgttatcatttgctctaagtctttcttacgtgaacagcaagttatacttcttcctgatctttttttcttatgttgtcttactatttgaacagccgaattcttgggactaccatacgtaccgccttactttggatcccaaaacgttagcttcgaacaagggatcaattttgcggtgtatggagcaaccgcattggaccgagcgtttcttttgggaaaaggaattgaatctgatttcaccaatgttagtttaagtgttcagcttgacaccttcaagcagattttgcctaacttatgcgcctcgtctactcgtggttagaaacttagccttgtcttgttttgttttttaacagaaacgtgcccttgttcttttctatgtctatggactatgatgatgagtctagctagcttggttctaacagggtttatttcgtttcttgtctagattgcaaagagatgcttggagactcgctgatactcatgggagagattggaggaaacgactataattacccattttttgaaggaaaaagtatcaatgaaatcaaagagcttgttcctctaatcgtcaaagctatttcttctgctattgtggtaacaaatcttaacattgccctccagtcacaataataatcacattatattttgtgttttatattttaaaaaattaacacaaaactacaggatttgattgatttagggggcaaaacatttttggtacccggaggcttcccaacaggatgttctgcggcgtatcttactctatttcagaccgtggcagaaaaagaccaggaccctttaacaggttgttacccattgctcaacgaatttggcgagcaccacaacgaacagctaaagacagaactcaagcgactccaaaaattctatcctcatgtcaacatcatttacgctgactaccacaactccttataccggttttatcaagaaccagctaaatacggtccgtgaaatttcaaactctgtcgttgaccctcacggattaattcattaacagatattttgtttgtctttttcaatagggtttaagaacaaacctttagctgcttgctgtggagtcggaggtaaatacaacttcactattggtaaggagtgtggatacgaaggagttaactattgtcaaaatccttctgagtatgtgaactgggatggttatcatttaaccgaagccgcctaccagaagatgactgagggtatactcaacggtccctatgcaactcctgctttcgactggtcctgccttggctctggtacagtggatacataaagggtattctttcagcagtaagaattcattcgttgtaaaaaatcaaagaggaagaaaattatgtgatgatgatgatgatgatgatgattaacaaaaacattgcttgtacggcaagacttgactaatgacaaaacttccgaggatatatggctatatgcatatatcttatcactgaaaaataccacacgcaaatagaaaatcctatatatacggttcgtagcactagttgcactctagttacaatgttgagaaaatctggaagtacgtataattttaagaccattctaagtttataaacagttccctggaagatgttggagaagttttggatgagttgagtgggacaaacgacagctaaggatttaaataatttcataacatccattgaactgaaagattaagaacataatatactatttgggacaacttacaatggatggatataacagatgagaacaagtgaggttcattgattacacattttggtcatttaattttgaaaaggttcaaaattctaaagtcttgctatttagagccagggttcctccggggtcacaaccagagacctattatataaaaaagaaaattatttaaaatttcttatttggattacactaaattaaaagtgattaagacgagagactagcccatttgtatccatgcataaacttaggtgtctttttatacgtggcactaaagtacgacttagccatctaatctaaagtggaagtttctgaagttacttcattgaacactcaatagtcattaataaacctgaccattttcctcaatttactaataggcgttgggataatacataaaatccaataactaatgcctcaaactctgcattagttaaagattctaaaaattgagtaatagagacgacaattctcctatggcttccctcatactatcgcgtgcgtcacatatctccataaccgtttcataattgttctctttctttttcactcattttataatggattagttaaagaatccatttatatgattataataagtaaggaaggccaaatagaaaaaagaaaaagcaacgaaggaatatttcgttattactagtttcacgaattctatcatcgaagaatccaatttcgtgatggagcctccaacttgtctgacgtttctgccgttaacttctttttctcatttctctctttcttactggcataataaatgaaatccaataattgccacatctcttgcattattcaatgatccaaaaagactttaaaaattgagtgacaaagacgaacgaagaccacgactagctcttccc

SEQ ID NO: 5809 - DNA, 3000 bp, Unknown
  misc_feature (1)..( 3000): cDNA_ID_2041481_gDNA_ID_1620819_Annot_ID_169401 3000 nt of promoter + ATG
tttcattagggtttaagaacaaacctttagctgcttgctgtggagtcggaggtaaatacaacttcactattggtaaggagtgtggatacgaaggagttagctattgtcaaaatccttccgagtatgtgaattgggatggttatcatttaaccgaagccgcctaccagaagatggctgagggtatactcaacggtccctatgcaactcctgctttcgactggtcctgccttggctctggtacagtggatacataaaaggagcagttagaattcatttgttgtaaaaaaaaaaaaagaggaagaaaattgtgtgatgatgattaacaaaaagattgcttgtacggcaggatttgactagtgacaaaaatttcgaggatatatgcatcaatcttatcaatgaaaaataccacacgcaaatagaaaatcctatttatacggttcgtagcacgagttgcatgttgagaaaatcctatttataacagttccgtggaagatgttggagaagttttggatgaattaagagggacaaacgacagctaaggattaaataatttcataacatcctttgaactgaaagattaagaacataatacactatttgggaaaacttaaaatactatattacaatggatggatataacagatgagaacatgcatgtgaggttcattgattacacattcatttaaattttgaaaaagttcaagattctatatataaaaaagaaaattatttaaaatttcttatttggattacactaaattaaaagtgattaagacgagagactagcccatttgtatccatgcataaacttaggtgtctttttatacgtggcactaaagtacgacttagccatctaatctaaagtggaagtttctgaagttacttcattgaacactcaacagtcattcataaacctgaccattttcctcaatttactcattggcgttgggataagacataaaatccaataactaatgcctcaaactctgcattagttaaagattctaaaaattgagtaatagagacgatgacgacgactctcctcatggcttcgctcatcgtaagctttctacttatcttatactacaccacaatagtcgttgcctcatcagaatctcggtgtcggcgttacaaatcaatcatcagcttcggtgattccattgcggacaccggaaattatgttcatctctccaacgtcaataatcttcctcaagccgcatttcttccttacggcgaaagcttcttccatcctccctccggccgttactcggacggccgtctcgttatagatttcatcggtacctgatttttcttctctatttttagacaactcggtcactcctctgcttcaggtctctcttgcttgaaccacaagttatcaaccttactagcttctgtgtttttgtaatgttgtcttactatttgcacagccgaattcttgggactaccgtacgttccgccttacttcggatcccaaaacgtgagcttcaatcaagggataaattttgctgtgtatggagcaaccgccttggatcgtgcctttcttgtaaaacaaggaattaaatctgacttcaccaatattagtctaagtgttcagcttaacaccttcaagcagattttacctaacctttgtgcctcatctactcgtggttacaaacttagccttgttctcttccatatctacgatgcattgagctccttctaactttttttctttgggggttcagattgcagagagatgcttggagactcgctgatactcatgggagagattggtggaaacgactataattacccattttttgaaggaaaaagtatcaatgaaatcaaagagcttgttcctctaatcatcaaagctatttcttctgctattgtggtaacaaatcttaacattgccctcccctcaaaaatgtgtgtttcaaattttaacaaattaattaagtaataaaactacaggatttgattgatttgggaggaaaaacattcctggtacccggaaacttcccaataggatgttccacggcatatcttactctatttcagaccgcgacagtagaacacgacccttttacaggttgtatcccatggcttaacaaattcggagagcaccataacgaacaacttaagatagaactcaaacaactccaaaaactctaccctcatgtcaacatcatttacgccgactactacaactctttgtacggactttttcaagaaccagccaaatatggtatgcgccttctaaagcttctaactttgaccctcacgtacggtttaattcgttaacccatgttttatgaattatggtccctttttaggttttaagaacagacctttggctgcttgttgtggagtcggaggtcaatacaacttcactattggtaaagagtgtggagaaaacggagttagctattgtcaaaatccttctgagtatgtgaattgggatggttatcatttaaccgaagccacgtaccagaagatggctcagggtttactcaatggtcgctatacaactcctgctttcgactggtcctgccttggctcttatgatttcagtggataaagatgatttagtagtggctctggcctttgcaagaaaaaaagaagagttgcagagaattgcaaggaatcttggattacaaattaatagtttattaaaagcacttgaagaattaaaataaaaattgtatccaaaaaaattaatggcctgatattcgaaaggaatcttagattatagactggagattcgtctatgtgtatcccatgcataaccttacgtgtcttaaatacgtggcatgaacgtttctgaaactagtgcattttcaaacaattattgatcacacaccaaaaaaacataaacaaaaaaaatttatattttccccagtttactatagtcttggttgcatagtaaatgaaatccaccactgaccatatttagtggtccaaattaaaaagggtgataaaaattgagttacagaaacgacgaagacgattcttccc

SEQ ID NO: 5810 - DNA, 3000 bp, Unknown
  misc_feature (1)..( 3000): cDNA_ID_2041470_gDNA_ID_1620819_Annot_ID_169404 3000 nt of promoter + ATG
attttggtttataccatactttatagttttactaaaaaatagtattatagatacttggatccattcctatatcttattttagttattgagttttacatgaaataaatagaaaataaggaattcaaatttatatatgtaatgaaagttaagatttgcttcttcttttttttgaattgtttgaaagaatttttaggagttttttaaagaatatttcaagaactttgtaagaattttaaatttcttttggatttagagaattttttggttcttgtgttttttaacctcggatttggttgaattttattgggggttcagtttcttcttcaaattaagcttaaaatgatgtttaaaaggtgtacgttaaatcttttaacgggctgttaatgggttaataagcacgatggttagttcatgtattaaatgggctgtataaataggttatatatatttttgtgaaacggtaatttttttgtttatacatgctggattctatttttgtcaaagaatctacaaattaagaaaactttttcttttacgacaggtgtatcactgtatcccgtagaacaatgaaatcattaagattgacacctaattactacattttattttttcatgtacagccaaacaaaattatttcacataaaaaaggggaaaataacttcatgagagagaagttaaataatagaaggaaaaaaatctgattatctttgtctattacctaataacaatattttatagttaaattacacttgattcaaaaaaaataaaaatataggtgaattacactttccatgtttgactaaatatggtaacatgacaaaatctcttaaaagtgtaacggttacaaaatctctcttttaggcaaaaaaaagacagttaaaactgacagaagactcttgtccagccgatgagaagcatcttaagaaatgaactttggacagaatccagtgtaatagcacgtgtaccaatcattgtttctcagttgtcattttcctcatataactgtccatgctttctatcttttaaaatattttactctttttgaattaaaaatatattaccttaaataaaattagtttttgggcagtaaaaaaacaaaacatttttttctgtttatgtaaaagccactgattatagcattgtgtcaattgacagctgtttacagcttgggattgtatttctgtctaaaaatgatatattttagtagatgtttccttgaaaatcaactaaatatctagtatttgcaaaataatgctcagtaattttatataaaaaaaattcttcatgttaataggttagaacatgttgtagaaaaatttggtattaaaacattaacaaaaaaataattaaaattttaatattttccgtgaaaattcattaaaacttttatagttaacaatgtcgtataacgacaacatgaatagtcagtttattcgatgtcgttattcaaaaacaaatactcttcattaatttgataattgtcggcgccgcaatgataattcacacatatttttaaacagtaaatataatgtattttacttatagtgaacttgtttttatgtttataattttgataatttattacaactagtatgatatattaaacatattactaatatcaagtatattacaaaaattgagagtaaattagaggagtagaaaacaaatattttgatttattcacctaaaacattttaaaaaggaaagatacaaaagttgtcaaaaccaaaaagatacaaaacttttaaacacgtggcataaaaaggatagggtatctaagaccttcttcatctgacattgggtatatatatgcctatatggtagacttctcaatatctccttacctctcccagtttccatatctctcactttcttactcatactccagtaagtgtctcttcttttctgttcgtttatatctggttttagcaaattagatcctttcgttttctttgcagttaagctctactgcaattcgatcctacattatatagtgtattataagaaaagagacatatatctatggattctttatgtgattttcaacatataaccatttgtatatttgatttctatgtaatatgtatataaatcctttatatttcttcaagtttttgaatatatttcttcactgccttcaatttactcacacaattcttttttgtctttgattgattatgattttgatcatgtttgttctctttgtataaaaatccttagttttctttttttctcaataatctttgttgtatatagatataaatatatttgatttgatattttgttattcatacatctaaggtgaaaaagtttatcagtattgttattgtgacggatgcactaaaaagttagaggctattttcttgtatactcatactttagaggcttcaagcagttttttaagaaaatatttctgtccaaaaaatatttacttcaaagaaattagaataaaattttctgttttttaaaaggaaaaaaaaggattttttcaaggagaaatttttttttttagaggaaaaagatagcttttaaaaagaaaatttgccctttcctaaggaaaagaaaagtgagccacaagctagtatttaaccagcttcctatcaaggatggttcgcttgttatatgtgaaatttattttatatatacttatactaatatttcaggacacaaacaaaatatttatttttatatctaatattttaatccaaaaatattaattagatgcggacaagttaaattgtcatgatttcatttagaagatagagttttttttttgttggttaaacaaaagatagagtaatttttatctgtttgatttattcccctcaattcatactccatatgatatttgaaagatatataagtagcatgatgttagtatacaaaatttatcgaaagaataatttctgattgtcaaaagtccgtacatatttttatttatcaatttctgattatctcacatatattcttattgtcaatctttcaggtaaacaagtcaag

SEQ ID NO: 5811 - DNA, 3000 bp, Unknown
  misc_feature (1)..( 3000): cDNA_ID_2041453_gDNA_ID_1620819_Annot_ID_169410 3000 nt of promoter + ATG
aaagagcttcaaaaagagtttaccaaatttatgcggctcaccatcaggtagtgaacaacaatttttccttttgtcggtggaatgattattatgtattttagtgaactaatactcacttgtatatgttttttagactgtagagatatgattggaaatgctttgattctcatgggagagattggagggaatgattataatttcccattcttcaaccgcaaacccgttaaggaagttgaagagctggttccatttgtaatcgcttctatttcttctacaataacggtatacatttttttcttgaattcttgttttgttagtcttaagaacgagtgaaaacagatttctagctatctgctgatttgtttgtcagagtttataatgagtttgttccattgggacttaatgttgaatccaggagttgattggtatggggggtaaaacctttctagtgcccggagagttccctatcggatgctcagtagtctatttgacattatacaaaacatcaaacaaggacgaatacgatccttcaacaggatgtttgaaatggttgaacaagtttggcgaataccatagcgagaaacttaaggtggaactcaacagacttaggaagctctaccctcatgtcaacatcatatacgctgactactacaactctctcttgcgcatttttaaagaaccagccaaattcggttagccttcttgattcctccactgaatctacacaccctaagtcgtcactgatttagtattgacaatttttcctatcaattatactgtcagggttcatggaaagacccttccctgcttgttgcggtataggaggaccgtacaacttcaacttcactaggaaatgtgggagtgtaggagtgaaatcttgtaaggatccttcaaagtatgtgggctgggatggcgttcatatgactgaggctgcatacaaatggatagctgatggaatactcaatggaccatatgcgaatcctccttttgatcggtcctgcctcagatctgagattaagaaggagtcattgtacaatcaaagtactctgacacaagcttgtgtgaaactttgacagacaaaagtgatgataagaatattccctctattccttattaatccaaattcaagcaaacaaatttgttgcaaaaaagatatgtttctaggtttctatgtatttttttattacttattgatgatgaattgtagaccttaattttctttttcttttttacttttattggtttaaatttgttaatcataaattgatgtatttataatcaatatttaatatattttctgaatatgtgtgaaaagcttaaattttggattaatcaaaatcagagagagtgattttgaaatgttcttttggcctttccccggagaaatcaataataaataaaaatgtcaaaatagatatttatcaaagtgcccgttttgaacgatacaaatacaaaaatttctaagccatgcaaagtgaaatgcattgccccaccttctttattagacaacaagaaacgctcattgtcattgagtctcagccatttggttctatataacttttccaaaacaaatacactaaacctttataaattagtactcgataaattaataatttctataaattaataaattcttagtttaattttcattgatgttcaaagatttttttttttttcactttttcatgtttataatttccaatgcaaaattaaatatttttttttaatttgttttgaccatttgtattttgctgtttgttttctgattggtggaatagtttttaattagataaaaaaaatgtttaatttaaattagataaaacaaaaattttaatgatttcttaatgtatgtgccaaaatttaaaacatcaagggaatatgtttttaagtgctcttgttggctggacatgtagggattgcttaccagatggcgttggcccccggagatatacaagtcccgaacttcgtaatcaataaataaatatttaaaagttgtgcaaaatagatattttctaatcagcatgattaagtgtcaaagtgctcgttttaaacgatacaaatacaaagtaaattgccttgccccacccttattcattagatagttcaggaaacgatcattgagtgatgactcattgatccataccagccttttgattctatataacttttctaaaacaaaatattttgaaaatcataataaaataaaaaataaaaagagagaaattttaggacttgtcgcatggcgtctctagattcttatgtaaactatttttcagttttcttgtttttccgcaacgttttcgatttaatttgtataaatatatgaaaacatctgaattcttagggtttcatttttttttcctgacacggtttctttctctgtttttctatttcttgatctgcaagtcaacagtatgagacctatagtgatcctccaattttccttcttacagctgaatttttggggcttccttatgtgcctccttactttggatctaaaaatggaaactttgagaaatgagttaataatggcgtaaacggagcaacggcattggaatgttcctttcttgaacagagaagaatttttagttctcacagcaacatgccaacatcagtttagatattcagctaaggagagtttaccaaatctatgtggctctccatcaggtagtgaagattaatttcactttttcattggagtgattataatgtattttccatgaattgagctctattgtatttgtttttagactgtagagattaacaatgctttgaattttatgtgagagattggagggaatgattataatatttccatcaggtataacatttctttcaaagtagcctcaaagttgcaaccactacatcaaatatgaacaaatagacaaacacggcaagtgaagcccttctctagtctgatctctacctaaaaattgattattgttttcttgtctcctagcgaatagaaaagagaaggagtacaaccttccggcctctccc

SEQ ID NO: 5812 - DNA, 3000 bp, Unknown
  misc_feature (1)..( 3000): cDNA_ID_2041459_gDNA_ID_1620819_Annot_ID_169407 3000 nt of promoter + ATG
agttcgcttcttagacgtgccataagtttcaccgcttacggtttcagttgatgtttcgattctcgaatgtctatggttctatgtttattttttatttttaatggcataagaccatgttttatgagttacttgatgtaatacctaaactttcattttttgaaatgatatatacattcttattaaaatataataaaaaaatcttgatgtattattttaaagtaattttatcaatgaataagatccatttaacattaatgagcatgtgaaacttatctaacatacctttgaagcatattataatagttcatcctttatggttgtcttttacattaatctttttcctagtgatatctggacgaagacagatggtttcagtataagattcataaaatagttactttgatcaataaatttttcatttagaaaaaaaaattgctgacatatatattactcatcttttttcattagatatataaatatttatactcgcacccaaaaccaacatcgtactggtgctccttatagagttaaactcatggccattatctgcatgatctaaacaagagtgagtataaatacttagtgcgagcgaatatttccgtccatatgcaacacaaagcgatgaaccactaatttatatgtattttcaaccaatcaattatcatagcctagactacacatgcatattccttcaactagctacggttcactattctaggctatgataaattactatatcggcctaaagcataagtttgtgcacaaaaataaaattaataataattaacttgtgacctaaaaagcatataagtataactactatatttagctttatgaaccggccgggcctcccatctaatgtcgccttcaaagtttcatttgtggaagctcacatgttttctgatcactgtagccaccgaagtcttaggctcagagtctttccaacgttataaatcgatcatcagcttcggtgattcgatttcggacaccggaaactttcttcatctctccgacccaaatcatcttccccgatggccgcctcattatcgacttcattggtatgaacttctttttacaccatcccatattcgcagtttaaatcaaaacttcagaaatatttttcagtttttagtatgaataatcaagattcaacaagtgttcaaaaaaaaaaaaaaaaaaaaaaaaatcaagatccaattagtcaacttaatttgacagctgaattcttggggataccatatatttccccttactttggacataataatcaaagctttgagaatggaatcaacttcgcggtggctggagcaaccgcggtggagcctgaattgcttcaagagaaaggaattactgctaattacatgactaatgtaagcttgattgttcagctaagcatcttcaagaaaattttaccaaacctctgtggctttccttcaggtgattcctcacaaatctcaactcatcttggaacacaagggacaagcataagccaatctttacttgttttcaagattgcagagagattctcgaaaactcgctgtttattgttggtgagattggaggtaatgactataactacggattcttgattggaaaaagcatcccggagattaaaaaaaatagtcccccttgttatcaatgctatttgctcaacaattgtggtaataaaaatctttcttaaatcctgttcaatgatccttccctttttcttgttttgtttgggagactaagaattgaaccttgcaagcatgaacaacatggtacaggaattgttcaatttgggagccagaacgtttctagtgccaggaaagtttccaactggatgttctgctgcatatttaacgagatttaggacaacagatatgtaggactacgatgctttaaccggatgtttgaagtggcctaatgagttttctcagtaccacaatgagcagcttcagacagaactcaatagactccaaaaactctatcccattgctactatcagatacactgactactacgacattgtgttacatttttaccttgaaccgacgaaatatgttgccctttcttattccgtccccttaactaacatatatacagtattgtcacaattatttatattaccaaatttactcttttgaaggatttatggagagaccttcactgttgataagccatgtgggtctagaggagtgaaacattgtcgagttccttctgagtatgtgacgtgggacggttttcatttgaccgaagccgcctaccgatggattgctaagagcttgcttaatggaccacttgcgtctattgctttggccgctcctgcattttcctttttaagctgatctacggacatagatcactttcccttgagcacttgggacctgttgctgcgagtaaactaaaatcacgttcttcgtttaatcacattgattgtttttttttttttttgttggtttctctttactttgttttcaaattaatacacaatctcttgcttgtacaacaagtttatgggagtaaatctttaaactaatttttatttgtttataaaaattttctgaataattttctctctaagaatgtaattttttttattttttttgataaaaataaatgttgatatattaaaatagccatactagattatgatttgcagtggaacccaagcaagtataaatcatggtagataatccgtaactagctcgtaaataacctgcaaataacttatcactcatgaataacatgaaaataatctgtagatattttctagaggttggttagaacttagaagtccacctacccatcttaaaacgatacaaatacaaaattttctagtccataaaaagttttgtagtcttggcccaccattatttataaggcaacaacaaaatcattgagacatatactcaccagtcctttcttttgttgtttacgaaaaaacgaaacaagatgttttgtaaaataatataacattctaaaagccgaaagataaaaatttcaccgcggacttctcgt

SEQ ID NO: 5813 - DNA, 3000 bp, Unknown
  misc_feature (1)..( 3000): cDNA_ID_2041439_gDNA_ID_1620819_Annot_ID_169414 3000 nt of promoter + ATG
agaccactacttcagtggtaccaagaggtggccccatttatctgccaaacatggttggaaatatttctaccacccctgaattcaagtcttcatttctcaatgtactacaggatttggaaactcatttatctctggactctacttcttcttcttctcagcagtttgatgtctcgtatgtattcttgcatcaattggctctctttttcatcagttaaaatctggttttttcaatacattaagttatttaattgggatgatttttgtttgatgcagaattgattctctcaagatttatacggatgaggaactcacagagatggctatgaaggaagcctttccggtacgttgcctaatcgtttgttgatttacttctcttcttctgctgtctttcaagtgtgagaacttgtgtcttgatgagtttggtttcttatttcattacaggaagattacctttcccaagaggagctcgaaccatctttaaacgtttctcatcagtaagtatcattaccagcctttcgttatttcttgatataatgtttccccttgtgtgaatccttagtaaaaacgaattggcatgtagcttctttctattagtgtgcttcgatggttgttaagttttttgtttacagtctcaattggttctggttcagccgtgcagccgtgctagctcccaatatatttcgaaagtcttgtagacaatatatatgttaatagcttagtcatgattagaaatcttccagagacaaagtatggttgacgtagacaattgtagaacgataacaaacagttaccttctcggtatgctgcagtgaaaatccattagctgggagggcaaaaaggaagaggacagtaaagaataccgaggtaaagaagaggacactaaagaatactgaggtaatgaagatgacagaaaagaagactgaggtgagtttatgtaacatggtcttggcatggctgggaattactatcttttcttttccagaggctatttgtgtttaggatctcttgataccaaatttacatggtcttgccatgatggctttattgcattttgttatgattgatatggtcatttttttgtttttaggaagcttatcttgtgaaagtcgagcagcttgctaaactcaaacaaaagcaggaggaggataaagcagctgtgacactgcactgcttcaggtctgtaattactattgcatagtctggtttgctgtgtaccttgtctgttttatgctgatgtttcttcgatttgaacttgttttcagcaagaccagtgagactggtaaagatgtagttgcacctccagaaggttttgagcagatgcaatctcttaggttcatagataataattacacggcaagtgatttccccttgcaatgtctttttagtgttgattatgctagtccaagttctaaagtgctcatgcatcctgctaagtattatcttcttcctatttaaacagaagttgaagccatctgacatccagggacaagtggatccgctatttcctgaagtcattttgtgtgttgagatttataacagtcgcaaggttaaggtactgtattgttctgtaaatctttgatgcgggatatagaatattgactgaattctcgtacatactaacaatacttgtgtaaatttttgttcagacccaagaatttttggttctaggacgtcaaatgttgactgagttgaaggacaatattcactgtgctacagaccaggtgatgcaaaaggctggaaagtatgatccctctggatacttcctcatagaagtaagaattcatctcgtttctgtatcttttgatgtttaagtaagtttaacttctgcgtcgctggtttaatcagatgctttttgctcgtctaggatgtctttcacaatgatttaaggaatccctcggctaaagattacagctatcctattttagattggctttggaactcgaaagatgaagctcttaaaaaatgggaatgtgttttaaccggcgaattacagaaaaagcagaaactggttctaggtgaagcgaaatctgtggatttacctcgttacagaactgcagacatgcagagtacacacttctgtgatataagattcagagtcggagctagttatgtctattgtcatcaggtaaaatcttctctctttctcttttggttctttaatttctcatcttgtgaaaacatttggcacagactcgagatattcactgattaaaaaccgtggaacagggagattgcaagcacacgattgtgattcgagacatgaggatgagtcatccagaggacgttcagaacagagcagcttacccgatcatgttctggccgaaacgtaggattcagaaatgcggtgtttgtaagataaagagagcttcaaaggttgcagtggatgacaagtgggcaagcgagaacagtagctatttctgtgatgtttgttttgagcttctacactcagaggaaggcccacttaactgtgacttcccagtgtttgattatgtgcatgagtaaagatgatcttctttgttgcataatatatagataggaagaatacgaagaaatagttggcattgcaagaagaagacatgatgagtcttgtcttggtaaatttgttgcataattggatatatataaaagattttcttgaaatgatgacatgacaactatttctgaatttagccattgtcaaaagctctcttcgttttgaagcggtagaaaattagaaatgtttatgtttagccaaattcaaaagtagaggagattccttgaatttctgttttctctcgctgtcttctcaatattcaaaactcaaattggtgtcttctccaatttagaaaacgttaaaaacaagagaaaataaaactaaactttttagaaccaaaaaaaataaaaataaaacgcatttgggatttctcattgtcatcccaagttcttggaacagccaaatactttttcattattagtttataatcgtctcataaaggcaaaaaggtttatttcggaaataag

SEQ ID NO: 5814 - DNA, 3000 bp, Unknown
  misc_feature (1)..( 3000): cDNA_ID_2027368_gDNA_ID_1620819_Annot_ID_169412 3000 nt of promoter + ATG
gagagtctttaggtctaaacacatgttacatgtataaaaggaatttaacaaggttgtatacgtagttacgtacattaggtgtttctctgttcgtgtgtacaaccgcatatttttaatctttggatcatatagtgttgatgaatgtgtacatcaactattggagatataatgtattatgctgtatacgtacaacagaatgttccaaaaatctttcttcttttttttattttattttaaatcggccccaatggtgctataataaacgagaaagccaaaaatactacaaataaaagcctcagtgatgggtttatcgtttaagcgaaagtgacgaaagagaggaaactagacagatacgacagtaagttttggtcatcgaagatacgtattgggatccgctcacaagaatttgttgtgtgtctttttgctaaaaggccaatacgaaaatcgttgataattcgtttcatctaccgcaatcactttatccttgaccaaaaaaagaaagaaataactcaaatatcaattttataatcaaataaaaacttaaataatcaaccaatatacccgtgtgtgtcaaaccatactgcatcccaataattgatcttttaatcattctttattatcttatccttggtattgtggctagtggggtattttcaaaagacttttttgacaaatcaacatcacactattaaaaaagggatctcgacggagaccaaccttcagctctctggcaatggcgtatcccggttcgcctatcttgatgaagctcctcgtcttcatctttttatcaacttttgtagtcactaacgtgagctcggaaactaagtgccgggagttcaaatcgatcatcagtttcggagattccattgccgacactggaaacttgcttggcctctcagatcctaaagatcttcctcacatggcgtttccaccgtatggagagaacttcttccaccacccaactggtcgtttctccaacggccgcctcatcattgatttcatcggtacttttgactttacagttttacttaaggtgtgagtaagtaagtgtgtaaaaaggtgaaactaaaagagttattaaatttcttcagccctttctttgttttcatcttctttatggttttacttgattaccaagtttgattgtgtaaaacctgaaatcatctaaatacagaaccattaagtgtggttaagtctttatgaccaacttacaggctgtaagttacagctcttagttcatgttcttttctttggttctgttcacagctgaattcttgggtttaccgcttgtgcctccattctatggatctcataatgcaaactttgaaaagggagttaatttcgcggtagggggagcaaccgctttggaacgttcctttcttgaagacagaggaattcattttccttacactaatgtgagtttaggcgttcagcttaatagcttcaaggagagtttacctagcatatgtggctctccttcaggttgggatgattaactatttcttttttgttttatagtgtttactgttatctatggttaggatatcaattctgatttctagtgcggttgctcttcaaaaaaaaaaaacattcgttctgtttttggttatgcttagtgatatcacttattgtatataatggcttactttatattcttgttttagactgtagagatatgatagaaaatgctttgattctcatgggggaaattggagggaatgactataactacgcgttcttcgtggacaaaggcattgaagagatcaaggagctgatgcccctggtgatcactactatttcttctgcaatcacggtaaacatttatctttcttaatatctcatcaagttcttgatcttctctgtgaacaacgaatattcgatagcacaggagttgatcggtatggggggaagaacatttttggtgcccggagagttcccagtcggatgctcagtattgtatttgacatcacatcaaacatcaaacatggaagaatacgatcctttaacaggatgtttgaaatggctgaacaagtttggtgaaaaccatggtgagcagcttagagcagaactcaacagactccagaagttgtaccctcatgttaacatcatatacgctgactactacaacgcgctgtttcacctttatcaagaaccagccaaattcggttagacttcttgatcgttttactgaacctaaacaaacaagtacattgatcagtttgctaaatattgagttaattatgcaatcaggattcatgaacagacctttgtccgcttgttgcggcgcaggaggaccgtacaactataccgtaggtaggaaatgtgggactgatatagttgaaagttgtgatgatccttcaaagtatgtggcttgggacggtgttcatatgactgaggctgcgtacagattgatggctgagggtatactaaatggaccgtatgcgattcctccttttgattggtcttgccgtagctctggagttaagaacagtgggtcatctgacacatagaattctttgatgagaaactgatacaagttggtcaaaaaattgagaaaaggatactgataaaaacatgtatgttccttagtattgtcttggatcatgttcatgtattgtatcatgttgttatgtgaaataatttaaaagggtatcatgttcatgtatactccactccatatagagagtaagtaaccggcaacggcattgaaaacttggagataaattggaatatttgttgattcaatttggaaaatggcaaaaacaaattatttagccaagtgaacatttgttgattcagtttggaaaatggcaaaaatgagaaagagacaatcatgctctcatttgtgcccatccctaaaccacataaagataccctgtctagtctctattgcatctaataattgatctttgttttttttggactttattgtctccgagcgaatagtggctctttccaaaaagtcattttgaaaagtttctaacctctaggccaccactc

SEQ ID NO: 5815 - DNA, 3000 bp, Unknown
  misc_feature (1)..( 3000): cDNA_ID_2041449_gDNA_ID_1620819_Annot_ID_169411 3000 nt of promoter + ATG
tctacctaaaaattgattattgttttcttgtctcctagcgaatagaaaagagaaggagtacaaccttccggcctctcccatggcatctttagattctcttccggcgatgaagctcgtgagattcatattatctacccttttggtcacttctgtgaactcgcaaacgcaatgccggaatttcaaatcaatcattagtttcggagattcaattgctgacactggaaacttgcttggtctctcggatcctaacgatcttcctgcttccgcgtttccgccatacggagaaaccttcttccaccacccaaccggtcgttactccgacggccgcctcatcattgatttcattggtacgtttatttacataaggtgtgagtgtagaaaaaaagagctattaattattattaattacccttactctcttttttcattctatattagctttcttgaatagcaagtttgattgtataaaacctaaaaccatctacatacaaccatattaagtgttgttgagcctccttattggttcctcaacttacagctctctcttgtttttttttttcggttatgttcacagctgaattcttggggtttccgcttgtgcctcctttttatggatgtcaaaatgcaaactttaaaaagggagttaatttcgcggtcgcgggagcaactgcattagaaccttcctttctagaggagagaggaattcattctactatcaccaacgtcagtctaagcgttcagcttaggagcttcacggaaagtttacctaacttatgtggctcaccttcaggttgggaagctcaactttttcttctctgtttttggtgtttcatgttttatatgatcaaactatcaaaatttgattttcttatatgcttatattgctataagttgtaatactttattttgctgttttgtatttagattgtagagatatgattgaaaatgctttgatactcatgggagagatcggaggaaatgattataattttgcactcttccaacgcaaacccgttaaggaagttgaagagctggtaccgtttgtgatcgctactatttcttctgcaatcacggtaaacattcttgatcagccagttccgggaatgactaaaacatatttgtatctacgctgataattagtttggtaagaaaaaacacatgtacatgttacgttgttttgaaactgaatgttgaattcaggaattggtttgcatgggaggaagaacattcctagttcctggaaatttcccgatcggatactcagcatcctatttgacattatacaaaacatcaaacaaggaagagtatgatcctctaacaggatgtttgaaatggcttaacgatttctcagaatactacaataagcagcttcaggaagaactcaacggactcaggaagttgtaccctcatgtcaacatcatatatgctgattactacaacgctttgttgcgccttttccaagaaccagccaaattcggttaggcttcttgaatcctccaagagatttcttcacaaccaagtcactcatttgattcactaattaattaaccgattttattatccaatcagggtttatgaacagacccttgcccgcttgttgcggtgtaggaggatcttacaacttcaactttagtagaagatgtgggagtgtaggagttgaatactgcgatgatccttcacagtatgtgaattatgatggcattcatatgacggaggcggcatacagattgatatctgagggcttactcaagggaccgtatgctattcctcctttcaagtggtcttgcctcagctccgagattatgaataagatgtcattagatactcagattcttgatgaacagctactacaaggttgtctgaaagtttgagagacaagagaaagagtggaaaaaacatataggttcttaagtgtttgtgtcttcttcttttttgttccgggtaacggtgttaattagccttaggtgcatcatgcatgtgttggatcatgtattatctttgtattgtattgttttcgttagtttgggtaagagttagtatccttaattgttggaccatgtacactgtcatatataatttaactatatacaaaacaattaaatgcataatttacgcatcgcgtggccaaatttctagaatcaaatatggttttatggtaagaaatcagaacactatgtaaatttgattaacgatgggactaattcagaaaaataaataaatactaagtctaaagaaatagttgggaactggcggaaaaaaaaaagttggagagtctttaggtctaaacacatgttacatgtataaaaggaatttaacaaggttgtatacgtagttacgtacattaggtgtttctctgttcgtgtgtacaaccgcatatttttaatctttggatcatatagtgttgatgaatgtgtacatcaactattggagatataatgtattatgctgtatacgtacaacagaatgttccaaaaatctttcttcttttttttattttattttaaatcggccccaatggtgctataataaacgagaaagccaaaaatactacaaataaaagcctcagtgatgggtttatcgtttaagcgaaagtgacgaaagagaggaaactagacagatacgacagtaagttttggtcatcgaagatacgtattgggatccgctcacaagaatttgttgtgtgtctttttgctaaaaggccaatacgaaaatcgttgataattcgtttcatctaccgcaatcactttatccttgaccaaaaaaagaaagaaataactcaaatatcaattttataatcaaataaaaacttaaataatcaaccaatatacccgtgtgtgtcaaaccatactgcatcccaataattgatcttttaatcattctttattatcttatccttggtattgtggctagtggggtattttcaaaagacttttttgacaaatcaacatcacactattaaaaaagggatctcgacggagaccaaccttcagctctctggca

SEQ ID NO: 5816 - DNA, 3000 bp, Unknown
  misc_feature (1)..( 3000): cDNA_ID_2041477_gDNA_ID_1620819_Annot_ID_169402 3000 nt of promoter + ATG
attatggtccctttttaggttttaagaacagacctttggctgcttgttgtggagtcggaggtcaatacaacttcactattggtaaagagtgtggagaaaacggagttagctattgtcaaaatccttctgagtatgtgaattgggatggttatcatttaaccgaagccacgtaccagaagatggctcagggtttactcaatggtcgctatacaactcctgctttcgactggtcctgccttggctcttatgatttcagtggataaagatgatttagtagtggctctggcctttgcaagaaaaaaagaagagttgcagagaattgcaaggaatcttggattacaaattaatagtttattaaaagcacttgaagaattaaaataaaaattgtatccaaaaaaattaatggcctgatattcgaaaggaatcttagattatagactggagattcgtctatgtgtatcccatgcataaccttacgtgtcttaaatacgtggcatgaacgtttctgaaactagtgcattttcaaacaattattgatcacacaccaaaaaaacataaacaaaaaaaatttatattttccccagtttactatagtcttggttgcatagtaaatgaaatccaccactgaccatatttagtggtccaaattaaaaagggtgataaaaattgagttacagaaacgacgaagacgattcttcccatggcttcttcactggagaagcttatttcaagctttctacttgtcttgtactccaccaccatcattgttgcttcatcagaatctcgatgtaggcgttttaaatcgatcatcagctttggtgattccatcgccgacaccggaaattatctccatctctctgatgttaaccaccttcctcaatccgcctttcttccttatggcgaaagcttcttccatcctccctccggccgttactcggacggccgtctcatcatcgactttataggtacctaatttttcctctctttttaatgttaggcagaaacgtttgttctcctctgctttaggtctttcttgcttgagcagaaagttagaaaccctatatgctttctgagtttcttacttggacagctgaattcttgggactaccgtacgtaccatcttattttggatcccaaaacgtgagctttgatcaaggtatcaatttcgcggtgtatggtgcaactgcattggatcgtgtgtttcttgtgggaaaaggaattgaatctgatttcaccaatgttagtttaagtgttcagcttaacatcttcaaacagattttacctaatctttgcacctcgtcttctcgtggttagaaacttagccttgtttcttttccatatctatatgatgttgaatcaaggtcacttcgaatgttttttcttttcttttctattggggtttagattgcagagagatgcttggagactcgctgatacttatgggtgagattggagtaaatgactataattaccctttctttgaaggcaaaagtatcaatgaaatcaaacagcttgttcctctagtcatcaaagctatttcttctgctattgtggtaacatatcttcacatatttccctccccctccccttaaaaacgactaattttcactaataaggcaacaaaactacaggatttgattgatttagggggcaaaacgtttctggtccctggaaacttcccattaggatgctatcccgcgtatctcactctatttcagaccgcggcagaagaagaccacgaccctttcacaggttgtatcccacggctcaatgaattcggagagtaccacaacgaacagctcaagacagaactcaaaagactccaagaactatacgatcatgtcaatatcatttacgccgactactacaactctttgttccggttatatcaagaaccagtcaaatatggtccgtttgtttctaaatttgttggcattgaccatcggttgatctcttgaccaacgttttgtggttccttttttagggtttaagaacagacctttggctgcttgttgcggagtcggaggtcaatacaacttcactattggtaaagagtgtggacacagaggagttagctgttgtcaaaatccttctgaatatgtgaattgggacggttatcatttaaccgaggccacacaccagaagatggctcaagttatactcaacggtacctatgcatcacctgctttcgactggtcctgctctggctctgaatcagtggataaagagtattctttcagcagttaaaattcagtttttgtgtaaaaaaggaagaatattatggtgataattggtgaggattaataagaacgagttccttatacggcaagtttttgacataatataatatttgacttttgaagaaaaccataaatgattctatttgatgatgataatgcaaacaagatttaatctctctaaggtgtaaagaaattccaaatacttatgtgacactgaaatgtggtgtaagatacaagctcaagatattgattggtttagttagcaccaaagctccaaatttgcatctacaaaacaattgacatgcaccatcatttgaacaaggtttgcttggaaatgtttgaagatacctaattgattgcctccaagaagataattgttgtgctaatataatcttcttttaaacatagctatcattatcaaagtatttattcttcttccattttcattgtctttgacttaatatattcgtcgttaggggaaaaaacagctacagtgtgtttatacttttccaatatatatacttttttgtcgactttccaatataaattttatgttagatatgaattgagtatatacatactatatacatgtgagaacttaaatttggtgaaaaacaaataacttttttaagtagatgattaggtaagagacatgatatctccttctcctttcggttgcattttatccggtttcactcttttggttttagaaactcgatcataaaccttatatttgtttgcctattctactcttccccta

SEQ ID NO: 5817 - DNA, 3000 bp, Unknown
  misc_feature (1)..( 3000): cDNA_ID_3078500_gDNA_ID_1620819_Annot_ID_169400 3000 nt of promoter + ATG
ttggattacactaaattaaaagtgattaagacgagagactagcccatttgtatccatgcataaacttaggtgtctttttatacgtggcactaaagtacgacttagccatctaatctaaagtggaagtttctgaagttacttcattgaacactcaatagtcattaataaacctgaccattttcctcaatttactaataggcgttgggataatacataaaatccaataactaatgcctcaaactctgcattagttaaagattctaaaaattgagtaatagagacgacaattctcctatggcttccctcatactatcgcgtgcgtcacatatctccataaccgtttcataattgttctctttctttttcactcattttataatggattagttaaagaatccatttatatgattataataagtaaggaaggccaaatagaaaaaagaaaaagcaacgaaggaatatttcgttattactagtttcacgaattctatcatcgaagaatccaatttcgtgatggagcctccaacttgtctgacgtttctgccgttaacttctttttctcatttctctctttcttactggcataataaatgaaatccaataattgccacatctcttgcattattcaatgatccaaaaagactttaaaaattgagtgacaaagacgaacgaagaccacgactagctcttcccatggcttcttcactgaagaagcttatctcaagctttctacttgtcttatactctaccaccatcattgttgcttcatcagaatctcgatgtcggcgctttacatctatcatcagctttggtgattccatcgcagacaccggaaatattctccatctctccgacgtcaatcatcttcctcaaaccgccttttttccttatggtgaaagcttcttccatcctccctctggtcgtgcctctgatggccgtctcatcatcgacttcatcggtacctaatatttcctctgtttaggcaaaaccacttgtaatcatctatctgctttaggtctatcttgcgtggaaagcaagatagaaaccctacttcacctgagtttttctaatattgtcttactatttgaacagctgaattcttgggactaccgtatgttccaccttactttggatcccaaaacgttagctttgaacaagggatcaatttcgcggtgtatggagcaaccgcattggaccgagcgtattttgtggcaaaaggaattgaatctgatttcaccaacgttagtttaggtgttcagcttgacatcttcaagcagattttgcctaacctttgtgcctcatcttctcgtggttagaaactcagccttttattttgataaacagaaacttagccttgttcttacagggtttctttatttttgtgtttagattgcagagagatgcttggagactcgctgatactcatgggagagattggaggtaacgactttttttacccatcctccgaaggcaaaagtatcaatgaaaccaaactacaggatttgatcatcaaagctatttcttctgcaattgtggtaacaaatctttacacaaatataatcacatatctgttttatactttaacaaattaagcaaccaaactacaggatttgatcgctttagggggcaaaacatttttggtacccggaggcttcccagcaggatgttccgcagcgtgtcttactcaatatcagaacgcgacagaagaagactacgaccccttgacaggttgtatcccacggctcaatgaacttggagagcacgacaacgaacaacttaagacagaactcaaacgactccaaaaactctatcctgatgtcaacatcatttacgctgactaccataactccttataccggttttatcaagaaccagctaaatatggtccgtgccacttaaaactctttcgttgaccctcatggtttaattcattaaccgagatattgttttgtttttttcattagggtttaagaacaaacctttagctgcttgctgtggagtcggaggtaaatacaacttcactattggtaaggagtgtggatacgaaggagttagctattgtcaaaatccttccgagtatgtgaattgggatggttatcatttaaccgaagccgcctaccagaagatggctgagggtatactcaacggtccctatgcaactcctgctttcgactggtcctgccttggctctggtacagtggatacataaaaggagcagttagaattcatttgttgtaaaaaaaaaaaaagaggaagaaaattgtgtgatgatgattaacaaaaagattgcttgtacggcaggatttgactagtgacaaaaatttcgaggatatatgcatcaatcttatcaatgaaaaataccacacgcaaatagaaaatcctatttatacggttcgtagcacgagttgcatgttgagaaaatcctatttataacagttccgtggaagatgttggagaagttttggatgaattaagagggacaaacgacagctaaggattaaataatttcataacatcctttgaactgaaagattaagaacataatacactatttgggaaaacttaaaatactatattacaatggatggatataacagatgagaacatgcatgtgaggttcattgattacacattcatttaaattttgaaaaagttcaagattctatatataaaaaagaaaattatttaaaatttcttatttggattacactaaattaaaagtgattaagacgagagactagcccatttgtatccatgcataaacttaggtgtctttttatacgtggcactaaagtacgacttagccatctaatctaaagtggaagtttctgaagttacttcattgaacactcaacagtcattcataaacctgaccattttcctcaatttactcattggcgttgggataagacataaaatccaataactaatgcctcaaactctgcattagttaaagattctaaaaattgagtaatagagacgatgacgacgactctcctc

SEQ ID NO: 5818 - DNA, 3000 bp, Unknown
  misc_feature (1)..( 3000): cDNA_ID_2041497_gDNA_ID_1620819_Annot_ID_169396 3000 nt of promoter + ATG
tatataaattaactaaaacaacaatttcattttattttgttacaggaaaaagaattgaaaagcagtgattttctcatatattaggatttgatctgcagtagccgcatgataataattttgtgcatatacataaagtctttgacatttattttaaaattgtgcatattttacatattgaagtttgtatttaaaaatacttagttttataatcaagaaatcagtaatatcgctgataaatatgactaattggattaaatttgatatagtctatatatttgaagtgtgtaatttgtgaatatgaattttaagtaacatcataataactactgctctatataacattgtggaggttaaaatgtaagaaaggaaaatacagatagtataataactaaacaaaaagactaaacatcagaacaattggagatattttatagttctttttcaaagtattataatatttacataattatatagattattagaattattaattagttggactattatagatatcgttttttttttaattattgtgtgaaatttgatcattttaaactaccaacgatcccaaagatgatgcaagagaagagtctttgaccaaatgtaagagaaaaacgtgttttcgatgattgatggatatggagatcagaattaagaaaccctgatgaagcactcaaactcttcactataggatgaaggattccgtatagaacccaattacatatgtaacctttcttggagctctctcggcttacaactacatatgattagtgggtacctaaagcatggattgataaagtaaatatttataagattctctaatctctatagcaaatataataatatgttggcgtgatgataatcgtgagactaaagtaggaaacaaaaaccctagaacaaaagatgattcatgtgtgacgtattcgagaaggaaccttaaaaacgtttgtgatattcacattaaactggtgttatacatccaaatccggtaatataaatatagtgttgaattgttgtgtgaatcaaaagagagaaaatagggcacatgaaatagttgtgagtatatcctaataatccgaacaaaaaccaaaaacatatgacttcctacaataactcctccggcagtctcgccctggccgttgctcttctatttgccggcgccttatatatctacttctcatcacgttcagcttctgatcccatctccggtctcctacaaaatgtcaacactgtaagttgattcatataatatatatggaattctagagtacaaataaaggaagatttgaaatatattttgaaatggtacgtgacagagattgatacagtatccggtggacgagctagagacggtgctggacaaggcgtcgacagggaacaacaagacggtgataatagcaatggtgaacaaagcttacgtggaggaggatggaggagggaggacgatgctggatctgtttttggagagtttttgggaaggagaggggacacgcccgcttcttaaccatctgatggtggttgcagcggatcagacggcctacgatcgctgcctcttcaggaggctccattgctacaagatggatacggaaggggttgacttggagggagagaaagtatacatgtcaaaagatttcatagagatgatgtggaggaggactcgcttgctcctagacgtcctcagccgcggctaccatattattttcacggttaggtccgtcccttgattttgtaacatatataacaaaacacttaatttgttgctcaaacaagtagtgtatatacaatgttaggatacggacgtgatgtggctaaggagtcccttgtcccggctaaacgtgagcttggatatgcatataagcgtggacagaaataacgtgagaggacaattgatcaacacgggattctaccatgcccggtccaacaacaagaccatctccctcttccagaaatggtacgacatgaggctcaagtctttgggcatgaaggaacaagacgtcctcaagaatctcctagactctggcttctttaaccagcttggtctcaacgttggcttcctcagtacggccgaattcagcggtttctgccaagacagccctgacatgggggctgtcacaaccgtccacgccaactgttgcgtccacatccctgctaagatctctgatctcagtcttgctcttcgtgactggaaacgctacaaagcctcccgtgtcaacagcaggtggagcccccatgttgagtgcaggcgttcatggaaggacgttcattatgtccccaagctctgactttcttcgttcatataagcaaattaatgagattgctatatagtatacacaattacatcatttataagtgcatatcttcttttgattaatcctctagctagctagatgagcaattctcttttaacaagtaattacaaaacatcttatatgtgtgttacaagctatattctcgttttttattttttcttttaataatatagagattaatttactatgttagacaaatatgtttttgttacaatgattgtagaaaaaactacttggctaatctaattccgaaagagaggagggcaaaatggaaagaaattgagaatgatctcaattaaggtagaagagacatttatatcatttcttacctaatggcatatcatgtaagtaactaaaagttttgttaattttgatatgtagtaaatatatatgtacgtttattggattcatattaattcccttaggtaaacagaatgttacgtgaacgattgaaaatctcacagagtaaaaacacaaaaaccctaattacatgacgattcttatgtgatatattcgtgaaggaaggaaccttaaaaacgttagtggattttctatatacattattcacatatatccatcgtttatataaataaataaataggttaattgtttagtacaaaatcacgagagagagaaataaaaaaggcgtgagtctcctaactagctcctaataatgcgataaaccaaaaac

SEQ ID NO: 5819 - DNA, 3000 bp, Unknown
  misc_feature (1)..( 3000): cDNA_ID_2041515_gDNA_ID_1620819_Annot_ID_169391 3000 nt of promoter + ATG
gtggtatgattctcgctttgggtgcgagaggtcccgagttcgattctcggaatgcccccttgaccttttctatagtgtatgatttagatgcaagctgaaaatggcttatgatattattatttttttagtatttagattttccacagacctcgttcaaggatcgaggaccatatatttccatttcattttcagtaagagaaaatcaaaaacaaaaccctccccacagtttcattattaagtgtttaatgcaatagaagagaagagcataccgctgtttcacatccagatccaatcaataaactttttaactagtacacttcatgtagggaagaccgtcatgttttgtaagctgttggattcacaaagaatagctgcagaaacagcaaacgaattgtgattaagtatgtaatggaaatgcagagggaagcaacaaatctctaagagaaaggagagaatgctaatagaatgcattaactgaacaattataataagcagggcatttggtctagtggtatgattctcgctttgggtgcgagaggtcccgagttcgattctcggaatgcccctttgactttttggaaaccaaagttctaaacgccagctaacatttcatcaattctaaatttccagactatccacctttactaataagccctgatggctgaaagtcaactgatatagcccagatctaaaaagtaatttctgtcttagatgatctaaacaagaaaacattctaatatcatattcaaaaataaattaaagaaaaatttgaacttactgcatcttgcctgcttcatcacgaatagaactctcaaaaggtaaaaaaaaagcatcaagagtgaatttcctgtaataacaaagtcaagcatgaattctcttttccacaggattacaacaatgcaatgcttcaatgggaattaaatcaacaacagggcatttggtctagtggtatgattctcgctttgggtgcgagaggtcccgagttcgattctcggaatgccccactatctttttaagtagttgatctaaattcaagtagataattgcttagaaaaatctgatctttgtttagtcatagttatgtcacagatcttgataaaccatatattactcttttatttcagcaagagaataagtgcataatgcaaaggaaaagaagaacataccgctctttcacatccgatcaataaatatcttaaccagtgctcttcacatctggaggaccaacgaaggagctgcagcaacagaaatgaattttgattaagtacctaccagaaaagcaaacgaaacaacaaaatctctgaatgaaaagaaagaatgcaactaggaggcattaactgaagaacaaaataaaaccagggcatttggtctagtggtatgattctcgctttgggtgcgagaggtcccgagttcgattctcggaatgccccgttaaattttttggatgtctgtttcatatgccatttgataactatcatagaacaaacctgattttagtgtataagttgtcaagtgcattttcccttcaatttttaacagtttcccattactacatttgttatacacagttaaaatacaaaaaaaaagagctagaattgcaatgcaccttggctttcacgtccactggctcacaaatgcagcaagaaaacagaatatggatagcggatttaacagagaacttcttcactagctgaatgctgccaaaaaatttcaagagataactgcaggaagtgaaaactgaaaaagaacacatctttaaagggtatttaagtttcaagagcagttatggatggattttatcaacaacagggcatttggtcttatgattcacagagtattaagcgtaggctctagtatccagctgaaagtgataacctttaggccctaataataaccattgaacaaagaggaactataaagcagaatgtgtcagcaacaatgatatggaaagagcaagtacttacccacttgccgctgaatctcattagctattaggttctccaaacagctcacataacaattggattctattacataaatgtgcgccaagaaagctggtttaggaatttcgtcgaacatgtggtgggcgtatctcatgaaggaccatatcaatcgaataacgactgaatccgatgaaaaaaacgctcacatccgttccgacgagacgaacgtgaatccggatccccgtcgtagaattgtgctgtaacgcataacgatgacgaacgagaggtagagtgacatgcaaaggatttttcaaatctttttttttttgtgcaacgaaacaagaaggcaaaagcacgaatttatctcctaatttttatgaaacgaagcaaatccggtttaaccgattcaaatcgaatcgaaaccgtataaaaaaaaaatctgatccgaaaacaaaaccaaagtgcaactaaactgattcagttttaatgttcccttatccaaacaaccctaactcaaccgaaccaaatgaaaaccgataaaacctttaattaataaaaaccgacaacatttctgttcctatgattcataaaccgaataattaaaatttggttatctctagtctcaacgctgacgaaatgaataatccaagctacaaaatgaatgtcattatttatttaatcatatccttaattcgtcatgtctgtttcaaagcaaacatagatacattttgatttgaataatttaggtcaaccattaacaaaatctataatggggtaaggtgtcaaatgaatacaagagggttggtatggtgggttagaagaatgttcataactacctcaactacacacaaatctggtatttgtggtttaagccgagctaaaccatagagagaagccacatacataccataaactgcaaccaccaccaccactccacatgacaagagaggttcaccaaacttgacccgacccttattaccccctttgaatgtttggggtaagtaacatataaatatacagatgcattggagggagttttgtattagtcttcaacatg

SEQ ID NO: 5820 - DNA, 3000 bp, Unknown
  misc_feature (1)..( 3000): cDNA_ID_2041539_gDNA_ID_1620819_Annot_ID_169383 3000 nt of promoter + ATG
taaaaaatgcaaaataatcatactaagacaataagtaatatagctcttttccgttattgtcaagttttaaaatttgataaataatatatcaaattgaacctttcgagatgatgaattcaactatatctttaaaatttttaaaataaaatgtatgtgatcgtgaaaacgtttaaaatatatgtaaagttataaaaatggatatactgcgtattattcttgacttcatataattattttgcatttttttttatgtagagggtaaagtagcaaaattgggcgactttgagggttttttttgctcaaaaccctaatgtttatataggtagaagaggaatattatccaaattatgtatgtacatattttgacatcatcgtgaataagaaatattctatattcctatattctaagtgtaacattaatttctataatttatttttttatgccgggtatcatcagacagtaattttgtcggtagaatgaacgctatatcaaatatctttttagaataaaatgttgaatgattattcttaaataagactaattttacagttgtaccgatatttttttccatatttgcctaaattgtattaaccaataactttggattttttttttgttttaacaatttcgagtttcggattttcttaagttcaggaaacataaaccactttatataaatcgaatcaatatatatatatatatatatactaaaatgtgaagttttagtatctattacaagcattgatgtgaagtttttactttttagtatcttctgcactgcacctaactacgctttcataacatggcttgcaatggatgacagattgactacatgtgaacgaatggagaagtgtaatactttaatgactacacttgtacatttttccaggaaccggttgagacaagacaataagcaccacctcttctttcaatgctcgttcacaagacaagtatgtgagaagctagctagtaaaagggctacgtcaagaaaagtaacacctcagtttgggatcaaatcactctactcctaacggatgcaacaatcgaaatgaaagctctactaattactattgcagtatatgttccaaaatacagtccacaccatattgagaaagagaaataatataagacatggtgaagaacctcaaacaacttcaagccttggggaaaacatcgataattgttcatattttggctttctactaggagataatttctaaactctatctagtagcgtatgttaaaaacaactcaaaaatcagttgcatttgatgtaataccggttttttgtgaatagattgaacattcattaaaaagaaggttttttacgtgatatagaggataaatagttaatgtgttaatcgtaattttgtatttagccttttctaatctctcttgtacattactcatctaataaagcaattcattctaaaatttaattattattttaaatttttgttgtagagtgaattgatttattagatgagcaatgtatacacaagatagatgagggcaaaggtaattacaataacatccttaacacattaatttatatactctataactggtataaaaaaattagtttgaatcattaaaattataattgaaacgaagattttatgcgagctcaaatagatttacagaaaataaggtatagaaagaaagatatatttcgagtttacaaaagctggaaacagtccattaacttaaagatgtgatttttgtctgattatcccatatctaagagtaaatgcgctatattttcttatatattttctccaatttaaaaagatctttgtcttatattcttcatcttacttagtagatacgcccaagactaaatactgactaaattgatgtgtaatcttttagcttccccgtagatatatattctttcgtaattttgatgaaataattaattgcttaagacaaacaaaaagttggtcaatattgtatgacatatataagtactaattaacaagttggaagatttgtttctatcttttattcctcgtttgtaatccacatgaaaacttttctagtttgtctacttcccatatttagtttttcttttctatttgtacaaattcaacatctatctgttcgctgcatttttccttcaaccttttaaacatagaaattacataattacttttcttaagttcttacgtttgaccaaatttttgtgtttcttttttttgttttttaaattagatattattccaaataaagggaaccaaaataattttaccccatccagccaattcacaaatcacaaccgtggacaacaagtggattagtaaaactaagaagaccgaaagatagtaatcttttattattaacaataaataaataaatatgaaatctattttcctttggtaagaatatttttcttaattatactattacaagtgatgagtacaacaatgacaaatcatatatgccttaccaataatgtaataaatatattgttacagcaaaacaaaaaaattggggttatcaagtaatttctaagttctttcttgaaataaaagcaaaattaaaatatctaaattatatttttatttcctccaatagaattgaagaaaagcacacaacatttttgttttaagcacaacttttcaaagaaaaaatcacggaaataaatgtggattcatgatatctctctccaggtggtttaaaatttaaatcattaaaaaaaaatgatagagatctttagaaagctaaaaacatggagtttgaaaattcctaaaatctcagaactttttttagcactacgccagaagagccgattttgtctcagatttactttcctttaatctctcctatttttaatgacttttatttctttctccttttgcaacatatttttctccaccacctttttttccttcaccattataaattgctctcaatcatttctcttttgtatattcataaactagacaccaagagacaaaaaaaacacacttaagtaatagagagaacacatcacaatg

SEQ ID NO: 5821 - DNA, 3000 bp, Unknown
  misc_feature (1)..( 3000): cDNA_ID_2041493_gDNA_ID_1620819_Annot_ID_169398 3000 nt of promoter + ATG
tctgagcatacattggcacacatccatttccccagtagcctttaggcaaaggtggattcatcaatctccttatatttatcgaatacacaaatttcacattctccttttcctcagtctttgcagctcttaccctgaatttcgatattttattgtttcagatcaaacacatttcaaaaaatttgattgaatcaaacatagtgaagaagaggttacttactttgcacgccaaatgtaagcaccaagagcttcgaatgtggtgaaattcagacccgatttctcgagtaattgagccttcaattgatccaaagaatcgtcggtcacaaagaagcagtctcttttgacgtctccaatggcttgtccatatggatcaaagtccttatccaggctcaagaagtcacgaactggagctccaacccaaggcttctcccttggaccaagtaaacgttctctgtcccaaaccggttcgatcgaaatctttgtcgctccgcgagctaattccgccatagcgttgaagaacagactcgcacctaacccatcgcagatcgcatgatgaatcgatgcacctagaacccaaccaccacactgaaacatagtgacctggaggatacaaggattgaccattccttcctcccgggtcggatccggtaccaatctctcgacgaaacctggatcgggtccatccaaatacccgactgactcaagcgtacagttcactgtagcgttgactaaaggcacgctttgaccagcggagcagagtagttcaaatcggttatcggaggcagagcgacggagagagccagcaagagggtagtagtgaacgagagcggtggcaagagaggcggatacgacggcagaggggctttctccggcgacggtggaagaggaggaggagtagacgcggaggtaacggaagctgacgtggaggttgttatcattgtcgagatgggaaagagagagagtttggtcgttggagagtggttggtgagaaggttgaaccagggctatatcggtaatttcaagtgtcgccataccttaataataagaatggtatgggtctttgttacttccaaaataagttttggggtccatatttataagagaagcaaaatcaatgccttgaggggacacagctcacgagagtaggcttcaccaactaccaaacggtcaagtcccatgtccaaatttctcacctacaacagtttcaaacaaaatcattttagtctttttgttattcataccatacttcatacttgtcttcactgtttttatgatcgagttttgtatgagtcttttcaaaattcaatcatgcttcttgtcttcagtcttcactgtttttctcctccacaagattagtatttttttttctttttttgtgcgtaagatagagttgtggtcgaaaattgtaagaaaaagaatctagcgtcaataatacaattggtggaaagaccaattttgaatctgattagggaaaaatgttgactagtgaacaaaaatttcttggtaagaaactataatttttttttttcaaaattataaattagaagtcgagagctattggaagtcggtggaactaaatggttgattggttcattagtaaaacacacgtggtgccactacacttttttaatagttacttgactggtgctgtttgcaaagttattatgattgatgattatttttgaaagaaaattggaatataaattcggttaggtcagtattgtcatgtatttgttaaaccactgtatattatactcctagcttagtttaatttatgagatttaagtggaattcatactaatcaaatgtgagatttcttgaaaattgtagtggaatttcttcaaggtcgaataggattattaaagagatactataaaggagcaattggtgccgacaaaaaaaaataaaaataaaggagcagttggaatggtcagctagaatttcatactccctccgtctttttttacttgatgtttagcagaatacatacaaattaaaaaaaaaaaaaatttgtttatttctaaattaaaatatcatttattatttaatcaactacaatctaaaaaataaaaatcatcaaaatcaataaaaatataactaattctgcattaaaagtttaaaacatcatttattaaagaataaaaatataaagcttaaaacatcatttataaaagaatttagaaagtagtactaatataatcgttttttaaagtgagccaaaatagatgactttgacacaccaaccaaaagcctaaaaagtggaacatgtaggctttcaaggcaccgcggacaagatattgttaatcgcaacgtcattattattgatttcgattcgtccatctgtggaataatacgaatatcattattagagtatttactaatcaaatataaaattatgtagactataacgaatcatttttttcttcttccaaataggtaaatactctaagaaagatattcatattattccaaaatgaatgatagctatatttgatttctataataagattccacataaaaactgactccataaagatatagatcacgcagagtcgcagactatcgcgtgcgtcacactactcacacatctccataatcaattctttctttttcgctcgtcttgtaatggattagaatataggtaaagaatccatttatatgattataaaatggtaaggaatttgcgaaaacccaaaagaaaaaagcattgaaggaatatttcgtaatcccttattattttcacgatttctatcatcgaagaatccaattttttgatggagtctccaacttgtctgacatttctgaagttacttcgttttcaaccaataagcaaaatttctttttggaaaataacaaataaccaaattttataatttctctctttcttactggcataataaatgaaatccaataatggcctcatctcttgcattattcagtgatccaaaaagactttaaaaattgagtgacaaagacgaacgaagaccacgattagctcttccc

SEQ ID NO: 5822 - DNA, 3000 bp, Unknown
  misc_feature (1)..( 3000): cDNA_ID_3078565_gDNA_ID_1620820_Annot_ID_169427 3000 nt of promoter + ATG
aattgaaattaaccgtatctcttttacacgcgtcatgaagagatatgaaaggaaacaaattaaaagaacttcatagattataaaatatgtttgaacttagcaaacgatccttttttctcttgcatgcttagaattaacatgtcgaccaactatcacaaaacaccaagaaaataagtgaaatactctttgagtgtttcatacagatcgagtcaaacttgactcactcgtcatttacctggtattctagtttgagtcaggttaattttactttaggaggctatacgaatcttgacaaaaaaaaattgtagttaatattaatatatatatatatatatataagtatgtgtttagctacactataatatataatctactcattagttgtacgtgaaggttaaaaccgtttgagacgttgtccataacatgcttaaattgcttgatttacttttttgtttgagttcaagtggataatcctaattattaatgacataaacatattactacatttaagcttataatatttataaaacgtgggaggttaaatgttttaattatctatatagtactaatcatgatgagacatgaggacacctagctgtctagcggagcatgcaacatgcaccagagagattaagaagttgtcattctttcgaaaatacccaaaaaaaatgatgggggtaattcaaccgtggaggagttaaaatgccaaatgatagagttgaagaaccacgttttaaggacatcaaaccgagttcggcgaccaaaccgaagatatgtgcaataagtcattttggtctggtttattttttactcatcctgtaatttgcttcagttgtaatatggagagatttggtcaacctactatgtaggaaccatctcttctactttcccattatttccttgcttataggagttacgtctctattttgttttgttataactatcaccaatgttaatatgcatgttgtccttctttactttgagtcccgagaaccttgttttcagaactccgatcttctcactattcgcgcaagagtgtacataacagcatgatcatcgcttacatgtacactaaacatttttttttttaacagatatgacacacatgaaaaggtatttaatcaagttggtcactcatcaattcgatccgaccatctattatgcgactatgcatttagttttggatttcacatggttccaagttaattaatgccagataaaaaagatttacggtatagtttttcttacgatggtcatgcattacgataagaacttcaaaatttcttgcacatttaaaatccggtctaagaatcagtgtcaaaacctcatataaaccatcttatttcacagaatgtaagacaatgactaacacaaacatatagggttcaaatgattacagcggtacgagcggataaaatcatttacggcataaccactttttatttacttttcataaactataatctctaatagtaaaaccaaaaagaaagaaaaaaactatcgcagaccaacaacagattgcttttacatacaattacgattagtccgcaacgctttgttgtccgccctaaaaataaagctgactatattgctgacggatttatctatcccgaccgccgtcacctttgaaacacataacctatattgtcacttctaccacttcttttttagatttcagttagaatgttaataaaaatataataaaatgtttgccatagtggtgtaattctgttaaaatttatctccaataattacattaaattataaatatatttgaacaaaattaactaaaaatatattaaaaagaattctttatttttttggtgattaatttaaaataattcctaattattacagattgttttctaaaaattattatatttagtttaaaagttaacagatgtagaaattttcaaaacttaaaaactaaactaaaaactccagttattcaatacctatactaaactaaaaatctactattccaagagataaaaaaaaaaaaaaaaaatctgtttccggaggaaccgcgtaatcctcttctcccaagattacagaaacaccctcttcttcatcccacgacagaaaaaacaaaaataaaacaaaccgaaagagagggtaaaatagtaaattcacattgactttcacatccctaggaccagaaaaatggcagagctttgaagcacacactgtctatatataaaaacacgctcacatttctataaaactataaaacctcttcacacctttgactctgtctctctctctctctctgttattttcctctccacgccagtttcgttctgatgaaattctgttgagaatttcgataatactttggcatcgatttgtctgtgaaaggagaacaaatcaaatcggcgacgaagaaattatgaggaggattatttcttcatcgcttcttctcctggaaagtccttcttctccctttttatttcaatttctttcaatcaattttgcttctccaatcttctggcaattttttttgtacttttctgaatttttttttgttggcttgaagatttttgaaatccattttttctattatgtgaaaaccattatacaaaatagtgatttatcaaaaaacaaaaaattcgaattctgtaacaaaaaaaaaagaaattgtggaattttatcttgttaaatccagctttttctattagtttgtattatttagattgtattgatgattaacattgatatacaactttttttttttgaaatgtatatatagattatttttttatatatatttttttgtcctccgaaattaattagagttcaaatgaatcatttctaaggaatattgtttacgtaagtgatatgatgcggttgaacacaattttctcgtgccaagctatacgatttgattttttgaaatttgtttttttttgctattttgtgaaattaattatacaatttccttttttgtttttttgaaagtctctgaatttgaggttgttgttgttgtgttttgtaccaatg

SEQ ID NO: 5823 - DNA, 3000 bp, Unknown
  misc_feature (1)..( 3000): cDNA_ID_2106384_gDNA_ID_1620820_Annot_ID_169435 3000 nt of promoter + ATG
tacagggatttgcccggccggactctgaccagcctgaaatacccttgaaaatatttttttgttttgttaatatttttgtttaattgatagatttttgtttatgattttctaaaaaaagagatgaaaaccttaaccctagttttctaattgtgttttactataaatgtgaaaagaaaatctttgttccactatttagtttgaagtattatcactttatatttatttggttatgagtttaaacaattaactagatagtttacccgcacagtgcggggaaaaacaattattaaatatatatattgtaaaaaattataaaatttactggattattatttaaaatctgaaattttcttgtgtattatgtaatgtaatatacttttctatttatttgaaccaacgatttttcgcatagaaattatgattacctatacattgattgatattaatatcttcgttaacatataatctttttgtttatatagaaaaaataaaaagggttatatattaagttccgaaagattacttgtttaattattaggttgttttaattaaaattttgtttttaattatttattactttaattggaatttgtttttaatttattatgttcttgagatatttatatataatactaatgacaaattttgtaaataatctaataaatgatggacaataaatcaagttggttgcgacacgtcagcatgacatctctctaaataacacggtagctaaaagttattctcttaagtgtgtttctctattaatatatagggtatttagattatttatttggttttaaaattttctttttaaactaaactggttttaataattactagtggttatttagtttcaattaactcgtttatatatattttttccaagagatattataaatcaaaaaaaattctcttcggaagaaagcccaaacaccccggaaaaagccttatagcattgtaagggccaggttgggctttaaaatataagctcaaaatttttacgggtcagactccaatatatactgattttgcaggcttcgtgttgttcctggcccagctagtccgatggacatacctagctgtagataaagtgattttagggtttttgtgtcgttgaagaagataaagaaaatcacgattttgccctttattaaagggaaatataaaataaaaaataaatgtaattacctaaaatctgtaacactataaccaacatgactttggctactttctcgcagtatttactatatatatttatattttggatagtttttcctgctaatattgtatatcggataaatccaaaccaaactgaacacgatccaaatccgacccaaatattagaaataatcgaacgtgtattattaacctaaacctgaaaactcgaatcgaatccaaatgtagttggtatagcaaagcaaacagttatgattcaattttcaaaatttgtgaaattataaattatcgagttgtaatatgggtagtttgtgcaaaaagttcaaacttcgtgtagttggaagcttaattgcaatttttcatagagttgaaccgtaatctattctaaaataataataacaacctttatagactctaaactctatcgttagaactctgaaaaaattatttacatcacctcaaaatgttgtgaacaagaaagttaacacctcgacactacagtattcacgcctgacccggacccgccggttcgatcggttaaaccacgacccaaacatttctccggtttgagtttaatattaatagcagacaatttaaaaataaaaaaaaaccacaaaaatccaccattaactcgcgacccagtgaaccggttgaaccggccggcacggccgggtatgggttttaaagaaatcatttgattttgaaacaaaatttaggattttagactttgtttagtaatttttagaactttttgagttatttttggaacttttaaaacttaaaagtcttgaattgttgattaaactttttgaattgagttttagttatattaatagattgactcaactaagtgttcttgatgttttagattttgatgaatatttaacaatatggtgaaagagataaccgagattcgttgtttgaattcatgatgttttataaaatttttccgtaattgccaatgagtcattaataatctcttacttcttagtatttgtttgggaaaaatgtcaaaaaaattcaccaactttcgaatttggaacgatttaatcttgaacttcacggaagacaaataaatcgtaaagtttttgttgactttctaaataaatgacaaagtttttgttgacttgccatttaaatcatgtcgttaaacagattaataaaaaaaattacgatattaatattccgtttatttgctctgttagaacaaattatcgtcttttattacgacgttaatgtctcgtccgtatttgttttgcgattttatacttttagttggattttaaaaaaattaatcattttattattatttttagagttgcttatattattaaaatgttataattatgttcttatttataaaaccgtatgatctctataaatattaaatacatataataaattttaatggattgatccgtgatcgaacctggttgatccagtaactcagtgtaccaaaacatagtccgattcaccgtccgggtattgttcaaaattcactgctacaggataatcatacaattgtcacaaatgattacaacaaaaaaaaataaacaaaggaagattagaataactacactcgcttaacatacgttagtaaattaataatacgcccaatttaattaaaactcgttttttcagaatataaaacctcctctcgggctttttcttctctacttggactgaaactgaaactgaaactgaaacacttctctctctctctctttctcgcttccacgaatcgagagttctacaaattcgcttcctagggtttctcaattcttctaatttcttcatttctatggcgagtcaatgagcgaaatg

SEQ ID NO: 5824 - DNA, 3000 bp, Unknown
  misc_feature (1)..( 3000): cDNA_ID_2176186_gDNA_ID_1620820_Annot_ID_169440 3000 nt of promoter + ATG
gttgtattgtacaaaccaatagcatatgggaattttgctgccgaatgctatagagctaccttatgggcggagctttacggagagtatggaggatagaaatcaatgtgttcataatgtgatgtccatcgttatctaatcatgtacatttctatacgtgataaatcttatatctttagaatgtgtgattctcctgttgtgccattgttctgttttaagaattcatctcacctctatttaatcctaggtaaattcaaacccccaactaactttgttggttgtcataaaagtgttgagcacgtttgtataagctaattccccagaaatgattctcaattgctaaccctgtttcgtggacatgttatcttggacagaacattgtaatggaaaaagtttatgaacacacatattaattgatgatatccgcaacctgcttcaagacgaatttccgaggtcaagacgaatttctgcttagtacaagacccattaaatccccatatcgtatttcaaactctatttacttttaatgaacattcaaagaaacaacgcttctttattacaagttacatcgtttaattcattcaatgaatcaacgcgtcgatattacaggttacatcgtttcactgtttatgcttccatcaaataaaccctttcattttgtataaatacctctgctactagtgacttcatcaagacaaccacatcacaaacgcaaaacaagagcttaacatatttctcagttttcgttactctttacttctccttttcacgatggttcaacatcactgtcggtacgagttgtctccgatggttactggttggacgatctatgtcatggtattgagaatttacaaaaagtttcttaacccgaacgctttcgaactacgtcttgtcttggccgatgaatgggtaaacaattttatccaatttcttttgcaatttgcagattttttctttacccgtgtatccctcaacccctaaaatattgttttaacagggcacccaaatagaagcaacaatcggatctcgtttctgtgccttctactttgacaggatcgaagagaatcaatggaaaacgataactacgtttatcgttcgacctaactgcgaagcaataagaacaactcctcatgagtttcgcattctattcatggatcaaaccatgccttggttggtaagtaatagcttcttcataaactccattcacttttttcaaaacatttattttttaaaaacagatatctccgacatatctcttatagatgttcttgggggcgctcgttgatgttggaattctgactattaccgcaagtaacgggaatgatgtggccggattcaagctgccgttcaaaatcctggataaaaagtacaattcttcaccatcaatttcagtttatttcaaacatctcatgtttatacatatttgtagtaaagtgagtttataatctcatatttttactgattttcagcaaggatatattgctatgcaaggcttatagagaaattgcagtggacttggagaaaagatttctagcatttcgcaataacaatgttgttattgcacttgcttggtggaagattgttagatattatgcatgtgctcaccgtttgaagattgttaaccatgcacctatatcaaccatgtatcccgaacctgatgttgaggaagtaaagaaattaaaatggttgtcgactaatggaagatgattagaactattacaatgcttgttgcttaaaattgttatctcatattcttctttttttgacctcttatgttttcctccaacataatttcactcttttagttgtaatatttttataatttgtcaaaaaaaaaagttgtagtatttttataagtgatattatatattaataataaagtttttctttattcataatttctcttttgtaattaatgcaacaaatacttgattaagtagtacagttgtaatccggtgtctgaattaagttcacctacgaaacatttatgaactgttttatagctgaagaattacccacgtacagtatcataactgtttgtacaacgtcaaactataattacttactcaaattgtttgaacttcttaatctgttgttctgactttgttatgtgaattctcgtttgcattccatctacatttctatataagttaagtcttatccttttaactatattgtttgtctttaatgacttcggtctatgaatgtataacctaatttcttctcatgtttacgaaaaaaaagaaaaaaaagtagaacctaaatccccataaatgagttccgtttgaattgcctgtaacaatacattgtaccatgtctatatattatattatagaccatgcgtatatatctgcttggacgttgtagtatggacatatctaatttactacaattattgccatgaaaaattatttggaatttttgtaggagccactaattatattcagtaacccatcgcgccacaacactccaccctcttaagtgatccatagtattagggttcccatttcatcacaatctcaaatccgttcccatcagcctggttcgctcctctttaattattggggtttcttcattactggcgatcacgaagcgcccttgcccctgttaggggaaatcaatttgccgtctagcctcttcgtcaacctttggttcaatttaacttacaggtaatgtttactcaataaatttctcaatccaattgagacactcattttctatagactgaaattgaaccaaaaattgcaaaatttaattttgaattggtatatagcctccaaaattcagtgttaacgttcgtactcattttctctcagcctcctccgttccctgatttccacatgcctgatcacgtagctgctaaaatagttagcttagtttccgaggacggtgtagatatgttaaatgcttggattcaatcaggaccagatggcaaagccgctgttttttcaagtgaaactctttcttctattcgactagataagtccccttttctttattcat

SEQ ID NO: 5825 - DNA, 3000 bp, Unknown
  misc_feature (1)..( 3000): cDNA_ID_2176154_gDNA_ID_1620820_Annot_ID_169431 3000 nt of promoter + ATG
tacatataatgtatatatataattgatatatttatacaattattaatttatgatattgatgagaccatatatttacatagaagtttcaaaaaagttattatcttattaatttattgatttatgtcattttttacattggttccaagttgagaccgtaagaatttattaatttataaaagttattaatttatcgaatattaaattatagaagttttactatagtttacttgacatgtaagaccatatattctactatattttaggtagctgacaatcttttttcctaaacacgagaacatatatttatatatttacgtacatattatgtattttttaatgttatatttttgttttatatgttaaatgatgaaaaaatgctaggttttttcttaactggaaatgtttttgatttgataaagattgtagtgtaattgtaaatggaatgagctacgtagcaaatagaattggaccctacgttatcacactctcatcattagcagcacttccaacaaccccttaaaggcttacacacccctccagtgtcaatgtcaccatctttatttatgttctttttaacatgagaaaaattatacaccagattaagggtctaaatagtaatagttgaattcggggtgaatatggttgaatttaacggaatttagttataattttttgttcagtttggctgatttgattatgttatgttgctgaatagacttaagatccataaattttcatgaatttactgtatgaaattcatacatttagctttcaaaaggtttttagctatatgggattaattagttaagtatgtcttgtttgtgatacatcaagtgagattcattttcttaaaagacgtttgttataaatagaatgagagtgtcagagcttgtaacagttatatgaaacacacaaaaaaaagaattagaaaaacagtttattattgaaagtaattgtacctaatctaaatatctaatgacgctcatataacttttttaatgttgcttgctcgaataagcaaagatgttttactttatgaagttggaatagttttgaagagttgaaactttgatttgtctttatcaatattttttttttcaaatgatttttgaataaatgttagaattcttttgtgtgtaagctagcaattttaccgttgagttaaatggatcattagaactcataaaaaaaattaaaatagtttgttttcctcttaactctctcagatcttttagatagagagtcttttccatcgtttaattccgactaagatcggaaatttgtttcggttttgtttctggcctttccatgatttatgtatattttgctttgtgcgacctaaacaaattatggttttatgatggactttttctaccggcttgtctggtttttcgtttttttttttcttttgctttaggtaagctatgatctccatctgtcggtgtttatcgttgtcaatgtttccgtctttttcacaatcctctctgtttcagtcaagttgtttcgaggaataatatcttcattaaatcatgttgctcatatgaaataggagcaacgattagtctatatcaatttggatgtagttcatggtggagcttctccggtgattagtggaaattttgatgcggtatatctaaatcgaaatcggtagtcggaaggaggattttttttcacagttctttggtcgactagtggtagctagtcggatttgcaccgctcgactcgtcgcataaggaaaacaagtccttcccacatgtcaatgactaaatcctagtattcgatttcatgtttatcttcattatactttgatttagtcttgggttttggtctattcgcacgtaatcctactatacattctatatttttgccctttgcacttattaacggaaaagtccaacaaaaaacaacaaaaataaatcaaaaaaacattcattttgaaaaaaaataataattttgatctaactaaagttagtaagatacatgtgactcatgttcaattcaaagaaggctcacaagtctggaagttttttaaattgagttcgcgtcctcaactttccctaactaaattttacacatcaactatatctaactaaatttagcacatgaacggttttcaaataaaaattaaatagttttggataaatggcctaaaccgcataagttgaaaacaatttatgaaatgtttggcaacccaaaaatgaagaacttgtttctggtaagtttgataactgacttgtatagtgttccgctagaaaagattgaggatgcataatctatatcagtatttttgaagtatatttttaaagttaacatttattatagtaaattatcacaaagaatgtcattatttatacctatgtatgtaaaaaatctcacaattaattatctactatctatataatcaaacacaattaaaagattttaacattaaatatataattggaaattagataagtagcaatataaataaataaagggtcaatgaaatatatgttcatggagagctacataattaaggaagtatacatgtatggttgatatttagctggaataaaacatgcaaatgaatatgcctattttagccctattcccctaacatacattaagccaactgaacaaagatatcgaatatctcgcattaaatgcgggaacaaactctggaaacatatatcccgtcggcgttacttgtaaaaacagagaatcataatgatgatcaaagatttaatcggggttgcgtgttggcctatttattactcctctatcaacgttgcttcctcaacaaaagtagaaacacataacactgtaaagaaaacagcattaacttctgcgaagaaaacaagagcgaagtacttggagacagaggtaagcagttaatgctcatggatctttgttctgcctaggtatagtgtaataaatggtacaccccgacatagggctttgtcttctatcaaacttgtccgctaacgttacagttatggttgattatcaacagtattcatg

SEQ ID NO: 5826 - DNA, 3000 bp, Unknown
  misc_feature (1)..( 3000): cDNA_ID_3078558_gDNA_ID_1620820_Annot_ID_169434 3000 nt of promoter + ATG
taatctatgtgaattgtttttaaaactgttgtattttaaaattagcatgttttgaaagttgcacaaatattttttttctaaaacaatatacgttaaaaaaaaaccaatatatcacaaatctcatccataatttttttttctgtttgtttattatattcacaaacgtagatatattgttttggaatcaagattgtgttctatattttaaattgctaaaaatctgttttctcttttcttattctctaaattctcattttaattgttttttcgattatgtataaaaaactgttttgttaaaaatcgaaaattcattttcactaccccaaccaacccacgatctctccgtatctactcaaataaaacttgtagtattcccaaaattattgtatataaaatcagaagttccataaaactcttccttaaaaattctccagaaacatcaattttcacataattcttaaaaggatgccaaccatacaactccgatgaatatgagttatacgtgtacttctccaacacaaaatcatattgatccttatatgttcatcttctaaacctttccaagacgacgaagaattgtttttctgttcttatttttattattttgtatttctcattttctcacccatgactctgattttctatttattggttttcatactcagaaaatctccacagtgaagaaacaatgtcaccaaaacaatggaaaagaaaaagcttggacaagaaacaagatgtgtgttcttgaagaaatcatacctagatcttgaactaattaagttcatatcactttcttttttttttttgtatgtgtaaaatctctaatgaatttattaactgcgttaaatttatgtttttgtcttttgtaattgacgttctggtataattatttgtaaaaaaaaaatagaaaagatttagtagatattgaaaacgattttcctatataaaattatttaaaaacgaaacaaaaatatttaagataataattctgttataaattttgtagtttcttttaaccatcgtttattgaaaaatatttaacacaaatattaacatcaattactattaagtgatgtaaataattgaaatcaattctcttaattgacactaatactaacatcacttaaataaatagatgtaaaatttaacattatttttttcaattgacacatattcatatcagttagaataattgatgtaaatattttatatcttaacatcggtcattaattaactgatgtcaattatttgcatcaacaatatataagtcatttatttaagtgatgtaaaattcttttacatcaattataagtaatacaaatattcaaaataaatgatataaaatgacccttttttgtagtgattgcacaatgttttatagaaagatgaatatacatatatcagtttattgtttttggatctagaacttttttttcttcagtctcaaatattatatgtgactccttttagaatggcacacattataaattaagaaaaaggtattggctttaaaaacttgtactaacatatgctaaaacaacagtataaacctctttttgtaaaacaaataacacacaaatatctatatatattaataaatcatcaagcttttcacgacccactcaaagtaatcatgatcactcatactcatctgatctttatcattccaacaccacgccaccgttttaccaaaactaaacaactaaaagagcatctggttccgatttctcataattaagaaggagaaaaaatgctacatgtcaattcccatctttacaataataaattcgtgaaagttaatgtgatggacagacagtttagtgtacgggtacatgtcaattgttgggaatttaacttacaaaatataaaaagagaaaagctagctctaatatatgcgatggggggactcattaaaagagattcgttttagagttagccctaaaacttaattctgcgcttttgacatcacattcaatcccgttgttgttgtttttgtatgtgacacatatcaattgattgataacacgtgtcacgattgtgagccaaatttgatataataatatgaatttataaatttttttccttttttacctttccaacctaattttagtcctaatttttgtaatttttcaaaattttcattcattcaaatcatttattttctattaaaattttgtttttattttttggtatagaaaatgacttttaaagttaaaacaaaaacctcaaaaaaacaaaaaacaaaaaaaaactttgtaaactttcaaatttttcattcatcatatcatttgtttttccactaaaatttctgtttttctttgtctttgtatacgaaaatgacttttaaggttaaattaaaaaaccttaaaaaaaccaaaaaaaaacaaaaaaaaacaaaaaaaaactctttaaaattaggtaaaagttgaaaaaagacaaaacgttatattgccgaaaaaaggaatattaataattaaggccctaagaacatccttattggtaagttcttaaattagttcttatgataagaacatctcattttaactcttatataagagacaaaatgacatttatataaaagacaaaaaaaaatcccaagaactaatctaagaacttaccaataatgatgctttaagcatgcaaatgatatcattttaagcacaaatagtaatttatattgggctgataggcccataaactgcattttattggtaaagttttaggccccaagcatgtgtagcaaaatatcattttaagtcacaaatactcattcatattgggctaatgggcccataaacttcatttttatttgtgaagttaggcccacatattttgtaattcttcgtcttcttccacttttgtctttgagccgtcgaacaaaaacaagtagtctgaagacaaactacacaaaacccttgaggaaataaaactgcaaaattgaaattagggtttatactttaaagcagtcaccaaatccagccaccatctcttgctgaagcc

SEQ ID NO: 5827 - DNA, 3000 bp, Unknown
  misc_feature (1)..( 3000): cDNA_ID_1829389_gDNA_ID_1620821_Annot_ID_50680 3000 nt of promoter + ATG
ctataaaagcataatataactattgatacatgcatgtatataataatacagaccgttcaatttattataaaaatatacgaacatttctatgaagttattttctttattgattggtataattcagattcattttcgtacaatttttttaataaacgttttaaaataggtaaaaactctgttggaaaagagttgtactgacattatatcacgatatcagataatgaatgtagatttacgacatatatagtatagttggatttatttttcttgcattttactattgcttttggaaatgaacagtaagaaatgagacatggtcagaaaatttccgatggtacctaaaaaaaatataccaatacggaattaaccatgtgggtttgtgacataagagacaaaacataatgatgctatgccacacaacagccgaagaccgtatgttagtttttttttttaccgaataccaaaccttttttctatatgtctaataccgaaattatttaaacttttttttcgtgcatatatatttacaggtcagttttgcaaagacttttggtcacgtcgatggaaaaaaggtggtaattatacacttttaagggccaaatttctcattaatatttatataatatatgtgtgttggacccttggattaaattacattcatctttcataaatattaaacgtctaaagtagaaaaaaatcacaaggtttttgggcatttagtgtggtacaaattaccagaagtagaatgactagatctttttaaaatttttttataggatcttataattttataacttcatagttgttattcctcatggatccgatcaatatccgagctatcaactttaatcaccaatccaatatttaatagaaatctaaacttctaattcctcagtatcaaaacgcaaaaatattccacattaacagtagccaacgagatagagctatagaaaaagaaaagattttttggcgggacccacgttttgtttgctgtcaatagtttatttagttacaactttatttaaatttatatatttgaactaaatgagacctaattataaaaaaaaaaatgaggcctaagcctaaccgaaaaaatgtgttaaacaaaaggatgcgtaattaatggggcaaggatttaccatatttatccttgacgagtgacgacatgttcgttttggattttcagttttttcgtattttattgttattattatatgtgatatagtgatgttaccatgtacagagtattactcgttgtaaacaacatttgactcatatcattaattgctttttatataaaaatggtatttgtatacttttcaaaatctgaaaaccctcaagaacactccatctagaataaacttttttaataaatactcttttaaagactttgtaatttcctttttaaaatatctaatttatttacaaaaactaacacgtttcgatatttaattggtagcatcaccattcaccaacattacgataagtcgataaccactaaaatgtaattatttaaatgatcttggtttaaattgcttcattatttttcatttaaagatgacacatcatcatagttttttttttttttatcccttctagatttgccaaaaatatagtaattatataatctcttaaaagcattaaaaagcaagaaagaaagatgaagagaacctagaagatacccatttccacatttcaccaattatttacttctactgctcaatgtagtagattattttatttcaaatggaatgaaaactaaaaactaaaaaggtaacataaaatatttaaataaatataacaaattaagcataaaataaaatttatcttgaaaaatcatttaatccctaaaaaatagaaccaagaattttatgagtcaaactaattgataaatcctgttttttatcctataataatatgtacttaataataaaaatggaagaatattagtattagttattacaagatggtaaaaaaaaaagaagaagaagagagaactaaaaaaggtgaagaaaaagcagagaataaaagggaagagaagaccggatgttgacaaattatttcatgtcactgtacaaaagccaaagccctcgttttttgtttttattttctctcttcttctgattttcggatcttctcttctcttctcctataatataaaccttctttatcatcatcgtccccctcacatacaagaagaagaagaagaagctaaatataaagcagatttctttttcctctcctcaatttttctttttgttagtttggtgagagagaagagtggcccagctagatcgaagatgacgatctaattatttccattaatggtgtttacgctataactcttataccctccccccaacactttattttattttttttgtttctcaatcttccctttagtagagagattcgaaaaaaattcttacttttttccttttgattcatagattttttttataaattgcttcttcttctgagaaagttttgagacaaggttggcgataagaagatgtgggtttgaggtaacaaaaataaaaatctcatttttataaactctgttttaatttcaatttcatctgcttaattttccctagattaaagcttggtttttttttgttaatttctatttggtacaatcttgtcctaagatttttgcagattctttgttatctaactttagatttccaactttgattactcaagatcctattttgactcgtcggcgttagaactcatctgttttgagtcaaaacccttagctttatatatagatagtgttatcacttttacaattgctttgtgtttgactttttgatgaatttgaagctactctcaaaatgggttttaactagatagagctcatggagctaaagttcttgtttttatggaggaaatgtgattaatgcttgttttttgttgccaatttcaatgtcattgaatcagatttgtgttagttagtctttggtactaaagtttggatatttgtgcgcaggaatg

SEQ ID NO: 5828 - DNA, 3000 bp, Unknown
  misc_feature (1)..( 3000): cDNA_ID_1829387_gDNA_ID_1620821_Annot_ID_50681 3000 nt of promoter + ATG
tttcacaaaatagctgcaaaaatgtatatatagattaagtgtctttcgtatattcaaaaattaggagtttcagtttagaaactctcggtttacactcagaaaatcattcaaacctattcaaatgtagattgaattattgaataggtatgtaattgattatttaattattgactgtttctccataaaaaaatactataaatacaactatgtattataactccctttttcccctggaataagactgatgataagcccattgacaaatacagattttgggcctaaatcaccccaaaaaaaaagaaaagaaacaacctctccattgcctttgtagcaatcaaatttcctaataagggcataattataatgatacacaattagtctacacaaacgagtgagacattgatggtgtaactcgtgttctacgaagtgtgactatttacatttgttcagcttgaagcttatttaatcccttttatttttcttgtcgtgaaaatctaatcacagtatcacactacgtttttttgtttgtcccagcagttaataaacacacacaaaaaaagcttcgatatttgggaatttttgtagttactagacatttttacaaattattacttaatatgttcatattattaatttcgttatggtttctttatttaattaaatcgttcaccggcttgtgtacgaatgatacttgatgctataacttggaatctgaaagagccaatcaccgaattttgtcgacagggacgagagaaaaagggagaaaaagatgctctttttctcgaagggtaatttggtaaattaataaatggcagatgatgtaattaacgtggaagttaggtggttttatttgtctgaaaaaatgtaagttcgaaacggaatcctagattcgtggacacagatcgttatggggattagagagagaaacaaatgttttctttttgtctccagaaaataagagagccatgagttactctcatatcttataccctttttacccttctatctagttgtagattttttttaatcatttctttaattattaattgcgttaaattaattattgttggaatagaaatattattttgcaatttgcaccaaaaaaatattattgtgcaatttacaccaaattagcaaaataaaataaaattatagaccaaactaaataaattttggtgctaaggaataccaacttatgtaggttgtcctttgaatagcctgacctatggttgctggttgcctggatcctatatatgcctagtatgtatgcatgaaagcgtgtacattgtaacaaaaagatacatgtattttatttattagaatttgagaaaataaattgcaagtttagataaataaaattaactaaaacgaattataaaagcctaattaacgagcaaattattcagtgtttatgatatatgatccaaaaatcaacatgcataaaatgttttttatttactagaaattgttgtatgatgtgattggaaaatggacgtattaattgttttgtagtatctacggttctttatgaaacattttgttccaatacttttttttttttggaaaattttgttccaatggtaagtggacaccatatccagagttcaaagttccttttcaacaatctctcctcttttttttaatgttctttcaaaaaattgttttaagaattttacatgttgtaaaaaaaagataattaaagatacaatccataatttactagaatacaattacaacacgtagttatttcaattatcatcggatatctatctacacagctctatttcatagattttccataaatatcatttaatacacgtagttacattttttgtttgtcttatacacgcactttctagaatcaaacaaatgctttcagaaaactttagtgattaattgatcgtagccaaattcatctagcaaattagtaattacagttataataccattattttgaatagtcattatttgttgaaaatatctttaataaattttgttaacttggagtttataaattataatcataaacgttgtttcgatttttgttacagttttctaacaatgttaaattttccagtatgtgtgtgaccctacaaaaatgggaatcaacaagaatcaaaagggcccatcaaagtctccaccaccaatcacctgtgaccgctctcacacttaacgatgatctttgttggattaacggcgcgtgtaatcttgatcccatcacgtgaactttcacgctcatagaccccactgttccaacctcagcaccatcagtcctattcgtcaagaagatttaaggccatacgtaacaaaagcaagctgagagaaacacatcctgtcaataatccttgagctggactctaaaattaggcccatgaaacttaatgacagccaaaaatattgtttgcattatgaattaattatggatttgccactttttttatggcatttgtagactttgaatttttttgaatagtttgtggattttgttttttttcctgattacaaaagtatgatttaacatgcattttatttgttatgtttgggtttagtcggttgtggttgtggttgttcttacaatttagttttttgaataaagtacatatttttaccaaaaacaaaatcttaaatacgtacattttgaaatgttaaaaatgacatattcataaaattttagtaaaaatgatgattttaaaagatctcgatgaaaaatgacaaaaccaacattaatcgcttacattattcgtaaaatttatcatgttttcaaagacatgaaaacattgatctctatatgaccggagaaaacattgatctctcatatcagatcacgtgatcgaacggtggagaaacgctctctacaataaggctttaaagcccataaaacccttaaatatatcaaagcccaaaagaaacgccttttgcgctttcccgatcgtggtcaacttcctctgttaccaaaaaatctgtaccgcaaaatcctcgtcgaagctcgctgctgcaacc

SEQ ID NO: 5829 - DNA, 3000 bp, Unknown
  misc_feature (1)..( 3000): cDNA_ID_1829383_gDNA_ID_1620821_Annot_ID_50682 3000 nt of promoter + ATG
gctgcaaccatgtccgacgaggagcatcactttgagtccagtgacgccggagcgtccaaaacctaccctcaacaagctggaaccatccgtaagaatggttacatcgtcatcaaaaatcgtccctgcaaggtttcgttctcaaacatttctccactctcttcctctgatcttattagatctgttcattacttagattcctcagattcttttttttgtcacctccacgatgttcgactgatatttgttcttgtcatcattgttaaattcacattttattgcacttttgttttagcgaaattattaaattggtcatcttcagttttgttcgattagataagttttaggattttttcttacacaagttactggatcagctgctaaatgtcattttgtgtcgcaggttgttgaggtttcaacctcgaagactggcaagcatggtcatgctaaatgtcattttgtagctattgatatcttcaccagcaagaaactcgaagatattgttccttcttcccacaattgtgatgtatgtgaaaaaagctcctttgatcactttcatttcttgtttgtttctttcaagtcccatttgagattttgtttttgttgaattgggtttcaggttcctcatgtcaaccgtactgattatcagctgattgacatttctgaagatggatatgtatgtgttcttaaatagcacttgttcctttatatggtttagttacttgttctgttttgtaatcattttgcaggtcagtttgttgactgataacggtagtaccaaggatgaccttaagctccctaatgatgacactctgctccaacaggttaagttttgcatgttcatcacattaaatgttgctagttaattaaaatcaactctatgtcgatttctgaaaatggaagaaaaagtgcagagtaatgagtgacctgattgtgttaatgaaacagatcaagagtgggtttgatgatggaaaagatctagtggtgagtgtgatgtcagctatgggagaggaacagatcaatgctcttaaggacatcggtcccaagtgagactaacaaagcctcccctttgttatgagattcttcttcttcttctgtaggcttccattactcatcggagattatcttgtttttgggtgactcctattttggatatttaaacttttgttaataatgccatcttcttcaaccttttccttctagatggtttttatacttcttctaattgattgattctttatggttgtccaagtgtcaaagtgttccacccatatgattctaaccttttgatgagcgaagtctttactcgtgcgttatgtagagacgtagaagcaataccacaaaagagtataattatagatatatgctaacaaaactcaaaagttaagatcagtttagtattcaaaattgaacagtaaaaggttaaaaaaaatatgtatacttatgaaaataactaaattcatagataatcttttaaaattcagagtttctttttcttatatcaaattcaaaatgaaaacacaaactaaaataaacaacgacacatatcataaggtcttttatattttgtattagatcaaaactattattgcaatcacatttcttgtggtaataaatgaaaggaattctactcctaaagccaacgtgtgtcccacacaaagtaagaagaatgtttatattatcttttgctcttgcaaagtcaaatgtatcttcaaaaagtcatgttgctagttttcttttattcccctcacgtcatcacggttcctcctcctattacaaatatacacacccaaaaagtccactaacatgaaatgctaaagttaattttagaaatccattgctttcacgtgaaaaaaaaaactattacagaaataacatgtatttatacagtttactaatagtcatcaactcatcatatatggtataaatatttgtcgaaaaacagctctcatgatatgtgtaggcttatattcgacagcccattaagacacaaaatgggccttttaaaaggaatgtcagttgtcaatatctgattcgtacaacgtggagtagctgtggccttgtccggttgtctctctctgcctcttcgctccaggttcaccgtacaataataacaaagaccgacgcttttgtaaaagtgaaacctaaattgataaccaaataatttgatcaatttggtacaacttttgttttgactgatgttcagattttcttttcttcttaattggtatagttttattttctttttaaaatgtttggatttgtaattcatttagcattccattctaataagatttatctttttctttttaattatctctttacatgatactactatactatttgtttaaacaaaaaatatagatatacatgcatattccatatttaattaatgggatcgaaattcaacattaaattaatgtacctgtaaaaaattaaatgtacaaaacgacagaaaaactcaaaaaagcagattttaaacgttatattttccaattttctactgcctcctgaaaaattggatttggacatgtctgaacattactcaaaataaataaatttagctagtttttgaaataagaaaacatagtaagtaccgttttgaaggagaaaaaacaaataaagtactttttacacacgaaaaaaaagaaagtaaaggaaagagcttgtttcacatatatctgcagcgtggactttctctactgcgaacccaaaaagttttttaatctttttatgtttccagatccgttttaagaccagaagtacaaaaaaaaaaaagaaactcgaaatctccattaaaagagcctatcgataataaaaagaaaaacaaaacggcaaaaaagtgaagcgaaacacgacacggattcacacaatactcagatatatacaaaaaggattttagattttgattcagaaccaaaaataaaaaaaggaacttttttatttctttgtttgattttttgggttgttggttttttttttgtttgttaattttggggatcg

SEQ ID NO: 5830 - DNA, 3000 bp, Unknown
  misc_feature (1)..( 3000): cDNA_ID_1809195_gDNA_ID_1620821_Annot_ID_50683 3000 nt of promoter + ATG
atatactatatttataaaaaggagcaatacactttgtcaaatttaatccgatcttttagtatttcaaaattacgattattaaactagacctggtttgcttggaaaaactagatctactcaaatgttatcttacctaacctaattttgtatcgtttgggtgagaaatggtggcctcgcttctaacaagttttcttcttataatcgggactcgggagaatcaacttcaaaggagattaaatttaaacattcgtaaacgtctggaaatcaaaataataccataaaattgggggaaaaaaaaagaacaagatcatttttcggccttcattattttcttacccaaaaatctttttttcttcatgctttcatgatactaaatattttcattaaaaagtttaaattcttacatgaacaaattgtttaggacatgtgtagtgtgactaatttgttgtgctgactagtttttgtttctcggaaatggttgaataggtcttttcggaatttaacgtttgatacataaaattctttacatattgcattattaaaattagctagcttcttattaattctagaaatatcatcagtatattagttgaataatctctctttttcttggaaatggttgaataaatccagaaaatcatggccataaatcctcatttcttttttgtccgaaagtaaaaatccattctataaaatatgagccgtcaataacacagttgaaaaaaaagaaaaaagaaacagaacccattaattgttgagactttttccatccgataacgtcatttttcactaaaagaatatatactatatgtataattagaaatggatgcaatggaaaatgtgcaaatggaattttaagatataaaagcttgttaccatctaatttaatcagaagtaacatgtaataaatctctaatagcaaataagatgaaaacatagaaatcaaagtgcatggaattagtctaaatttttggcagtcctaaacataatttaaaatgagcaactcacctactttaaatagttttcgttggactatatagtttttaaaaataaattgtgttccacaaacacatagagaatcagctaagtctctttcatacaatagctatagcttcaaccagaagattatataaaaaaaatactgaaaactattgaacaaaactaaagaatcaatgattagaatatatctccgtggactaattaatctcctacgaaaaggactttgaactaactaatagcttttattcactttttagctatattttttttaagtagattattttattcttagacggctttagttgatgcaaaaataaacaatcaatctattatgaatgatgacatattaaaaataaataacaaactgtattgtacaacgacataataacataacttctccatcactataacaagatagtattgaacataaatcaccatttgttatccacgaggtaccaaatgttgtctatgcgaaactaaggatcccactactatgatctaggtccattcacagaaaccctccataatttttacgttgataaaaaaagttattgtgtatagtatactgtatataccatgcattacttggctaattttatttttgttgagatgatggttaaattatattcatgatactaatatagaaatacaatggttaaattatgaatacgataacgaatacatgaagcatgtgatcctcgagaacttcagatacgaatctctttttttttatttctttaatgtcaattcagtgtcaatttctatcatcaatttctttctatatggaactattattttttgttaagagttacgtctagctgattgttaacttatagactctaactaaatttattgaacttgaatattaaaaactctaatttagaaggaaaaaattgttttctttttaccttttttttgttttatgttggaagatagggtaaacatgttttgtaaatgaatggatttaacattgatgaggacgaagaagacacaagacaaggtattaaagaggttaagaaaataagaagattgtttcccataaatggcgacacgtgaagtaaataactcgtctgttctgtaattaaaacgctgtttcttctttaccccgcgaacttgatgggtcaatcacatccccaataacactaatttactgtttctctgtaataataataatcattaaaatggacaaaataaaatattagtaattaaaaacagagaaattaaagagagagaatttaacgggggagaagacttttgggaatgatccgaagaaaacgggttactaaagaaaacagtggtgcggttcttaatatttctcttaagaagatctctctctttctgtttctgttttattattgttattgacacgaaaagacagagaaacaaatagaggcagagagcagaagaaagacgaaacagaggattttcatagagaatcctctttcttcctcctttcttcgccttcttctgttcttcttcttctcctggttagttttcttgatttcatggttaacaaatgattagagttttcgttaaaaacaatacttggttgtgttttcaagattttgtttcttatctttcacgtttcataaaaaattcaaatggctgcatttgttgcgtttgatgttatcgatgtttaatttgtttatttaagtattcaaaatttcagacccaagtaagcaacaaatttaagaaaataaacctcattcgattttttttcttatatgaagggtcttgaagatacatgaaacaacatctcattgttatgaatgttgatgcattcttttatgtaaacttaactttttacaggtgacctctctgaaagattgtaaggtaaaaatagtctatcttttttggcatctgatttttgatttctagacaagatcatgtatatcttggtaatggtcttattcttgttttatgtcttgatacaggttccttacaaaaatttgatttcgtttggtgaatgaaatagttagaaattctccaaaacaaaatatg

SEQ ID NO: 5831 - DNA, 3000 bp, Unknown
  misc_feature (1)..( 3000): cDNA_ID_1829379_gDNA_ID_1620821_Annot_ID_50684 3000 nt of promoter + ATG
atataattcagagtcatatcattaataaaattaatattaataaaataaatgactttttggcaagacgaatttggagggacgggtttttgaatcaacattaataaaaaagtaaaatataattaatccaccgttttaatacgggttaaatctttaattaattattttttaagaccactaatattaaacatatcaaatcatcctaatttagaaaagattatataaaaccaaaaatgttatgtggtatgtataatattactatatataaaattaaacaataaaatataaatgtattagagaatgatacaatgtgcaaaacttttatatataaaaaataattcttaaattttaaaaattactactttaaaaaaaaaatcacgggacgggtaaaaaatttacagaacgggttttattttggaattgggttatatggtggatgtatttgaatcaatatttataaaattttaaaatattattaatatgctgtttaagtagggattaaaacttcagttttttaacaattatctcatgaattcgtggtatagtgttatttaataacaattataaactgtaaaataaaaatattttataaaaataaaatttgcaagttttaatatatattacttttaaaaaataaatcgtcccgcagtatatcacatgttaaaatctagtttatatatcattttgatacttttttaaaacagagaccggtgcagtttagtagttacgtggataccaaatatatcatacaagttaatatagaaattaagaatcagatacgacgttccaaacaaatacttaaacgtgtgtagaccttaggaaacattgccaactggcaactttgtattatactaccaaaatctagatatctataaatctagaggtgtgtatgataatgaatattgaatagtatatgtttgatattcaatgttatactattcagatatcaaatacctggatgtatatatgtcaactgaaaacaaatataattctcttagtatgaagactatttacatctaaatcatatgaataactaattaactttttcttcttttttttgttaattttcaaaaactatgtcatttgttatgtattacataatcacttaagatatatataaaaaaaaatgccctaacgaatttcgtccacaacatatgaatcgagctagctatttagatatttctattatgcatatgatgaatcatagattgataaacatattatatattttttgaaaaatggtagttcaatttcttttgacactaattaaacatgaaagagacatgtccttcgggtgtaagaatacctaaacagacaaagcagagagtcataaatatcttatgattataaatggaagagacatataaaaaatgtttattgtgtactaatcccttatatagtttatgttggacaactccatattaatttaggtttacttatatttcggttatgaaactctaaaaagtattgtctcccactatccattaggacaaactggcaaaggcaaccacctcaacaacatcaaagaacaagaattattcaactgttctacaaaactatactagtactattacagttgtttgtagcatatacttttccaaatagaattttatacgattttcttttccatattttttgaaaatgacaagtgatatgatttgagaaaaaacaaaaaaaaaaaacaaatttatacagtgaggcctgcaagaccataaaacaaactaaagccgttcattaaggttccattaattgggcctatatttttctcgttatattatgagcctgttataggcccattagtaataatttatcgggttatgaagtaaattttcagataattaagggtctcaagtataaatatcttaaataacagacccatctacctggaaatatgagtatttgggcagagaggggtgttttcgtaaattcaagtacatactttatttttatttttttgctttcttcgccttttgctccctcctcgagaatttccgatcgtgctttcctcaaaagcatttctgtttctcgtcgtcggagcccgacgacagatctctgaatcgctggagaaacagtaagtaaatctacagatctcgtttcttcgaacttcttcttcgtatactatttgtttgtatcgttccttcgttgtgcattgatgttcttaatgattactagaatctaagtcagaagttacctctatttgttcttcttctatatttgaactagatttcgttctagcgtcgaacaaactcctcgttttctttgattcgcattgctggtgattttcctgaatttcgagatttagcgagacgtgtctcgagttctcttgtgttgacgggatttttcttatctggagaactgataatagtttcatgacactgtcactggtctgttgaattgtagtttaaacttattccatcggatatagtgactcttaactctataagttgctgattttgtagatgggtttagtgttatcaggtttattgatgtaacaacgagtttacaaactttgctatttagggatctgtaggaattcgtttttttgggggctcaaattgttggaaatagttgcttagctattcacaatctaaatgtgatttgggaaatctgcaacatatgttattactatggaagaggttactctatatagttactaaattatcagcatggtttctgaccattatagaattctttgcttgtggtttatttgtttgaatcaaagtggtttcattcagagacagcgttgtagattttgattatctctgtaatgtatgatgtgaaaagttacgccactttctatcttattagctcttgaaatgcatctattatctgttttaaaataagattttttaaatttaatttgtttttttttgccagtaatgattgagtttggcctctatctgtgaagggtatatgctccggctgtatctactttatattctgccaggaagattgtgagcattgaagtgccttgggctctggctgaagatttgagcagattaa

SEQ ID NO: 5832 - DNA, 3000 bp, Unknown
  misc_feature (1)..( 3000): cDNA_ID_1829376_gDNA_ID_1620821_Annot_ID_50685 3000 nt of promoter + ATG
ctgacaaactcgatccccaaagtgttgcttgcttttttagatatactgctgggcttgataagaaccttgttggggattttcttggaaatcatgacgaattttgtgttcaagttctcaatgagtttgctgggactttcgatttccagtacatgaatctggatactgcactccgactcttcttggaaaccttcaggttgcctggagaatcccagaaaatacagagagtgcttgaggcgttctctgaaagatactatatgcaatctcctgagattctggccaacaaggatgctgctcttgtgttatcatactctattatcatgcttaacactgatcagcacaacgttcaagtaaagaaaaagatgacagaagaggatttcattcgcaataataggcatatcaatggaggaaatgatctacctcgagaattcttgtctgaactctttcactccatctgcaacaatgagatcaggactactccagaacaaggtgcaggctttcctgaaatgactcccagccgttggattgatttgatgcataaatcaaagaaaactgctccatatattctggctgattcaagggcttatcttgaccatgatatgtttgctatcatgtctggtccaaccattgctgccatatcagtcgtttttgaccatgcagaacatgaagacgtttaccagacatgcatcgatggattcttggctatagctaaaatttctgcctgtcatcatcttgaagatgtgcttgatgatctggttgtctctctctgcaaattcacaactctgttgaatccatcatctgttgatgaacccgttcttgcatttggtgatgacgcaaaagcaaggatggctactatcacaatttttaccattgcaaacaaatatggagattatatacgtacgggttggaggaacatattggactgtatcttacggctacataaacttggacttctgccagctcgtgtagccagtgatgcagctgatgaatcagaacattcatctgagcaagggcaaggaaagcccctcgcgaattccctatcttcagctcatctacagtcaatgggaactccgaggagatcttccggattgatgggaagatttagtcagcttctttcacttgatacagaagagccaagatcacagcctactgagcaacagcttgcagctcatcaacgaacacttcaaacaattcagaaatgtcacattgacagcatatttaccgaaagcaagtttctacaagctgaatctttgttgcagcttgcgcgtgctctcatttgggctgcaggtaggccacagaaaggaaccagttctccagaggatgaggatactgcggttttctgtctggaattgcttattgcaatcactctaaacaacagagacaggatcgttctcctatggcaaggcgtctatgaacatatagctacaattgctcagtcaacggtgatgccctgcaacttagtggataaagctatttttggtctacttcggatctgccagagactacttccttataaagaaagcctagctgatgagcttttgagatctcttcagcttgtgctgaaactggatgcacgtgttgcagatgcctattgtgagcaaattgcaattgaagtcagccgtcttgtgaaagccaatgctaatcacatcaggtctcaggcgggttggagaacaatcacatccttactctccatcacagcgcggcacccagaagcttctgaatcaggatttgatgccgtatcctttgttatgtctgaaggaactcacctgtatccagccaattatgtactctgtgttgatgctgcaagacagtttgctgaatcccgcgtgggacagtccgaacgctctatccgtgcccttgatctaatgggagattcattagaatttttggctaaatgggctctctcagctaaggaaaacatgggagaagaagatttcgggaagatgtcacaagatattggggaaatgtggttaaggcttgttcaaggactaagaaaagtgtgtttagaccagagggaggatgtccgaaaccacgctttacagtcattacagaagtgtttaggcggagtagacggaatcaacctagctcatagcatgtggtctcaatgctttgacaaagtaatcttcacggttttggatgacttacttgagatagctgctgggtcacagaaagactaccgaaacatggaaggcacattgcttctcgcaatcaaacttctctccaaagtgtttcttcagcaactccaagagctatctcagttatcaaccttctgcaagctatggctcggtgttctaactcgaatggagaaatacatgaaagtgaaagtaagaggcaaaaaaagcgacaagctacaagaatcagtaccagagcttctcaaaaacatattgctggtgatgaagacgaaaggcgtgctattgcaaagaagtgctcttggtggagatagcttatgggagctaacatggcttcatgtgaataacattgcaccgtctatgcgactggagctattccctgatcaagaatcctcacaacttggtgatgatgaaaccgtatcgaatggcttatcttctcctgaaaacacaactggttcgtgaccttacaagtgagatcattaggtgagtttctttcgaatatccatataagtactgtgaaagtgaaagcttcttatgtaacacctctctacgtttttttttgtaatatataagtctttctaattcagagactcgtattaattaagcaagtttcttaattacgactttgttaatcacggacctttggaacgaggtagaaggtcttgaacatgtgtggaacccaccaaaggaaaaatatcagtagattcaggagagttgttaaattttgcctccacgagtttttttcttttcttcttgttgagtcgtttacgtcacgtcgagaattttctcttttcccgagaaaattaagaaaggatcgtttgattttctaagaagggaaagataaacagtgaattagaaagagaaggaagtttca

SEQ ID NO: 5833 - DNA, 3000 bp, Unknown
  misc_feature (1)..( 3000): cDNA_ID_1829372_gDNA_ID_1620821_Annot_ID_50686 3000 nt of promoter + ATG
gtgtggaacccaccaaaggaaaaatatcagtagattcaggagagttgttaaattttgcctccacgagtttttttcttttcttcttgttgagtcgtttacgtcacgtcgagaattttctcttttcccgagaaaattaagaaaggatcgtttgattttctaagaagggaaagataaacagtgaattagaaagagaaggaagtttcaatggaatcgctaacatctatttctccttccataattcttcctccggccaccactactacgatccccgtttcaacttcacgatcagtgttgattcgtcttccttcacgccgttcttcttaccttttcggcttgtccagctccgggagacggatttcgatttctagaagaagacacttcgttagctgtaaatcgaccggcggcggaggaggaggatcagataagcttggtggcgatgaagaagagagcgaggaagttgagaaggcgcttcacttggatggtacgatccctgggacttccgatgagtttgtaaggcaagtttcgtcgcgtgcttacgacatgcgtcggaaacttgagcagacgtttgattccactagctatgacggtataatctctatcgctctcaattcctgcgtttactttgattttggtgatgcaaaattaatactttcgttgatgcaactaacttgatcagagtttcttaaagattgtctaggaagtttgggaactgtagtagtttgaaattcccttagtgccttgtttttgttaacaggagtcaaatcgttttgttgaacaatgtcagaatttagtcactgtgtcacacacaaccggtgaagaagctctccattgatagatgtagtgttagttatgattcaaaagtttgtgttctgcataccatttctttagttccccaggagaagagtgcttcagctgaactatgatgaggaaaattgttcatttctagattccactcttacagtaagattgcaagcacggttttatcatctcatctttcacatagtgctgatgcataggaatatcaaagcaataggaacataagtgttttattcaatttaagcttgtattcatctaaagttaataaattgatgttgttcctttagtgctctgtatctttgactgagtgatttcgttgagaaccatttctctcactgtggcttctcacaatcttagtgttggagtccaacccatggagaggagattcgaagcctgtatatgtattaacacatagagaaaaccagatatgtaccatgaaaacaagaacaaaccacaggttccaactctattccactcaagtttttttttatagttttagttttcttctccctatgacattagcaatccttataaacagtgaagtagaaaaagagcttggactgttgttccctagtaggatcagcaaccagacaaagcaggctagacccaaaactaaattcgatatgctcgtagaagacattcgagatggagtactggtaagtattctcactgaatcactttcaagaccttatgaaacccagacaacgtgatatgcctagtttttatctcaaaggttttcgaagatgtgaatgaggctgttagatactgtgacctattacaagggggagggaaagggtgtgaaggtgtcgctgagattgaggcctcctctgtaagattatgagacaaagatatcatctaattctagaacttgttgcctttaaacatttgaaatgatctgcttttttttttttgaataggtttttgatctttgtcggaaaacaaggtctctggcagtgctcttccgccgtggaagaacaccacctacacctcagacgctggaacgtaatctcggatcccggaagcgttctcttgaggacttgagggataataaatagcttgtgaaacaatgtattaattttacttgcaataattgaaaatactttgtatagactaaacagtaattaaccgtgggtgatactgtgtatatatataaaatgcattttacttgtgctccataacttttttttgttccttataattctcttgaagttgcgctcttttctttgaaggctttaaagctaacactagtaggtaatgtattacttggtcaatcaacatgtgagtatttatagtatctatgattagttgacaaaaaagaccattgtatattgaacttcttaacatgaaaaatagtgacttttttttgtttagataaaaatagatatgctaaaggcatatgctagtgtattattaataaaaatcatgtgatagatgtgattccatgttatccggatcgttgacttgacttagtacccataacgtttattatataattcatatagcattttatgattgtcaaatttatatttatacatatgatagactattatgtcaaaaagacaggtaaagccactttgtttacttattctttcttaactcaaaactccaaagggtaaaatcaaggtgaccattactctttcagtttcaaaagattgtattattgtaacaaggtgaccattactcttaaaatttattcaaaaataaccaaatctaaactaaaacgtaactaaaatttgatattattcatgaaattctaagaacaaatccaacatgatcccttaataatttccctttagtagtctagccttcttagtcggtcactaataataaagagtaaagagaccaaaagagagaagtcttagataacggtgacagagttaaaaaagaactcactaaaatagacggaggaaaaagtcatcaattcaacttgacggctaagttaacggcgattatcttcgttcacacaagcaacacaaaagagaaaacatgaatcatctctctctccctctctccggttccacagtaaagaattgattcctcaatctcacgcggaagcaaaatccaaattctaaaattctaagaaaccactctaatcacatcgctctatcgatcaaaatcgaaacccttattcaaaaatctcttattttttccatttttctctcaatcatctgaatcggttttgag

SEQ ID NO: 5834 - DNA, 3000 bp, Unknown
  misc_feature (1)..( 3000): cDNA_ID_1829369_gDNA_ID_1620821_Annot_ID_50687 3000 nt of promoter + ATG
ttattcttaacaccacctttttagttgtcatgaaattgaatgcattcgacaccacaaataatttacctacgatgaccttccacgacttttgccatgtttccatcatacgtaggaataaaagtgttgctggccacagataccatgaaatctagagcagccatttgagacgaatggttctgaaactgttgcagctctgctgactccaatagcatttccttctttacctataaccacaggtgagtaaaactgataagaaaaagtgcattgtaatgacgatgcagttgagcattctttgtagcaagaaaagggaaaccaggactggtagactcacaattctcgggaatgcttcccttaacacggatagtctatgctcgctcccataaatctcaccagctgcaatgtatatctgtgtatttttctcaaatcccaacgcttttaataccaaggccacctcctctggcgtcaaaggacacagcccttgcgccctcctctcctctgagactatctccttctctctccaccagggatatgtgtacctaaagaacacagaatggacctatgaattaacaactaaaaagacctataaccagagcaccaattcaggagaaatcttttgaagagaaacctcatcttttttagctcttccgcttcttcctcagtgcaaccatgagtgcagccagagaaagctaacatgtccatctcatatctcagatgcaaagccacaaatggccctctttgttgtagaatccgaactaacttagatcccaaagcctcaagctgtggagtgaactttagtccctgaaaattcacccggcacctgagccactggagagagagcggaagaccattgtttgccaggcgggtatcagtcctattgaagtgtacaactttatgcttgctgaagagaggcaatacctgaacaagaaattaaccaatcacatatgcaaatggttaggtaatatcttgtaacaaggatagtcaaaggaaccaaaacagcaaaactagtgataaacaagacaaacctgcttcaagtaatatttttcatcagaccagctcacaggaggcatttcgaacatttgatatccatactttctactaaaccgtttaggaagcctccttaagatccgaacttcatctcttaatgaatcaatgaaatgtctcacatcaaaaatatcctcaaaaccactgcaaacaaaaatgaggatactttagattgctaaaaaatgttaagcatataagacacatgagtgattctataaacaccaaagatagagtacctaggatcagcccagaaagatgttttgtcaagctctggaacaacgagagtgagattcaataaccgagcaacagtcaccatatcacatatctgaaacacaacataaaaatcagaatttggaaaaacatcaaatctgaaagaagaagaaaaagagaattaaagcaaagtcaccaaccgcggatcgcatttgattcaatccaccattacaggatacaagtagaataccattgcttgtataattccctgcacaaaatcaacaatctcgttaaactctctcaagcaccaacgaaccctaatgtcccctaaatagagagaaaactgactcggaggaggtagaggaggtggcaatggaactggctcaacaggggctgagaatctagaaatctgattggttaaaccagtgaagatccgggaatgccaaagctcaccggcggcgaaaagctgaaccaaacacgtccaaaccaaaatgctggagcaaactctaacgaaccatacttgtacacgaggcttcggaactgccggcggaagcggaagcttatcgcttcgcgcctgagtaatattactctccgatctaacttccatctccctcctccgacgatcgtcgtcgccgcttcatgagaataaaattactataacctaaatttctccgatcttgtgagatgtcagaaattgaaattagatgacaaacgcgaaatgaaatgcttcttctctcctttgtgtcaaatggtttgaatctcgaggagtttttttttctttcgaaattcagaagaagaaaaaaaaatcacgagacggaaaaaaaaaaaaaagaggtggtaacggtgagagatgggaaaataagttaattaaccgtcaaagtgtcttcttcttcttctatttattgttttcccaagaaactcattctattgcttacacaatttatttcctaattcagaaagcttcaattttcctaacttgtttcattatatatatcattaaatgtcaaagattattctataaccaaaaaaaaaaaaaaataggtttcaaggataatgattgatcagaaaaacatatgataaataaagatttcaagaatattcaacattgaaaaacatataaagaaagatgacacattttgcctttttgatagtcgttgtcattcgtcaacggattcacctaattgttctcccgtactttttttattactgtcatctatttattgcactaatcacgattcaaaccactgtttatattcatctcctttattcagatattttcaagctgttgtaaaacaaaacaaaaactgaaacgaaatcatgacacgtacctcaatgttgcattattaacatcccttccaaggaaagattactattttattctttactaaaaactcgagtacaattgtcttttcaacaaaatttcccaattaagtttaaaattaacattaccaagtcatatgtagttatgcttgaattataaaatctggatgtgttatttgtttctttatttacttctaacttactttagtgtgatccactacaagtatataggtccaacattattaatgggccttaattttaaagcccaattccagagggtagtactccacgtgttttaacgaatgaaatactaacacgtggcaatgcacgtgttgactttcttttgtttccttccttccgtttaacaagaaaaatagctaaactttgaaatccgtcagatcgatttctctctatatcggagccgtcatg

SEQ ID NO: 5835 - DNA, 3000 bp, Unknown
  misc_feature (1)..( 3000): cDNA_ID_1829365_gDNA_ID_1620821_Annot_ID_50688 3000 nt of promoter + ATG
tgctgggacgcagacatgaaccagagaccgtcgtttctggacattctcaagagacttgaaaagatcaaggaaactctaccatcagatcaccattggggcttattcacttcataatacacaaaatccattatttaagcacaaaaacaaccagaaacaagaaagtatcattctctgtttgccttattaatctctgtttcatttcttttgtaaagattgtttctttttcatcttttcatttgctttaaaagagtgtgagatagaaagcttttattgttgttacatggattggattgagtttgcaggttaatgagaagttcatatcatatcagacaggataaaatgtctgtttccgaaaaattcagtaacaaaatgaaaaatgagttcagtagtgtatataaagctatagtcatagggttttcaatacaatctctgccctcaggagatggtaatggttttcagataagcttctttttctggaagaaagtcttcaagtgccaaaactgaagacctgcgaccgataaacaaactgcaagcgacacgaaactcaaccatgccatcttcgaatttgtcgctatgttcagattgtgcatttcttcttccctgtaatataccaaatgaagaagggttttgagttttgattcactctcatcctctgatcaagtgacttcaagggaagacaggttttgttgtcattacctgtcgcggagatagaacatctcatcgtggattccattcacggtttcaaataacttcttaacctcaaactccatcgtctggccaataaataaaacaagatccaaccataacaaggttaacaaaacattccttcaaaaactctgcaatctctttaagaggctatgttacatttcaagctagtcttgctctgtagtatgttaaagcctagtcctatctaccacatttcaagatagtaattttctgcgtctgttaaagcctagtcctatccaccttcatttagcagggaaagaactcctgaatgagctgaagaaatcgatggggttcaaaggtgaaactaatgaagctattttctcatatgcaagactgcagacacaggtcagtaacacacgagccctgtcagcttaattcatggccttgttctaaccaaaccaatgcaccaacataacctataaaccaagactacatagcatttctcacttcagatataactttccactttccagcactatgtcttggtgtaacttaggcagctatcaaattctcacacatccggcgcaatgctctattgttcatgtcattagaagcatcaaaatctatttcctctaaagagattagtttgactaagttaagacttcaagagtaaagaaaaagcgaaaaacttacttcgacttggctcttctttgccacattcgaccaatccttggtatgaatacccgtcctccaatcaaagtcaatgatcagcgtcgtctctggtttgtgatcgacggcggagaagcaacttatgtaatcccctgtttccacagctacaaacgagaattgtcccgattctactccgtccgattcgtgataagccgtcccttgtggcgatgtgaccttaaaaatcaaacacattgcattatactgaaatcgccggaagaagaaattgaagggaaatgcgatccgatcggatgattattaccctgacggtgactttatgggaagaaggaagaggatgatcctcgtgagggtttataatgctgtattttccgatggtcattgcgtttgcgtgaatctcctctgagatgcatttcgtgtgcccagaaagtagctcgtatcgtatagagagtgtcacgggagataaaattgagaggatcaatagtacgatcgagctccgacgatgattcatgacggctccgatatagagagaaatcgatctgacggatttcaaagtttagctatttttcttgttaaacggaaggaaggaaacaaaagaaagtcaacacgtgcattgccacgtgttagtatttcattcgttaaaacacgtggagtactaccctctggaattgggctttaaaattaaggcccattaataatgttggacctatatacttgtagtggatcacactaaagtaagttagaagtaaataaagaaacaaataacacatccagattttataattcaagcataactacatatgacttggtaatgttaattttaaacttaattgggaaattttgttgaaaagacaattgtactcgagtttttagtaaagaataaaatagtaatctttccttggaagggatgttaataatgcaacattgaggtacgtgtcatgatttcgtttcagtttttgttttgttttacaacagcttgaaaatatctgaataaaggagatgaatataaacagtggtttgaatcgtgattagtgcaataaatagatgacagtaataaaaaaagtacgggagaacaattaggtgaatccgttgacgaatgacaacgactatcaaaaaggcaaaatgtgtcatctttctttatatgtttttcaatgttgaatattcttgaaatctttatttatcatatgtttttctgatcaatcattatccttgaaacctatttttttttttttttggttatagaataatctttgacatttaatgatatatataatgaaacaagttaggaaaattgaagctttctgaattaggaaataaattgtgtaagcaatagaatgagtttcttgggaaaacaataaatagaagaagaagaagacactttgacggttaattaacttattttcccatctctcaccgttaccacctcttttttttttttttccgtctcgtgatttttttttcttcttctgaatttcgaaagaaaaaaaaactcctcgagattcaaaccatttgacacaaaggagagaagaagcatttcatttcgcgtttgtcatctaatttcaatttctgacatctcacaagatcggagaaatttaggttatagtaattttattctcatgaagcggcgacgacgatcgtcggaggagggag

SEQ ID NO: 5836 - DNA, 3000 bp, Unknown
  misc_feature (1)..( 3000): cDNA_ID_1829358_gDNA_ID_1620821_Annot_ID_50690 3000 nt of promoter + ATG
gataacaataatatcacatcagttttttctaagttgttgatgagacaaaaatctagttattctagttaccaatgttaaaggcccattattctaaaaggccaaggcctacattttatttttgttctgatgtaattaaattgttaattgtctgtatttattttcatttttaaaaaattatctttttaacttatggtagcttcaacttctttttcttttttttttttgtcatctcaacctttgtaagaagaaaaatggtcaactatagcttcaacctcaaatctactgacttgacacttgagttttaaataggtaacatctcatggagatcccaatattcattctaaattcctccaagataatgcaacatgttacaacaacaacaacaacaacaacaacaacaacaacaacaacaacaacaacaacaaaagagattggccgagacatatatgtagtatgtacccaccatatcacacataccttcataatcatcatcatcatcataatatcaagtggtctaattcaaatgtttttgatttaattatgtgtttaagtagttcatatttaattgtgtgctaaaatacttattgtaattgaagaatcaaatatacaagtcttattcactattcttaatcaaatagaaattagtcttaaatttgtaatttagggggtacaatgatccactattctccatcaacgtagaagacaagtaatttactttgtaatataggtaatggtacgtacgtagtaatcacatgtaaaagcggaactttcctttctcttgttttgccggcttgaccacgggatatgagaccagtaaggtacatgtgtaatgtgatacctatcagaaaccctattacactcttatcaaaaaacaaaacaaaacctattacactctctcggcttaattaagattatgatcaattccaaatatgtttctgatataactttaattattaacgagaaaaccaaagtttattgctacttttttccgtcgaaatggccgctattttaagttttagacaataacttggtccatgaaattaaggtacaacgtcgatattgattaagatcagtttacttttgctaatataacgtgttaagtttgagatgggagacacgtgaatgacttttcattactttcaaaaattgttcaaaattccaaaattggcaacaagactgttttagttgttaatatgcaattagactgtttcaatagagtgtatttttctttgtcaaaatgtaataagtactaatttgtcatacaaaatatcaaatgtcaagaacataaactcttctaacggaaccgcttgtcgcgccgaaactcgtgtggtaaacctgaaaaacaactcactaatcgcaattttaaatcagagactgagaaaacacttctcacgaaaaccacaaaacgcggtcaatatcgggatgacgacatgatgtggtggtcggattgacacaattcaggttggtcaacaaaattcatccctctaaaatatattttcttagttcgttgccaaacagatatcttacctttactcttttttttttttttttaaaaactcatataaataggatagttattaaatttaactacaaatggtattgtatatgtatattctatggctaggtgaaaaggcttcctttagttcgagaaggtcaaaatggatggctaattaacttttatatacaaacagtatatgcctaacatttaataaggagagactcagattccttgtcaactactcactattgtctccatgactctttaaaaaatatatttttatagaatcttagtattcagaaattaaaccgtagcctttataggataacaaatgtagatgatgttaaatatgaaaattggctccacaactgtccatgaggcataaataactcgaaaacttaattagtttgatcttacagataactaattttttgtcacatttattataccccaaagtatcttaataatgcttgtcggttcaagttcatattttttcctcggttcaaaatccaggctatttatccgttcttttttaattaccttcatgataacttgtcaattttgtatttcttattcatgatttttctcatgcacatacctaatttacgtcgattaagatccatgcaacgttcataaaataatgagatagtatattagtattagtatcacatacataacgatataatattttacaatgtatttgcatgtaaagcattttcaacaactactacttaatccactttggttctgtgcaccatatcgaccttgagccgcccatataccgcgactagggtcgtccactacgaatataaaaatttatcgttataaatataaataattgatatatttcaatgattgatggattaattaatataaataaaacatgtcaatgtaagactaaatgactaatcagcgggactaatcaactcctctttttttttaaataattcaactggtagatcaacgcgggtttttaatctcttgtaagaactagtacgaatgtacgataataattccagtttctcacccgaaaaactgaagcataatgtttgctcacacactgacacacactgtggttaaataaaatatcgaaagttaaatttacaaattgttttatcgtaatacttgaaaaaccaaagattatattatgtaattataacaaaaagagatataataaattactggatttcaaatctctatatttttgtctccactttatcaaaaaaaaaaaacatcagtctccactctccacgcgccttttagtcgccctctctgaatacactacagtacaacgttgaaaagaattcaataaagaagatcaaaaagcaataaagttaatccttactttaattagaaacaattttctaatcataaacctttatcatatcgtcaaaacatatcatgaacgacttgtctctctctgttctctatatatatatgactcctcttcttcaaagttcagacacaaacataaactagcgtttaataaaaaacaagaaaaa

SEQ ID NO: 5837 - DNA, 3000 bp, Unknown
  misc_feature (1)..( 3000): cDNA_ID_1829354_gDNA_ID_1620821_Annot_ID_50692 3000 nt of promoter + ATG
cacatgaagaaatagctaactaaagaaaccacaaacaaacacaaaaatcctcttatagatcaaataacctatcgaatcatatacagaaggaaagagtattaattcagatggaaacactcccaagccccaactgatattccttgtaaacaaagaaaccatcaaaaaaccctagaccctcttaattaatcattctttcgagagaaaggcttgaagctccttctctatgtgttcttgagcagtttttttggccgcaagaaacggacgatagtgatcagtgagcatccataccatacatttggtcatcatcgcaaagactccaacgttggtagcttcatcagtgcaatcttcccagtcagtaaatggttccttgcaaccacctcctctcatgaacgctgaaaacacctctcctttctcttcttcttcccttacttcatttggggatacggattcccctggatctcgccaaacagttgacggcaagaaatccttcatcatcagttttcttcgcatcgagaaagggaagatagtaatcagaatgtctctccatacacttctccaacatcgtataacacaaagatataggttccttattcttcttctcagcttcctccacacaacctttaaaggccgtataatgtttccttggatgcaccttctttcataaacacttgtaatcgattttgccaaagacttcacgaatctcctactttctctggctagacttgttttttttttgagatttggtatcggaattctccggtttcagatccgtggatgacaattaatcagtgattatcatttcattaggtcagagaattacaatatatgtagggatatgataatttacaattaagtatttgataattgcaattttttaaaatattcgataattacagtttctttacgcatgtagggatgtagtcatgtagggatgcatcatgtctatataacataagacatattgggatgcatcagaatcatataacataaatagtttggaaccaaataaacgttgaacgaggcttttctcacaccatatatcttttcaaaacatactaacaagtcaaaaattgatatccatgtaacttgaaaatcatgcacagacaatgctacctttgaatggtcattaaaaaaagaagctaaacacacttcagatccaaccatatatgtgatcaaagccagtgataaaagtcgagtcattcttggcagctaacgactaaggtaagcaaagaatcatatggtcatgtatggaggctgataacagagatgaagttctgtaatgtttcacatctccctacaaattagaaacacgacatacatacataccaggcaaaactgggatctgtaaaaaaaactatcttcgaggagatatcaaccaaacagaacgtcatcgatcatgaatgaaagtgttaaaaacaaatgctagtgtatcttaagcacaaagtgagtcaacatagaagtaaacttgatctttagacaaactagaaaatgctggaaccagaagctatcactacaaaaggtctgaccttttctgtttcagaagcaacaaatcacattccaatgagaaatagcttagcaaaccacaaagaagacaagatttcttcactgaaccattaatgggtctcaacaaaagtcatgacctttaaagagcaaattctctctcgaatcatataaaaaggagtatgaattcagatgacctcaatcaatcaacttattaattagagaagaaacatgatcatcaatgggatcttataagttatgattctaacaacgaactttcctctgttcctagagaacaatttttatccccaaattccaatcttttgatattcccataaacaagaaaccataacaaaattacccttgagcttgcttcttcgcagctacctcctcttccgagatcttctcttcttcttccttcttcttctcagcttcaagctccttcttaacctctgcttcagcagctttctccgcagcgagaatgggctgatagtaatcggaatgttcatccatacacttcttcaacatcgaagtgacttccatacaattagtaacaatatcttccttgttcttctcagctgcttcaacacactcttcccaagcaacaaacgaatctttgcaaccacctcctttcataaacaagcaaaacccacactctccttcctcttcaccatctgcgtctcctcctcctccttcttctggtttttcatccgattcggaatcttctgggtctctccaaacagttgatgaatctccgagttcctcagatggagctggagtcgacggagacgcatctccgagtttctcagatttagctggaggagcttcttcgttgttttgagatttggggtcggaaaaagtctctgtttttggatctgtggatgatgtaattcccatttttctctcaggagagagtgagatcggatcttatggaaattggaggattcaggaggagaaaaagatgtctctttttaagggttttaaggttctctctcggtgccgccgccgattctctttacaagccagagagaaatgatcaatcgaaacgtctttatgttaaaacccctcaaaaacctttctattgaaccggatattctaaaccggaccaaaccgaacttaaacctttgttaaaccgtaagaatttaaccaaagtgaatatgataaaacaacaacaaaagaatgatctgtccacaagacgattcaagaataatgtattgttaagatttcaacatcaatgtttgttgctaattaaacacaagtctcctatttgctacaaatcgaatatagacaccaacatcattcgttttatagtaataaaaggaagataaatatagggagtaatcattagattaatattacagtcgctttcagatttcgtcaaatttcacaggcagacaagtttctttgacttggtcactataagagttgtaaactctttgataaataattgaatacagcaattatttcaaatctccggtgaagtttttctgggctctaagt

SEQ ID NO: 5838 - DNA, 3000 bp, Unknown
  misc_feature (1)..( 3000): cDNA_ID_1829350_gDNA_ID_1620821_Annot_ID_50693 3000 nt of promoter + ATG
agggattcaagtacgggttttcagcagacaaactaaatatttccagcacgtgatggaccaaatcgtagcatgtacacaaagagagaaactgttacctgaatttgctgcacaagaagaagcacaagtaactaatacatcaaatccctccaaacttaaagctgttctggttacatctctgaatccagaatactcaaataacctaaagaagatgtattgggaacacccaactacaacaggagacatagtagaagtttatcagccaagtagagaaaggtttcagcaaacagacaaaaagcttcacgaccaaaaggccctggcagagatgtacctcttaagcctaactgataagcttgtcacaagcgctttgtcaacatttggatatgtagctcaaggtcttggagggttaaagccatggatactctacacaccaaagaagttcaaatcccctaatccaccatgtggccgtgtcatctccatggagccttgtttccttacacctccagtacatggatgtgaagccaaaaagggaattaacactgcaaaaatcgttccttttgtaagacattgtgaagatcttagacactatgggcttaagctagttgatgataccaaaaatgagttatagattttacaaatcgaaacagagcatctttctgattgtatgtaaaggcaaatgtatacagcagatgtattaaaaatcaaaacttggctactgcaatttggttacttactcgatccagaagttatggtccaaaggcaatgctcgaatacatggttactgcaattttaacagaacaggaccttctctgtcggatttgtgaggtcatgtcgatgttcttcaaaattcaagcactctcctaacttgtaatcgctcttcgttcacttcttctcaaaatagttaggttatctggagaaactggggtctattgaattattatatgtcagctaacctaaactatttggagaagaggagatcgaggcgtttacagattttgtgtttagtaaagacactagcgagactctggtgaaatagacaaaacaaaacaaaaataatcctaattttataggtttttggttaatatcatgtgtaatttattattatttttaaaatgtttaaaagtaaaaaaaagagttataaagctgagtttttaacaagtgtcaaaaaaatgaaatttgaattttaagttttagattttcaatattgcatataataaaattctggaaataatcatattattattttccgtataaaatagtcaatgttaccttacctattaaaatgttaatacatatcacaaaattaaatgctaaagattgttttccaagttaaatttgaaccattaagctgtctttggaaaaccaaataatatttacttatgacaattgacctaaactatatacattaaacagatatggaaataatcataaaggcataaatcttttcaccttttttttcttcttctagaaaacagtcaatattattaaatacgggcataataacttcttactatgaacgtttagcaattagcattaagctctctttgttgaaaaaaaaaaaaaaaaaaaattctctgttcttcttttgtaattttctttttatcaccttcttgttcttctttgtttctattttttattggcttttttcgtcttcgttcaatctgaatcattttttcatgactattttttaagttgcgttttcaattataaaaaaatttgtttatagattgattgacaatatggacaccaaaaaaccatccgatccatatgttcgagaacaaacatgttctcaaagatcaattcaaccaccaacaaatcaaggcaaggtacgttatgaatttatatatgaaactttataatttgttttctgttcatatttaagtacacattcaatatatacatattcaaaagatgaataaaacttcatttgataaaaattataatcttagttcaaaggtctatattgataattccattagaattcttaacatagttttcatagaacattcattcatacctctaaaaatccctgtggattggtttaatctgttttaatcgttgatttcggttggtttagtgaaaagttcagcataggcttttatctcttgattttgggcttagttgttaaaggcccatgagttcagattttctatttcaaaccgttcgaaacagagtagacctaaacagagtaacgaacgactctagtgaaggtagcttgttttgctagcaacgaaagctatttttattggtcattgcaatacgttttcataatactaataaagcaattagtggtctagtagcatttttttattggatggtagatgcaaaaagttttctataagaaacccgactagattagccaaattacatgcaacatctttaaaaatgatttcgagaagctgcctaaaaaaagaaaaaaggatttgaaacataacccattttaaaaccaaaacataaaagttgaattggcctatcaataagttgtcaaaatggtaagttttggataggctcatcactcataaatcaattttgtttactctctttattcttagtcaacaacgcgaatttccggatctgattagtattatttccataaaataaatgaatgtatgatttgtcaatttgaaaataatacatgacatgtgatgtattgtttggattccaagttctcaccattttgaggattattgctttactacaaaacaagtccctagtcacattggtcatttcttcgttagtttaaaattatatataactcaacttgatgattcacataaatcgaagatcaagacttttctagtttaaaaaaaagtggagtcacgttacgtagttcgttgattgtcacaacttaacaatgacccattagaatattcaaaagacttagtattatatacaaatgcatgtttcgtcacctttaattaagaataaagagttgtaatcacgctagatatataactcttttgaatcaatctcctagttatagctgatcatactaaagtcaac

SEQ ID NO: 5839 - DNA, 3000 bp, Unknown
  misc_feature (1)..( 3000): cDNA_ID_3078623_gDNA_ID_1620821_Annot_ID_50695 3000 nt of promoter + ATG
ttttagatcgaagtctcttggcctttaatatagcatactgtactgtagacagggaagctgtagttggctcaatgccctttccccacatctcttggataagtgtgaccgccttatgtacgaatccattcctacaacaactagctattagtgctgtgtaaggcacaacatcaggctccaatccactttcaatcatttcagcaaaaattctttctgcctcttgaagatcctgaatcttgcactgctgagcaattaaaaacgtgtagtagacaacgtctggtttaacatcaaaggccttcatttccctcttcgtatcaaactttggaatattgagcaaaactgtgcatgttaccacatcaggtttgattcccattgtcttcatccttataaaaagagcataggcttccttcagctcgtttaaccggcagtatgtgttaatgactgtaaaagtgtacaaatcagggatcattcctctagcaactaaaacattaaattctgccgggcttctctcacattattaactcgacaccaagcaccaattagctttccatacatgctcttctcaggttcgactccaagttcccacattctttccagtaactcttgagctttgctgatataatcattctcggcgcaaagactagtgaatagtgtgaaatacacactcttgggtagaggacattccagactaatgaatcgttcaaaggcctgatcaagacagccagcttcacaatagcctttcaccatacttgcatcattttcccgagatttatgttccaatctctcataaaaagcttcagcctcgtctagtttatctgcaacaatcaggccttcaatgaccatgttgtgtgtaacagaagtgggttctacaccccgatcttccattagtttcagcgaatgcctcttgtacaagaccattcctagccaatccaccagcaaatacgttatatataacaatatcaggtgttttacctgtcccgtccatttcaatcatcaaattaaaggcatcaaaacattaaccttgaagacagcaaccacctatcaatgtcgtgtagttgatgacatcaggagctattcctttacccgtcatttctcggaacaagcttcctctactttgccaagctttcccaaagcaccaaatgcaacattgtagcaaaccttatcaagagaaatgttcatctctctaaactctttaaacagatcaaaagcttccgagaaatttcccatctgacaaatgcattgaaggattgagcttacaatcacacaatgtattctttttcttttcttcaccattttgttaaaaaaatccaaagcttagatatattcagattcttgcgatatccctcaattatggacgagttaaaatagacatccggatcaatcccaagttcctccatgtcaagaacagcttttttagcctcttctattctcatctcattacataaaccacgaaccactctgcgatatgcaattccaagatcactcttatccaccagaatatttgcgtccctcaatggttggagtacaagattagctatacctgccatctgatttaaacagagtccttcaatgaaattcatataaaacacactacatttcctaggctctgaatttaacagtctactaagaagcttctctactccttttgtatcctcattcctacacaatgcttgaaccacaagcacataagtatttgcatccgcatccagccccagccgctctatttgcatgaaagtagccacagccatattgttttctccagaagcaatcatacggttcatcaaaaaactcaatgcttgtatatctggaacacaccctaggggactagtctggaaaaatatatcgatagcttggtcaaacatatcaagattagcataggctttaaccaaggcactggagagcctgctcaacaacagcaatgacccttttccctcctcttctgcttctccaacggcctttaacagatccatgacactgaatccgcgtcctttatctccttttctaacgagttccactagaaaattattcaatttctgatccaaaccacaaccaaaaacgattctgataacagttgcataagcttggacactaggcaaaaaagtcacatttctttccattcgtttcagaaacgataaagcaagataaggatcatctttcaaactagctaaaactcgaagaagctcaatttctttaaattccaaatgctttacaatcaaagttaccttctttcacttgctccgagtatgagattatcgggttcgcccgggaaagtgcaggaaccacgtacaatcgcgacgagggtgctcttcgaatcaatcctctcacatgcgagagtaatgaaatcgggataacccgcatgagatattttccgatcttgtggctgccgggaaaaaaaccctagcagaggctaattccgacgacgattagcatcagagattttctcacttatcggagggtttttacaccgacaccgaaccgactccaaccaaatataaaaataaatttgaaccaaaaccggttaacgcggtcgtactctaattgtgtgtaccaacttttttagcttaaaagcgcattagtgtctttaataatatttaaaacattaatcaaatgtgttggttctttaaattggagatacttcttaaaaatgtctctatcaaacatttatgacgtggtgtctttattttgtagacattcaaaaattaaaataataatttcttttttatatattatattttaagtttggaaagacattctctttatatgtgcagtgaaatactcttttgtttcctttgaattcgccataaattaaaaaagaactattataaaatggtttaaaatttgataatgatagttggtacttggtaacaacaagtttgggtttggtaaaaaaaccaaaaaaaaaagtttgggattggtcaaaataaattcaacattgcttcttaatgagataagaagatgaaggtcgtgataacagtcgtcacttgtttatttcttttgtcagtg

SEQ ID NO: 5840 - DNA, 3000 bp, Unknown
  misc_feature (1)..( 3000): cDNA_ID_1829338_gDNA_ID_1620821_Annot_ID_50696 3000 nt of promoter + ATG
gcgacgagggtgctcttcgaatcaatcctctcacatgcgagagtaatgaaatcgggataacccgcatgagatattttccgatcttgtggctgccgggaaaaaaaccctagcagaggctaattccgacgacgattagcatcagagattttctcacttatcggagggtttttacaccgacaccgaaccgactccaaccaaatataaaaataaatttgaaccaaaaccggttaacgcggtcgtactctaattgtgtgtaccaacttttttagcttaaaagcgcattagtgtctttaataatatttaaaacattaatcaaatgtgttggttctttaaattggagatacttcttaaaaatgtctctatcaaacatttatgacgtggtgtctttattttgtagacattcaaaaattaaaataataatttcttttttatatattatattttaagtttggaaagacattctctttatatgtgcagtgaaatactcttttgtttcctttgaattcgccataaattaaaaaagaactattataaaatggtttaaaatttgataatgatagttggtacttggtaacaacaagtttgggtttggtaaaaaaaccaaaaaaaaaagtttgggattggtcaaaataaattcaacattgcttcttaatgagataagaagatgaaggtcgtgataacagtcgtcacttgtttatttcttttgtcagtgatgcaactctcattcttcaatattttcaattaccagcttctggatgctacaaccaacggtaaaatctttaatctttaggtcttgctgttgttactcaagttttctcctttgactcaatatttcatttttcttaggttcaaaggattccaggaaatcaaaggataaactgttaggagggcttttaacagctgattttgatgaagattcttgcttgagtaggtatgagtcttccttgtatcgcaagccttcaccatacaaaccatccagatatctcgtctctaagcttagaagctatgagatgcttcacaagcgttgcggtccaggcacagaagcttacaagaaagcaacggagattcttggtcatgatgatgagaatcattcaaccaaatctgttggtgaatgcagatacattgtgtggattgctgtttatgggctaggaaacagaatacttactcttgcttctctgtttctctatgctctcttgactgacagaatcatgcttgttgaccaacgtacggacataagtgacctcttctgtgagccttttccaggtacttcctggctactccctctggattttccactaacagatcaattagatagcttcaacaaggaatctccgcgctgttacggaacaatgttgaagaatcatgccattaactcaactacaacagaaagcatcatcccctcgtacctctgtctttatcttattcacgattacgacgattatgataagatgttcttctgtgaaagtgaccaaattctcatcaggcaagtcccttggttggtcttcaactcgaatctttactttatcccatctctatggttgatcccttcttttcagtcagaattaagcaagctattcccacagaaagaaaccgtctttcaccatttggctcgctatctttttcacccgactaaccaagtttggggcatgatcacaagatcctataatggttatttatcaagagctgatgagagacttgggattcaagtacgagtttttagcaagccggctggatatttccaacatgtcatggaccagatcttagcctgtacacaaagagagaaactattacctgaagtgtttgtcttagaaacacaagtcactaacacatcaagaagctcgaaacttaaagctgttcttgtcacttctctttacccagagtactcggagattctaaggcaaatgtattggaaaggcccgagttcaacaggagagataatacaaatttaccaaccaagtcaagaaatatatcagcaaacagacaataagcttcatgaccaaaaggcactcgctgagatatatctcttaagtttaacggattacattgtcacgagcgactcgtctacgttcggatacgttgctcaaggtcttggaggattaaagccatggatactctacaagccaaagaaccacacagctcctgagccaccatgtgttcgtgccgtgtcaatggagccatgtttccttagagctccactctatggttgtcaagctaagaaagtgaacatcaccccttttgttatgtattgtgaggatcggatcacgggtcttaagctagttgattcaaattagaaatcaaatttttttattactttgtgttgtttgatctgaaatccactagcttttatttttgtgtgtgtacttggatcactaaattcaaagttttatttattaatttaatgatttctatatagtagtttaaatttaaataattataacatgcctttcttcaagatttttttccttcactttggcgaagaatgataactccaactactacaaagaaaaaaccttactacaaattaagtgatattgaaatcactaaaaacacttctcaaacaatatatgggagtcatttcatatggtttatagaaattatatttagttataaattttagtgaatacaaatttacatattatattccacaaaagtaaatataatttttagtaattaaaagtgtattaaattttggaaacatattattgaatcataaatagtgatatatatacagtattctcttccataaaatcattttagtattactaaaagttgtttcaaaataaaaaaaattaacatagtaattattaaacattggcatgcaaataaactgattattaaattagatctcttaacatgtctttttagtactacaagttagtacctaagatttcaaatgattcatgcaaacctataagatatctttcacctcgtgatgaccataacatgaaaccataaatctatgcaacaaagtagaaaacaggaagaaaacatatctccaat

SEQ ID NO: 5841 - DNA, 3000 bp, Unknown
  misc_feature (1)..( 3000): cDNA_ID_1841814_gDNA_ID_1620821_Annot_ID_50698 3000 nt of promoter + ATG
tattagtgaagtcaaggttctccggcgggtgaagatgtcttgttggggttctccggtgcaacatacgacggagaacggttggtttacacggcgatgataaattttccggaggagatacggtggcggagtgttggtggtggtgaaggagctcatttgatttttgtttttgtttttcttaaggatatgaaatgggaggagctcaaaactataatgtctactcggtctttcatgttttgccacgtcggctgttatctctaaagttttgtattttagaatttgtgaacatgggcccataagactttaaagcccaatattatggaaacgacgtcgtcaaatacactctgatgaccgaaacgatgtcgttgactacgaaatagaatcaagttgtgttctctgtgatggacattgtgttagtggtaatcaaatccggtgaaaatggagcggagccgagtgaccagagaagcaccgaccggaaccaggatcctgcttgcttcactctctgcgatggttgcagagtcagttacgtttccgattgatctcacaaagactagaatgcagctccatggttcgggatccgcttctggtgcgcatcggattggcgctttcggagtcgtatcggagattgcgagaaaggaaggagtgattggtctctacaaaggtctatctccggcgattatcagacacctgttctacacgcctatcagaatcattggatacgagaatttgaaaggactcatcgtcagatctgaaactaacaatagcgagtctcttcctctcgccacaaaggctctcgtcggaggattttctggtgttatagctcaggtaacggtgtttcttcaccggtaaatctttagagtcatgttttgactgtaaattggatctggattaacagttgcttagagtagaattaacatttcgaattgaacaatcgatctctatgtatagtttcctttgaatatgtttcgtagaagaaggtattaattagaaggagattttgtttcaagttttataggctttcaatgttcgtttcattccaaagttagctgctactttaggttggttcagagataagaaccaatgcagatcctagtcatagacgtctcaatgtatttcacagatccttaatccaaaatttgtgcttgcttgttgtctcctatgtgttacaattaagttctctcagatcactgattacctatggaaactcgtagatttccggcgaagttaattattaaggattttcaattgtttttacgctactgaagtgagaaatgtagctatcttttaggttgttgatatctttagaattgacatttgagtgttgtttatacctacaccacactaaaatgcttcttattgtgtccatactagaaatgcaggtagtggctagtccagctgatttggtcaaagtgagaatgcaagcagatggtagattggtgagccaaggcctgaaaccgaggtactcgggaccaatcgaggcttttaccaaaatcctacaatcagaaggagtaaaagggttatggaaaggtgttcttccaaacatccagagagcatttctagtgaatatgggagaactagcttgctatgatcacgccaaacactttgtcatcgataagaagattgctgaggataacatttttgcgcacactcttgcttctataatgtcgggtcttgcttcgacaagtttgagttgtccagctgatgtggtgaagacgaggatgatgaaccagggtgaaaatgctgtgtacagaaattcttacgactgtttggtgaagacggttaagtttgaaggaataagagctttgtggaaaggtttcttcccgacatgggcaaggcttggaccgtggcagttcgtgttttgggtctcctatgagaagtttagactgctggcaggaatctcttccttctagacctgagaaactggaaaagcaaatttgagatttgtgttctttagttcttacttgttagttgttacacattttgtaagaaccttgagaagtagcatcagtttctgattaacgcgagaagagttatataaatttgggcccaaaagtgtaggcccatagatttatcattttttttttgttgattaaattagattggacatcctaagcaaaaaaatattttaaaaagtaagagattaataaaatattccatagaaatgtaatatgtgaatttcaaaattgcaattaaaaaaagtcgtgatgtttggcacatacaaaatattatatgataatggaataatattagatttatcatttatgtatatcgtatgtatatttaagttagaaaattttgtgtgtcatttgtccatgtattaaatcgaaatttggcgcgtggaaatcgttgcccaaacatattgacgtcatttttcttcttcttctcctctataataaagtagacttctgtgaacgcgaaaaaaaaaaaaaaaactgtatccaattttctgatttcgtttttccttctttccttcaataagtaactctacactgaatcaactcctctgatttctcgataaaaatctagaggcaagattccccacggaattaaggtactctttatttctgaaaactctttgatgtttacccagaataagcaaacgtgacaaatcatcttttgtttatttagcttaactattactggggtttcttcaatttaaacgtaattgaagtttatccagaagaagtactgatgaattatcttgttaattcagcctaattagttaccgggttttcttcgatttagactgttttagctggttgaatcgtcactttatagatcattagccaatttaagctattaaagttttaaactttttcttctgattcgttgaacgtcattgtccaattcagaccactttactgatttgatcagagagaattgtctttcttcaaagtaattttctacactgatctcattgattacgtcactctctctattgatgtttctttctctataatattggccttaggtttctttgttaacctctccattgaagatatg

SEQ ID NO: 5842 - DNA, 3000 bp, Unknown
  misc_feature (1)..( 3000): cDNA_ID_1010536_gDNA_ID_1620821_Annot_ID_50700 3000 nt of promoter + ATG
cttcatctcagccatcaaagacaatgaaactccatggtttatcaccctgaaacatccccatctctcactggcttcacggattttctgattcagaatcttatcagaaacctcttccaagtctatagtcggaatgatgactccgtttagttcccccatatcttcaatggagaggttaacaaagaaacctaaggccaatattatagagaaagaaacatcaatagagagagtgacgtaatcaatgagatcagtgtagaaaattactttgaagaaagacaattctctctgatcaaatcagtaaagtggtctgaattggacaatgacgttcaacgaatcagaagaaaaagtttaaaactttaatagcttaaattggctaatgatctataaagtgacgattcaaccagctaaaacagtctaaatcgaagaaaacccggtaactaattaggctgaattaacaagataattcatcagtacttcttctggataaacttcaattacgtttaaattgaagaaaccccagtaatagttaagctaaataaacaaaagatgatttgtcacgtttgcttattctgggtaaacatcaaagagttttcagaaataaagagtaccttaattccgtggggaatcttgcctctagatttttatcgagaaatcagaggagttgattcagtgtagagttacttattgaaggaaagaaggaaaaacgaaatcagaaaattggatacagttttttttttttttttcgcgttcacagaagtctactttattatagaggagaagaagaagaaaaatgacgtcaatatgtttgggcaacgatttccacgcgccaaatttcgatttaatacatggacaaatgacacacaaaattttctaacttaaatatacatacgatatacataaatgataaatctaatattattccattatcatataatattttgtatgtgccaaacatcacgactttttttaattgcaattttgaaattcacatattacatttctatggaatattttattaatctcttactttttaaaatatttttttgcttaggatgtccaatctaatttaatcaacaaaaaaaaaatgataaatctatgggcctacacttttgggcccaaatttatataactcttctcgcgttaatcagaaactgatgctacttctcaaggttcttacaaaatgtgtaacaactaacaagtaagaactaaagaacacaaatctcaaatttgcttttccagtttctcaggtctagaaggaagagattcctgccagcagtctaaacttctcataggagacccaaaacacgaactgccacggtccaagccttgcccatgtcgggaagaaacctttccacaaagctcttattccttcaaacttaaccgtcttcaccaaacagtcgtaagaatttctgtacacagcattttcaccctggttcatcatcctcgtcttcaccacatcagctggacaactcaaacttgtcgaagcaagacccgacattatagaagcaagagtgtgcgcaaaaatgttatcctcagcaatcttcttatcgatgacaaagtgtttggcgtgatcatagcaagctagttctcccatattcactagaaatgctctctggatgtttggaagaacacctttccataacccttttactccttctgattgtaggattttggtaaaagcctcgattggtcccgagtacctcggtttcaggccttggctcaccaatctaccatctgcttgcattctcactttgaccaaatcagctggactagccactacctgcatttctagtatggacacaataagaagcattttagtgtggtgtaggtataaacaacactcaaatgtcaattctaaagatatcaacaacctaaaagatagctacatttctcacttcagtagcgtaaaaacaattgaaaatccttaataattaacttcgccggaaatctacgagtttccataggtaatcagtgatctgagagaacttaattgtaacacataggagacaacaagcaagcacaaattttggattaaggatctgtgaaatacattgagacgtctatgactaggatctgcattggttcttatctctgaaccaacctaaagtagcagctaactttggaatgaaacgaacattgaaagcctataaaacttgaaacaaaatctccttctaattaataccttcttctacgaaacatattcaaaggaaactatacatagagatcgattgttcaattcgaaatgttaattctactctaagcaactgttaatccagatccaatttacagtcaaaacatgactctaaagatttaccggtgaagaaacaccgttacctgagctataacaccagaaaatcctccgacgagagcctttgtggcgagaggaagagactcgctattgttagtttcagatctgacgatgagtcctttcaaattctcgtatccaatgattctgataggcgtgtagaacaggtgtctgataatcgccggagatagacctttgtagagaccaatcactccttcctttctcgcaatctccgatacgactccgaaagcgccaatccgatgcgcaccagaagcggatcccgaaccatggagctgcattctagtctttgtgagatcaatcggaaacgtaactgactctgcaaccatcgcagagagtgaagcaagcaggatcctggttccggtcggtgcttctctggtcactcggctccgctccattttcaccggatttgattaccactaacacaatgtccatcacagagaacacaacttgattctatttcgtagtcaacgacatcgtttcggtcatcagagtgtatttgacgacgtcgtttccataatattgggctttaaagtcttatgggcccatgttcacaaattctaaaatacaaaactttagagataacagccgacgtggcaaaacatgaaagaccgagtagacattatagttttgagctcctcccatttcatatccttaagaaaaacaaaaacaaaaatcaa

SEQ ID NO: 5843 - DNA, 3000 bp, Unknown
  misc_feature (1)..( 3000): cDNA_ID_3078589_gDNA_ID_1620821_Annot_ID_169496 3000 nt of promoter + ATG
caagataagagacacataaatacataattaagacttttagcaaaaatacataattaagatctaccataacaacgaaactgaaaacacgtaaagatataaattagaacttagaaaactggatttgagatggacagcttcctctaggcaaaactggacattcgataaactcagttcctgacgtatcaacacaaatatagatctgatgaagctgggcattacgctccggatctttgttacattctattcctggcgtaaatccaattccatcttttatcgcgttggtgatcttatccagattgtagaatccatcatccggattaattcctacatttacgaaaagaaaatggtcactggtgagtttaaaatgtacacatgaatagtacatttatatagtgatttattagtgtatataccggagtttttgaggatttggaggagatttgctttttgtttgagtttaagagcattttcaaagtactcatgttggtccattacggattcggagcatgtaccgtgtttctcccattcgtgttcccaaaagttgaacccttcgttgcttggacatgatagtgttggccaattctttttcaaactacttacgagatccgatatctatacattcatatacatgatagctaataatcgttgtttaagaattagaagaaaaaattacactatcaattatatatacctgagatctatcaaattggctatcgggatcacaatttgatggccatgaaccaccgttataattaggccatagaccgtggataccaaaatctgcagcgggtttaccggatgttggatagcaacaagcacgcgatgtatcgcaataggctccaggccactgcagcaaattcataaaatttcacattcagtttatatatgtactttgtcaaaaagaatgaataaaatgattactggatcttagtttaaaccagaatatatatacctgaagaacgaagtagaagaaatcaaagtcttcttgaggacgtgaaacgaaaagaccttgaaacactagaagcttgaggagaacgttaacacaaccctttgctcccatctttcttctcttcttttctgcgattgcatgattaagacgtttcggtttcaaaatttatagacagataaaaatgccatttcccttgtaataccatttttaattagttattcatctacgtgattagttaagagattggcatattctcttaagtaattcatttcatatttccgaccttattgaaaagtcatttttgtacgttttacaagtagacagtaaactcaatctcagaatttagtaaactgattgttagaagtttttttattttatttggtagcccttcattacgcgcaattgtcactatatatgtcacaatttttaattaaaaaaaaatagttaaacatgtagactagtttttgagaaactttatgattacaagattgttaatttacactatgttagaggacttttatatcccataccgcaattgcatggtatccaaaggatcgcagaccaactatcacttaactaaaaatataaaaggaccaagtcgatcggcaaatcgatccgagtggagattaaacaaaaaaggattgacttgaaaatatttccaagggatatccatttctatgcttaactaattttaaaatatgggaaggaattatagtatcaacgtacgttacaacttacaacatgtgagcacgtgacccaagcttcaagaaaatctcaaatattttatttatttatttttctaataaaaatgttaatatttcattagaaaatgaaaaagttaggaattacaagaatgtaaaacctatactttggtctcatagcaaaaaagaataaaaaacatggaagcaaatatcaatcggtccatcgacatcaacaaaaacagttaagcttttgaaaacaatgaatcgatacaacaattttaatgaatcgcatataagacacctcaaagaggaagataatgctgtcaaacggcaaaggtcgaaacaatgaaaacccaagtggatggaagcctttcaccggtaggccgagaacactgagccgtcaacggcgaaacacacatagcacacgaaaatctcaaatataaccaactaatgtacattttaacatggaattatgaattatatgctaattaatgctttgttaaggatccatccatattccatagcttagcaaaaaaggatccacccacgattagcgttaaacttaaacttaaacatgtcttatagtaacactttaacagaaataagcaaacatcatataaaagagctagaacatagaaaattaatcaataatgaaggagaaggaaggtacgtggaattataatttaattaggaagcactactaatccacttcccgatgatatgtactgatcctggtcgtggtttaacagctaggtttggtcaaccaagccaatgtaataaggtttgatttgattatttttgttgatttttgatttgatttgatacctaactgaatccaaagtttagtagtttaccatccatgaggttacttggattaaacataatgttgactgtaaaccggtccggttcatgaaagaaagacttgatacgttaaaaccggagtcaccctgtatcggtcagaaggacccggaaatcaaatggttttgaatgtgacccgaaacaacccaaacccgacccggtccgaatttgtgaggaataggtgtgtaatttgtaaaaaggcgctcccaattttcttctccactacgaaaacggagactgagagcagcagcgacgagcttcatcggccgtcgtctccgacctcactcgcgatctccgattacaaaaattagatcctcgattaagaattcgaaacatcaaaatttcatcaacaaaaaaaaatcagttactggatttacgtttcgtttgcgtcacagatcagatctccatgatcccttatccgctttcgttgcggttccttaaaccttgatgcaacggtctaatgctcgttccaggtcgaatatcaattcagat

SEQ ID NO: 5844 - DNA, 3000 bp, Unknown
  misc_feature (1)..( 3000): cDNA_ID_3078598_gDNA_ID_1620821_Annot_ID_169493 3000 nt of promoter + ATG
gttaaaccacgaccaggatcagtacatatcatcgggaagtggattagtagtgcttcctaattaaattataattccacgtaccttccttctccttcattattgattaattttctatgttctagctcttttatatgatgtttgcttatttctgttaaagtgttactataagacatgtttaagtttaagtttaacgctaatcgtgggtggatccttttttgctaagctatggaatatggatggatccttaacaaagcattaattagcatataattcataattccatgttaaaatgtacattagttggttatatttgagattttcgtgtgctatgtgtgtttcgccgttgacggctcagtgttctcggcctaccggtgaaaggcttccatccacttgggttttcattgtttcgacctttgccgtttgacagcattatcttcctctttgaggtgtcttatatgcgattcattaaaattgttgtatcgattcattgttttcaaaagcttaactgtttttgttgatgtcgatggaccgattgatatttgcttccatgttttttattcttttttgctatgagaccaaagtataggttttacattcttgtaattcctaactttttcattttctaatgaaatattaacatttttattagaaaaataaataaataaaatatttgagattttcttgaagcttgggtcacgtgctcacatgttgtaagttgtaacgtacgttgatactataattccttcccatattttaaaattagttaagcatagaaatggatatcccttggaaatattttcaagtcaatccttttttgtttaatctccactcggatcgatttgccgatcgacttggtccttttatatttttagttaagtgatagttggtctgcgatcctttggataccatgcaattgcggtatgggatataaaagtcctctaacatagtgtaaattaacaatcttgtaatcataaagtttctcaaaaactagtctacatgtttaactatttttttttaattaaaaattgtgacatatatagtgacaattgcgcgtaatgaagggctaccaaataaaataaaaaaacttctaacaatcagtttactaaattctgagattgagtttactgtctacttgtaaaacgtacaaaaatgacttttcaataaggtcggaaatatgaaatgaattacttaagagaatatgccaatctcttaactaatcacgtagatgaataactaattaaaaatggtattacaagggaaatggcatttttatctgtctataaattttgaaaccgaaacgtcttaatcatgcaatcgcagaaaagaagagaagaaagatgggagcaaagggttgtgttaacgttctcctcaagcttctagtgtttcaaggtcttttcgtttcacgtcctcaagaagactttgatttcttctacttcgttcttcaggtatatatattctggtttaaactaagatccagtaatcattttattcattctttttgacaaagtacatatataaactgaatgtgaaattttatgaatttgctgcagtggcctggagcctattgcgatacatcgcgtgcttgttgctatccaacatccggtaaacccgctgcagattttggtatccacggtctatggcctaattataacggtggttcatggccatcaaattgtgatcccgatagccaatttgatagatctcaggtatatataattgatagtgtaattttttcttctaattcttaaacaacgattattagctatcatgtatatgaatgtatagatatcggatctcgtaagtagtttgaaaaagaattggccaacactatcatgtccaagcaacgaagggttcaacttttgggaacacgaatgggagaaacacggtacatgctccgaatccgtaatggaccaacatgagtactttgaaaatgctcttaaactcaaacaaaaagcaaatctcctccaaatcctcaaaaactccggtatatacactaataaatcactatataaatgtactattcatgtgtacattttaaactcaccagtgaccattttcttttcgtaaatgtaggaattaatccggatgatggattctacaatctggataagatcaccaacgcgataaaagatggaattggatttacgccaggaatagaatgtaacaaagatccggagcgtaatgcccagcttcatcagatctatatttgtgttgatacgtcaggaactgagtttatcgaatgtccagttttgcctagaggaagctgtccatctcaaatccagttttctaagttctaatttatatctttacgtgttttcagtttcgttgttatggtagatcttaattatgtatttttgctaaaagtcttaattatgtatttatgtgtctcttatcttgttatcttttgtaacttctcttctcctttttagagtccaaaccaaattcatggggattctaaaatctaaaattcaaataagataaaccttcgtatattggtaaaattcctaatgcatcatacgtttcataaaacttcagccctaatggctaatgcataagtttaacagaatttggtcagtcacggtacaatagttttttaataatgtgctaaagtattatttagtttagtattatagaaacaataatcggaatgtagtagaatcgtttaatctccttttgagggcattatcggatcccagttcaagccaatgttaccaagagcattgttgcatggcatttatctgttacaaaagtccatccgattaagtttcacaaagagaattaatgacgcagcgtaatcattaaggttgcctatatttttttagacaagtggagaaccaagttgagaataataaattaataaacaaattaagaaaatattctttatatattcatttttggaaacaattgattgtgaggtacctttccctttttacatatagattgggaaataaattcaaggaaacaaaaaataatcaagaaacacagagagcaaaacacatg

SEQ ID NO: 5845 - DNA, 3000 bp, Unknown
  misc_feature (1)..( 3000): cDNA_ID_3078601_gDNA_ID_1620821_Annot_ID_169492 3000 nt of promoter + ATG
ccattaaaccaaacaatcccttttaatcagacaaaactctgtctctcaatctcaaaatcaagattgacatgtctcgttttgtgcttctctttatcatttccacattcattaatctgtcacaaggtattaatgtagagtatcttcttgtttgaaacaaatatattatatatgtgcaataaggtttttcattagatgttgtttgatgttttcaggagcgcaaatgccttacatgaccacagatgctaaagaagtttccggcaagtcattcgattacatcgttgtaggtggcggaactgcgggatgctccttagccgcaactctatctgagaaatactctgttcttgtcattgaacgtggtggctcaccttttggtgatcctttagtagaggaaagaaagtactttggatactcattgctaaatacagatgaatactcatctgttgcgcaaagttttacctctgtagatggaatcgaaaactacagaggacgcgttcttggaggatcgagcgctataaatggcggattttacagccgagcaagcgatgagtttgtgaagaaagctggatgggacaagggtctggttcaagaatcttataaatgggttgagtctaaggttgttttcatgccagaactgactcaatggcaatctgttgtgcaattcgggtttcttgaagccgggttttatccatataacggatatagtttggagcacacgcaagggacaaaaatcggtggaagcatatacgatcagtgtgggaaaagacatacatctgcagatcttttgggatttggtaaaccaaattgtataactgttcttttaaacacaacggtaaagagcataatctttgatagtagtaataagactcgtgcggttggagttaggtttatggagagtgatgggaactcaagtaagagctacaaagttcatgttgagcagcatagaggcgaggttatactcgcggctggggctttaggtagtccgcagattcttctcttaagcggtattggacccgagaatcatctaaaggatttcgacattcctgtgattgtcaatctcaaagaagtcggaagaaaaatgtcggataatccagcgatctctcttcttgttgatagattctcgcaaaaccgcacactcgagccacctcaagttgcagcaatagcagaaggttacaaattcatactcgaatccgaggttctcccaactgacattaccacaacaagaatctctatagcagccaaaatcgcattccctaaatccaaaggaaggctcaagcttaacagcactaaccctagggagaatccgtcagtgaaattcaactacttggaaaacaaggcagacctcgacgcatgcctagagatggttctgcatcttcaacatgtagcgaggtctgagactgtcacgttcttcttggggacacaagctcatgataagcttgtggcgggtgacgaagagcttaaaagcttctgcataaagaatgttagaacttattatcattaccatggtggttgcgttgttggatctgttgtggacgaggagtataaagtgaatggtgttaagcgtttaagagttgttgatggttcaacgtttgaagaatcaccaggaacaaaccctatggctactgttttaatgctgggaagatatcaaggaatcaaaatactcaaagaacgagaagagcaagaagatacatttcttagccctcaaggtagcccacaaccacagccataacacattgaaatctttgtttctgttgtagtttgcttcaatgagaaagaatcaagttgctgattaatacttacaacttaagcaaccaattttattgaattcgaaattgatttcagtaaacgaaaacgaaactatacaaaacattctagcaaacctaaacctaaacctagccccatgttgcatcttgagggttcgagtcacttttaacttcttcttcctccgtcttcttagtttcttctgtcgccggcgttaatggagaaaccaatccaaatcccaatcttcttctcttcttcaacttcttcaacaggcatctcatacctacacataggacacgtggcgtgcctccctaaccactcctccacacactttgagtgaaacttatgtttacaaggcatctccgccgccacgtcacctttagaccactcatccaaacaaatcgcgcaagaaccaccatatttctccttatcttctccgatcacgacacgtggcatattctccacttctgacttcaacgccggcgacctcccttgttttccaccgtcgctaaagaaatcgtcgagtcccgatcgcgatccgatcatcacgaaccttggactcaacggatctccccgtctcgttgtttgatcggtagatccttggtcatcatcgtcttctctggcggctaaagctacaatcaccggcaaaaatcgagagagaccatcacctcttccttgtataattctctcgaacatagaagaaaactcaacgaaatcattctcagaagacatcacgctagtacccaaaacaaagagaaaaaaaccgagacttttttgttaagaacagagaaaaggagcgaactttcttggagaaaaatctcttaagaagaagaagaagaaaagtcgaaagataagacaattgaaattggagaagatagtgtttgagattatatatgttagcagaagattacagtagtttcatgaaaagaaagttgcagaagactctagaaccattgacgacgcttaagactttccatttatttttagtttcttttaaaaacaatttagtatttattatttaaaaaccttatcctctttcataaaggacaaaaaggaaatagataattacgctgtgagaaattttgcataaaggtacgaacatttataattttatttacaaagttccagtttttttggagtgttgataaaacccccagagattattcctgcacagaaggtgtttgattaaattccgctgagggtaatgttctgactttcgatgctttacgaatgatacttggc

SEQ ID NO: 5846 - DNA, 3000 bp, Unknown; identical to SEQ ID NO: 5842
  misc_feature (1)..( 3000): cDNA_ID_1010536_gDNA_ID_1620821_Annot_ID_169483 3000 nt of promoter + ATG

SEQ ID NO: 5847 - DNA, 3000 bp, Unknown; identical to SEQ ID NO: 5841
  misc_feature (1)..( 3000): cDNA_ID_1841814_gDNA_ID_1620821_Annot_ID_169481 3000 nt of promoter + ATG

SEQ ID NO: 5848 - DNA, 3000 bp, Unknown
  misc_feature (1)..( 3000): cDNA_ID_3078623_gDNA_ID_1620821_Annot_ID_169478 3000 nt of promoter + ATG
ctttgaccttttagatataggctctcttcataaattcttggatcacttttttagatcgaagtctcttggcctttaatatagcatactgtactgtagacagggaagctgtagttggctcaatgccctttccccacatctcttggataagtgtgaccgccttatgtacgaatccattcctacaacaactagctattagtgctgtgtaaggcacaacatcaggctccaatccactttcaatcatttcagcaaaaattctttctgcctcttgaagatcctgaatcttgcactgctgagcaattaaaaacgtgtagtagacaacgtctggtttaacatcaaaggccttcatttccctcttcgtatcaaactttggaatattgagcaaaactgtgcatgttaccacatcaggtttgattcccattgtcttcatccttataaaaagagcataggcttccttcagctcgtttaaccggcagtatgtgttaatgactgtaaaagtgtacaaatcagggatcattcctctagcaactaaaacattaaattctgccgggcttctctcacattattaactcgacaccaagcaccaattagctttccatacatgctcttctcaggttcgactccaagttcccacattctttccagtaactcttgagctttgctgatataatcattctcggcgcaaagactagtgaatagtgtgaaatacacactcttgggtagaggacattccagactaatgaatcgttcaaaggcctgatcaagacagccagcttcacaatagcctttcaccatacttgcatcattttcccgagatttatgttccaatctctcataaaaagcttcagcctcgtctagtttatctgcaacaatcaggccttcaatgaccatgttgtgtgtaacagaagtgggttctacaccccgatcttccattagtttcagcgaatgcctcttgtacaagaccattcctagccaatccaccagcaaatacgttatatataacaatatcaggtgttttacctgtcccgtccatttcaatcatcaaattaaaggcatcaaaacattaaccttgaagacagcaaccacctatcaatgtcgtgtagttgatgacatcaggagctattcctttacccgtcatttctcggaacaagcttcctctactttgccaagctttcccaaagcaccaaatgcaacattgtagcaaaccttatcaagagaaatgttcatctctctaaactctttaaacagatcaaaagcttccgagaaatttcccatctgacaaatgcattgaaggattgagcttacaatcacacaatgtattctttttcttttcttcaccattttgttaaaaaaatccaaagcttagatatattcagattcttgcgatatccctcaattatggacgagttaaaatagacatccggatcaatcccaagttcctccatgtcaagaacagcttttttagcctcttctattctcatctcattacataaaccacgaaccactctgcgatatgcaattccaagatcactcttatccaccagaatatttgcgtccctcaatggttggagtacaagattagctatacctgccatctgatttaaacagagtccttcaatgaaattcatataaaacacactacatttcctaggctctgaatttaacagtctactaagaagcttctctactccttttgtatcctcattcctacacaatgcttgaaccacaagcacataagtatttgcatccgcatccagccccagccgctctatttgcatgaaagtagccacagccatattgttttctccagaagcaatcatacggttcatcaaaaaactcaatgcttgtatatctggaacacaccctaggggactagtctggaaaaatatatcgatagcttggtcaaacatatcaagattagcataggctttaaccaaggcactggagagcctgctcaacaacagcaatgacccttttccctcctcttctgcttctccaacggcctttaacagatccatgacactgaatccgcgtcctttatctccttttctaacgagttccactagaaaattattcaatttctgatccaaaccacaaccaaaaacgattctgataacagttgcataagcttggacactaggcaaaaaagtcacatttctttccattcgtttcagaaacgataaagcaagataaggatcatctttcaaactagctaaaactcgaagaagctcaatttctttaaattccaaatgctttacaatcaaagttaccttctttcacttgctccgagtatgagattatcgggttcgcccgggaaagtgcaggaaccacgtacaatcgcgacgagggtgctcttcgaatcaatcctctcacatgcgagagtaatgaaatcgggataacccgcatgagatattttccgatcttgtggctgccgggaaaaaaaccctagcagaggctaattccgacgacgattagcatcagagattttctcacttatcggagggtttttacaccgacaccgaaccgactccaaccaaatataaaaataaatttgaaccaaaaccggttaacgcggtcgtactctaattgtgtgtaccaacttttttagcttaaaagcgcattagtgtctttaataatatttaaaacattaatcaaatgtgttggttctttaaattggagatacttcttaaaaatgtctctatcaaacatttatgacgtggtgtctttattttgtagacattcaaaaattaaaataataatttcttttttatatattatattttaagtttggaaagacattctctttatatgtgcagtgaaatactcttttgtttcctttgaattcgccataaattaaaaaagaactattataaaatggtttaaaatttgataatgatagttggtacttggtaacaacaagtttgggtttggtaaaaaaaccaaaaaaaaaagtttgggattggtcaaaataaattcaacattgcttcttaatgagataagaag

SEQ ID NO: 5849 - DNA, 3000 bp, Unknown; identical to SEQ ID NO: 5838
  misc_feature (1)..( 3000): cDNA_ID_1829350_gDNA_ID_1620821_Annot_ID_169476 3000 nt of promoter + ATG

SEQ ID NO: 5850 - DNA, 3000 bp, Unknown; identical to SEQ ID NO: 5836
  misc_feature (1)..( 3000): cDNA_ID_3078636_gDNA_ID_1620821_Annot_ID_169470 3000 nt of promoter + ATG

SEQ ID NO: 5851 - DNA, 3000 bp, Unknown
  misc_feature (1)..( 3000): cDNA_ID_3078585_gDNA_ID_1620821_Annot_ID_169497 3000 nt of promoter + ATG
agagttcttagatcttcaggttttatgtttcgagacgaatgggctaatgttatctctggttagttgtttttttttcttgaatcaattcttcattttggataagttgggaaatgtaatcattgggaaatgattcaggatctgatgaaggtatatattcttggattactgccaattacgcacttggttcgcttggaactgatccgttggaaacaacggggattgttgaactaggcggtgcttctgcgcaggtttagtcttgtctctctcgttggatgctagagtactagaccatgcatacatttacgctatatatagctggctttctctttttctttgtataaatgtaggtattttccgtccaattttggcagaaaaaaatgatttgactttttttttttgatataattttcatcacaaattttgtaatttaagacgttttttgtcgcttgatgattcaagattgggtttagatttttttaacaaatttgaaacgaacatttttgatgcaaaaattggtttgaaaaacgaacaattccggattaagaaactaacaacaaccgaactatactgcatctagatctgaatcttgatgttgactttagatgtacgtccggattaagaaactaacaacaacagaactatactacatttggatctgaatctagatgttgactttgtaacatatttttagacttcaactgtggtatatggtcgaattgttagtgatgactatttgtgcatatgtttaggtgacatttgtgtcaagtgagcatgtgcctcctgagtactcgcgtacgattgcctacggaaatatttcatacacaatctacagtcacagcttcctcgattatgggaaggtaacttttgagacaagaggatttgtgtctttgattccttgttttttaaaagttgtttggaaacgtattaatcgctgaattttatttcttttctttttctcatcaaaattgtagataataatgctaccaaatttgttaattttcaaaaaagctattaacttttgtctccttccaggatgcagcactaaaaaagttattggaaaaactccaaaactcaggttagttgtttttgataaattgttataattgcacttttgagttcatgtaattgtaataatattatttttctctcaatactcatcttcggtgttacaattcatatagctaactctacagtggatggagtagttgaagacccttgtactcctaaagggtacatctacgacacaaattcaaagaattattcatccggattcttagctgatgaaagcaaacttaaaggctcccttcaagctgctggtaatttctcaaaatgccgatccgctacgtttgcgcttttgaaagaaggaaaaggtaaacaaagagcattattggtacgtatagctgaatgttgttcctcgtatcgatttttcttgatctcttatgggtgtagttttgttcctttgtgaacagagaactgtctatatgagcattgttctattggatcaacattcacacctgatcttcaaggaagttttttggctacagcatctttctactacaccgccaaggtataatcccatgacgtcaagattatatgtatgaatttgtgggggagaaattgtttgaacattaatgtcttatatattttcctgtatgaaattaatctgaatcagttctttgagttggaagaaaagggttggttgtctgaattgattccagctgggaagagatattgtggagaagaatggtcgaaactgatattggaatacccaacaactgatgaagaatatttgcgtggctattgtttctcagcagcatatactatatcaatgcttcatgatagtcttggtattgctcttgatgatgaaaggtaaaatttactgcacaaattcaagaacattgtaagattaatcaaatgtgggtttttttggacaaagatataaacaaaaactatacgtttgtttttgtttgcagtatcacgtatgcaagtaaagcaggagaaaaacacataccactagattgggcattgggggcttttatactagatgttgtaacacccaattctgattacaatggtaaatctagaaaatatcttggcttttaagtaacgtagccaaatacaaaatatgaaatcatagttttgtattttacgttaaactgtgtttgaaagtaactatcatgtcgtcgttccttttcatgaaataagttagctaagttcgtaggtgtgtatcttcccctgcatgggatcgactcttctcgtttgtgggattgtattattgtaataaaactctttgtttggtttcttctctcaataatattgttacaaagttgacgagtacaaaacaaaaagaggaaggaaacaaattaaaaaaaaattactcataagaaaaagagagagaccaaattaaagtagaggtggtacataataacatgaaattcaatattgtttttttgtttttttgttttcattctgattttgattatggacacgaaatctaagattacagagcaattatgaatggtactgtttaagaaatcggcccacagcgagtgatgatatatgatcctttgttcgcatgtccttctgttttgcacacgttttgtaaatgtgcttttactttctttaactattaatttaggtgtacaacaaaataatagattttcaaataccagttaccactagtttcttatccctggaggattggttacgtgaaatatcttttaggtctaaagactagagcttgtagttataggtcttcctctggactcctatttctcagttctcactgattataaaatcagattctagactaattaagaagaacaggcaaaacgaatttgctattggcccgttacgttttttttcctttaaataatttttacgttttttcactacgtttattgctattgctataaatttatcttctcagttttcgttagagagtcttaaatgctgatacaatgtttgtatacgttccaggttggaaaaaaataatcggat

SEQ ID NO: 5852 - DNA, 3000 bp, Unknown; identical to SEQ ID NO: 5835
  misc_feature (1)..( 3000): cDNA_ID_3078643_gDNA_ID_1620821_Annot_ID_169468 3000 nt of promoter + ATG

SEQ ID NO: 5853 - DNA, 3000 bp, Unknown; identical to SEQ ID NO: 5834
  misc_feature (1)..( 3000): cDNA_ID_2042017_gDNA_ID_1620821_Annot_ID_169467 3000 nt of promoter + ATG

SEQ ID NO: 5854 - DNA, 3000 bp, Unknown; identical to SEQ ID NO: 5832
  misc_feature (1)..( 3000): cDNA_ID_1443575_gDNA_ID_1620821_Annot_ID_169465 3000 nt of promoter + ATG

SEQ ID NO: 5855 - DNA, 3000 bp, Unknown; identical to SEQ ID NO: 5831
  misc_feature (1)..( 3000): cDNA_ID_1829379_gDNA_ID_1620821_Annot_ID_169464 3000 nt of promoter + ATG

SEQ ID NO: 5856 - DNA, 3000 bp, Unknown; identical to SEQ ID NO: 5830
  misc_feature (1)..( 3000): cDNA_ID_1809195_gDNA_ID_1620821_Annot_ID_169461 3000 nt of promoter + ATG

SEQ ID NO: 5857 - DNA, 3000 bp, Unknown; identical to SEQ ID NO: 5829
  misc_feature (1)..( 3000): cDNA_ID_2041837_gDNA_ID_1620821_Annot_ID_169460 3000 nt of promoter + ATG

SEQ ID NO: 5858 - DNA, 3000 bp, Unknown; identical to SEQ ID NO: 5828
  misc_feature (1)..( 3000): cDNA_ID_1829387_gDNA_ID_1620821_Annot_ID_169457 3000 nt of promoter + ATG

SEQ ID NO: 5859 - DNA, 3000 bp, Unknown
  misc_feature (1)..( 3000): cDNA_ID_1829334_gDNA_ID_1620821_Annot_ID_50701 3000 nt of promoter + ATG
tctggtgagatacactcacaatgattagagaaaaaagatttgaattatgaatttagctaatgattctgtgtttgttaattttcagataattggagagcctttggttgttagagaagctctttatcaagttgcttcactgcttcatgataatccttcaagatttcaacacttactcctgtcttcttcaagttcttccatgcatcaacctggtgcaatgttaatgtctgcagcactgacgagctctcacagaaactacgctgtgcgtagagatatagcagatgcaagagaattttgtgtttgcttcatctgtccagctgaaaacgttggaggtgtgattggaaaaggcggtggtttcattaatcagatcaggcaagaaactggtgctactattagagtcaatacctcagaaactgatgatgatgattgcatcattttcatatcatcaaaagaggtaatgcaaatctttttcttttataaatcatacaaagattatttcatatttaaaccgaccttttttgttgtatgtagttctacgaagatcaatctccagcggtgaatgcagcaatacgcttacaacagcgatgcagtgagaaagttggtaaagatgcaaatgatttagcaatctctacgcgtttacttgtatcgagttcccaaatcgggtgtctcattggaaaaggtggagcagttatatctgagatgaggagtgtaacaagagctaatattcgtattcttcaaaaagaagatgtaccaaaaattgctcgtgaagatgaagagatggttcaggtaataaacacattcggattgtgtttggacttggttttgtttcctttgtgaaagtgaaactaagccaatgtttcctgttatattgctgtggttagattacaggaagtcctgatgccgctatgaaagctctcacgcaagtaatcttgcgattaagagctaactctttcgacatggatcatggacttgtcttgctaccaacatcttttccatatatccctcaagtgactgaaagttcgagcaaatccaaatacgcaaaacgcgatgaccacagtaaactggtatgtactggtccacaagatttttttaaaaaatatcaaatgtaatatgcatcaatcaatcaaagatattcacttaagtaatttatatgcttttgcagaattcgaattctaagagaagaaaccatgtttcttaaatcaagaaaaccaatcttagagaggaagattgagagtgttcagaacttcaatgttgatgcaatttttatacaatattatgttacttgtaggaaaaaaaagttgtctatgcaattcacataagaaatgtaaacaagagatggtgtgttttcatctttgttctttttttcttttacgttggtatactctttgaattttcgcaagtattttttaaaatttctatttctagtaaccaacatttcattattctattgcattacataaaaaataccaattcaatactctctacgtttttattgtttttgagattaatgtctagatactctggatcttttccactttactttgttcttgcaagaattatacttttagttcaagttagtggatgtacactatagagtaggtgagaagaagaggacacaaacaagattacagaagtcttagtcattcatatgaaaaatctcacgcttacgctttccatcagtttcttagttgtacatcaaatctcaaaaaaagagatgttgacactggaacgtaagccccgttcagtttggtcagaagaaagacccaagtgaataactgttttgtaacgaacggccatattatcattcgtcggagagaaggctccaaacacgtgtctcagccatattatatcattcgtccgagagaaggctccacacacgtgtctcagccatatgtctatccgacgtaaagattctctcgttgccgaggttccgcatctctacggaaaagtgacccgcggacttatctgggcctgaactttgacaagtttatagtccaatcacttcgtacagtgacgagttgaacttaccaaagttcagatgtatatataaatacactagatatcctcataatcgtcgatgtgggatgaagttacgtttgcaagctagaatctcaccaaatcggtattccttgggccttgacggtgcaataagaagaatcgattcttaaaaattgggactctaaaattggcgggttgagccaagcccgtgcaatagtgcaacgcatgggcgactcgcgaaagcccagatagcaagctatcttagtgagctatctccctcaaaaaatagagttaatatcgtgtgggccgatggcccacatatcagatattaaactgataagaacagatactacacttgatcttagccaaaaggccgagaaaggtatgaattgttcgtacggctcagcttctattttatacccaaagctatgactaaagctcttctaaactatcgatgtgggacaattcaaaaagaacctcttgaacaaaaacgcctatgaaagacaaaacatcataagttgtcgtcgtgccttaaagcactgaattcaatctgggtagctttaatcttttgaatttcttctctctttctctacgaataaaatatattcatcattctaaaaaaaatcacagtcaaatttagtaaacacttcaaagtttatagcttagattattatttagctacggacatgaatacaatgccaaaatgagaattcttattggttgttgtttgatgtaacaatatagagcaggtacagagaggataagcaaaaacacaagataacaaataaatctttgctcattatatgtcctcagcaataaacctaaattctctgtctttatatgtgaattccacaattaattatgctttaacattttttttatcttgtattcttcattataatcagctacttcaaagtcttaaccacttcttgaagtgtttcactgtggagatttatataaactgcagaccctttttgtttagtaaacagtcacagagcaaaaatg

SEQ ID NO: 5860 - DNA, 3000 bp, Unknown
  misc_feature (1)..( 3000): cDNA_ID_1829330_gDNA_ID_1620821_Annot_ID_50702 3000 nt of promoter + ATG
caggttcagagtcaccaataccgacatttcttgatgtacctggtagttgcttaacaatctgatctgcatagagaaatgaaaaaacaaaaagatacactgttcaagttccgtagatgtaaatatcataaagaggagaatgtgaatttgagtgcaacaaacctcttcttgtagcagattcaaaatcgttaggtgtccaatgaagagcttgagaaaggtcgggactacgaagaacattagcatttgatgatgtggaagatccataacagctaataccatccattaatccatggacgtcccatctcgatgaaggaggagagaaacttgtattagtctccaataaggctcatgcaggccaaatgaaaagtccccacttgtagaatttgatctatctgacttcgcagctacacaacagagcgaacccatactttaacttctattcactcgatagaccctttcgctaaaaacacctcaagctgacaacagtatagcttctcaataccaagcttaaacacctctccaactccataaactatgagacagatctcgcaaacacataatttggttttgttccttgttctttagcttagctcacctgagtaatcaaaatagcaccaaagtttcaaactttcaatcatcaaacaaacattacacattgtacaaaaagcttactagataaacaccacacagaaccaattcacaaaatcaaatctggaaactcatagaattaatctacctacccagcaatctctcactcatcaaacgacaagcaaagatctgaactttagtttccaaaatactttttttcttcacgaagaagattatcaaggaaaaagaacaacccacattgtcgaaattctgtaccagagattttcgttgcaatgcattatgaaatttccagtgacaacaaaaatgagtaaagtaaagagcttactgcttcgaaactcggagagacaaatgaggaagaagatgactgttgtcggaagaaattgaacctacttgccgcaaattcgatcgaagccaaaaaccctaatttcttggaaaggggagaaatctgcttcttctttacttgtactgtgtctatctaactttactttatcttttgtgttttttatgtatatatatttttttaattttattatgaagttaaatttaaaggtcccaaaaaggtaactctttataagcaaagcagtaattaatgtaagttgaatacttgaatgtatttgttgacaaaattaaaaagttggaatgcatttaattttggatgaaaaatgaattcgttgaattttgagtcaaagaaaattaatacaacactatgttcaaatatgcaaattttgaatcctacactaaaccatgaatatcatttttggtatcaagtgccatgcacttaataatgaatgagcaatcaactgatatatctagtcggaataatgaaggatcacatatttagaagagttgggcactcgttagtcgtttcattagctttaactgaaaaaactacaggtgaattaggggtaaaagctttattagagtatattgttaagtgttaaccataattgagtctgtaaaccggaataaaccggtaaattatctatctgaaattccgtgtcgatacatggcatgggctgcttcaagccttcaaaagtatgatatcgactccaactcttttgagagatattacgacgttgactatcaaatttctacgcatattgatatggattacagataattttaattctagtttctgatcactatttggaaaaagaaactacttttgatcattctttatattttcgatatgattgtattcaaatctagctcacatgcagaaaactccactaacgaagactaattcagagtagttgtgtaattctaattcacagctacacaatcatccaaagccaccggacacaagtggaatataacaaagtcataataatttagttttattccttttatcaaatatttcatcaagttagtgttattctatttgaccaaaagcctgttatataaaagacactaaaaatgcttaaataaaagaaaaatcgtctgctgtttttttttataatgtcgttagcacattaaaatattagttcaccaaactataatgatggttgaacattgattttcaatgtagttggtgataattttaaaaagttggttaaaatacatttatgtaattcaccaaaactacgatctaatcagtataaacgctaacttttgaagaacaaataaaacgaaattattatgtttttctaagaaaactataattattccgtcataaaatattttaatttcaggtacatatatatgtatttaaatatatatttttaagtagtagtttacgtgccgtcacgtcccgaagaacagttaaaagagaaaaagccacctgtaatcagatatttatatttaatatatagacgttagccccaaaaactttgtatttctctgctttcaaacccaagaagccaaaataaaaccattgaagctagcagcagccgaagaagcggtcacattttccggcaaaacagacagatcgaccagtgaaagctcctatctgtaagcattgcatgttcccaagctctaattcaatgaaatgttgtagattcaacaagtcatgtaaaatgtttccttaataagtcggtgatgtctcatggatcttgatcggttgtgtttgtgtagttttcttgtctcaattttgcataaagagctagaattgaggggagagatttgacctaatccctgtttcttgaataatcttgtttcttgatttagcatagttgaccaaacaagtcaaaggtgtttatgtctgaaaatttggctctttgattttaactaatgtagtgccaagatctgatctttagaattctcaaggactctgttttgtgtgtttctttagtgtttgttgattatatataaaggatcatatgaacaaactaagctctaaattatttttcatattttctccagcttcctgaggcattgtgatctcttgttaaaatg

SEQ ID NO: 5861 - DNA, 3000 bp, Unknown; identical to SEQ ID NO: 5844
  misc_feature (1)..( 3000): cDNA_ID_1829312_gDNA_ID_1620821_Annot_ID_50708 3000 nt of promoter + ATG

SEQ ID NO: 5862 - DNA, 3000 bp, Unknown; identical to SEQ ID NO: 5843
  misc_feature (1)..( 3000): cDNA_ID_1829306_gDNA_ID_1620821_Annot_ID_50710 3000 nt of promoter + ATG

SEQ ID NO: 5863 - DNA, 3000 bp, Unknown
  misc_feature (1)..( 3000): cDNA_ID_1829302_gDNA_ID_1620821_Annot_ID_50711 3000 nt of promoter + ATG
ttgacctctacattgtggaagtaaaagataggattggagtggtgtggatttatgttgcaatgatacttttgatgaaagtttcattttttgttatatagtagcttagttgagtgctagtaaaataaatgagatccattggctattgttggtgttataattactagaaatcttggaaaattttcaggatctgatgaaggtgtatatgcttgggttgttgctaatcatgcgctcggttcgcttggaggtgaacctttaaaaacaacgggaattgttgaactcggtggggcttctgcccaggttttatctcttgtcaaatctgttattgataagaaaatatgcgtatgatgccatttatcaggtttaggataaacctttacttgtatggtaatagattaattgtgagtgatgactgtttattcattcgtttaggttacatttgtgtcaactgagcttgtgccttctgagttctcgcgtacgttagcctatggaaatgtctcatacaatctctacagtcacagcttcctcgattttggacaggtaactcatgagagcagagttttttttttctctttgagaagttttgttcttggttggcccttttctgaagtttggtgtttggaaacttaatgtagttttgtccctatttactacttagtgatctctgattttctaagattcctcaagattgtagaccgtgttaccaaaagaaatgatttttgtccatactaattttcaaaaagctattaattttagtcgcctctgcaggatgcagcacaagaaaagttatcggaatcactatacaactcaggttaatttttgacaaatccttaaaataattgctctttggagttcaagcagttgaaataaacttctcttccctcaaaactcatacagtgtttcaatcctagcagctgcaaactctacaggggaaggaatagttcctgacccttgtattcctaaagggtatatccttgaaacaaatttacaaaaggacttacctggattcttggctgataaaggcaaatttacagccacccttcaagctgctggtaatttctcagagtgtcgatctgctgcatttgccatgttgcaggaagaaaaaggtaagagcatcattgttggtataggtgaatatcgttcctgtgtacaattttcttatgggtgcagttttggcacttttgtatacagggaaatgtacttataagcgttgttctattggatcaatattcacacctaatcttcaaggaagttttttggctacagagaatttcttccacacatccaaggtatataatcctttcaatttcatgttggtcgatgccaagattccgtcagaatgtgaggagaattgtttgaacattggtctttaatttctgtctggatcagttctttgggttgggagaaaaagagtggctgtctgaaatgattttggccggaaagagattctgtggagaagaatggtcaaaattgaaagtgaaatatccaacatttaaggacgagaatttgcttcggtattgcttctcatcagcatatattatctcaatgcttcatgatagtcttggtgttgctcttgatgatgaaaggtaaatgttattgcacaagttcaagatcaatcaatgttggttttctgtgacaaagatataaacaaaaagtcgaacctatgcttgttttgtctacagaatcaagtatgcaagtaaagcaggagaagaagacataccactagattgggcattgggtgcttttatccttaatactgccacagccacttttgattacagtggtaaatctagaaaaattcttgacttgagtaatgtagccaaatacaaaatatgacatttgttactatataaaacaaaattgtttcagataaaacaagtaaattattaatcatgtatatgtatttacgtcaactcgtgtttggagcttcagtcttcataaatctctttttgtgaattagttagctactataaaaaaattaaagaccaatttgaattagcttgtgtgaaaatgaaaatgtttaggaagctcagtccatgaagctatctgtgttgaagtgtattacaataatttctcaacaatcaatgagacaagatcaagaaccgtttatctgcaataacttctcaacatcaatgagggacaagatcaagagacgattgtgatggagaaagaaagtcaagacaattatgatgtgatttacactgtcaacacgtgtatcatatactgtagtcctcgataaaattaatactataaagattacagaccgatttaaaattcattaccacgatatgcatgaggacaactatttgatagtttttttttttatttttatgatagacaactcacaactaattgatccgatgcacaataatgagcttatagtatttatttcgacatttcgattgttcaagtcggatttcggagatggttttgtgatatttggctcgatcaaaattgaactcttgatggggatcataagctaaaccacgaaaatactcatgcttgcaataacgagtaggagagaaactgacccattgctagtgattcgtgtatccttgtgttaggttacacacgtttttttaaccactcaagtctacgtcacaaaaaaaatcaatttaccactaatattttatcttatcctcaattattgacccgtactataatttattttatagactagatgtagaatatattatataatagccaatagggatcggtgggaagagattcatttctttaagttataggtctggagcggccgttttgaacttctgattattaaatcagattctagactaattaagaagcaggcacaaaaagaaatagattacgtttcttattttcttgcgttgttttcactacatttattgctattgcgttacgtttttttaaactacgtttattgcttaatgctagtatttgattatcttgttaatataattttcgttacggttctttagacgttaatgcaacgatcccatgctccttcctgcaggttgaaaa

SEQ ID NO: 5864 - DNA, 3000 bp, Unknown
  misc_feature (1)..( 3000): cDNA_ID_4262256_gDNA_ID_1620822_Annot_ID_169517 3000 nt of promoter + ATG
tctggcatgtgcagctgacgagaaggatccgtttaccatgcccttgtcgccaggtgatagaaaaaaggctgctgccgcaaaacatgaacttgcatcgctttatggagaccacagtgatcatcttgccactgtcgcggcttttcagtgctggaaaaatgcaaaagcaagtggtcaagctaaggagttttgttctaagtacttcatctcccaagttgtcatgaagaggctggatgatctgtgtcgcaagcttcagggagaacttaatagacatggggtcatacctagcagcagctcaaactgtagcctgaatgctcatgatccgggtattctccgtgctgttatagcagttggattgtaccctatgttgggaaggatgtgcccactttccaagaatcggacaaggtctgtaatagagactattgctggagccaaagtccgtgtgccctcgctatcaaacaatgttgacatgtcctctaccaagtttgacgaagctttaattgtttttgatgagatcactcgaggagattggggtgtggtgataaggagctgcactgttcttcccactatacctgtgttactgttttcaagagagatagccgtttctactacagagagctatgatgctgttaagagtgatgacgaggaagaccacaaagtaggaaatgtaggagacgcgatggacatagataaagaagttggtaggcctggagagaaaataatgcttgggccggaaaattcagtaaaagtagtagtggatcggtggctgcctttcaaggttacagcttttgaaattgctcaaatgtacatcttgagagagagactaatggcgtccattttgttcaaggtacatgagttatcactacgatttaagattttcattattttattttggcaatgtcatccttttcaaccttccatatgcatttgtaggttaaacatccaaaggaaaatttgccgcctcatctcggtgcttctatgtatgcaatagcttctgttctctcatatgatagcctcgcacaatcttcagttcaaactgtagctgtgcaacctattacttcagtggtagatgcaacgagtcccagagatgacataccttccactaaccccaatgagcttcgggagcatgacccgaacactactccaatggggtcaaagctcgaattagccaacaagttgggtttgggtaatatggaagagagcttgccttcaaatttcgctgatgggaatgagcaacctgacccaaacacttctccagtggaagatgtttcggcggctacaaaacaaaagaagatgcagtcagagtccaaaaggtgcaagtcgctcaacaacgtggatttggggaacattgaagagaatttcgggaacatggaagagaacccaccttctgatctggctattgggaatgagcaaacattgccgaagttagctagcaacttggacatggggaacatggaagagaacacgccttctgatctggccaatgggaatgagaaaacagagcctaactcagccaacagcatggatttagggaacatggaagagaacacgccttctgatttggcaaatgggaataagaaaaaagagcctaagtcagtcagcaagttggatctgggtagcgagaaagtgagcattccttctaatctcgtcaatggaaatgagcaacatgacctaaacattgctccaggtgaagatgcttcagcggctaagcaaccagaaaagaagcgatccaggtctaaaaagcgcaaatcaggcaacaacctggatttggggaagatggaaaagagcaagccttccgatctggcaaatgagaatgagcaaacagagcccaagtcagccaacaacttggatttagggaatatgaaagagaacacgccttcggatctggctaatgagaatgagcaaacagagcttaggctacctaacaactcggattatggtaacatggaagagagcttgcctttgaatcttgctaatggggatgaacaacctgacccaaccactgctccaatggaagctgctaagcaaccaaaaaagaagcgatcaaggtccaaaaagtgcaaatcagtcaacaacctggacttggggaacatggaagaaaacaagccttctgatctggcaaacggaaatgagcaaaaagatcctgagtcagtcaacaggttggatccgggtaaggagaaagagagcattccttcgaatcttgtcagtgggaatgagcaacctgactcaaacactgctccagctaagaaaccaaaaaagaaaaagcgcaaattagctaacaactttgattcggttaacaatatggaagagaaaatgccttccactaatgtattgagccagggaaacaagtcaggtttgattgaggaaaaaccgagcataccttccgatcaatgagcagtgtggctcaaatactgcaccaacctaagcaaaaccgaaagaagaagggaagtatgatgcccattccactttggtgttttaatgagcatttcggtgtttgtcatgaaaccaagttttgaaatggcacttgtctacataagtgtaacagattcttaatttcaacaattttgttagataatttgtattcattctcacttagtgcttccgttgttctatcgttataaacgttttaagatatacgcatgtaactgaaagaagaaaagccattattgatccagtactgtagtgtcttagtgtgagcagaaaaaagatttgatcatggaatggctttagagtaaaatactaaaatagatggaatcgaaggcttatgaatctgacgtggaacaagaagaaagcgtatctgccacgtggcacaatacaacacctcaacagccttatctggacatcaacagagagatcctccaatatccgaaaccaaccaatcagcttcactcttggtttcacctccatacattaacacaccaacaatcctcaaaaaacactttcataacttaatcacacacaaggagagaagagagaaagagagaaagagagacagagataatg

SEQ ID NO: 5865 - DNA, 3000 bp, Unknown
  misc_feature (1)..( 3000): cDNA_ID_2172271_gDNA_ID_1620822_Annot_ID_169523 3000 nt of promoter + ATG
cggaagtcggaaaccagctaatttatgagaaataatatcaaaaattacaacttttataacatttatctaaaaacatgaacgattctctaatgttacgttattacgagatttaaactcttgaatttgcaaaatccgtgttaggagccatacaatcagattaattcatcaagctatatactaaaactgtgctccaaatcctcatgacatgatgcaaatctacatggtcggactatataagtatatataaaccatatattagttttacatcaaaaccattgatataggttgatattattaaaaaaaaaaaaaccttgtgacagtttcatgcatggctttaacagtcataaaagaaggcattacacatataatcaaagtcccaagcacccttattagacaagctaaatcacattctcagatcttgagatagagtaatccagaggtaccatcgaatcctttggatctgtagaactttgcatactctgtaatagtagtgtctctataattaggagggttttcttcagacaaaatctctttgatgggtccataaactcgaggattcgccatcaaatacgagctgaagaaacatgccactgaaattctcggtccagctacattggccaaaaccctatgctccacgcttatgaacttgtcgtttgttataagctgcacccaatgaggtaataaaagtcagatttatattagtccattgattaaccactgataaaaaaccaaaagggttagttagttagcctgaagaagatctccaacgttaacaacaagagctccagggacaggaggaacatcaacccaatattggtcatgaagaacttgaagccctccgatatggtcttgaagaagaatagtgagaaaagagttgtcggagtgtttcgttaagcctagagtaaggtcgggttggggacatggcgggtaataatggccgagcaacagcaaggagttagtgcaatccatgtccttgaggtgattagtgtttaaccctagagcttccgagagaagctcgaagagtaatttacccaatttcatcacttcctttgagtactcaatcatcatctccctgaaaaaatgtccaccaaaatctttaagacacactaatgaataatgggggcgtaaaaatcttcaacgaaatcctagcgcttataactatttgaataagttattattggatttatgtatttcaattgttataaaaatttgttaaaaaagaaaacgtattattggattaatattcgtctaacgagtagtgaaacactattcgaccatatataatttcttcggaccgaggaacacaacatgttacaaaagcaaaaatagtcaaactcgtaatttaacaaatttggaaatcttacccacaagtggcgggtaagtcctccggtctcgggggatctggtgctgtataacaaccaagtgtatctctccaattcgccgccggtgagctaaacagatcgaagttgctgctgtataccatcttactagctggatctcgagagtaaaaccctttcttcacttcagtgtcttgctcgtgaaactcacgaatcccatctatcatcttctccaacacatccatcgggatcccgtggttgatcacctggaaaaatccccatttctctgccgcgtctccgatcttctccaccaagctccgccgcgtgatcgagtccgtgccacctcctttgagatcgattgtggggatggagaaatcagaggaggaaggtggttttggacttgttaaagtagccggaggtgcacgaaatatcgaaggaatctctgtgattccggcgtcgataaggcctttcacgccggttttagtctcgtcgaaagctttgagtagagttgaacgatcaagtgcagcaacttggggaagtgatgactccattgcttttagctgaaaatgcaattgccgttggtttgaagttggatcttaatactacaagttgtcaaaagtttcacgagtcaacgacgaagatagatgagaagaagtacatgtcttagttaaattattcacgtttcccacgtggggaaaaaccgggacaagaaaaaataatgataacaaaaaataggaaaatggagatgcggggtatcgatccccgtacctctcgcatgctaagcgagcgctctaccatctgagctacatccccgatgacgaaaatgtacaattggtcaaaataaattaatatacgaactatactagtatcatattcaacagctcattttgtcacgtttatatattgtatatacaataatttttgttattattttatttttggccatcagcaagacctttttaaaaaatcgcaacaataatattattcaagtattcggatagtggctctcgcgtcgaaatgttttggaagcctgcgtcactatcatggttaatggcaagttggcaacaactacatgaggtaatcctttgtcaaaaataaataaattgaaatctctgataaaaagataaaatatagattctgttctaatacgatatttagtcgaaactaataaaagagtatatacgaactttttaatgtctttgtaatttgtaaattccgttgtagttttgtaaatttaagaaagttttgttgccccaaaaaaaaacgaaattaaaaaggaagttttattcgtttgattattagtttatttagcttcttttatttcacctttgggccttacacatcaaatcaaacttaaaagttaaaaggaaaactttgggccttggcctctgggttatatactcttaaggcttaacccgacggcggtcaactaccggcctgaaataaccggtttttatttttcctttgtttctcttttcaaagtgctcactttcccggtgactctttagtcaaaatttcaaattaattcctctaaggtgccctaatcccggctgctcgtcgggggaaaataacccggcagggattgagcaacagcgtgagtcccaaagtgagagacagtgtgaatcccaaagtgagagagtgagtgttttagcgacagagagat

SEQ ID NO: 5866 - DNA, 3000 bp, Unknown
  misc_feature (1)..( 3000): cDNA_ID_2105286_gDNA_ID_1620822_Annot_ID_169528 3000 nt of promoter + ATG
cttaccaagagcatgagcaacaataatacttggcaggttttgaagaaatatttccccctcaaggatatctaaggagcgaaaacgaaaatgtatgagaaataccccatgatgaaataagatactaagagtcataaattgtaagctgaagtacaaagaagaatcttactatgtaaagaaggcaatctgaaaactctatggttcaaatccaccgcaattccattaggaacacgaaacatcccagcccttgacaacatagctgttcccatgccgatatatagtccactgcgttcacgatagtaaggatctacaataacatttcaactgttaaagttaaaaacatttcacaagtttcgtagttggcacccctaaaacttatggataatataacactttcaagaaaaaatactggagagaaagcttatctaatacgactggattattgaggaaaactactctttaaaatttgaacgcattccaccgagtatactgtttgactcttttggctgccataatttattactcaaataatagcacctttgatcaataaacaacttaacacgtgaagcgcttaataaatcaaagacctattcttcgggtttcagttactgtgaaacaaagtaatggtcaatcatatgataggttcctgcacttattttatagagaagaaagcaaaagaaacatttctgattcttgcctgttggcagcccctggagagtggtcccacgagtcatattaacactccagtcaccttcatcaccaggttgttccatagcaacacagacagcaaccgcatctcctttctcaacatgggcagtgcaagccagtacacctggcacatagacctaccaaagacccataagagaaattagtacatatttgttcacttaaaagcccggagtttctcagctagattgtcaaaaactataacgaaatacaaccaagatagggattcatattccaacccaactcccagcagcatagtgacaggatagaagcttaagccctcccaatggaatactttaagatcgcataattttaagtatcaatgtgactagccactaaagtttcactgagagagcgtcaagattacctgggctcctctgagaactgcttcagcacacttcctgctcactagtacctcctttggagggttttcaagaccagaatcatattctatcttatgtgggcctgaaccattgacaaagacaacataatccaaaccaggtatctgacacttggtgacgggactacttccatctggttgtactagcttcaagccctcctccgagtcgtttaaaattttcgtaagcttttcgataaccgcatcactcgtcgttttaacagtgttcaccctaatgcaggagtatgaagatgggcgcctaatatggaacaaaaacaaaatatatatagagtcgagcaaaatgtagcaacaataactagagcagacgcaagaaaaatgtgagaaagtttgttaatttagttacgatggcagactacaactgaaacatgtgaaggagaagctaacattggggaaaatgcaattaaataataattcgatttaggagattagagaatgaataagcaataaggcaaagcgaatccagctaaatgcgcctaaaggagggcaatgttgcttcagaagtagatgagaatgatagaaaagtacgtgagagcctttgaaatgcgagcaaagtgatcgggtccataagctttagtgaagtagtcttcaacttcaggattccatcgcagtaccggatcataacagtaacgctccgaatcggaaggacccatctccatctgatgagagatagagcgtgactgagaaacagaggagaagaaggccttggctctggttaagcaagtggtgagggaagagggttttagcagaaccctcgctttactcattcaaggtggaaggagactggagagatagagagagcttcttcaagggaagaaacttcttgggtttttacctttttagagctttaatggtagatgggccatgggttgcaatgaataagcccatatcattcagagctttaatggtgtatgggccttgggttgcaatgaataagcccatatcattcagagctttaatagtagatgggccttgggttgcaatgaataagcccatctcattcagagctttaatggtagatgggccttgggttgcaaagaataagcccatatcattcagagctttaatgacagatgggccttgggttgcaatgaataagcccatcacattcagagctttaatggtatatgggccttaggttgcaaagaataagtccatcatattcatctgcttgtttatttactttgatgtaaggttttttatataaaggtcaaaaaaggttaggtagaagaagctaaaaggtttgatgagagtcttttcctaccaaaccccctctccttgtgatgatgattagcttcacctgccattttctcaatgactgtacccacaggttatataaatggcttctcacatttcgagctccattcctcaccagaccccttttgcaaggttatccctttttctctctctatttcatttgatttcactattagcttcttcatttttgtgagaggctcttggatttttttgatttttgcaacttgtaatggagtctgttcccattaaagtttcttcatttctgagtctttagccatctattcgttggttggaacttggaagagtaggattttagtttgaaatgctcattctccgatcataaagtttatatattttgaatagaatttgtgttcttgttctagtggatgaagtagagaataatctagggaggttgaaattagattgttgcaagttcgtgaatattaggatttgtctcattgggtctgaagttttgtggaatttcttgacagtgtagtttggcagtttgagagtgtttttcatatccgactctttcaaactgatggttttgacatttttgttgaccagattagtaagttattgttgtcgttttgagaaagctggat

SEQ ID NO: 5867 - DNA, 3000 bp, Unknown
  misc_feature (1)..( 3000): cDNA_ID_3078714_gDNA_ID_1620822_Annot_ID_169536 3000 nt of promoter + ATG
ttgtcaaaatttagtaaaatatattcaaatataattaaatttattaaaacttaaaatttaaaagtttttttggtttgaagacccgctatctaaatacaaaataccgtttctatttttttgggtatttttagggcctgaaactttttatcaaaactgacccgaatccaactggacccgacccgaaccagaaccgaatatttagaattattctattgggtagtaaatcatatacccattaatcccaaacccgaatggttctacccgaactcgaatagattactcatatgcccagccctattctctgatttaattatctaaaaactcccaaaaaaacatatgttttgctgactactttttattcgaaaaattttacatcctcttctgccaaaatcatttcataagacatcccaaaacccttggaataatgattccatgaatgaaaaatcctaatttgaatataccaaaaagttttgaaaggttttaagtttttgataggtgtgtatgtgggaaggtatagacatcgtgatgataatctgcttatttataattttaacctgcagtatatcgcagataggcttatattttagttaaactaaaaacttttattgtaaagatgattataaatatatgatattattttatttgattttaaatgtatagtaaactgcgagttgtatatattttgttgatattatttacattgtttagtgtttaaaattatacacttgtattttaagtgttaattttagagtttcacctgtagtataccatcttgtattaatatcgatctaaacccgtccattctagaattttccagcttgtattaaaaattgaatcacatcatacacataaaaaaaactaatatgttatgaattattgtagtatataagattataaattttcaaaataatatgtatgaaattgaatataaatattcaaattatgacccaatactcagtagaaagtttttttaaatctatttttgacccgttataatattttttcatgtattgaacagtttctatttgtttttaaaaattcaaattatggcatatgcgaaaaaactctaattatgtttttataacgatgatattattttttcgcaaaaatagaatcatataaagatgagaggtgaactataataattcccaaaaaaattaatatgataattaagatatcaaatctaatttgttgattttaattggttacttttttggaaatttataatgtatttcgttttttaattaaatttaattaattaaattagtatttgactttttaattcttaagggaatgaattaatttattatttaaaattttatttctaatgacatacttatgtaattacttacaaaaaataaggttatatttaaaatgtatttcccaaataatatagtaggattttagattttataagaagatgttaaaccgttattcttgcgagtaaaacagaagaggccgaactaaagatttttttaacgttgacgcagcttatcaagtttctatactctccgacaaaattggtatttaagaggaaatatatttaaaaataaaaaaaaatcaagtagatcttgtatgatctgattctgatctaatatctacggctaccagcacaacgacaaccatatatcttgactctttcaccacttagttttgtaacttgtattgccccgacgcatggacacatatgtatatatatgatcatgagtttttatatcgccatgctcattcgtttgattgtaaagttacggggatatgatattactagtaggggatacgataatattccaactattattaacttaatgttttacgtcaattagtcacgccgtacgcaataataataataataataagttgaagtagctggaaacaaacaataaaaaggttgagaagaagtcaaagtagctggaaacaaaatctgaccgttaagaaagttgatttgtccagataatgataattggttaagcctgccaagggactcattagaatagtttagtgttatcatcacacgttattttttctttcgttttgaagtattcttgagaatccagttcagaatcctagaccaattgccaaaaaaaaaaagagatgtaaaactgtgaaaatggaatgtaagggtacaaatatgaaatgtcaactatgcaaaatgtggaactgttcagaacaggtttgtatatcgttttaagcaaggaatgatatgatgtgaaatagttacgttgttgttacattcataaactaatgggtcgggaatttatacttgatactctcatgtgcctccaagttctttatgccgatacctaatacgaataacacgaaggcccattagctcagttggttagagcgtcgtgctaataacgcgaaggtcgcaggttcgaaacctgcatgggccatatgtcttcttaccttttttttttattaccttaatcttaagaacccatgggccagtaggtggcccaactaagagttgctgatttccgtgtcgttgtgtaaacataatagtgtcacgttgttaattagtaaaaacgtaaaacgtcatgtagtctagattccctatagccgttgcgtagccgtcccaaagctccgtttcgacttcacagagaagcaattctccagactttcccggggaaaaaaaatcccggaaaatctcgtaaaggagaataagggattcaaaaacctcgtcctgggtttgctttcgtacctatttatggaaaaagtcacagctcaaaagcgagcgagtgaaagaaagaaaaatcaattcttttattctgagtgtaaaggaagaagacacaaatcgagaaatcaattttttagaatatctcctttagcattcctttcttcctcgtagagcaatcgcataaccctaaagcccactccacgaatctaagctcctgttcccgcttcactttcctctgcacacatgtatatatccacaaaaagggggaagaagaagatgggttttatcgattcttcggaatttgaaattgatcagctattatg

SEQ ID NO: 5868 - DNA, 3000 bp, Unknown
  misc_feature (1)..( 3000): cDNA_ID_3078718_gDNA_ID_1620822_Annot_ID_169535 3000 nt of promoter + ATG
aaaggtacgtaattgttttttgtctgatgtgaacagccatatctcctgcttttggatctcattctttcgttctaattttgtaggttgtaagacttttgttacttttgactgttaaagaatccgcaataaatatccctcaaagtttggaagctcgtcgtcgtatgacattctttgcaaattccttattcatgaatatgccagatgctccccgagttcgtgacatgttatcctttaggtacatgttttagcttactacctgaagaaatatgctatcgaatcacaactttgataaataagagttagacatgatccaagtcttcttctatttttcagttggttcatggagaatacaacttttagatgatcttgaaagcaagtaacaattgttttccaaattatttgtgtagtgtcttaactccttattacaaagaggatgttctctattcggaggaagaactgaacaaggaaaacgaagatggaataactattttgttttacctacagaggatatatcctggtaagcttctatttggtgctttttaagtgtttataacaaatttaaagtttactgaatgaaaatgactgcataacagaggaatggtcaaactattgcgaacgtgtaaatgatttgaaacgcaacttatctgagaaagacaaggcagagcaactccgccaatgggtatcttatagaggccagactctttcaaggacaggtatactatcagaacgttgtaggattttctgacttgttctactcgctctgcgatcgctaatattcctcactatttctagttaggggaatgatgtactacagagtggctctcgaacttcaatgtttccaggaatacactgaagaaaacggtttgaacttatccttcattctcaatattgaatgttttaaccttacagatattgtggtttggccttctctgcctaagtatcctccactacttcatttagttgtcaaagttaatcttgcttgtgaagaagattgttttatgaactctattttcttcttgcagctaccaatggtggctatcttccctcagaatcaaatgaagatgatcgaaaggcttttagtgaccgtgcacgagctcttgcagatttaaaatttacatatgtcgtgtcctgtcaggtctatgggaaccagaaaaagtcaagtgaaagccgagaccggagttgttacaataacattttacagctcatgctaaagtaagaaagttctcttgtttgaaatcaaaacttcatatgcttattcttctagcttagttttaattatacattatggttaggtatccgtcattgcgtgttgcctatatagatgaaagggaggagacagttaatggaaaatcacagaaagtattctactctgtgctactcaaaggatgtgacaaattggatgaggtatgcaaaggaaatttataataattaagttcatacattcgtagcccacttccttccttactggttttaggtcacaaaggaaaacttatttatttccagtcccacataggacccagatatagttacctatttatcctgaactttgattttgatttcttaggaaatatatcgtatcaaacttcccggccctcccactgaaattggtgaaggaaaacccgagaatcaaaaccatgccatcattttcactcgcggtgaagcactccagaccatagacatgaaccaggtagctttcacctctctatccctcaaccattttattgattccaactatagtttcatttcctttttccatttcaggacaactactttgaagagtgtttcaaaatgagaaacgtgctacaagaatttgatgaaggtcgacgtggcaagagaaatcctacaattttgggtcttcgtgaacacatatttactggaaggtctgagattcttcatacattttttatttttattgagattcttcatattatttagttttctttatctttctcatctgacttctttctgacctcgcagtgtttcttcacttgcttggttcatgtcgaatcaagaaacaagttttgtaaccattggccaacgtgttctggcaaatcctctgaggtattttcatatcttgtgactagggaaaagatccttccaatccttcctttgtagcttcaaatcttatttaaaagtagcagtccccgcatcattgaacctaatagactatattatagttagaatctttttgttatggaaagaagactagctttggtctttggcaacttacccacgattcttttacagggtgcgtttccattatggccatcctgatatatttgatagaatcttccacatcacaagaggaggcattagcaaggcttcaaagataataaacttaagcgaagatatctttgcaggtagagaacgatcttgacaagtttttgttttctaattattttggtgtatttgtgatggctgatcatggtaacatccagggtacaattcaactcttcgtgggggttacgtcacacatcacgagtatattcaagcagggaaaggtcgtgatgtagggatgaatcagatttcgttttttgaagccaaagttgcgaatggtaatggagaacaaacactaagtcgtgacgtttaccgacttggacgccggtttgatttttacaggatgctttcattctacttcaccacagttggtttctatttcagtagtatggtatgcctcatttctcattcaaatagttatttcctcttgtagctctgccctatactttggttggaatcttggatttttaaaacatgtattctctgtttcagataacggtgctcacggtatatgtgttcctttatgggcgtctttatctggtattgagcggattagaaaaaaacatcctgcaaagtgcaagtgtacatgagtccaatgcccttgagcaggcactagcagcccaatctgttttccagttaggttttctgatggttctaccaatggttatggaaattggcctagaaaaagggtttcgcacagccttgggtgatttcatcataatg

SEQ ID NO: 5869 - DNA, 3000 bp, Unknown
  misc_feature (1)..( 3000): cDNA_ID_2172323_gDNA_ID_1620822_Annot_ID_169542 3000 nt of promoter + ATG
actatatggtgcttttactctctttttaaccaatccacaatttcctttttccgtcccaaaaagtaaattacatataattaatagataatggcaaaacttccaatacaagtattagattaatatgtaaaatgagtatcaattagtgtttaaacttttgattttaaacactaagaacttgaatggttattgttattagatgctttgacactaattatagaaatcgcatcataccattttaattctttgtaagtcaaaaacttatccataacattaaaatattttgttttataaaactttatatttgacagcatttatcctctcataccaaaagtttatgatatcaaactagtataattatttactaggctaaactattattgtatgtgttttattagtttaaataaattttatagcggtaattgattcgcttatagatgtgttttggtcttggacatgaaaatacaaaggtccatataattcttctacttcattttttaatttcgttttttcccttaatgcctgttaggtgttcgatataattccgcagagagtgtgggtatatacagcgacgttgtggaacgcggaaactcaaaatagctccatatactctttgagatactatgaggttcctcctcatgagatcacttctggttcacccatgtggtggctccatcatcaatgtccgatcaacgactacgtctgctcaatatgtagcttccagatcaagagaccctgttttcgagaagctcatggacaaatacaagaaccttctcaaggtcattgccatacaagaccttaccctcgccaatccaacagctgatcctccctctctatccattgagtttctctccaggctctcccagaagctccaccttaatcgtggcgctgcttctttcctgcgaaagtatcctcacatctttcatgtcttgtatgatcctgtgaaagctgagcccttttgcaggttaactgatgtagccatggagatttctcgccaagaggctttggctatcactgctactttgtctcttgttgttgaccggttggttaggctcttgtctatgtccatatcaaagtccattccgcttcgtgcggtttttaaggtttggagagaacttgggctcccagatgattttgaggactctgtgatctcaaagaaccctcatctttttaagcttagtgatggtcatgaatccaacacccatatcttagagctggttcaggaagaagagaaaagactggaatttgaggccgcggttgagaaatggagggtggttgagtgttctaaggaggattgcagtgtcgatagaaccgagattcagtttagtttcaaacatagttacccaccaggaatgagactgagcaagacatttaaggctaaagttaaggaatggcagaggctgccttacgtagggccatacgaggacatggttggtaagaagaagagtagatccggtgtgatgggaatagagaaaagagcggttgcgattgctcacgagttcctgaatctgactgtagagaagatggtggaggtagaaaagatcagccatttcagaaaatgttttgggattgatttgaacataagagatttgttcttggatcacccgggcatgttttatgtgtcaactaaagggaaaagacacactgtctttctcagagaggcttatgaaagaggacgtttgattgatccaaatcctgtttacgatgcgaggaggaagcttcttgaccttgttctcttgggacgccatgctgctttatcagaatctgggaacactagtatgtctgaacaagaatgacattacgatttttcaggccctattgagtctgagctatgcaatcttccatatggaagtgtatgagacacttgagagattaggtccaccaagaatcaggcaatgtttctatggcgtttgtccgaatttcggactaattggcttgctcacaagcaaaagctcgagataatctgaaagcaggaaaagcgagttacttgatgtagcgtaagtgagtacttggatcaatacttgtctacgaaaccaatgtaggagtaaacggtctttgttgtgtacttttttggttatgtattgtcgacagaaaggttagaaactagtatccaaactcaatacgtcttctttctttagattttgcttggttgctaattgcttcatgtggctttccttattctactaaaactctcatctttgttcttgttctattttttacttttacatcctaatttttttgaaatattattttttggaataaaatttgaattctttttcttaacctttatcactaccagggtttaaattataagtttaattatataatgtaaaaattgtgaacgttatttatgtattgaatttttgatggatggtttttgtggaaaaaatggttatagaaaaaattgtgacaagaaatgagtgaaataaaaaccgagagcccatgaaaggaagccacgtaagctgttcggagccacatctcttgtcttcaaaagtaccaaacttcatttgcttctccaaacaaacaatctctttctcttcttctgccaaattccacaggtgcgtttcactcttagctcatctgtgtaatctcaagcattttctgctttgtttggtctgaatttctgaaatcttttgatgataaaaatttctatgaaatctcggtctgcttgttgcatgattcttactacctgggttttgttcagcaagtctatttgtctttatctgttttcttcttaatttgactttaggaatgtctaataatggtggattcatgtgttgaaatatagactaatgttatatccagtggcaatttctacaaatttttttatcttggagcatgaaaatgttccaatctttcttcatatgcgtcgctaatgatcgcttatgttgattatagtcttaccagaaacttgcatgttgttaaaggtctcgttttgtttggttgttctttgttcagattgtttttttttgttcacgccatggcttgtaatcgtctgtgcag

SEQ ID NO: 5870 - DNA, 3000 bp, Unknown
  misc_feature (1)..( 3000): cDNA_ID_3078730_gDNA_ID_1620822_Annot_ID_169525 3000 nt of promoter + ATG
aaccgtatcgaaatcaaaagtattgttgctcaagttgcaactactacatgagcgtgccttgcattggtaaggttccctacctcctatgttgaacatgcactcaagttgcaaccaacaaagttgatccattatctgctctctgtgatcacttactatattgtttaagggttatataaattcaaaacagaggcttcctagtgttctggaattgttatatcttaagttggctgttctaactttgttaaatccattagtgggaatttaaaactagctcaacgaatatgtaatgagctaggaggcttggcatcaacagccatgggtgtagacatggagctaaaagtagaagcaagtcttcgtgaagctcggactttgcttgcagcaaaacagtatagccaggtttgtaaaaaagtcttattggccatctgttttttaagcccatgtgatatatttatttcaggccatgtgctatggcaatgttagtgtgtcttcattttgctttggtactacgttctctacaggcagcaaatgtggcacactccctcttctgcacatgtcacaaattcaatttgcaaatcgaaaaggcgtctgttcttcttctgctcgcagagatccataaggtaagacatggctacaagaaattactagcttgagagcacattgattggaatctgatattccattgaaaatatgttccgccttatcaaattgcaatcaaaactttttttttttttctggaaatttgttccgttccatgcatacatagctaacatccatctatatgttctgaatgtgctctttctttgctgattgctcttagactacatagaaaagtgttgtactatggtattatttctaatcttttattggttttctgaccggcggccttcacctttcgctttcccctttttgggttctcagaagtcaggaaatgctgtcctgggtcttccatatgcgctggcaagcatctcgttttgccagtcattcaacttggatcttctcaaagcatcagctactctcactctggccgagctttggcttggtcttggatcaaatcataccaaacgagcattagaccttttgcatggggctttccctatgattcttggccatggaggtttggagttgcgtgctcgagcttacatctttgaagcaaactgctatctatctgatccaagttcttcaggtagcttttgtgtcttgtactgctttgacgaggatgttcagaacataattgaatagagcctgactgttatggataaaggttgatcttgttagttgcgagtttctaatttgtttactgttgttaccagtttccacagattctgacactgtcttggattctctaaggcaagcttcagatgagcttcaagctttggaggtataacttatgtcaataagagtgctatgtagctttttgttcaaaaacaaacctgagcactatattatcgccacatcattgcataagagatgaacaaacaaacctgagcactatataattgccacaacattgcataagagatgctatgttgcttttgattcgaaaataacaccaaactcttataactaggttcagcttcgtttagctcatcataactctcctagtaccgtgatttactgttggttcacttagtagttgtgtttattgtgcagtaccatgaactggcagcggaagcctcgtacttaatggccatggtatatgacaagttgggacggcttgatgagagggaagaagctgcgtctttgtttaagaaacatatcatagctctcgagaaccctcaagatgtggaacaaaacatggcatgagatgttgtgaaccttatttaataagcttattgtgcaaagcttgtaacttaaagttgtaatcatggtccttaccaagactcgttctagtgtccgaatcttgtcgagattgtgtaacttgtaaccttgtataactctaaaatgtaggagactgaggaagtcatcaagataattgtgaagatttcgcaattgacattttacataacgtctctttctttgtgaaacaagattgtgaatacaatcatgattgatattagtttccattacttgttatcgatcgagcaacattatcaagtcgtttagtgtcacgataaagacaattgagcatgtgaaacaacagacaaagataattactctactaatgacaatcaaggaaacccatttgccaaaaacgtcgtcgttttggaatgaaacaacagctcaaaccccaaaaccgtgttgggacggtaaacagacccctccctgctcgccggagcactactcggcgacttcagatcttctttcagggttcttccaggaattagattgtcaacgaatccaatcttctgaaacaaaaatcttcggatgcgaagatcgattgtgattgtgattgcgttaacggcgaaggggtttcttcatcggcatcttctggagaaaggtaatcttgtaactgctctctcattacgcatttgcaattcccgagctttttctggtaggagtgattaccgagagagattgagaagtgggcttcactctattaagtttaacgatgcacttactttgttctgtgacatggctgagtctcatcccctcccttccattgttgatttcagtagattactgattgccattgctaagctgaataagtatgaagctgtgatctctctctttcggcatttggagatgttgggaatttcacatgatctctatagcttcactactttaatagattgtttctgccgatgcgctcgactctctcttgctctgtcatgtctaggaaagatgatgaagcttggttttgagcccagcatagttacctttggatctctggtcaatggattctgtcacgtaaatagattttatgaagccatgtctctggttgatcaaatcgtgggattgggatatgaacctaatgttgtaatctacaacactatcattgatagtctctgcgaaaagggacaagtgaatactgcgctggatgttttgaaacatatgaagaaa

SEQ ID NO: 5871 - DNA, 3000 bp, Unknown
  misc_feature (1)..( 3000): cDNA_ID_3078734_gDNA_ID_1620822_Annot_ID_169522 3000 nt of promoter + ATG
tgtagcaaacctgcaatgtttcatgtgttctgtgcattattataacattgagatccttacaagacaagtgagtgtcaaagcataagaatgaaacaaaaatataaaaaaccgacaaaattaatttcttagtagatcgtttctacattacaaaagggaaaaagggaaatatcttcagaagcccaactgttaaaaaagaaaagtctgaaaaagcttcatacaaacacatcgaaagactttgataaaacgttgatcctatgactgatgctaatcatcagcaaaaatacattaccaaacatatatgagaaaagtggcagctaaattgcagcctgatcatgaatataaaactctatttcctcatagttttctagcacctgagactctgaaaaactctaggttttctctgaattgggtgaataccataagggataccttctgtcgctttcataagtgaatctggtgtatgaaggtgaaaagggacaattccactagcagttttctgaaactctatttcttcagttggtttatccattgcataattctccatatccatctgatcatattgtattaatgactccagattattattaggtgcaccaaactgagcaaagcttgaatgggcttctttgcagtaatcttcaatacttgaaaaaagatgacaaactccctgcacatatcaatgaaatggacggttctttcaaacattcacttatgtgtttctgcagcaatcaagaacactacagctagatattacacttcaaccagaccagccagagttctgccattagatatcatattttaatgtacctatacatgcgtctacatttaagtctagcctagacaagtactccattgtagtgggtcaagaaacaaacaaacttcacatagatgtttagacacaattaagtggctgacgaaaaagctaacaaatccgcgtccttcaagcaaaacctcaaactacacgtcatgttgaataatattaatattattcagtctcaaaataaaacaagaataacacaaacgtaaaaagctcaatacctcgaacgataaaaggttgaatgccaaaatgcaacgacgaacaaacattcccaagttgctgttgggatccaaaataatctgatcatcttgcacgactcctgaatcaaggctcccaagtattcctacatacaaagaaatgataactaatttgagtcaaacatgatggaaaagaagaaaaaacagaccttaagcaagcaagtagctaacctcgcatgtcattaaagaaatttaatagatcatctggtgaagccaaagaggaaaatctattagttaaatggtcagttagccacgcgtccatctcttcaccaacttccctcaactggttgatgagcttttccagcttcggctcaaatatatcatcgcaagactgcagcatgaatatcaatctcgtcagggaaaagaacagtttgttagcacacgaaaccagcaaattcattattcactcatgaaatcaacataagttacaagagttttgagccgtgaaatcgttacaacagacatcgctgaaatcaatctcagaaattagcaaagaagctctaagaaatgcaataaagaaactcgatacaacttcgggtatgagagacgggccaggaaactcagaagaatcaaaagacattgctgaattaaacctcaaaaaactacaagatattgcaattcgagagaaatcgaagagtgaaaccttagtaagagagagcaagtagaggccgaggcggttgtgctgagcaacggaagagaaaggaaaaggaagagacatctgagcggaaggagcgtatatctgcaggagaatgcaaacggagatcttgtgtggagttaccgcaaaagcaccggccgttctcgttaatccggccatatctctctgtcgctaaaacactcactctctcactttgggattcacactgtctctcactttgggactcacgctgttgctcaatccctgccgggttattttcccccgacgagcagccgggattagggcaccttagaggaattaatttgaaattttgactaaagagtcaccgggaaagtgagcactttgaaaagagaaacaaaggaaaaataaaaaccggttatttcaggccggtagttgaccgccgtcgggttaagccttaagagtatataacccagaggccaaggcccaaagttttccttttaacttttaagtttgatttgatgtgtaaggcccaaaggtgaaataaaagaagctaaataaactaataatcaaacgaataaaacttcctttttaatttcgtttttttttggggcaacaaaactttcttaaatttacaaaactacaacggaatttacaaattacaaagacattaaaaagttcgtatatactcttttattagtttcgactaaatatcgtattagaacagaatctatattttatctttttatcagagatttcaatttatttatttttgacaaaggattacctcatgtagttgttgccaacttgccattaaccatgatagtgacgcaggcttccaaaacatttcgacgcgagagccactatccgaatacttgaataatattattgttgcgattttttaaaaaggtcttgctgatggccaaaaataaaataataacaaaaattattgtatatacaatatataaacgtgacaaaatgagctgttgaatatgatactagtatagttcgtatattaatttattttgaccaattgtacattttcgtcatcggggatgtagctcagatggtagagcgctcgcttagcatgcgagaggtacggggatcgataccccgcatctccattttcctattttttgttatcattattttttcttgtcccggtttttccccacgtgggaaacgtgaataatttaactaagacatgtacttcttctcatctatcttcgtcgttgactcgtgaaacttttgacaacttgtagtattaagatccaacttcaaaccaacggcaattgcattttcagctaaaagcaatg

SEQ ID NO: 5872 - DNA, 3000 bp, Unknown
  misc_feature (1)..( 3000): cDNA_ID_3078746_gDNA_ID_1620822_Annot_ID_169518 3000 nt of promoter + ATG
ttatgggggttgcttatttaggtttcatcacttctcctatagattatcaatgagatttacggttaatacctttgagggaataaactctgaccaccttcttcagaaagtgccttctccagtctcacttcaaatggtgttgcatgccaactcactttctgatcctgcataaggtttagtttctgaatattagaggagctgaaagagcctagaaagcagagatgaaaggcagggaatattacctccttgtatttggttgtcgaatttgggatcccatttccatcccacattttgggtgaaatctcagtttgctcattctcgatccactgagcagcaaccaatccaatgataggcctgtcacctggggttatgacaccgactcctggtgtcctttcatttaaagccgcaatgttttcattgatctggtttagccaaggagaaaaacttgcctcaaacttggacagtttctcatctgagctttcttccactttttcaccataagtttctgaagagggtgtttcagcctctatctgctcttcgtaatctaggccttcatgtgaatccttgtagaccttatataaggatgcattttccattatattggaaactgaatgcacaaactgtgacctgattctaggcctcccccttccccctgattccatgtttgcaggatatatggttccaggagtttgcatctcatcagatagtttcaagggggttggattaggtgagctcactgtaaaacaaattttgccacccatctcgggttttcttgaactgccattctcggaagaattagaagagtttgattgatcaagatcacattcaaaccggacagacttattctttccagctgtgaacgttggcctggccgttctatccaactcacccttgattgcagtgccaacgctttctacctcagtaccatcactagatgcagaagagatccttgcattgtcccggacatcgattacacaactaatatgaaaaatgaaaaagtgaacttcagatccatgaatccattaaccattagtaagatgtgagaataatgttagcatagaaaccacaccagttctatcaagaaaccatgtcaattctatcaagcatagcaaaatgagcaaaatgtctgttttattaaacaaagtaacatctctacctgctagctgtttgctctgaagtaaatgatggtcttcccacctcttcacaagctttcatgggggttgaggattcagccaaacgagaccccatagaggagctactggaaatccatgagtgaaaatgggaagatccagaatgttgaggactaagtttttgggatgctttcctaatttcaataggtgtctccggtatagtaccacaagctttaagaaaccgcgcctatgattccacaagtaaaaggaaaaaagcgttagattctcagcatagactcttgaaagcatgtaaaatctgattatattgatatatgcaaagaaagaatgctctgaaaaatttcagagcttccacaacaaaattacagagtttctgaaaaagaatccctgcattctaataagaaagtcattaatgtaaggaaacacatttacacagggatccatgcattcagatatatagacatccgtgatagaaatatgaacagtgaattaagagcagagggaaaaaagaagaacaaaacttcattatatcaacaaacctaagacgacctcagtaacaaaaaacatagaactcatcttctcattacctgaagaagagatgtggtaattataagactcgcaaaaacaaaatcagggtttcaaaaacaagaaattgattcatgtggagttaagttgagatatcaaaatcaatccaagggcacaagtcttgatcatgataaaaggaataagaatcagtatggttagaatcacatgaatagaggcaatgcttcaaataaaaatcatacctcatccctaaggcctttgtcaatatgtatagaatctaaatcaaatctttctttgtcaaggcaaggcgaagaagctgatttctctataaaaatcaagaacaaaacccttatattattaacaagaacagtaccaaaaacaagtaatcatctcgattcctgatataaacacatcgaaaaagagatttaccttcagaaagaaacaaagctgacaaatcattctgcgagtcctgtgctttctgaagataaataagaaaagaaacatataattctgggtcagatcgatacgatcttgatcaaaaatcaaaagaatcgatcagaagccaacagactaaaatccatcatatacaaaattcagctcaaggatcaaacagggcattgcgaattgcgatctatttcttatacgatcattgtagcagcaaaattgacaggatcatgcaaagaaaagaagcggaaaaagcaagagaagctaaagaattactctggaattggcgagtgaagaatgagagacgagattactagtagagcgattgtctctggcgcggaagcagtcgagaaaacaagccatggctctacagactgataaatcgatgaatctgagcacggatctgcacaaggggcttaggtttcggttcatcaacagtcgtctcatatcatttgatttcctcaagagcgaaacagtgattgaccaagaaaacaatcaggctgacgattttcccgagaaacacgcagaaaatgagagagaaaatgccgttgttttgaaatttgaaacgaaagggtgcgagggaatgaatcaggtgcggtgcaggtcttcccgatcactgttttctgttaatttccttctggcccaaaaggcccaaaaagcccaaaagactccaagttattcaataaggagttttttttttcttttcttaaaaaaatgtttgtggaaaaaagggaaagtagggcaaggagggaggcggagagcaaaaccggaacactctcatcaacgagcgtctctctggaagctcacattaccgccacatagtctctgctcacaagtattgagagaaaagaaacctttgaaagcgatg

SEQ ID NO: 5873 - DNA, 3000 bp, Unknown
  misc_feature (1)..( 3000): cDNA_ID_1989655_gDNA_ID_1620823_Annot_ID_57822 3000 nt of promoter + ATG
ataatggcaacaatggcaaggttctgtagcctaaaaagggagtgatggcaacaaaaaaaactcaccagaacttaaggaacccatgcctacggagatgaagcgagatgaaattctttcctaagaatgtctggatgaatcgttgtgccgtcaccaaaatgagcctactgggttcgatcagtgttttacatttatggttgatgggtccaccaggctgcatcaccaaatcttgctccatatcagcatagaagacatcccctatggcgatcacaccatcatcggacttaaacttttccactacctcttgagaagtccgcttagttggcttctttatatcttcactccaaggagcctcaagcttcccaccaatggaaacccccaatcccttgagcttcttgatatgatcctcatcaacataacaaggctgtggcgacgagacgtaacagatgaatctgtcaatgtgagcattgttcttcttatcaatctccttgaactgatcaaaagaaatgacaacagttcttcccaagcacgtgttaatccgctctatatcaatcactttatcatactggtaatcaaacttagagcttggaatcacaagaactcgatccagtagcgcagcaaagaacatatgtttctctaaacaaatcaagtggttactcatttgacctgagagacagatagcaaataggaacttatctggtctcggcttccattcgatcgttttccggtccaacaacttctgatctacctttctacatatatcagcgttataagaaccagtgaaactatctgaaccagaagcagtgatagagtaattcccagtcctgtgtggtgaaagaagcacttcttcgatttccttattcactgaaatctgcttcagtagagcagctttcacattgtctattactacagaagaactaattgcattcgaagaattgaaattcgtacggttcaacagagagactagcgctagctgttgctgcctaagaagattcagagcttggagctcagattccttgacacggcttgacattggatcaagcttaaagctcgagaagaatgtacgagtatcagtaaataagaacagaagtccgacgaataaagttagagagacggcagcaacgacgtaacgcttgttaactgagattttccaacgattccgagctcgcgacaagatttcatcgatctgtaacgccgatctcggactcctgccaccgccgttagccatatttacggtcctggcgtcagggcgtagattgagatcgttgtctctggtgtcgttttgtgggattaaattgcggtggtcctcttcttcgtccgacgagttgcgcaccatcgccgagctggtaatcaatgggagattcttctcagagtcaaatctcaaaattcaaaaactcgaaattcgatagaaaatgcgaataaacagattaaattatgagaaaactgttatttaatacctcaacttacaaagaatggccaaattaaccgtgaactcgtgaaatggccgttttaactctcaacaaaaagttgacttctgttttaacattcaagtttgcgttgactcggcagcataattgacagacgttttagtccgttaaacatctgttactatagtcttacgacgtcgttttcgtgctaaagagaaatcaaaatcgagaatagaaattctcaaaacaaaatcaattaccctaaacccaaatcgaaacttaatcatgcccccaaaatcaaaatcgaaaccctaattgcttcaattcgttttctgaaatgccattagttagaaagaatggcgtcgttgtgaggattggatctccaatgcttcacgaatcagagaatttggtgggagatggagttgaagcaccaccgcgaggagaaagagatgaaattggagaagaagttgggggtgaaacgaatgtggtatctgagtcttgtggcggagaagacggagcacaagatgcagctaaagcaacgccggaaggagaagcagatcgaattggagaagaagctcgaggtcaagcgaatgtagtatcaaatgttgatgtggcagatgtggccgaagttcgttctccacttaggcgaagtaaacgaaggcaaatcagattggaagaagaagctcacgatgcagttgaaccagtgccggaaggagaagcaaatcaaattggagaagaagcttgaggtcagtccgttgatgtggcagatgcaaccgcagtttgttctccacttaggcgaagtagacgaacgcaaaatagattggaagaagaagttgatgttgcagttgaagaatcaactcgtcgtgaaattggacaagaggaagaggaagctcacgatgaagctcaagaatcaggcgttgctgtggcagatgcagtcgaagttcgtgctccacttagacgaagtaaacgaaggagaatcagagatgaagaagaggaggatttagaggctgaagttcctgctcttgatgaagacgatgactgtgcagtccaaggagatgaagactgcgatgaggttgatgatgcagtagatactaatagagaagaagatgatactgctggattaggtgtcgaagaagatggtaacttagacatggaaagagattttccagaggctaatggagaagaagaagctagtgacaatgacagcggagatgatatatgggatgaagacaagattccagatcctttgtcctctgacgatgaagatgatgatagagtagaggcagctcgaaatgatcttggtgatcctgagattttactagcattggagaagacttataactctcctgaagatttcaagcttgctcctttgatgtcttccctaaagacaaggtatgacattaaactttataaatctgaagctatggttgttgctgctaagtgtgtgtatgttagtgatgagggtgttgaatgtccgtggagagtccgttgctcttatgagaagagaaaacataagatgcaaatacgaacttattacaatgagcatacttgtgtgaggtcaggacattcgaagatg

SEQ ID NO: 5874 - DNA, 3000 bp, Unknown
  misc_feature (1)..( 3000): cDNA_ID_1988782_gDNA_ID_1620823_Annot_ID_57832 3000 nt of promoter + ATG
tctaaaactgatactcttttcaagtcctcttatcaataaaagttgttcagatttcatcctctattttcattttttttttctttttcatttcactcaaattttataaacaaaaacacaattcaccagaaacaagtcttagttaagtcaattgtccaaagcatgctgacgcaggcagtggcctaagcaactaacgagaatctcttttttcttcttctttgaaagcaactatcgaaaatctttataattaaataaagattagcgtacaacactcatttctcacataaatctgttgtcaaaataatataacttgtatttaacaaaaatatgtgaacattacattaaaaaaactgaatactgatcaatattaagaacctaaaaagtaaagagggaatttttgacttattattcgcaaaactcatagtattgatatgagtgacacccaaacaaaaaaatgatgtaatcaagtgcgccaaaaggaaagaaagaaaacaatccgacttaaagaagacaaacaacgaacaacaactgtagaactaatttaatacaacttttttggctttaagagcaagcaaaatgcgattcaaaacccctaaaaattaccaaacatattttctattcatcacacatatagacacaaaacagcaaacgagagaggtcgtagtgagagcttaatcaagagcaacaatggcagatgaggtgattcttctggatttctgggcgagtatgtttgggatgaggacaagaattgctctggcggagaaaagagttaagtacgatcacagagaagaagatctatggaataagagctccttgctcctcgagatgaacccggttcataagaaaattccggttctcatccacaatggtaaaccggtatgtgaatctctcattcagatcgagtacatagacgagacttggcccgacaataaccctctccttccctccgatccttacaagagagctcatgccaaattctgggccgacttcatcgacaaaaaggtagaaaatttacggtttggttttggtttattttgttgtttctaggttttggtttcggtttaagtattttggattggtttggttcggtttcttccgctagagtctcttgtgtaagttttttgtttttaccaacggatcaggtgaatgttacggcgagaaggatttgggcggtcaaaggtgaggagcaagaagcagccaaggagttaatcgaaatactcaagacgctagagtctgagcttggagacaaaaagtactttggagacgaaacttttgggtatgtagatatagctctcattggattccatagctggtttgcagtgtacgagaagtttggaaatgtcagtatcgaatctgagtgttcgaaattggttgcgtgggccaaaaggtgtttggagagagagagcgtcgctaaagccctgcctgagtcagagaaggtcattacattcatttccgaacgtaggaagaaacttgggttggagtaaatctctactttgttatgttgatctgttgttgctttgttctattttctttgaggtctatgtaatgcataataataccaatttcaatttgtgagattatatttccctttatgtaaactcgatttcaataaaagaaactttgttgtgatgttcattcaatggagaattgttggtacattaatctggttgccataacggcgcttgctctaataccaaaatcgacgtaaatatatgataaagattaaattcgttgattcaatgaataacctcacatgtgaacaagatttgacgatcgtgattcaaaaaatatgattaacttagttaaataaccaggagaaatgctaaaccggtcgaaaagaagaatacaagaatgaaacaaactaagtgaaaactttgagccaaagaaaaaaaaactgaagtgaaactaaaccgattagcaaaccccgattaagaactttttaaccagacacatctaaaaatcgttggatatttggcccaaagataagtcatttaatcatttgatttttgaagtattggaaaaaatgttaaaagcaaatagttattatatcttaccatgcaaactcattctacaccgtttatttgtttaatcgtttattggttattttatttttgtcgttagatgcacaaaagatacaagaatggggacaatgtgaaatgggaaatggatgccaaacacatataatgagatatgcatatactctatatttttaaaaaagaggtatgtataattgtatattaatcaattttattaggtttcagacagctaaaatttgtttttttgtttttttttcgtcatccttaaagtaaatatagtcctaaccaaagaaaagtaaccaataaaaagtttggaaaaagtgaaggtaaaaaggtatgatggcgtaagcagtggcataatcaattcaactctgtgaatcatgtggtcaatgtcttgaaccgcaaaacattaataaatgagttgttcaactaaataattgtatactactcgttaccaatctctaggtttaagctttctgatttaaaatttgtcacataaattttacaccaaaatatttattaattccacattttaatataaagtacgagaaactttacacgagaagaaatcaacatgaaatttcaacatataaattacaaacccccttgatagtttttttttggtatgtataaccccttgatagttgatatactcatattcaataacacaaagtattgaagctaaataatctctgacgacttttaaactaaagctaatgaaaagaaaatgtttaatcaaaagtttattcccttcatattaaaatgctttagtgcgatgagatttagtgtaatgggcacgttaatgcatttctgactttagcggcaagcaaatgcgatttcgtttgtagttttgagttattgtctcctctataaattgaccaaaaccttgttctcttcaccataatatacttagacacaaaacaaacaaacaaaaatatcttagtgagcttaatcaagaacagcaatg

SEQ ID NO: 5875 - DNA, 3000 bp, Unknown
  misc_feature (1)..( 3000): cDNA_ID_1989641_gDNA_ID_1620823_Annot_ID_57838 3000 nt of promoter + ATG
actatgtaataatgaatcttctaataattaattttactttttctttatttataaaacgtcacgtagaatatcagtaaaaaaaaatcgaaagcaattataaaaatcagaaaaggtactaaataacaaaatctgttattgtcaaatcaaaaacgaatggcaaaacacaagttctgtatctaatacattttctttcaaacaaataacaaatactagaaatatgattttaaaatgtgacaaaaaaaaaaagaaatatgattttaaaacaatttgtttttataaaaaaatggtaagcaagttgatgaataaatcagtcaagctcatcgacgaacgtggcatgatctcgtaatagacattcgtcacgtggcgtttagctatttgatcaaaacatgtcagacaaagtgggtcctgcattttgtacgattcatctcaaaaggtgatatcgagtctcacatctccaatcctgaccgttggtttataactcttattagacgactttcaataaaaactttaggtgggtccctcgtttttagggttgtactgtcaccacctttcagtttcagtgaacgctgcacgaattttaactacaattagacgactatttacatttcgatccataactattttattatcatattttagacactcaagtttttaaattgccaattattcgctctttcggattttttgtggatttgagatgatccctgcttcaatggaggaagctcaccagctggagtcgagatccgatgacctaagtcaacggagaagctactggagatggaggaagcaggattttttcccggaattctcttttcagagcttctctacctacaaatcagctctctccgccacttgtccacgcctcgccgatcgtcttctctctcgctcttccgatgcgtacgagctcgatgcagcccgccgcgaaagcgagaaccctatgcgtcgttgtctcacttggtgggacttgctctggcttagctttggttctgttgttggttcgggtgtgttcgtgatcacgggtcaggaggctcgagttggagctggtcctgctgttgttctctcctacgctatctctggtgtctctgcattgctctcagttctctgttatgctgagtttggagttgagattcctgtcgctggaggttctttctcttatcttagggttgaattgggggattttattgcctttattgctgctgggaatattcttcttgaggctatggttggtgctgctggattagggaggtcatggtcttcgtatctagctagtttggtcaagaatgattctgattattttcggattaaagtcgattcctttgctaaagggtttgatcttttggatccggttgctgttgcagtgcttttagttgctaatggtattgccatgactggaacaaagaggacttcttggttgaatttgattacttccatggtcactgtttgtattattgtgtttatcgtcgttgtggggtttactcattcaaaaacctcaaatttggttccttttttcccttatggagcgaaaggtgtggtgcaatctgctgcagttgtctactggtcatacactggttttgatatggtggctaacatggctgaagaaaccgagaaaccttccagagatattccaattggtttggttggttcgatgtctatgatcactgtggtttactgtttgatggctctggccttgactatgatggtgaaatacactgaaattgatgcgaatgcagcttattctgttgcttttgctcagattgggatgaaatgggcgaagtacttggttggtatatgcgctttaaagggaatgaccacaagcctgcttgttggctctctaggccaagctcggtacaccactcagattgctcggtctcatatgattcctccatggtttgctttggttcatccaaaaacaggaacccctatttatgctactctccttgtaaccatactcagttcaataatatccttcttcaccagcttagaggttttatcaagcgttttctcctttgctaccctcttcattttcatgctcgtggcagtagcattgcttgtgagacgttactacgtgaaggatgtcactcctgaggccggtttgttgaagtttcttggttttctgtttttgataattgcttcctccattggagtatcagcgctttggaactcaggcgttaaaggttggatcgcttacacagtgactggagttatttggtttataggcactttagggttggcattgcttccgaaatatcgtgttcctaaggtatggggagtcccactagttccgtggttgccatcgttttcaatcgccatgaatctattccttatcggatcactcggttatgtagcattcttgagattcattatctgcaccatggtgatgcttttgtactacctattcgttggtcttcatgcaacctatgatgtagctcatcagcctttggaggaagcaaagtttgagggagagagataaaagaatcgatcgtaacacttcactacgtttggtaaattgtataaattcccttgttttctgatgtgatttcaatattcttctattaaaatgtacaataatactatcgatcttgttttcgtgttttctcattcttttcatttttcaatgttgaaacttattaacttgttgaactctgttgtatttgtttctatcttggaaatttaaaattggagttgaataaggtgttctcagttctcacacctttttatttagctactttgtgattattatactttaatgacccgagctaccggtaacccgaatgcacgacccggttaacttcacccaaaattgaatacaacatgataactcaagcccaaaaaagcccatttaaccgatttataaaagcggtgcttcagacagatatgtgttataaggagaagccgaggttaaaatccaaagcgtaaaatcatagcgagaaatttccttattcctgtgattttgctgagaagaagaagaatctcgaggaggaagaagaaacaggcgacatg

SEQ ID NO: 5876 - DNA, 3000 bp, Unknown
  misc_feature (1)..( 3000): cDNA_ID_1989646_gDNA_ID_1620823_Annot_ID_57833 3000 nt of promoter + ATG
acaaattttgatatctataatgtcaagtgcggaccgggacatggaattagtattggaagcttaggaaaaaacaaagacgaaaagaatgttaatggtttaatggttagaaattcggtctttaccggtacgaccaacggtatacggatcaagacatgggaatcttcagcttcaacaatccgaattatcaatttagtgtatgagaatctacagatgataaatgttgaaaatcctatcggcattgatcaaaaatactgtccttacccgccatgcagcaatatggtaacttactatgcaagaaacaaatttctatcttcttagaatcttcatcgactttaaaattaacatgttagttcatgttttatcgcagggagattctcacattcagatccgaaacgtgacactaaagaacatttggggaacatcaaagaataaagtggctgtgaaatttcaatgtagcaaaacctttccttgcaaagatgttcagttaattgacattaacttaactcaccatggagtcgacggtcctgcaagtgcgttgtgtgagaacgttgatggatctgctactgggaagatggttcctccgcattgtctaagttgatccagtccaaacatagtcatgtactcatgttgtttattttttggttaacatataaataacattaatgatcataacaaacatggatatatctttaacttacatataattctcagatatgtttagttgttggttctgagttgtgacataacagcgatttcataaaagccaaaaatcaaataacgatgatgaaagggatctcttcagtttctcaatcgatcaattataatccatacatcgaattcaatcgaccgcagcttcagatcagtactgtgaatcccaatccagctcaatctcgattttcccgccctcgatccctccgtgttctctcactctccgccgatccatcggcaaatcggaatcctaaatcagccgttgacgcacacgcgccgccactggtggttgtgggatctgcgaacgccgatatctatgtggagatcgagagattacccaaggaaggggaaacgatttcggccaagacagggcaaacgctcgccggaggaaaaggcgcgaatcaggcggcgtgtggagcgaagctaatgtatccgacttacttcgttggtcgtttgggagaggacgcgcacgggaagctaatagctgaggcgttgggcgatgatgggtgtggggttcacttggactacgtgagatctgtgaataatgagccgacgggacacgcggtggtgatgcttcagtcggacggtcagaattcgatcattatcgttggtggtgcaaatatgaaagcttggcctgagattatgagcgatgatgatcttgagattgtgaggaatgctggtattgtgcttctgcaaagggagatcccagattccatcaatattcaagttgctaaggtccatttttttactttcttgagttagttacttcagtgagagttggtttagggtttagggaagctctgttgaatggatgcagctgctttaggttttgaaaactatgagaggttttggaatagggttatagagttgattatgtttgaaatatcatgttcgaagaaacttaggctgctggtgggttttattgcaggctgtgaagaaagcaggtgttccagtcatccttgatgtgggaggaatggatacgcctataccaaatgagctattggattccattgatatcttgagccccaatgaaactgagctcagtcgcttgacaggaatgccaactgaaacttttgaacagattagccaagctgttgcaaagtgccataagttggtaagtccctttcttgcacattattaactccaaattttggctaatccttgctgctactggactctttgaaaatgctggtttagtggcttttgggtttaaaaggtttaaggctatgttttcctcagggagttaagcaagttctagtaaaactcgggtccaaaggatctgcactattcatacaaggggaaaaaccaatccagcagtctatcataccggctgcacaagtggttgatactacaggagctggggatactttcactgcagcatttgcagtcgctatggtagagggcaagtcccatgaggaatgcttgagatttgctggtaataattagtgacataaatctggttttctaacccgtaattcagattagttttgtctcacttttttccgatgcctgcagctgcagctgcctctctttgtgtccaagtaaagggtgcaataccgagcatgcctgaccgaaaatctgttttgaagctccttaaatttagtatctaaaactgatactcttttcaagtcctcttatcaataaaagttgttcagatttcatcctctattttcattttttttttctttttcatttcactcaaattttataaacaaaaacacaattcaccagaaacaagtcttagttaagtcaattgtccaaagcatgctgacgcaggcagtggcctaagcaactaacgagaatctcttttttcttcttctttgaaagcaactatcgaaaatctttataattaaataaagattagcgtacaacactcatttctcacataaatctgttgtcaaaataatataacttgtatttaacaaaaatatgtgaacattacattaaaaaaactgaatactgatcaatattaagaacctaaaaagtaaagagggaatttttgacttattattcgcaaaactcatagtattgatatgagtgacacccaaacaaaaaaatgatgtaatcaagtgcgccaaaaggaaagaaagaaaacaatccgacttaaagaagacaaacaacgaacaacaactgtagaactaatttaatacaacttttttggctttaagagcaagcaaaatgcgattcaaaacccctaaaaattaccaaacatattttctattcatcacacatatagacacaaaacagcaaacgagagaggtcgtagtgagagcttaatcaagagcaacaatg

SEQ ID NO: 5877 - DNA, 3000 bp, Unknown
  misc_feature (1)..( 3000): cDNA_ID_1989634_gDNA_ID_1620823_Annot_ID_57848 3000 nt of promoter + ATG
ggctctttagtctaattaatggattcagcagccaaattactttagaataaaatccaactttatgtctgtgtaatgaataattaatggttgagtgtacaaaataatgaaaattgttgtgatctccaaaaaaaaataatgaaaatatgagttctcctgataccatttatatagagtctaaaatcacaagtatatatttagaagtaaatttcaaattaatctaacaatgaaacaaaaattcatttgcgtgaaccgctttctctacttctttagactgaactttataggtgagtgtgagcagtaattgtagttctatccattatatgcacaaataataggttagatttggcttttagctttgcctacatctcttttttttcttgtttcatccaaggagaagaaagcccccatggaagccaaagaagaaaccccgtggagctctattttagttccttctgttcaggagatggtgaaggataagatgatcacgaccgttcctcccagatatgttcggtatgatcaagacaaaactgaagtcgtcgtccatgattctggcctcatatccgagatccccatcatcgacatgaatcggttgtgttcttctaccgccgtggactctgaggttgagaaactcgactttgcttgcaaagaatatggatttttccaggcaaaatctcaaacttcactttttttacaaaattatctatgttagacctaacgtggagcttattacccttgtttccatgcaagtatcagaattaaatagattacgtttgatgaaattattcagaaaaaatcgtttcttacaactatgttaaagccaaaatggagcctaaaactttccgtttcaaatttatttatttggttatgtctttgtatggtccttaacagcttgtaaaccatggaatagacccaagtttcttggacaaaataaagtcagagattcaagatttcttcaaccttcccatggaagaaaaaaagaagttgtggcagacaccagcggtgatggaagggtttggacaagcttttgtggtttcagaagatcagaaactcgactgggcagatttattcttccttataatgcaacctgttcaattacgcaagcgtcacttgttccccaagctacctcttccctttaggttttgcatgcataaaaaaaagtgttaacattctcaactaacaccacaaagtctctctatttacattttggttaatgtttttcagggatacgttagatatgtattccactcgagtaaagagtatagctaagatcttactagcgaaaatggcgaaagccttgcagatcaagccagaggaggtagaagaaatatttggtgatgatatgatgcagagtatgaggatgaactactatcccccgtgtccacaacctaatctggttacgggtctaattccgcattccgatgcagtcgggctcaccatacttttgcaggtgaatgaagttgacggtctccaaatcaagaaaaatggcaagtggttttttgtcaaacctctccaaaatgctttcattgtcaatgttggggacgtgttagaggtaagccatactatatagatgttttgatgaatttggtcgggctaaaccctgatagactttatggcagctaatcgctagtcataaatattttgatgatgggtgttgggccgtttgtaatgcagatcataacgaacgggacataccgaagcatcgagcaccgggcaatggtgaacttggagaaagagaggctctccattgcgacatttcacaacacgggaatggataaagaaattggtccggcgagaagccttgttcaaagacaagaggctgcaaagtttagaagcctgaaaactaaagactacttgaatggcttgttttcccgtgaactcaaaggaaaggcttatcttgatgctatgagaattgaagggaagtgatatcttgtttcccaagaaattctgttttctccaactggtcactgtcgtgttcatattctgtttttccttctctcttatgtctttggttcaaatctgttaaagaaaaaaacgcctgtgaataatacttaataagctcgttcgtcttcgtcaacatacaaaaatatcaactacgtagtaataccacaccttatttatttagacacatacagttcttgtttttcttttctctttgttatatatttcgatatgccctttattttttattctttttataaacatcatgaatgacaacacatgtgtgtccgtttcgctttccggccgtttttacaccgtcacaccattcacaatcccaatgttaaagacacatgaacgttgggataaatatttctttgatttaacggaaaaaaaaattgtacaatgcaatatattattataaatgtatatacaaagatatatatattatatatatatataacgacacatatatatatatatatatatatatatatatatgtcgaggtaaatttgaacgatatataaggggttggtaaaaaaaccaaaaaccaaaaagtgatttttggattttggtttatagttttcagattgtgtattaaaaaaaatgaaaaactaaaaaaggttttataaaaagtcaagtcactttaagaaaattaaaaaccaataaaacataaattttagattttctttaaaatttgacaaaactatcaaaatctaggtttcctattttttagaaaacacactttttcacaatcttggttcggtataaagtagatttttagaaaaactaaaaccaaaaacaacatcaaaatctacaaccattcaaagtatcatgtatcaatttacctactttgggtctggggtcatactcataccatatgtcttttatcatctgtcctttatttatattttcttccatcagtcagtttaaatcaatcattttcttcaactatttaagtcaatccaatcaatcatttaggaaaaatacgtatacgtttttaataccacctacaaaagaaccgtgtccaaacttttgtttcgtccaggaaagaagccgacatg

SEQ ID NO: 5878 - DNA, 3000 bp, Unknown
  misc_feature (1)..( 3000): cDNA_ID_1988788_gDNA_ID_1620823_Annot_ID_57847 3000 nt of promoter + ATG
aagatatatatattatatatatatataacgacacatatatatatatatatatatatatatatatatgtcgaggtaaatttgaacgatatataaggggttggtaaaaaaaccaaaaaccaaaaagtgatttttggattttggtttatagttttcagattgtgtattaaaaaaaatgaaaaactaaaaaaggttttataaaaagtcaagtcactttaagaaaattaaaaaccaataaaacataaattttagattttctttaaaatttgacaaaactatcaaaatctaggtttcctattttttagaaaacacactttttcacaatcttggttcggtataaagtagatttttagaaaaactaaaaccaaaaacaacatcaaaatctacaaccattcaaagtatcatgtatcaatttacctactttgggtctggggtcatactcataccatatgtcttttatcatctgtcctttatttatattttcttccatcagtcagtttaaatcaatcattttcttcaactatttaagtcaatccaatcaatcatttaggaaaaatacgtatacgtttttaataccacctacaaaagaaccgtgtccaaacttttgtttcgtccaggaaagaagccgacatggaagcaaaaggggcagcacagtggagctctatcctagttccatccgttcaagagatggttaaggagaagacgatcacgaccgttcctcctaggtacgtccggtctgatcaagacaaaactgaagtcgatgatgattttgatgtgaaaattgagatcccaatcatcgatatgaagcgtttgtgttcttcaaccaccatggattctgaggttgagaaactcgacttcgcttgcaaagagtggggatttttccaggtaaattctccaactacaaatataactcttctataaagcagcccatcgcgtctttctttattaacataatatacgtcacatggagcttatattagtttttactatttttgattgaggaaaataggcagataaaatcgtttcttacaaaacaacctctgttttttttaccatgttaaacacaaattggagccgaacactctatgtttcaaatgttattattttggttaatggttatgacttatggttatccacagcttgtaaaccatggaatagactcaagtttcttggacaaagtaaagtcagagattcaagatttcttcaaccttcccatggaagaaaagaagaagttctggcagcgaccagatgagatagaaggtttcggacaagcttttgtggtttcagaagatcagaaactagattgggcagacttgttcttccataccgtgcaaccagttgaattacgcaagcctcacttgttccccaagctacctcttccctttaggttttgttctaattcaacattttatcaactagctccacaaagtattgctctgtataatattggttttatgtttctgtagagatacactggagatgtattcttctgaagtgcagagcgtagctaagatcttaatagcgaaaatggcaagagccctagagatcaaaccagaggaactggaaaagttgtttgatgatgttgattcggttcaaagtatgaggatgaattactacccaccatgcccacaaccagatcaggttattggtctaaccccgcattctgattcggtcggactcactgtactgatgcaagtgaatgacgttgaaggtctccaaatcaagaaagatgggaaatgggttcctgttaaacccctcccaaatgctttcattgtcaatattggagacgtcttagaggtaaagtttaatcaaatacatagggtaatagatcattgtaatttcatcatgacgtttgtttgggcttaatgtagatcataactaatgggacataccgaagcatagagcatcgcggagttgtgaattcagagaaagagaggctctctattgcaacgtttcacaatgtgggaatgtataaagaagttggtcctgcaaaaagcctagttgaaagacaaaaggttgcaagattcaaaaggctgaccatgaaagagtataacgatggtttgttctctcgtactctcgacggaaaagcttatctagatgctttgagaatctaaagagagcaatgccttgtcgcccactactctgtttctctgttttcttgatttatgcaataaaacaatctctataatcttatcttcattgtctctctatttgcttcatttcgttaaagacaaaaatctcctgtagagaatgcttctacgtattgctacaataagacaataagtttgttcttagcaaaaaaaaggacaataagtttgttaaagtttcttgacacgttcgttgttgctcaaagatatacctaataatatgatcacatgattcacatactctgttatcttagaagtctatggtttgtcgcaaaatccaattttaattttcgactcctaaatttagtaacttttgtgttgttagcgtgcgctgtgagaaaagacttgctcacgtacaagatattttagataagttaagaaacctcaaacgtaagacatacattgcacttaacgtattaccaacctcttgctcaatcttgtggataacagcaacagtaacgaatgtcgattttattcttaaacatgtatttccctaaaaatggacaaacaacaataacatagaataaaaattatggttaattagcttccacaattttttaaaaagaaacaatctgttgacaaaaaaaataattaatttatagatttgcttgggatcaattagctcgcatgtggattttcatatatatacaataccatatgaagccaaatatattataaagaaagaaatcttttttagattttgagctctggaatggagaaaagtatcaatggatcatgcagactcatcaagagactcgtgattatactttcttgtctttcatattcctttgttcgatcagactttacagagagaacaaatatcaattatgtatcagctgtgggagatcccgggatg

SEQ ID NO: 5879 - DNA, 3000 bp, Unknown
  misc_feature (1)..( 3000): cDNA_ID_3078792_gDNA_ID_1620823_Annot_ID_57845 3000 nt of promoter + ATG
ataaaccgtgcaacttattgaacggatgtgcttctttcaagttcaaattatctcaggtggtgattataaatctaggccatcggaatgggatttcacattcttgttagaatttttttgtctatgctaaaaggcattgaaggatccttgttttcttttgttttgtagctttcttccaagagtgataagaggttgttctgcatcaaattcgaaataccagaagtgaaggccaattatcctttcctcgaaactgtcaccaaccaaatccgttgcatttcgagaaaccgtgattctgtttcctctatgaaacggatcagattaggagaagaaaaggtttctgagagtaaggtggataatccaatttctctgagttacgttttgttttgctttgtatccatatcccacttactgttattctgcattgttgttgctctcgagttagattgtgaatggaaatggtacgagtatggaatggaggcctcagaaccacgaagaagataactcttcaactgattccgaaaacactgaaatgagagactcgactgctttcaggagatattcaatcccagactggattattttcaaatactgccttggaaacttaacagagagagctcttcttctgaaggaaatcacaaacaattcatcagacgaagaagtctcggaatttgcagatcaagtttctctctattccggatgctcccaccacgggtaaagaaatcaaattaaactcacacctgcctcaaataaaatagaacactaatcttccaaattttccagctatcaaatcaaaatggcaagaaaactgatagcagaaggaacaaatgcgtggaatctgatctctcggaactatcgacatgttcattgggacaatgtggtaattgagattgaagaacatttcatgagaatagctaaatgcagcagtagatctctcactcaccaggtcttgtctctttctcttctcatattgcttgaactttcaccaagatcaaagtcttgatcttttgtatttgtgattctgacatgaaattgtaatcaggattttgaccttctaagaaggatatgtggatgctatgaatacataactcaagagaattttgagacaatgtggtgttggttgttccctgttgcttcggctgtatcaagggggttgattaatggaatgtggcgctctgcttcgcctaaatggatagaagggtttgtgactaaagaagaggcagaacgttcgcttcagaatcaagtaccgggcactttcattctcaggttccctacttcaagaagctggccacatcctgacgctggttccgtggttgtgacttatgtcggccatgatttagttattcatcatagattactcacaatcaaccacatctgcgagtaagtaaacctctttatctcctttttttttcccctcagtgtctgtcttgtgacaattgtttttgtttttagttctagtgaaaggtatacagatgcaaaacagttgcaagatatgcttttggcggaacctgagctatctcggcttggaaggtgagtgaggaagtgaaaaaatttagtttttgttgaagcaaagagagatcaaattgaagatcttaaattgcttattttatttattttggtttttgttgcatttttcaggattataagaggcatctgaatctaatcaacagactcaactcaacaaagtagagaagcatcgactgttattgaggtttattgtacagatagatttgctaagtctaagtattaactgatactaacttttgtaaagctcagtgatttaaattaggtggaaaggatttttattgtaagacttaagtatatttgtttatctaaaatcaattaccgacaagaaagaaaggagttgcgatttttgcttcttctgctcagtttttatatttgtgtggcccatttatgttccaactacatatttgcttggtccctaatcccttattagaggttaattatggtaatgttttttttaccaagaaataaataaaataattatggtaatgtttttctttcatatttttgttttgttatgtactaattaaatttaaaagctcttagaaaatttattcaaccatttttgttaatcttctcatatatgatgacttattgtgattggtaatacatggaatgagaataatatacagaaattgtaaattaagtcataacagtattattttgattcacaatggagttggagaaatgaattatcaatataaaaaatcatggtttcacgtaatttgatgatttgtttttaaaatactccctagagcctaattattgtaggtaaaaaacttattagtataaaatttgtgagatctggattaatgatattataattgtcttgaaaccagaaaaatggatattctctaatctcaaaatatttgatacgagttagatgacggaccaatcggtaggaaacacgtggtgacatttcagcttctgattacaacgatggacttttttttccctctctctctaatttgtatattgaattaaaaaagaaaacggacacacacacacacacacaaatctgaaatctctctcgtccgccaaaggtcgagttttgagagcgagttcttacttctgatgtggttttgtctcgtccacccaaagaaaatcaacacaaaaaaaaaaagggatcgattcacaaacttataaatttcttgtcttttttattttttatttttctgaaaatttgccatacacacacccaatctctctctcgtcagccaaaaagaaaaaaacttaacattggactctcagtttccgaagattcttctctttggactctcagtttctgaaacttattattagccgtctttttttggtttgggtttgcctaaaagttgtcgtcacttgtggattttggtctgagaaatgatgatgtcatgtcggaatatagacttgggtacgagtgttcttgatcattcttgtagctcttcttcaacaagtcgtcgattcttgtttggcaattcttcgaagaccgtttgtatg

SEQ ID NO: 5880 - DNA, 3000 bp, Unknown
  misc_feature (1)..( 3000): cDNA_ID_1989637_gDNA_ID_1620823_Annot_ID_57844 3000 nt of promoter + ATG
tttagtagacttctcaaactgacctatatcactgcctaaagtattcttctttcctccctttgcaccaccaccctcttgacctctcttctccacctttgccttccctctcatctttgcccgatcagctatcttcttccccaatgcacccggtaaaagattgtcctcatcatcaaaaccattcgcattaaaccctaaccctaaacctgagctaccaatacccaatccacctctaacttcaacatcctcatcaatcatatcattatcttcgattttatccctatctttctcatcattatgttctctagaatccttatcaatctcttgattcggcataaccgtacctgtagatacaaaattgacaggcttggttaagtctgctttccttcccgaatcacgatccttacgcctcttcctacgactgccgccgccgccagaatcatcggaatccgaatcgctctcagcgaagattccataagtagcgtcgtttttggtttgtttccgtttctccttcctcttctggtatacgaactcgtcaccttcccatcgacctccttcgtagtcattatccatactgaatctctccatatcttgatactcatccatggcgaagaaactagatctgaaactctgcgaattttccaaactatcggaggtttttggatttacgactgcaaatcgccgacgtcgccgtgtataatcggagggaaaggattaaccgacttgggctttataaataataaaggcccatttatttttgaattatagcccatttatttgtaaacttggctataacaatcagtcacctcatcttcttcattttggactcttggccaaccttatgtcgttttatcgcatctgttacaataaaacgcaaaaggtgatttttttttcaggtaaaaactatgagtttcgttatctaaccataactcaatagatactacgataactaaactaattaaaagggataaaataaacaaaaacacagttttggaaaagaaaacaaaatagaacccaccaaaacagatatagtaggttagaagtataacttataaggttaaccaaattgctcattataaccaaaaacaaaaaattgtgaacccaaaaattacgttaagaaaacgtagattccattatatcatggagttttgagtcttcaatccacatactttcgaaagtaacaaatttttccattaattctactaagatttttagggtgttgtttttgatgttttaagtttttcttattttttgtcttaatttctcctcctcctatctctcttattccaatttcataattatatatttttgcatgactagattattagaaaaaattgtttctgttttatgttatatataattaatctttctctttctgataaaatcataaaagtcaataattttttggtttaaacagtaatataaagtcatgagattttaggaacactttgttttctctaactaaccaacttttcattttgcaacatagaatagaagcattaatatattctttctggaataaatacaacaaaatccccttatttcttgtacaaatcgcataaatatgggatttgaagagtacaacaacacataaagaaacgtcccacctttttagatgttataacaaagaaaagtcggttgtatgactcggacttttctagttggtttttcaaaaatgttacgtaggttttgacgtcatatctcattatttgaaactattttccttggaatggttcactaatagctaaatgtaccattcttgttacattttttaaattagcagctaaaagtgtatacaaacttttatatatgtcgtcatttaattgcacacattggttatacaatgcaaattatttccttaaccatgtctagacttttttacttctatcaatttaattatatacttttcgtatctttatgtacataaaataagtttcaggtagtaatatcagcaaaaaataaggacttaaatgaatacgtctgataaataacttacgggatatgttatagcttcgcgacaaaaaaaaaatcctcgaagcctatagtctattaattacttgttgaacaaaacaattagtacgtactagctaatgaaataagcttacgttacaaattagtataataataaaccaacaacgcccgtagccgttaggtctattttgtcctaggtggaaaatttagtaaatgcctaatgaccctagtctacgcgtaattgcatttatatgaattattaaacttcaaaattaattgatatggttggacgaacattatcttatgaattattattatatcatatatcacatgcgtttcgcaagagagttgacattgctattcatcgtctccaaagaacaacgccacctggttccatatttattgtccccaatttaaatttaatttaatcgtgatcattgtcttagttacataaatgttaaggttgatttcgagttatacgtcaattattcaatggaaacttgtttaattatataagttgagacgaactctcctttctctacctgtttaaagataactacgatacgaagacgcaaacaaaaaaatgcgtaagaaagtaattatggaagcatcatgatcagcatatacgtactagtagatatatgtatatataaaaagataaaatactaaatactctcatgcaataaagccacatgcatgtagcgtaagggaaggaagacaaaattaaatttttggaaataaacaccaaagaacttgttgttataaattcattgccagttgcacatacagcgatttattacatatatatcccctctctctctctctctatagtctctctataaacaagttttttatcacatttcttttctacagtattttctctattcacgcatatatatagatatccagctgcctccaacatatatagtcaactgatgaaattataagcatcatcattatagttttgtctcctttttttcttcttcttttctttttctttctagctactctcttcttcatagctagatcaag

SEQ ID NO: 5881 - DNA, 3000 bp, Unknown
  misc_feature (1)..( 3000): cDNA_ID_3443592_gDNA_ID_1620823_Annot_ID_57841 3000 nt of promoter + ATG
gaaagttttgaaaatataatttatgaagaaacatgtggttagggtataataaatattaaatgcatccgtcgaagcttcgagttcttggaaatgattatgaaattaactaatgttctttatcatccatgaatatgatttatcatcttcaatcatttttatacaattaggcaatggaaactataatacagaacagagaattttatcagtagtctgtcactataagcatttcgttgtccttgtttttaattttaaatatctatttcaagttttttaattgtcacttttgtcaactaacaacatcgttgttaaactttttattactttctttgagtggaatttttttctcttcttctttcacgctaagtagaggcagcctttaattctcagcctccaaagaaacgtaaaccttgaaaattaaacttaatcaagaaatatatgcaccacaaattaaacaatataactttgaactttccacaaatttgtgcaccaccaccattcaatttacatatgctttttgcagactgtataatttctttcatatgatacacatgaaacaaaaacaaaaatctggattccgcataagatggatactctcgatctatggatttaaccatttacaagtaggaatgatcataagacaaaattgcaaaagcaagaggagaattgtgtaatggaaatagaagccaacctttgtttcaacaagcacaaatatcctcatgagagcaatcttggccaccatcatcatcatcagtggagtcagataattcttggttactagagactgtaatgatcattaccttctcatctggtttagcttcctctggttcaataagattcttcctgagatcactgaaatcctggttttcatctttcatggagctctgaagaatggagaagcaagtgaaacaagaaaacactaaattgattgcaaacaaggagatgcagaagatcacgacgatacaattgtaagcatccattcttcttggaaactgagcatgatggttgttggtttacaacaaaaaccagaatcgttcaaatggagaaatcaaaagtattattcacttgaaaagtgatttgattctctggtcccctacacagatatataagaagaaagctcaaatctgaatgtttggtgagcttacaacaacaatctcttataagaagcaaacaaaaaggataaagaaaacaatattatttttttgggtctgcggtggagaagatttttcaacagataaaggtggcaagcatgacaaaagcatttgtctctttctttcttttcccaccaaattcatataaataaagatattatgttttgctaaaaaagtacatattactaaattctaaacaacttcaaataataagcaacataatatgaaagggagagatcatcttctcttatatatgaattgcgttaattagtattgcagagtatttgattttacctgcacattttcaatcagagagtcgcaatagcatctgaagagaccatcaccacctgtctatatcagtgaaaggttcagggtttgcgatttaaatctgaagtatgacaaaaaaccatttgtttataaagattatctgatgttagcattcaatatgtagcttgagtgtggataataatctattaaggatttgaaggtttcttggtttgaagtaaacatcaaagaggccttactacgtacaaaacttcatttaaaaagacatagtttgtggcaatccgaattagtaaactagacttgttcttcgacttatctaattcataaataatttatcacaataagctcacaacttatcattgactacttgcattatgcaatctagaaatactaaggattataaagaacaatttgttgaagacagctatcaaatttaaaagccatgaacaacaaaatatagaatacaaaaacactaatatatttttcccaattcgtacaacaagaaacctataatattgttttaaagacatctttgcatcaacacacaattgacatttgatcaaccaagtcaactcttttttaaaaacatggcaagatgatgatacaagaacatgtcaaataagttctacaaaataccaaaaaaaaaacaatgcagaaaaagagaattcagatgagtaaggcagagagatcatgttgaaacagagaaccacctgcagctaatagctgggcagtagttagtctcatattcagccactactgtttcatcataatcccaaattgagctaaacaataaaaatttcaaaagcttgaaaaaatcatctcttttaaactcatgcataaaaagttagatattgaaacagaaatccttcgagaaaagtaaaacacgaaaagatcccaaagataaattaaaaaatgacaaagttgctttaactcataaagaacagatatacccgaatgtcaaaactcgtcgaagaagccaaaatttcctttcagccatttcgtcgaacacttgatgggcatttttcaacagagaggatgatatgatgatgacctggggcagtttcgagaattccttttgacttgggtaattagttttgttgttaacaaaggtacataatcagtttccgacccggaccatttcgggtcgggtggagtgtgtatttctttatttacaactgttcaaaatagttttgttgtcagacatattcctaactatttattacaaaatgatccctacagtttcatttattatgatttgatccatgtagggtgattttatataacataatcaccatttagtttggttcattacaaatattattttttcttctggttcttaaatgtgtgtacccgtggcaatttcaaactcagaactcatgacaaacggttcataggcacacacatatacaagaacaaaaaaatgacaaaaaggtcgaaacttttttacacacacacaaaacctatccgaagatgaaccacacattcacacgtaacaaataatctatattaccggtaaaaggccgcgtaaacaaagaaagaagtaagctacctagataaaaccgccatg

SEQ ID NO: 5882 - DNA, 3000 bp, Unknown
  misc_feature (1)..( 3000): cDNA_ID_1989640_gDNA_ID_1620823_Annot_ID_57840 3000 nt of promoter + ATG
atatctctggaaggtttctcggtttcttcagccatgttagccaccatatcaaaaccagtgtatgaccagtagacaactgcagcagattgcaccacacctttcgctccataagggaaaaaaggaaccaaatttgaggtttttgaatgagtaaaccccacaacgacgataaacacaataatacaaacagtgaccatggaagtaatcaaattcaaccaagaagtcctctttgttccagtcatggcaataccattagcaactaaaagcactgcaacagcaaccggatccaaaagatcaaaccctttagcaaaggaatcgactttaatccgaaaataatcagaatcattcttgaccaaactagctagatacgaagaccatgacctccctaatccagcagcaccaaccatagcctcaagaagaatattcccagcagcaataaaggcaataaaatcccccaattcaaccctaagataagagaaagaacctccagcgacaggaatctcaactccaaactcagcataacagagaactgagagcaatgcagagacaccagagatagcgtaggagagaacaacagcaggaccagctccaactcgagcctcctgacccgtgatcacgaacacacccgaaccaacaacagaaccaaagctaagccagagcaagtcccaccaagtgagacaacgacgcatagggttctcgctttcgcggcgggctgcatcgagctcgtacgcatcggaagagcgagagagaagacgatcggcgaggcgtggacaagtggcggagagagctgatttgtaggtagagaagctctgaaaagagaattccgggaaaaaatcctgcttcctccatctccagtagcttctccgttgacttaggtcatcggatctcgactccagctggtgagcttcctccattgaagcagggatcatctcaaatccacaaaaaatccgaaagagcgaataattggcaatttaaaaacttgagtgtctaaaatatgataataaaatagttatggatcgaaatgtaaatagtcgtctaattgtagttaaaattcgtgcagcgttcactgaaactgaaaggtggtgacagtacaaccctaaaaacgagggacccacctaaagtttttattgaaagtcgtctaataagagttataaaccaacggtcaggattggagatgtgagactcgatatcaccttttgagatgaatcgtacaaaatgcaggacccactttgtctgacatgttttgatcaaatagctaaacgccacgtgacgaatgtctattacgagatcatgccacgttcgtcgatgagcttgactgatttattcatcaacttgcttaccatttttttataaaaacaaattgttttaaaatcatatttctttttttttttgtcacattttaaaatcatatttctagtatttgttatttgtttgaaagaaaatgtattagatacagaacttgtgttttgccattcgtttttgatttgacaataacagattttgttatttagtaccttttctgatttttataattgctttcgatttttttttactgatattctacgtgacgttttataaataaagaaaaagtaaaattaattattagaagattcattattacatagtttcagatttcgtcaacagtcattttcatactttataaaacttacatgttcctgtccaaaggtatcaaggtaaaaatcccataataaaaatattactgttaatgtgacatattattttaggacaatgaaagactatttttatggagtatagaattcctttctggtattttgaataggaaaaaatcaactacatttaataattttatcaatttgcttacataattacgtgtgataaaataatagtattccggaatttattaaatgtctacctatattttggttattacccaaaatgagcttataaaattattattaataatctactttctatatttttggttaattattagtttatttaaaaacagcatcctgaaggacggagagagacagagtatgcgaggagtgtgaaaacgaagagcataaacaacacgggacgaggagagagaaactagtgtgttttagaaagaagaaagagagagatagacaaagagactgtttgtgtcttcttacccattcgaggaatcaaagcatctatttccgagctctcaagacgacgagaagctaaaagataaggctgaagaaatttagggttttttcttccttttgtattcagctcgttaattaaggtatgttcccaaattcttattcttaaagttcggctctttcctttttcttccgacttgtgtcttagttttttttttcaatcgtggtcaaaatttgttcttgagctactctgttataagggtttgtgggtactggaatctttgattcgagagcaatggagactttcaagcacctcagattttatggttagagaagtttttttttttgagctgctctgtagaataatgtgcttaggtctgtacggatttggggtaactagttggatcgcgagtgtttctcaccaggtccttggaaaaggatttgttttatacctgaaatttgggatttttcagactcatcttcaagtactttgctttgaatcggggatttagcagacttgggttcttcagtgagatgctttattcagttttgggggtttgttagatttgagagcttaagagataatttcttgttgcttttgttgaaaaactatgaatggagactagatttaattgggcttcccttggaaaccatcttgagctttattgaatctgtgtataatatgatggaataatgagagtataaactgaactcattctattggtatttgtaaatgcagggctatccatcttccgagttcttcagtagcttcacaagctggacctgaaaatagatcttggcgcatatcaggagtgtgattatggttatctgaattcatgtaatttgaagggattttcacgagctgtgatcgggtcatgaatgcgtgtctgaggac

SEQ ID NO: 5883 - DNA, 3000 bp, Unknown
  misc_feature (1)..( 3000): cDNA_ID_1989647_gDNA_ID_1620823_Annot_ID_57831 3000 nt of promoter + ATG
cacttcttccttctgatccttaccaaagagctcaggccaaattttggggagatttcattgataagaaggtaatctatcttccaaaaataagcttaaaaatcaaacccttcttaggcaagacatagacgttaatatttcgtataatgtgcttaggtgtatgcttcagcgaggttgatttggggagctaaaggcgaagagcatgaggcggggaagaaggagttcatcgagatactcaagacactagagtctgagcttggagacaagacttactttggaggtgaaacattcggttatgttgatatagctctcattggattttacagttggtttgaagcgtatgagaagtttgggagtttcagcattgaagccgagtgtccaaaactgattgcttggggtaaaaggtgtgtggagagagagagtgtggctaagtctcttcctgattcggagaagatcattaagttcgttcctgagctaaggaaaaaacttgggatcgaaatcgaatagattctacgctgatatgtttttatgtttctgtttgtgttgctgtttctgctctgtttcatgttctgtttcttccttgtttcggaaatctttaagataatgtcatcaaaataatacaaatatttacttgaaaattcggttggggtggttaagcatgcgtaatacgttgcattagcttcaattttttagatcttcattgcgatgataagtctagtaaaccgaattaaaccagtaccaagaaaatccaatccaaaatctaaaacaatcgatttgttttattttttctttccccttactaattactattatagtattatcaaaacaaagcgtcaaagaaaaaaaaaactaacaaaccgactacattgttgattttattaaaatagattttggtggagtgccaaatctgaataaattatcgaggctgtactaaaccaaaactaatgagtaatgacaattacaatttgtaatctttgtttgatagtcatagaccaaatcaactaatttcaaacattggactgaatcctttataatatagcccatccgaatatccaaaacataatgggcttttgggcccaaaaacaaaatcagtgtgttgagtttagccgtgatagtctatttacttgggtcttagtgggctttaaagtttaattgtactattatatttttcgaaccaataattggaatcgaatctggaggaaaacaagtttacgttgtagtttgtacacccaagtcccaagtaccaataaccatccgactaccgttgctggattatgtttatgtaggttatgtttctgttttctattgctctgtttttttttttagttttgccttttttgtaggttatatgtttctaaatgataagaactaactctgaagttgttttagtgtggactgtgccactgtggagcgcgtttgttgtgttgtgttgtgctgcgctatcatcagtctcggattcaatcattcaatggtttttaggttttctaataaagaatatcgtcagtggtgcattaggaaggggaatctaaactcaaaaccttctacgttacctagaaggttagctcgagcctcttccacgcatgatcagatttgaaaaccatattaaatatttgtagtaaagacaatttaaacgtggttcgaaaaatcattaagtattcagcctctttttggtgatcagtaatcagtttattaaaataccacgtgaaacttgaaaatcaaatactacctgtcttagcctggaataacaaatgtcaaatttgtctatgaactatgaagagaaggtctaattgagtaaattgtattgcagccaaaaattatttatttagaaaactattaacccttttcgttgtcctgaaaaattgagtctccagacatcatcttacaaaagtgaacaaccaaaagatatgttttcactgtacttgtaagctcttagttactgttaaaagagttttccaattcaaatttttttttttttgccatacaattcaaatctattttgttagtattaaaattataataggcttatcaattcaaaatattttgtcaaatcattctaaaataaaaaagttttttcaaagatattttgaattgaatattagtgaattccactttcttgatgtaatatgtaacgaataaatattattagttgttgaaacgaataaaaacaaataaaaacgagtgagagtattatttaaaattttaaaacatgtgacttgacaatacaataatttatacataatcaaataaccgatgcatcttgattagcattaggtaaagataatgtattcaattgtgttaaataagtttacccttttttgttaaagttttggaattaagtaaaagagatataagtagcagagaaataccaaaaaaagaaaaaaaaaagctaactacaacgcaacacaagcataacaaatttgtgtgatttcctcagattcaaacttaacaaaaagtttgaatcttcaataccgttcttaccacgagcaaatacagtttctttgaagactaacacaaaaaatgggactggtacagcggattcaatcatacaccccagtactatcctatcatgcgtttttttactttaaacgtcattttagtagactatattatggtacggtcaagctttatcaccctcctttttatggaacaaaataaaacacttcccaagaagaaagcttataaaaatcccaataatacagtcagtactgatatcttcttccaaatcaagatattcgttgacaggtaaggaaatcacatttcgatacaatagagattagagggatataataataaagaaataacaatatcatggcctaaacgtgaacaataaaaaataatccacatattctataaggaaaaaaaaaaaaaatagaacatgcgacgtggtactctataaatccccccaaaaccgcaacctctatcatcctcatctacatttcaataaacacaaagagttgaaaacattaaatcgatatatcagaactaaaccggatctgaaaaatg

SEQ ID NO: 5884 - DNA, 3000 bp, Unknown
  misc_feature (1)..( 3000): cDNA_ID_1989653_gDNA_ID_1620823_Annot_ID_57824 3000 nt of promoter + ATG
tcctgtgggtattggcccgtcgagactgttgttcaccacgttgaaataagacatataatggaggcttgttagcgaccaaggaattctaccagataagtgattgttggacaggtcaagcctctctaagctggtgagtttcgacaactcatgtgggatgatgccagacaaatagttatgagaaagctcgaggacatgaagaacctttaactggccaacttcgatcggtatacttcctttcaggttattccttcttatgtagatcccaggtgggaggctaaacagctgattgtattgctgatgagttgtaacattattgggactgacaaaaactggcagctttagatagttcctttctgttgcgtcgtaggccttttgggacatcagagcctttagttggaataaatccttcggcagctctcctgaaagaagattttctgagagatcaatatagaaaaggtggggaaaagttcccaaccaaccaggaattgaccctacaagctggttgtgggacaaatctatgactgctaagctcttcaatttgattagccaagctggtatttcacctctcagtccagatccaccgctagcaaatatttggagattagggaatccatctgaggaaatcaagtctttgtcgcttggaaatgtttcgttgtaaaaattctttcctatgaggagagtggacagattcctgcagccctgcagaattccaagagcgcctgtaatgttcatcagtttattgtctgaaagagacaagatcgatagagattcaagttccagtacgtgaggagatatctgtcctgttaacttattgcttgcaaatctcatcgctgatagagatttgcaggagtgaaccctccaagggaaatcaccgctgaagctattgtttccgagatctagaatgctaaggctctgaaagcgggaaaagtcaagctctgataaggttccttccagccgattaagcctcagattcaacttgacgagattagtacaatttgcaagagaaggcgggactgtaccagtgatgttattgatatggagttggaggctttgcaggcgagagagctgacctatgtccattggtatttctcctccaaggtgattggagtacagctcgagcgattttagttttgtgaggtgggtgatgtcatcattgatctttccagaaagatgattgacgggtagaaagagttgctcgagctccgaaagattgtatatgtcacttgggatttcaccagagatattgttgaagcctgcttgtagaacacttagcttcaaacatctccctagtccttgcggaatattaccggtaaaatcattgtaggagaaatccagtttgctgagctgcggtgaactcttgcacataaacgaagggattgagcctgtgaagctgttcttgctgacattgaaactgattaaatcgaaagttccttgcataaaaatagaactagggaggatttcgccttggagaaaattgcttgacagatcaactatccgaattgggaaacatctgttgcttccatttctaaatgtttgttcaactggcaactcaccatcgaggctgttgtaactaagatcaagaactttgagctgatcaagggctgagagaaagccagatgggagatgaccggagagacggttatgagaaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagcccagacataacaaaattagacttgtcgtacatctttaatattttttttatctgtttctttgtcctgacgctttcattattcctgtgatcaattttctcataccattggtccatcgttaatcctttctcaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtatggccgaggatttggacaagccattgctggatcctgatactttcaacagaaaaggaattgatttggtaaatgttccttttaactgtatactcttattagtacttgaattcttagtggcaaaaaagggttttgacccttcttgagcttgacagggtatattgccgttggaggaggtttttgaatacctaagaacatcgcctcaagggcttttatctggagatgctgaagagagattgaagatatttggtcctaacagacttgaagagaaacaggtaataaacatgacattcttcttagtgttcctgccaattgtctctattatcttgtgctaaccgccatttaaaacaacaatg

SEQ ID NO: 5885 - DNA, 3000 bp, Unknown
  misc_feature (1)..( 3000): cDNA_ID_1989641_gDNA_ID_1620823_Annot_ID_169593 3000 nt of promoter + ATG
atcagaaaaggtactaaataacaaaatctgttattgtcaaatcaaaaacgaatggcaaaacacaagttctgtatctaatacattttctttcaaacaaataacaaatactagaaatatgattttaaaatgtgacaaaaaaaaaaagaaatatgattttaaaacaatttgtttttataaaaaaatggtaagcaagttgatgaataaatcagtcaagctcatcgacgaacgtggcatgatctcgtaatagacattcgtcacgtggcgtttagctatttgatcaaaacatgtcagacaaagtgggtcctgcattttgtacgattcatctcaaaaggtgatatcgagtctcacatctccaatcctgaccgttggtttataactcttattagacgactttcaataaaaactttaggtgggtccctcgtttttagggttgtactgtcaccacctttcagtttcagtgaacgctgcacgaattttaactacaattagacgactatttacatttcgatccataactattttattatcatattttagacactcaagtttttaaattgccaattattcgctctttcggattttttgtggatttgagatgatccctgcttcaatggaggaagctcaccagctggagtcgagatccgatgacctaagtcaacggagaagctactggagatggaggaagcaggattttttcccggaattctcttttcagagcttctctacctacaaatcagctctctccgccacttgtccacgcctcgccgatcgtcttctctctcgctcttccgatgcgtacgagctcgatgcagcccgccgcgaaagcgagaaccctatgcgtcgttgtctcacttggtgggacttgctctggcttagctttggttctgttgttggttcgggtgtgttcgtgatcacgggtcaggaggctcgagttggagctggtcctgctgttgttctctcctacgctatctctggtgtctctgcattgctctcagttctctgttatgctgagtttggagttgagattcctgtcgctggaggttctttctcttatcttagggttgaattgggggattttattgcctttattgctgctgggaatattcttcttgaggctatggttggtgctgctggattagggaggtcatggtcttcgtatctagctagtttggtcaagaatgattctgattattttcggattaaagtcgattcctttgctaaagggtttgatcttttggatccggttgctgttgcagtgcttttagttgctaatggtattgccatgactggaacaaagaggacttcttggttgaatttgattacttccatggtcactgtttgtattattgtgtttatcgtcgttgtggggtttactcattcaaaaacctcaaatttggttccttttttcccttatggagcgaaaggtgtggtgcaatctgctgcagttgtctactggtcatacactggttttgatatggtggctaacatggctgaagaaaccgagaaaccttccagagatattccaattggtttggttggttcgatgtctatgatcactgtggtttactgtttgatggctctggccttgactatgatggtgaaatacactgaaattgatgcgaatgcagcttattctgttgcttttgctcagattgggatgaaatgggcgaagtacttggttggtatatgcgctttaaagggaatgaccacaagcctgcttgttggctctctaggccaagctcggtacaccactcagattgctcggtctcatatgattcctccatggtttgctttggttcatccaaaaacaggaacccctatttatgctactctccttgtaaccatactcagttcaataatatccttcttcaccagcttagaggttttatcaagcgttttctcctttgctaccctcttcattttcatgctcgtggcagtagcattgcttgtgagacgttactacgtgaaggatgtcactcctgaggccggtttgttgaagtttcttggttttctgtttttgataattgcttcctccattggagtatcagcgctttggaactcaggcgttaaaggttggatcgcttacacagtgactggagttatttggtttataggcactttagggttggcattgcttccgaaatatcgtgttcctaaggtatggggagtcccactagttccgtggttgccatcgttttcaatcgccatgaatctattccttatcggatcactcggttatgtagcattcttgagattcattatctgcaccatggtgatgcttttgtactacctattcgttggtcttcatgcaacctatgatgtagctcatcagcctttggaggaagcaaagtttgagggagagagataaaagaatcgatcgtaacacttcactacgtttggtaaattgtataaattcccttgttttctgatgtgatttcaatattcttctattaaaatgtacaataatactatcgatcttgttttcgtgttttctcattcttttcatttttcaatgttgaaacttattaacttgttgaactctgttgtatttgtttctatcttggaaatttaaaattggagttgaataaggtgttctcagttctcacacctttttatttagctactttgtgattattatactttaatgacccgagctaccggtaacccgaatgcacgacccggttaacttcacccaaaattgaatacaacatgataactcaagcccaaaaaagcccatttaaccgatttataaaagcggtgcttcagacagatatgtgttataaggagaagccgaggttaaaatccaaagcgtaaaatcatagcgagaaatttccttattcctgtgattttgctgagaagaagaagaatctcgaggaggaagaagaaacaggcgacatgggagaacggaaggtgctaaacaagtattatccgccggacttcgatcctgcgaagcttcaacggctccggcggccgaagaaccagcagatcaaggttcgtatg

SEQ ID NO: 5886 - DNA, 3000 bp, Unknown
  misc_feature (1)..( 3000): cDNA_ID_3078805_gDNA_ID_1620823_Annot_ID_169589 3000 nt of promoter + ATG
cgttatcttgctgtatgaagattttagaaagaatttgtttttttttagaaaaaaaaatatcaaggaaaaaaaaaatcaactactaaaacctgtatacagtttatttttagtttgcatataatataaaaaaaaacacttatatagttatatacatatcaaggaatctataatacaaaaatcgaaatatgcttatataccaatgctgaggaatcatttttttgttactgagtaacgtagtcacatagactccaaatttcttatttcttatagtattctaaagatatcaaaacctgttctgcatatgtaaattatgtatgcatcttaggctggtttcacgttatgtaatgtgattccaatattccatcaaataaggcgtgctttgacccattacactatataatactgattctttcgatcgatattaaataaaggtcacataataataacaaaagcccatttattatttggtccgtcaaggctgcttgaatgttaacggtcaaacctgtctcacccgtacaagaatctcgtcaaagaccaatacaataaaattgaaaagaccacaaaataatttccttatggtcaaggaacatacaaatgaacataaaaacatctaacaaactagtgtaaaaataaaataaaaaaactatcagatttgtctatcaataattaatgaaaaatattggtgaaacgttgcaaaaaataaaccccacatgtgtatagaaattcttgaaataagtgacaatctccagtttcagttgaccccgtcgttacaaaaactctaaaatagattttattatatgcaacgtttgattagttttttttttggtaaaaaacgtttgattagttgattctaatttctttaaatagtggaaaatttgagccactccctgatatctaatcagtatataattagtcattagtcatgaaagcatatgatcgtaactccacacgtaagcaatttctagaatcaaaatatcattcgatctatataataatattcttttccaatccacaactatggatatagaatataaatgctatatcaataaaagaatctgctctcttatccatatagttcataatactaattaggagtccccatgataataaatgtttctaaacaataactaaaaatcaataaaatgataaaagttcggtctccccacaaatattatatatattcccatatatttatctacacatataaatacaaccaatatcggggagattcaaaaggcatactactcaatagagcaaaccaaaagaaaaaatctcatataacgccaaaaatatgtctgcaggagtgagatctgaaccgatgaaggttgtcttcattaacacacagtacgttcagacagatgctcggagcttcaagacaattgttcaagaactcacaggtaaaaacgcagtcgtcgccgacggtccttatgaattctccggtcaagggtacggtggcaaagattcatcacagcggttttgtggcgtaggaaaagaagcagaaagaggtgtagagacgacggagttcgatagttttttcagagagatgcctccggtcggcgaattgtataatctttggtcagaccattgactagactaataattcgttcttttttttcccacaatattaaggcccattgggtttaatattattatctcaagcctatgtgaaacacgaatgttccttagaaggtgaacttctttttttttgcttaatgcattaatgtattatactagattttaacctgcggtataccgcggagacaatttatttccttaaagttagtatatataaaagtttacaaattttatctatctataaaatatttttattttatagtttacaattgttattaagtagcttcctgccaaacccgtcccgccaacccgtctcgtaaaaaaaactatttattttattaatgttgatcttatttatgatatgtttatgaatcattgtctaaatattttgtaattttgtagtaattaattgctatcaaatatctttacggtttgctgcttataatcgaattgttatagtcataaaaaaagcaatatcaaaaatgataattttgtagtatttaaatgatattaaatattttggaaattttattttagtaattaatggtatagttaatgcagagagattttagaaaggtagttaaatgcaaacatttaattcgaagatttactttctaattatcaaaaacaattattaaatgccagtggtagccactgtaaataagtctcaacttgaaaatttatttcacaaagtggctgcaaaaatgtatatgtagattatctttcacttttttaaaaaagacaatcaataaaatcattagtagcatagtttgtttattttttttgaaagttttttttcgacccttatattattttttgaaataaatatttgcaacaataatagtctatcagattttacgacaaaatatcagaaggaacaaaaaaaaaaagaagaagcgtggagaaagttaacgcgcgagaggggcgcgtgacgataaagaagaggaagagtgaaaacaaaagagatgacgacgattcatttctttcgtatccgactaactccaccgtttcgttcttcgttcttcatcggatctttcttcttcacgacgacaacattactgtatatctctttcgcaaaggaaaagttctgatctttgtattctcttatcattcgttatctaagtctcttcgattctcgaagcttttaaggtttcttctctgactcaaactttattactcatttatattcaaagggtttgcaaattttcttctgtttgaaaagatttgttgcttcaattcttatcaacggttggaatttagggttttaaactttgtttgttagtttcggaaaaaaggaaatggctttggattgctacaagctctttattgcgttttgtgaattgtagaaagtgaaattgatttctatttgagtgttcttattatgtctctctactatcttaatttcaaggcatttaaagagacgaa

SEQ ID NO: 5887 - DNA, 3000 bp, Unknown; identical to SEQ ID NO: 5876
  misc_feature (1)..( 3000): cDNA_ID_1989646_gDNA_ID_1620823_Annot_ID_169584 3000 nt of promoter + ATG

SEQ ID NO: 5888 - DNA, 3000 bp, Unknown; identical to SEQ ID NO: 5874
  misc_feature (1)..( 3000): cDNA_ID_1988782_gDNA_ID_1620823_Annot_ID_169583 3000 nt of promoter + ATG

SEQ ID NO: 5889 - DNA, 3000 bp, Unknown; identical to SEQ ID NO: 5883
  misc_feature (1)..( 3000): cDNA_ID_1989647_gDNA_ID_1620823_Annot_ID_169580 3000 nt of promoter + ATG

SEQ ID NO: 5890 - DNA, 3000 bp, Unknown
  misc_feature (1)..( 3000): cDNA_ID_2993403_gDNA_ID_1620823_Annot_ID_169579 3000 nt of promoter + ATG
gttcgggatgaggacgaagatggctttggctgagaaaggagtcaagtatgagtacaaggaaacagatccatgggttaagactcctttactcatagagatgaacccgattcacaagaagattccggttctcatccacaacggtaaaccgatttgtgaatctcttattcagcttgagtacattgatgaggtttggtccgatgcatccccaatccttccctctgatccttaccagaagtctcgagctagattttgggctgaattcatcgacaaaaaggtaaacaactcgcttttttttttgtttactaaaaagttgtatagttttttaatttgagatccggaatagttagttagggttttagatgaagttaatttattgggagttattggtataacatgaagaaaaaactatacaacttttaaaatgttcaacaatcaaaattaggctcacgtatttttcaatgatttatgacataatcaaaattaggctcacgtactttcaatgatttatgactttgatgatttttggttggttcagttttacgacccatcatggaaggtatgggcaacaatgggcgaagaacatgcagcagtgaagaaggaattgttggaacatttcaagacacttgagacagagctcggagacaaaccttattacggtggtgaagtatttggatacctagacattgcattaatgggatactacagctggttcaaggccatggagaaatttggtgaattcagtatcgaaacagagtttcctatattgactacgtggaccaagaggtgtttggaaagagagagtgtggtcaaggcattggctgattctgataggatcattgagtatgtttatgtcctgaggaagaaatttggagcagcgtaaaaaaatggtttgggtttcaagaaggctgttattttctgtcttttataatgtttcatgtgaggtttgtaattgttatttctgtcgttttgttgaaagtatgataaaccgtaataacgaaatgtttactgtaccctattaaattcgacgacattgcactcaatttgaataaaccggattagcttcagtaaaccatccggtttaatcgaagagtcgtttcagttcacgaaccgtacatattaattccgaggacttgttcttcctgatatcaattatatcaacatcatctgacatgacatcttataacaaatgattgatctattttcaattacaaatacaatatgtagttggacttaatataactaatgattaacttactctttttgttgtttataatagagatatttaataatctataacaaatcaatccagtaatatatggaattcttgtgtctttcatgatttatcgttaattgtggagctatgaatcaaattcgaaagaaatgttacaatatacctctagattgagactggccacgagactgagaacacttatctatcttgtatttttatttttggttttatatttttgtcaaatttatttttgcttttatcttacgaggcagtttaagtttaaacattaacaaacaaaaacaaaacaataaaattatggtcaatgtaattacacatatatatatatatgtataatcttgcgtaaagatatggtttgattgatccaacacttaaacaaaacctttaatatgcgttgctaagctgtcccttatcataatccctatcaaattcatcattcatattttttagttcctctattatttatttatttaagggtaaattaggaaaaagtctcctattaattgacaaaggcaattgaattcataattacgaaagaacctatcaacgttattttcgtcgctaattatagtaacctgaattttttgatgacgttattatgatcacgtggagctcggaggaactcaataaataatgtacaataactgatttatacttgtctcagtatacggatataagatatttttccaaaacaatgaaagtacacgttgccttgccagttgcctgcatatatatacacatcgtctagtagataccattacagtatattgttgttgaggttttataaattgtgtaatgattttgtataaattaaagaaacatatctccaggcatctcataattacgaaatcacgtttaactttataaaatattattaataccacaagatttgaaagtatttttaacaaatcataatttgaatcatatgtgaaattttgcagccaagagcattcatatttgatctaccagaatgtcataatgatcaaatttcatatttgatccgccaagaccctgagcattcatttgatccaccaaattaaaaagtcctagtggattataacttagaattatttacttttattaaatcaactaatctatgaaccactcaaccacatactacattataagaaagaaaacgtaagtagccaaactaatactctatacatttattatataagacgaaacaagatatatccattctcgaccacgacattggattagcttaaagttatttttagtatcctataaacagtaccgtaaacggagcaatcttgcaaatcatttgcttcaagttcaaaaacctatctagggttctctggtggagatgtgctaactgattttctaacttgagtttagtatagtaatttttgttttttttttcgtattttaagatttgaactgaaggatttagaaaagaaatgattccaatcttgagtatagagagagaccttcatacggagtatattacaatgaattataatctagattgtagtggagtgatcaatattttgctttttagcggggagttatcattttcgaaggctttaaatgtttttttttgcttgggaaatgtgaggagtgtcatgaatatcgaaattaaatgcattcaccaaccctatcgatccaacacttccctttagttaatgtcacacattaaaatcatatccacttgtttataaccacattttctctcaaaatccataaaaagagagagagataaataaagagaaaactaaagaagctagaagatg

SEQ ID NO: 5891 - DNA, 3000 bp, Unknown
  misc_feature (1)..( 3000): cDNA_ID_1989648_gDNA_ID_1620823_Annot_ID_169578 3000 nt of promoter + ATG
ctttgcgtgagctattgcttcatttgtttgaggacgaattccatcatcagcagcaaccacaatgattgcaatgtcagtgactcgtgctccgcgagctctcattgcaccaaatgcctagatgaggacataaaagtaagatgagtaaaactatggtatgcctagcaatagatgtgagatagtcaataaacatgctacatgtaagaaagctcatgaagtataattaatgatacttcagcatcagaaatgaacatgcgaagattcaattgcaagaaaaagaatctacctcatgtccaggagtatcaaggaaaacgcaggactgcaactttccatcaacaggcactgacaccttatatgcaccaattccttgtgtaattcctcctgcttctgacgcagcaacctgcatgtatccagcgaagggagattagctgacaacgctacttagcactaatcttgacaataagcaaatgaacaaacattaattgccagtagccatgctttagaaatgataagaaactgaagaggccacaatgaaatttcttaaataataaaaggcaaattaatagctaatctcatccataccttgctttttctgatatagtcgagaagagtggtctgcaaaataggcagcaaatgcattaggaacaacctactgctaaaaaataggactctatatatccttttaagggcgagtaggacatgagaacaaaaaaaaggcaatgcaaactgtgcctacctttccatggtccacatgacccattatcgttatgacaggaggtctgtcctctaacttgtccaaatcttcttcatcaaaagtttgccttttctttgccatctcttctactttaactgaatcagcatcaaggacctcaacatcgtaatctctacaaatcatcttcaccatctcgcggtccaaagtgtgcacaccatcaggtctaatcccttttgaatataggtacccaaggatgtcaccttctccgatggctaggttgtaagccaaatcctcgatggacatgccttcttcctctacctctaagatttcagctttgacaggtgctgcgtcttttgcagcctggagtcttacagccttcctactagctttactccattttctcccttttctacctgatcgagaaatggatgcatcatcgtcgccgtcgtcttcagcaacaattcttcgtcttggactagctgatgcattttttttattacggtgctcaactctgaacttgttagagggaggaccctttccaggcttagtaggagctaacacagcctgagaggccgcaggatcaacaccttttttcttcgaagcaaatttgtcaaccaaaataggcttcctttctttacttttaacgctagaatcaacttcttcagaaactaaaggttttgctgccataccaagatcttttaagatgggtgatttctttacgggtggagctaccataggcttcccttgtaacattggctggggtcttacaggcggttgaggtctaaaaggtggctgaggtggtgccaatggagtgcctgctttggcattcacctctccctcttctctcgttctaggttcggtctgcactcctctattaaaaattttaggtgattccttaacaactttttgcacagcagcaacagcatcgcccttacgccacacactcttcatggttttcgtcttccttgttcctccatcactcgcattcgcatagctaccatttcttgagttactactgttggcactaggctgtgacggcttaacagcctcaccaccctctttgttacccggtttcggaatttccaacttctcagctttatctaaaacttcaccaagagattcaataaccttattcctctcttcttctccatcaaacttacccccattcgacaaatctttactccaaggagcagtattcacccccaaacctctttctacccttgccacagggggtttcaagacaggtttaggagtctgcttcagcacaacctcactatcatccccatctttactccccctaaacgagttagaatctatagaaactgagttgttgttttggtcagcaatgaagtcagcagtagtagtagtagttgaagacgaaacagaatatctacacagccatttcttagtccccttaacacttctccttgacaaagaaaccctcttaactaaagcatacgatgcatccgaagaactcgttccagaaacgcttgcacaagcaccacctagactaaccagagaagccaaggacggcattgtgccgacgagaacaagcatcgatggcatctcaaaaaaaacagaaaacgaataaaacaaagcgatagcaaattcagagactttatctcattccaattgcaacgaatttcgaaccagaaatgacataaaaacttcaactttgtaaagaaattggggttatcgacgaatcaaatccgaaagcatgaagctgaattgagaatcgatgagcaatttagatatatggtgagagaaagagagagaggaagaagaagataagtgaaggaggaagaagaagaagagagtgcggagataactttgaacttgagcttgtgtgggtgtggctgcttctatgcctggaattttcgcggatttccgataaggccaacttacaaaattaaaattaaaatccataaatattttagctaacaaaaaaaaaaaacacttttgtttgtctgaaaagtaaggctattgggctcgtctctaaagcccatttataaaatcagacccggaaacttctgcgtgatagacacacgtggctacatttaagccgtatattgtaaatataggggcaaattcgtcattaacaaattaaaagtatttaatattatcgataagtaacagagcatttaatactaaatttaataaatattaaataacgtcaagagagagatttgtcatttgagacctcaagatttctctttctattgcctactctctgttgaaaaagtgaagaaggcccgatatagagagagagtgtgtgtcgttgacgaaggagg

SEQ ID NO: 5892 - DNA, 3000 bp, Unknown
  misc_feature (1)..( 3000): cDNA_ID_2042114_gDNA_ID_1620823_Annot_ID_169577 3000 nt of promoter + ATG
ccattgattccacttgttgcgctagtgccacgtgtcactcccattttcttactcgtttcaggaagattggcatttatagcagcaaacggaaccggccgagaagtggtcatgaaatcacaaattctgacggttacaccacataaactacaatccagtaaaggtaatctggattctgacttatattctggacccaaaacttcataatttccagaggcttttcgggatgaagccgagaattgtttcctgcttggaccaggatcttgcagacgactttgatttctagccggtccagaagggcacccatttctagctgattgggcagaatgttcttcacaatcttggatatttggaagccatctaggctcccatccacataggcttatcagcttttgagcctacaagataaaacataaattaagaaacaatagtagtttatggctagtaagtttgatattcctgaatcctgagttcttacgcgagagtaattactgaaagcctcttctttgtacgtttctgcagctgatatattgtccattctgaaactgagatcatcattggcatgtgccaaaaggcggtcaatttgtggtcgtcttgaagcacgcatctggtcaattgcagatggcgaaacaattggtagagaatagaattgtaggagcccatcacaacgatccttgtaacctccaatcaaggctgatggaggagttggaggaaactgaactaagctttctgaacaactttttcctacccaaggacaagagctctcatgtgcatcatcaagctgcttagagaatttttctccggtggtatcagctgctcatcaaagatggatgaggaatataaaatgttagcagcatataacgaggctgattcatgaataatgatcttttgtgcttaaatgacagcgaaatagttaaaatctttcattgtagatgttggtaaactgaccaaaactcttggctcttaagatactcataaagagtgtcagatactatctttttccgtacagtataagagaaagatgaatacttaaatgttaagaagacgaatacttaaatgatatccccccaccccttgattccaagaagaaaaagaagataagttaggttacagtaacaagaactgaccttcgggaggattcaacgaatcttgtggaggggagtattgtagaatggacccacagtattcacattgaagtttgtccagatcaacactaacccagcctttctgagcacaagccaaagaactagctgtctgtaaacagagattaccaaagcaggacacccctttaatcaaacagcatttcattgaaccagttgaaacttgcaacaaatatcaaaggagatagaaaggaccaatccaaagtagagaaagaataaaaagtaataagcccacaaatgagataacctagctattcttcctcatgtttccattccaggttatctttaatacatcagtccctcagattgaattctgaatataaaggaccattaaatatactgttggattcacctatagcaaatttatttgagccaaaaaagaactacaggaggatatttgccaagtttatcaatcagcattcagtccaaattttgtttttcgcatcactaaattcactagctctaggataactggactttttgctaggatatgcactacggattttccaaagaaatatagtttgctgagagtggaaaaatgaatttgcatgtgaaagagcaaataacgagaaaacaagagtcatactttgggcttcccaagccaatttgaaggcttgaaagtggcaagacgtcgaagtaaatctcctctatcccatgttctacacgaacgcactgataatgccagtccatgacctgtccagtcaacactgccagcgtttaccagaacagctggagatgatgcccctgcagagctgcacattgattcaattgaattcaatcgtcgatatccaaaagagcaaaacttacagaaaactaaaagcaccgcaagcaaaattaagatgcaaatctcaaacaacgaaccctagatatatctcgtctcagctcaaattcaacaaatcgaattcaaactaactcataatttcacacttctgaaactcgatctgcgttaaaatggggacgaacctagcagcagcagtttgaggaggagaaggcgatctagcacgtcgtcggaacctatcaacgggagtagcagaggcggaagcagaagctgaggctacactgttccgattacttctagggtttacgttctgcgagctcacatcctcttccttcatcctccttcgtcaacgacacacactctctctctatatcgggccttcttcactttttcaacagagagtaggcaatagaaagagaaatcttgaggtctcaaatgacaaatctctctcttgacgttatttaatatttattaaatttagtattaaatgctctgttacttatcgataatattaaatacttttaatttgttaatgacgaatttgcccctatatttacaatatacggcttaaatgtagccacgtgtgtctatcacgcagaagtttccgggtctgattttataaatgggctttagagacgagcccaatagccttacttttcagacaaacaaaagtgttttttttttttgttagctaaaatatttatggattttaattttaattttgtaagttggccttatcggaaatccgcgaaaattccaggcatagaagcagccacacccacacaagctcaagttcaaagttatctccgcactctcttcttcttcttcctccttcacttatcttcttcttcctctctctctttctctcaccatatatctaaattgctcatcgattctcaattcagcttcatgctttcggatttgattcgtcgataaccccaatttctttacaaagttgaagtttttatgtcatttctggttcgaaattcgttgcaattggaatgagataaagtctctgaatttgctatcgctttgttttattcgttttctgttttttttgagatg

SEQ ID NO: 5893 - DNA, 3000 bp, Unknown; identical to SEQ ID NO: 5877
  misc_feature (1)..( 3000): cDNA_ID_3078784_gDNA_ID_1620823_Annot_ID_169606 3000 nt of promoter + ATG

SEQ ID NO: 5894 - DNA, 3000 bp, Unknown
  misc_feature (1)..( 3000): cDNA_ID_3078792_gDNA_ID_1620823_Annot_ID_169604 3000 nt of promoter + ATG
tgcaggttgtggcttctctactgtatgctgatagtgggacgcatgttgagaagaggagtgactttgaggcattccttttagtaagctatgaaggcattgaattatctgctgaagataaaccgtgcaacttattgaacggatgtgcttctttcaagttcaaattatctcaggtggtgattataaatctaggccatcggaatgggatttcacattcttgttagaatttttttgtctatgctaaaaggcattgaaggatccttgttttcttttgttttgtagctttcttccaagagtgataagaggttgttctgcatcaaattcgaaataccagaagtgaaggccaattatcctttcctcgaaactgtcaccaaccaaatccgttgcatttcgagaaaccgtgattctgtttcctctatgaaacggatcagattaggagaagaaaaggtttctgagagtaaggtggataatccaatttctctgagttacgttttgttttgctttgtatccatatcccacttactgttattctgcattgttgttgctctcgagttagattgtgaatggaaatggtacgagtatggaatggaggcctcagaaccacgaagaagataactcttcaactgattccgaaaacactgaaatgagagactcgactgctttcaggagatattcaatcccagactggattattttcaaatactgccttggaaacttaacagagagagctcttcttctgaaggaaatcacaaacaattcatcagacgaagaagtctcggaatttgcagatcaagtttctctctattccggatgctcccaccacgggtaaagaaatcaaattaaactcacacctgcctcaaataaaatagaacactaatcttccaaattttccagctatcaaatcaaaatggcaagaaaactgatagcagaaggaacaaatgcgtggaatctgatctctcggaactatcgacatgttcattgggacaatgtggtaattgagattgaagaacatttcatgagaatagctaaatgcagcagtagatctctcactcaccaggtcttgtctctttctcttctcatattgcttgaactttcaccaagatcaaagtcttgatcttttgtatttgtgattctgacatgaaattgtaatcaggattttgaccttctaagaaggatatgtggatgctatgaatacataactcaagagaattttgagacaatgtggtgttggttgttccctgttgcttcggctgtatcaagggggttgattaatggaatgtggcgctctgcttcgcctaaatggatagaagggtttgtgactaaagaagaggcagaacgttcgcttcagaatcaagtaccgggcactttcattctcaggttccctacttcaagaagctggccacatcctgacgctggttccgtggttgtgacttatgtcggccatgatttagttattcatcatagattactcacaatcaaccacatctgcgagtaagtaaacctctttatctcctttttttttcccctcagtgtctgtcttgtgacaattgtttttgtttttagttctagtgaaaggtatacagatgcaaaacagttgcaagatatgcttttggcggaacctgagctatctcggcttggaaggtgagtgaggaagtgaaaaaatttagtttttgttgaagcaaagagagatcaaattgaagatcttaaattgcttattttatttattttggtttttgttgcatttttcaggattataagaggcatctgaatctaatcaacagactcaactcaacaaagtagagaagcatcgactgttattgaggtttattgtacagatagatttgctaagtctaagtattaactgatactaacttttgtaaagctcagtgatttaaattaggtggaaaggatttttattgtaagacttaagtatatttgtttatctaaaatcaattaccgacaagaaagaaaggagttgcgatttttgcttcttctgctcagtttttatatttgtgtggcccatttatgttccaactacatatttgcttggtccctaatcccttattagaggttaattatggtaatgttttttttaccaagaaataaataaaataattatggtaatgtttttctttcatatttttgttttgttatgtactaattaaatttaaaagctcttagaaaatttattcaaccatttttgttaatcttctcatatatgatgacttattgtgattggtaatacatggaatgagaataatatacagaaattgtaaattaagtcataacagtattattttgattcacaatggagttggagaaatgaattatcaatataaaaaatcatggtttcacgtaatttgatgatttgtttttaaaatactccctagagcctaattattgtaggtaaaaaacttattagtataaaatttgtgagatctggattaatgatattataattgtcttgaaaccagaaaaatggatattctctaatctcaaaatatttgatacgagttagatgacggaccaatcggtaggaaacacgtggtgacatttcagcttctgattacaacgatggacttttttttccctctctctctaatttgtatattgaattaaaaaagaaaacggacacacacacacacacacaaatctgaaatctctctcgtccgccaaaggtcgagttttgagagcgagttcttacttctgatgtggttttgtctcgtccacccaaagaaaatcaacacaaaaaaaaaaagggatcgattcacaaacttataaatttcttgtcttttttattttttatttttctgaaaatttgccatacacacacccaatctctctctcgtcagccaaaaagaaaaaaacttaacattggactctcagtttccgaagattcttctctttggactctcagtttctgaaacttattattagccgtctttttttggtttgggtttgcctaaaagttgtcgtcacttgtggattttggtctgagaaatg

SEQ ID NO: 5895 - DNA, 3000 bp, Unknown; identical to SEQ ID NO: 5880
  misc_feature (1)..( 3000): cDNA_ID_3078796_gDNA_ID_1620823_Annot_ID_169603 3000 nt of promoter + ATG

SEQ ID NO: 5896 - DNA, 3000 bp, Unknown; identical to SEQ ID NO: 5881
  misc_feature (1)..( 3000): cDNA_ID_3443592_gDNA_ID_1620823_Annot_ID_169598 3000 nt of promoter + ATG

SEQ ID NO: 5897 - DNA, 3000 bp, Unknown
  misc_feature (1)..( 3000): cDNA_ID_2042114_gDNA_ID_1620823_Annot_ID_57828 3000 nt of promoter + ATG
cgtgtcactcccattttcttactcgtttcaggaagattggcatttatagcagcaaacggaaccggccgagaagtggtcatgaaatcacaaattctgacggttacaccacataaactacaatccagtaaaggtaatctggattctgacttatattctggacccaaaacttcataatttccagaggcttttcgggatgaagccgagaattgtttcctgcttggaccaggatcttgcagacgactttgatttctagccggtccagaagggcacccatttctagctgattgggcagaatgttcttcacaatcttggatatttggaagccatctaggctcccatccacataggcttatcagcttttgagcctacaagataaaacataaattaagaaacaatagtagtttatggctagtaagtttgatattcctgaatcctgagttcttacgcgagagtaattactgaaagcctcttctttgtacgtttctgcagctgatatattgtccattctgaaactgagatcatcattggcatgtgccaaaaggcggtcaatttgtggtcgtcttgaagcacgcatctggtcaattgcagatggcgaaacaattggtagagaatagaattgtaggagcccatcacaacgatccttgtaacctccaatcaaggctgatggaggagttggaggaaactgaactaagctttctgaacaactttttcctacccaaggacaagagctctcatgtgcatcatcaagctgcttagagaatttttctccggtggtatcagctgctcatcaaagatggatgaggaatataaaatgttagcagcatataacgaggctgattcatgaataatgatcttttgtgcttaaatgacagcgaaatagttaaaatctttcattgtagatgttggtaaactgaccaaaactcttggctcttaagatactcataaagagtgtcagatactatctttttccgtacagtataagagaaagatgaatacttaaatgttaagaagacgaatacttaaatgatatccccccaccccttgattccaagaagaaaaagaagataagttaggttacagtaacaagaactgaccttcgggaggattcaacgaatcttgtggaggggagtattgtagaatggacccacagtattcacattgaagtttgtccagatcaacactaacccagcctttctgagcacaagccaaagaactagctgtctgtaaacagagattaccaaagcaggacacccctttaatcaaacagcatttcattgaaccagttgaaacttgcaacaaatatcaaaggagatagaaaggaccaatccaaagtagagaaagaataaaaagtaataagcccacaaatgagataacctagctattcttcctcatgtttccattccaggttatctttaatacatcagtccctcagattgaattctgaatataaaggaccattaaatatactgttggattcacctatagcaaatttatttgagccaaaaaagaactacaggaggatatttgccaagtttatcaatcagcattcagtccaaattttgtttttcgcatcactaaattcactagctctaggataactggactttttgctaggatatgcactacggattttccaaagaaatatagtttgctgagagtggaaaaatgaatttgcatgtgaaagagcaaataacgagaaaacaagagtcatactttgggcttcccaagccaatttgaaggcttgaaagtggcaagacgtcgaagtaaatctcctctatcccatgttctacacgaacgcactgataatgccagtccatgacctgtccagtcaacactgccagcgtttaccagaacagctggagatgatgcccctgcagagctgcacattgattcaattgaattcaatcgtcgatatccaaaagagcaaaacttacagaaaactaaaagcaccgcaagcaaaattaagatgcaaatctcaaacaacgaaccctagatatatctcgtctcagctcaaattcaacaaatcgaattcaaactaactcataatttcacacttctgaaactcgatctgcgttaaaatggggacgaacctagcagcagcagtttgaggaggagaaggcgatctagcacgtcgtcggaacctatcaacgggagtagcagaggcggaagcagaagctgaggctacactgttccgattacttctagggtttacgttctgcgagctcacatcctcttccttcatcctccttcgtcaacgacacacactctctctctatatcgggccttcttcactttttcaacagagagtaggcaatagaaagagaaatcttgaggtctcaaatgacaaatctctctcttgacgttatttaatatttattaaatttagtattaaatgctctgttacttatcgataatattaaatacttttaatttgttaatgacgaatttgcccctatatttacaatatacggcttaaatgtagccacgtgtgtctatcacgcagaagtttccgggtctgattttataaatgggctttagagacgagcccaatagccttacttttcagacaaacaaaagtgttttttttttttgttagctaaaatatttatggattttaattttaattttgtaagttggccttatcggaaatccgcgaaaattccaggcatagaagcagccacacccacacaagctcaagttcaaagttatctccgcactctcttcttcttcttcctccttcacttatcttcttcttcctctctctctttctctcaccatatatctaaattgctcatcgattctcaattcagcttcatgctttcggatttgattcgtcgataaccccaatttctttacaaagttgaagtttttatgtcatttctggttcgaaattcgttgcaattggaatgagataaagtctctgaatttgctatcgctttgttttattcgttttctgttttttttgagatgccatcgatgcttgttctcgtcggcacaatg

SEQ ID NO: 5898 - DNA, 3000 bp, Unknown; identical to SEQ ID NO: 5890
  misc_feature (1)..( 3000): cDNA_ID_2993403_gDNA_ID_1620823_Annot_ID_57830 3000 nt of promoter + ATG

SEQ ID NO: 5899 - DNA, 3000 bp, Unknown; identical to SEQ ID NO: 5891
  misc_feature (1)..( 3000): cDNA_ID_1989648_gDNA_ID_1620823_Annot_ID_57829 3000 nt of promoter + ATG

SEQ ID NO: 5900 - DNA, 3000 bp, Unknown
  misc_feature (1)..( 3000): cDNA_ID_1817193_gDNA_ID_1620824_Annot_ID_169620 3000 nt of promoter + ATG
gacaatggaaattgcaagtgtcttacgttacaacttacaagcgatggataccaaaagagtcgacgtgaatcacataggggaatgtaacacagaccttgagtgccaaagcatgcgtagttgtgacaaggtcgatgatcgatactgtgaaagcggaatttgcaagtgtctatcgttaccaagcgatgaatacaaaaagcatcgatgtgaatcatggagggatcagggatacgtgacacataccttgagtgtggaagtatgctattctttgactatcgtcgggcgtgttgcgtaaatggaaaatgcgtgtgtcgcaaacagagccaatttgtgcccaattgcccaaaataaattatgctaaaaatttctttgtaactgactgcaatgaaccctagttatgttctatcatgcctccaatatttaatttgctaaaataacttattattaagcactttgaatcgaggacaaccttctaataaaattagatgcttaaaattttaagaatttgtcttatttcatcattcattataaattaaatcactttttaactattatcaaacttttgttttatgttctttttcattattttatcatcgaattatgtcatgtttttgtcttttaagtaaaaaattaatgataataacatatttatagatgaaaatggatcgatgaaatccttgatttcaggtctatggattcagatatgttaaatttaaggtaaagctatccaaatcctgaattcgatatgtgatcttaacaaaatttaaaaacttgaaaaatcaataatttcgtaagggatggtttttaccggttcgccggttttcactggttttaagaattcatatgttcaaacttatgtttttcatgataaacatgaccggtcaagggtctcactcgcggttcgatgggctcaaaccggtcgatccgtatcggttaacagtttattttttcccttcaattatatactttgtttagattaatatttaggatggaataagatcctggcttcgtggcttgtagtgctgattaaaaatcactgataaccaatgcaacgccggttcgatacttcacaaaatttagggttctttaaaaaattcataaactccaattcgcctccttctctctttctcgatcctctcaaaatctctccaccaccaatgaagcgacgacgccgtaactccaaacttaaattcgaagaaacctccgaccaatcaccgacatccacggcagagttctccttctctctcaccaaaatcgccgtcagccaaatctgccaatctattggatacaaagccaccgatgcctccgctctcaacactctaaccctaaccaccaccaaattcttacaatccctcgccgaactcgcatcgtcgttctctaacaccgctaatcgcacggaggttaatctcttcgacatcgtcaatggtctccaagatatcgctttatctacttccgattgtttccccggtggctctacggttcacgatattgaatctcagtgcctgatcaaatccgctgttctccgtaacctctccgatttcgttacctacgctcctgagattcctttcgctaaaccgttaccgagacgggaaagagacggatcgttcggaggagatttggatcacgtggcggtgactcgatcggtggatgtgacgtcagttccagcttggcttccgccttttcctgactctagtctctgctccgatcgttgttcaaaggataatagatctgatcacttgtgggaaaactctgattccgttattcgccgtgaaattttgccggagagtttgaaatctaaaagcggaggaagattaccggtaatgagagataaagtgagattcaagatggaacaacgagattggagtagtggtggtgatacgagattggagcggtcgcgggacaataacaatggcgaatctggccgtgatcttgaggttaagaagaaaattagagaaggatacacttactgtgccggcgagtggccgttttagtctattctgatgacgtggaaaaaaacaaaatcgcgaggtttaagatggattcgaacccgcgaggcttgagtatatgtgtgattggccaattggaatctaccgcacgagctgcttctctgatagtttcggtgctccaattgtttattttataaagccattactctaaggatttactttatttctttctatgggattattttaaaaattgaaatagaaaaatggttgaacctgttcgactttactcaatgttaacttggttagtccattgaaccatcgtacaagtgatgaagtaaacaacggattcgtctcacaaatagaggtttgttcatgaatataatgcttgtgggtgaagtgtggttcttttggaaactagaatgagaactcattggatgagttatatctcaaagaattggggaaagctatgtatgtaattgtttgtttcatttttattttctcaaaataatgcaaactataggttggtggattaaaaaatgttagaaaaactaaaatgtcatgttgttattcttttcaccaaatttcatgtattcagtatttatatgaaaaaagctttttaagcaacttgactctagtgtggcttgtatagacacatgtatgcagtctttttcttaacattatttttcattaagatctaaatgaatctcaaccgtccattcattagagaagtaaaacaaaacttacacgtggcaaccatcgaggtttgaggtacactgtttcattacctccactatgtttcatatatatataacaaaaacaagtcgccttccttcttagtaaaatttactgaaattgccactgttttcgattttgttggttctccgatctcagtggtgtcttcttctccggtagataattctcgtgttgaaaatctccggtagtgtttgactgagttacggtatgattttgttcttcattttcttttgcaataagtcgttgttatgaagtgagtaatccactggttttgactatagaaatcaaattgctacagaatatg

SEQ ID NO: 5901 - DNA, 645 bp, Unknown
  misc_feature (1)..( 645): cDNA_ID_3078847_gDNA_ID_1620824_Annot_ID_169644 3000 nt of promoter + ATG
cttgactccgagatgaataagaacatttgagagacggacaaaagtggaaatggaatcatttgtatgattacatagagcaacttcatgttggttaacataaggggttttctatctccttataacagagtatcatgtcatgaagagccagaggctgatcgcctttgctcatgttactagttagtcgttagttcaaacactatagatgccaaaacaagtgtataaattaaattaaactacacaaaacgcctaatataacctaacattatttaatttattggccatctaagaggtaaatatcatgtaaaacggtgttaatgaatgctttgttttgaaaatgaacaagggaaagttaaatgttctttttcttgggactatcagcccaacaatgagctatgaagagccgaagcgttttcacattcctcaagttttcgtaatcaacgcgagtcacattcaaacacgtattatatgcttttaaagtgagtgactctgcgttttctcgattctgtttacttataaaagttgttgtgtgataattttctctatcaagtatggtagtgtgacactcggttctaggatttagtctctcttcatcctctggtatttctgttttggtttggttgcaaggagacttcattaagatcaatg

SEQ ID NO: 5902 - DNA, 3000 bp, Unknown
  misc_feature (1)..( 3000): cDNA_ID_3078855_gDNA_ID_1620824_Annot_ID_169642 3000 nt of promoter + ATG
gtgattattcccaaatttgacatacaagttttctctcactttataacaaaatatcatgtcatgaagaacaagaggctgatcgcatttgcttatgttactagttagtcgttagtttcaacactttagatgccaaagtcaaaccaaagagaaatgacaaaaggaataaagaaggtgaaacatttgtagaatttaaagtaaataaatcgcccaacgttattaaatgtattggccattagcctgattatgtgatctatgaggttaataacataattttatcagatttggtttaaaaaaataaaggaaggaaatttggggagaaaacatttagaacgtcggaactcgcatcacttaacaatctctcagtataagtcatctaaaacggtgttagtgaatgttttgttggtgaaagtcaagtgtttttgaaaatgatttacttgggactattagcccaccaatgagctatcaggagccgaagcgttttcacaattctcaagttttcgtaatcaacacgattcacattcaaacctatttgacagtgaagtgactctacttataaaagttgttgtgtgatattataaagttttgtacatgccactcggttctcggatttattctcttttcatcttcttctagttcttttcttaggattattttctggacgtttggttgtgacttgtgaggagtcttcatcaagaacaatggaagatcaatatgaaaagaagataacatggacgattaagaatttctcctttgtgcaatctcaagcaattgattctgatattttcgtagttggtgactccaaatggtaaaaacttgttctctaatgttttgtaagtttacatttcattttaggtttacctgacatcaccctttgcttattggtttttggtttatggttgcaggcatcttgtggcctatcccaagggaaatggtgaaagtactaataaatgtttgtcactgtatctgaatgttgcggatttccaatctttgcctaatggttggaaaagacacatcaaatatcgcttaactgttgttaatcaaatgtcggagaaactttccgaacaggaaggtgattctttctacatttgctagtttatgtttccaaggtggacaaaagaaagtgcatattttatggttcagcttgtcatggactcatatgggacttgtgttgtatagtgagattctatgtatgcgttgtgcaaactggttttgactaaagttctatgtttcgtgactttacagtaatacaaggctggttttataaaaactttcatatctctggtttccaaacaatgcttcccctttccaaacttcttgacaaaaatggtgggtttctggtgaatggtgatgtcaagattgttgtcgaggtaggtgttcttgaagtcgttggcaaatcagatgtgttagaggaaactttattagttcatgaaagcatcgatatcaatgggtttcaagttcttccttcacaggtaagaaaagtacctgtaactatataactttactttcttgtacaagctgcatatttggtttgtgggtatggttcaggtctcgaaaaaatgctatctgagaaggttcgtccatgtttcccttgcaggtagaatctgtgaacaatctctttgagaagcacccagacatcgtatcagaatttcgttccaagaacccacttatgagaacaacatacttgaatgacctactatgtttgactgagatcctgtgcgagtcctctgaggaactctccactggtgatatggctaacgcgtattctacactaacttgtttgaaaaaagcggggtttaagttggattggctggagaagaaactgaaagaggtttgtgaggctcgggtgcaagaaattgatgaagagtggaaggacttgacggacttgaaggaaaagttttagctggagttctgacgatgaggatgacttgaatcgactttagtccgttaagagtttatatctaattggtgttctggtctgtttgtttttcgttttggttttgagaacaatgtcctttaatcttcgagtagaagatcaagagacttgtgttgtcattgaggtttccctacgtcttttttattgcactttagtttgtttcttgatggaattagttaaataaatgttgttggtattcttcattctaaactgctgtgaccactggcacacaaaggtagtcaaattaacttatgttgatgatgcgaagatgatacgagacagtagtgatgcttatacagaaataatcagtaattcttctctataaggaagcaaacacaatgacctggccttgtggagaaactacaggacacattattgcttctatttgtgttgggtggttttaggactttgagagactcataaaataatttgtgtttttgtataattacatagagcaatttcacgtgcaagtttaacatgtgtgttatgaagagccgatgctgcattttttcatgctatatattagtcgtgcattcaatacttcatatgctaaagttgaagatagattgagcaagccaaagagaactgaacaaaatagataaagaagtctgttgttctacgttttctttgattaaactacacaaatcgcctaatacattaataacctaacattattgatgtgaataagtggtattttattagacttggggaaagaaaaaacaggaacgaaatctgaggaaaaaactttaaaagagttgataacgaattttagaactcagaagcattagacacttttctcacttttagtcaaaggaaagtacatattttatggttctacttttcatggactcataggactaaaaacttaagtccttatgagttgtgcaattcttgttttgacttaagttttatgtttcgtgactttacagtagtaacaccatgctggtttgatcagaagtctcgctactggggttcaccagcaatgcttccccttaccgaacttcttgaagagattatgaggagacgataaatcgaaagtttatgaggagattatacatgatataatg

SEQ ID NO: 5903 - DNA, 3000 bp, Unknown
  misc_feature (1)..( 3000): cDNA_ID_3078859_gDNA_ID_1620824_Annot_ID_169640 3000 nt of promoter + ATG
atctactatgattcttagtgatgttttcattttgactttgatgtttatcatttagttgaatctcttggagagctaattttgagttttgggttgggttttagattaagaacagaaacataaggaagaggatacatgtacgtgtggagcatgtgcaacagtcaaggtgtgatgaggagtttaatctctggaagaagcagaacgatgtgcttaaggctgcaacagtcaaggtgtgatgatgagtttagtctcaggaaaaagcaaaacgatgtgtttaaggctgctgctaaagctaaatgtgaaactattagcactaagagacaacctaaaggtcctaaaccttgtttcatggttgaaggtatgaccttggagactgtcactcccattcccaatgttgtcaacgatctcaaaggtggctattgagttgtttccattttcttcattctcttctaagaatttttgcacttgctttgttctttttatgatgtttttgtatcaaacaagactgaattctatattgtacgagttcagattttgttaggaaagatggtttatcccaatcctttacctgttccatttgtatttaaaatcgtttctgcatttttcagaaaactgatactttgggaaaagttgagacatctaatctctttcagtgttagcaatttataccacacaaaaataaacagagagagcaatcgaaacaaaatctctttgtaaagttgggaagtgcagacagaccttttaattgcaaaccttttaattcctttgcagcttcacacaattgcctcctcttcattcattagttaaatgtttgagtttgctatttttgttttaactgagcttatgatttatcacaaaattttattgttataattatatatatttaactaaaaattattactccttaccaaaaaaaaactaaaaactattactagctaaacaaatactttttattgatgtaaatatatttaaattacatttttttatattcagaatataactaaaaaagtaaataaaagaattacatgaaaattatcgtagcggcgtcgaaacgaacaaagaaacctgcggttgcggcagcggctgcggcagcgtctgcggcaacaaaacgaacaacaacctgcggtagtgtttgccgccaccgctaccgcagccgctgccgcaaccgccagcgttaatgaaacgaacatgctaaatatatatatttttttccaaaagttaacggtaaataactcaatatatatagatatatataactcgatcaccttacttatttatctaataaatttataaacattactcaatatcctgaaaaattgagttaaactagtcatgaactagtctttaacagtaacgtaacgtatataagtagaagcactcaattttaattagttctattgaatttgttatcttcgttctatccattttacaccatttatcttactcgttttgttttgtctttttataaaacttactcggtttttttgataaacctaactcctttggttagtagttaatttccttcgttttgcttttccaattctatgcatattgttttaaccattttattactccgtttccgtttgtttcactacaattatttggagctacagtactacagtagtatatagttctatgttcatatcaagattgtcttcttgggaaacacttgccctttgactggatttgttatattaaaaattgtgcaagcacgtgtttgctaaaatttaaaatgagaagctgtgagctaaaagcttcgctgttaggttcatcaactagtctgtctggtgcttcaaaggaatgatgacacaagcaatgatgtaattggcaaaaaggtagttttgtcgtttagtgcttttaaatcgagaggcaggggatagatcagagtgatccggtatgggtcgcagattttgttcggtcccgacatgtttttagttctatttaaatactttataagtaaaaataattctattgtctcgtctctattatttacataaattgtatgtacattaattgtaagggaagtatgtatataactataaatctaaaaatcttagattaataaataatacatcaaaatgcctaacttacatatatgtatttatttatttctataatgaatacagtttttaattaagaagtgaaaatgtctcgtcacacttttcaaataggtcatttggagatatatcacatatcgaacgaatccatgatccctccaggcttcatccagttcactttgacctcactcactcttcttctttctttcagaaaatgatttatataacttttcttcttcttttaaacatatatatttaacaattttttataataatttctatagaattcttttaatatatatatccacaaatccacatagttttgaataatctttagataaactagtcctctccttcgatgaatacttcacgcgtactagttttttttcttcatgaatacttgtcgttgtgatgcagcattttgaaacatgaatatcttaaagccttttgcccaaaaaaaaaaagaatatcttaatgcctaatacttggattacgtatttatgtaccagtatcgcgatcaaaacaatcaccttttattcagtcaaattaaacataatttatgattcatatatcctcaaaaacatattacaaaattaccaggtatctttgtatgctatacaccactattctaaatttaaaaattaatatagagtaatatatactattaagttttaaaaatcgagattcatattaatataaaacatcttactaaaacaatgatcaaagttttattcatatgctcaataacatttttatgattaaattaagcatacgtcgagcatcattagttaggttccaagtacaaaagcccatttagattattttagcccgtttaaggcccaatatgttctgcttcacctcttgcttaggagccgttgccgacttctgggagcgacgccgacgacgaaagggtaaacacgccgccgttgattcagccggagaatca

SEQ ID NO: 5904 - DNA, 3000 bp, Unknown
  misc_feature (1)..( 3000): cDNA_ID_2172610_gDNA_ID_1620824_Annot_ID_169634 3000 nt of promoter + ATG
gatttgatgaaaacaggacaaagagggaataccacctgatcaacagaggttgatatttgctggtaagcagcttgaagatggtagaacattagcggattacaacattcagaaagaatcgactcttcacttggtattgaggcttaggggtgggactatgattaaggtgaagactctcacagggaaggaaattgagattgatatcgaaccaaccgatactattgatcggattaaggaacgtgttgaggagaaagaaggtatccctcctgttcaacaaaggtaaataacttctttttttccagttacttcagaagaattgagtcgcaaagtttttgccttgggaacattgagtcttgaactatattaactctttgtgatatctgtctcagctctcttagagttgtttgtgtggttgagtcaaaactgattgtataagataggttgcagtttattgacttgagtttcatgttttagtgacttgcccctcttgtgaaaattgcagctcctttcagctcagctcttttacttgattgtataagttgcggttcattgacttgattttcatgttttagtgactggctgcttccctcttgagaaaattgcagctcctttcgagtgtgtttacttatgcttttggcatcaaacgattctactctgcgtgcaagctgataatctatgctgtctcatataacagtgattctcattagtatttctaggatgcttatatatctcatggatgtttgcaggctaatctacgccggaaaacagctagctgatgacaaaacggcaaaggactacaacatagagggaggctctgttcttcatctggttcttgcccttaggggtggttttggtcttctctgagaagtaactcttgaagatatctttttctctttgtatggcttgttggagttcatgggaaaaaagtgattgcaatttggatatgatactttgaatattatgctgtttcactgggtttggatcattttaccaataatctgttaaatatcgaatcattttgttttgtttaacatcgaatcgtactttaacatatttatttgggatttagctatttatgatgaatatctttcattcaagaaagaggctagacatgtgaaaataggatcgagctatgtgtaagatcggaccaggccgattgagattgctggttgcatgagtccatcaatagtcccatatttatttgcattacaatgaaatagtggttacaaatcgtcaaatccaatgagtgtccatcacatttaacaatttttactttaattttctaagtaacttaacttgtcaacttgagtttgattctctatactttcatagccagaaaagcacatgagacatgactaatgtgattataaaaactagaagaaatcgtatggatgggccgaccaaaaaaaaagatgaccgttgagatttaaacgttaagctttaaagctttacaagacataaacgttgcggacagaatcggatccttccagagcctcccacaaactcatacatataaatacatgtgaagtagaatcaaagcaagaacaagagtccaagaataaaaatcaatcagaaagaagattgaacatagatctcaagagtcaagatcgatgggtttggttgtggtcatatctctgcctctaattttcttctgtctacttctcggatttggctgctacttcctcggaaaatctcgcggccgtcgtgagatccgtacaaatcctcaggtgtatggagctccagctccgcctcccggtgctatcgccgcctcctctccgccgttgtctccacacgccaagcccgacaattctcacaacgtctgattttccttcattttctcttctttgtctgtcttgcttgtctctattggaagatgcttttgtttgacttattgtgaattgttgtaacttgtaatcttttgattgtctttagttttcttgggatgaatttccttctttatttgtgtattttcctatctctttgatgtaaataagaaagctagtaatggtttacacattgattattctataagaaacatctagaaaagaaaaaaaaggaaaaaaaacatctagaaatatatcagaacttctttcacaaaagaataatatatatcagaactgcgtgttattaattcaacgagttcaaacttcaaagtatgatgtggtaacacaaccaaattctcctctcggatataattagaccaaaaaaaaaaagacgaaatatttttgctataaacaatatatatatgggtaaatgtgaagaaatttgtttcttctgccaggaaatagacagttaatacattgaaaaaatggtaaaactttaaagaaaagcatatcttaagagatgaaaccctaattaaggtgttgagacttcagagacagatcaagagatcttatcagaagatatctgtgaagcatttcaaacaaacattacaaaaaatgtagcctccttccggcggaatggtagaaggagttgtaattctgctaatgtttattttggtcatatatagatttaattctttgatattgcaaactcatgatcccattttcttattatgtggttaaccaataaaagactcaattttgcagtcttactaatcaggactatttgccaaaaaaaaaactaatcaggactaaaaaactacatctctttttttttttgctacatatatatatatatatgattattttcagtgtatatataatatgtatagatattaaaaataaataaaagataagtcgtgtgtagtccacatatcttgaacatcaaaatgacaaaactattaaaatccgcggcaaaatctcttatccagtgacatgttacttatcaaccaatcacaacacgccacctcatcaccccaagaccacttctcttatcttcctctccctccactaatcccctcaagaatctaaagctcctcccataagtcttctctccacacttcacccaaaactccagaaccctagaattcgaaatctccaaagaacccgacaaagcgccatg

SEQ ID NO: 5905 - DNA, 3000 bp, Unknown
  misc_feature (1)..( 3000): cDNA_ID_2172606_gDNA_ID_1620824_Annot_ID_169633 3000 nt of promoter + ATG
cattttaggttatattttcctagacaaagaatccatagggataaggagtgaatcctgaacaaaacccaattgagcccaatgaataaaaaagacatccaaagtaggtttgaaggaaaggatagtccatgctccctccatgtagagtgagtgatggtaagtaaatgtgtcttatgaagctatcgacaccaagttggagataaacaaaattgaaaagccaatgtacgtatgatgttgattcaggattaaaaatttataatatggttataaagtaacatatatcgtggatttgaaatctgaaaaagtcacgtactgtatgttgaatatgtaaggtgtgttaattgtaaatcattatataataacaggttcaaagaaaacgagtagccacctgccgatgcaaatttttttttgccaattacagacaaatcaaagatttgggattggagaggagaagatctattgaaaccgacacattaggtccaaaacatttcattttaattattatgatttaacgaaatagtaaaatacatatatcaacctttttggtccggtccctgttcttacgtctgtgatcataaagtatagagtgattttttattttttttcattatacaaattacaaatgactaatttaattaattagtgaacttttaatttgtcgataaccaataagaatgatggaaaacggcaaaagagtcgactgttgaagtttgtcggaaagacactccaccaaaatataaatacaaatcttatcactagtggaaactgtcgagtgtgtgtagttctcttttccttctaataaaagaatattatctttctaaattcttccaaattcattttggaattttctttcctttttctttttgttgacatgaaattttggagtcttcttctatcgccaattacgactaaaaaaacgattttatatatatcaacatagctctaacaagaacatgataatcgcaaatatacatagatttgcctatttgtacacaagcaaagttagttttaatactcagtatattacatctcatgaaaagaatttacagttttttctattaaagctgtgggagttttcttctaaaatgtttttttttgtcgtccttgtaaaatgttctacattcgtcattttcaggctatctttgatttcgaaagctgtgggcgttttctttttttaatttttttaatttttttttttttttgtctttttctacgaaaataaaatagcgtgcactgtattgtttctttcaactttattttttgactagtgaaagactagacattttgttgccctgcccctatattttttgtgtttattttaaggttgttttttctctttttataatgaccgtaaaatgagtttttacaaaatctgcttcaaatatgtaatgaaaaccttgataatatgtaaatgtactaaaaacaaaatcttgatatgggtacatgtgaaaatagtatatttctgttctaagaatatactgttttatgttctaaaatatcaacaaatagatatctttgcatttttttttatacatcaatattagtattacctacattgtctaagagatgtaacccaacttatgtcgcaactagaactacatctcagaaatcaccgagccgagagaaaattgtaagagtcctcgaccagcaaaacgtaggaacatcaactcaaagcagtcgagaataagaaccactgacttgcatcaaaacagaagatctaaccacaccacacagaatccgaaaagaagacatccaccatcgtttaaactttcaacccttgacccaaccaccggtgataaagacttgtccattatagtttactaaagtttatgatcaaacttaaaatatctgttgttagattgatacctctaattcctttgaattgcttcttagatttccactttacccttccacgatttttaagcaatggaaaattaagtttcatttgtttcagattttaatattaatccccttctatgcaaattgagggaccacgtagaaagttgtgagaatctcaatacacaaaagatatagaaacaatgattacatgcacaagcacgaggccataaatttccttatcctatacacattttcaataaagatgtaacattccaaacagaaaaccctcttgtagctcactctacaaaaaaaagagtatagaattccaatattaaagtttataggtcgactatttcaaaaccaattgctataaagtaaattgattaatatttttatactttcttcgatttataatataagttgttttggaccaatttttttgttttacaattaaattgtttttaagtttttatgcaaactatatatttattttaatattttataattatttatattatgcagtctcttttgtgattggttgaactttttaaaagtaaatattcttaatcttcgtacttttaggtaaaacaacttatattgtgaaacggagggagtatatcatttacaatttctctttatttagttttgtggtgattccgaatattaattacaacttgtaccatttaattcaaccatattcgaagaaaacattaaaggcaaaacaaattaaggggaaaaagaaatcaaaagttaaaaaaaaaaattaagaccaatgagaatagataaggggtaaaagacaaaaagagaatataaaaaaaacaaatagcatttggcgccaaaagtaaaactaaaatggtcatgtcacgtgatgttaatttttgctctacgaccaaagcaaaacaaacctaaagttttccaaatctctgggtcccactctcagatgtgctgacttttattttttttacttttgtcttaaatctttggaaattttcagttttaatttaatttaattcatctctctttctcactctataaatccccacagatccgtcacacttcacctagagaccctcccacagctttctcgataactgacaatccaacggttgagattcagttcttctagataaattcacatatccaaaggacacgtggcggcgagag

SEQ ID NO: 5906 - DNA, 3000 bp, Unknown
  misc_feature (1)..( 3000): cDNA_ID_2172582_gDNA_ID_1620824_Annot_ID_169627 3000 nt of promoter + ATG
gattccgggagagagttcccggcccagacgtagcaccgttggtgtgaactgggttaccattgtgtgtgtgttctgttctgcatttctcattacaaaggttctgtttttggttctaagtcgaagttggttctaaagctgaaacgttcttggtttgtggtgtgttaatcttcacaaaatatataacttcaaactttaaaagaaggaaaaaaaaatcggtgaaatttatttgaaaaagcaatttggaataggtcgaacagaatgttataaaagctcgttgttgacatatatataattcgtacgaatgtacttcgctgactttacttctacttacatcatacagaatacgaatccttttgataaaagttattagtcgtgttgatttcgaaatcgcacaaccactgttattatacaatcactaatccaaaaccacctcattcgttgttaaagctaatataaattcatcctaccaaaaaaaagctaataaaaatttatttggaaattgcaacgaaagatcttaaaaagtttaatgttttatatattcggattatgttatgattggtatatgaatcgttttagttgaattggtatataatttggtggtcaagtaggtttgcataaaatttaaatactagctagctttataaacttacattatacataagcacatgcctctcataacatatattggattttggccttttggtcgtttgagtcaagcaattaaaattttatttgaagaataaatttaaactatcaatattcaatcatgccagacgagtcgttaaaagtcaatggaattattggttgataagatgagatattttcgatcgttcttatgactatctagatatgaagatgagtcatacaagctatgagttcaaaaacggtgtaattttgccttgtttgaaaggacacaacaattatgaaattgtgttagtttaataaaggtttatgagtctttaagtcaagacgacgtgcataatcatatggaatgaacaaataattaatcttgtaagcttaatattgttactttgctagtaagttctgaatttaactttgaccaaaactaaaaagttttgaatttgatattcactttgttatacgcatattttagaatagcaatgaaattggaaaatttaaaagtagtattgattttttttttttaatcaaaggtttgttttcattccattagagtagctaacacatacaaggataaaaggactctaagatcccaaaatttagaacaacataataaagggtataccccaaaattactaacatgaaaataagagagtagatagagttaatcgacaaattatcttttgagagctttgaaccaaaagctaaggggctttgtagaacatgtaaggtcaaggtttgtcgaagtttcttccaagagcgagtcattgggtgaacgaattgttaatgtcgagagatgaaatatcgttgatgagggggctaaagataagcttctcgccgacacgaggagaactacacaaaatagtgatttagcaactgttcgggcaatggtggtggtgtcgcagtgagggtttaagggcatttgaccaatgttgagcaagtaaacaaactcgcaacttacggtatttggtgaagctattataagggttcgcacatggagagagtgtaaagccgtaacataataggtggatcctctctcatattgattatgacttcgatgatgctaaatcacaatttggtattgtgcatccgttcacaaaagttaattaaatcattcgaattgtatgttctttggcgacccgtacgatacttgtttgttgataatccacacacatgggctgaggaaagttttaacctacggcctaagtactaatcacattctttaatcgaacttaaggcccaagtgctaaatcacgacacattcttttaatttcatcagagagacaataaccgtaacagcgcaacaaataacaaactttaaagacaaaatgtatttccaaagagcaaacgtgaaacagaaagatcgtggtcataaagacaacatcgtgggttcaagatgactagataaacatgagttatggaccttacggttttccaaaaatccattttttaaccattcattattggattctaagaatttttactaatttcttaacaaaatccaaaatctcatttcaatgggtttttttcaatttcctctacgagatccttttttctttcaattttccatttgattttttttttttttttttacttttgttacaaaatccaaaaaccaaaaactaaggccatgaatgtttgtaattttaaaaatggtttttggattttggtttttggtttttagtttttgattttcttggtttttgtttttggtgtagattttagtttcttaaaaacttgaatggtagtttgtttagattttggtttttatgttaatggataatatttttgtaacaaaaaaatctaaaaataaaataaaagaatgtaatggatggttttatgattttggttttctttgaaaaattgttaaaacactcaaacactagattctctattttttagaaaaacttatttttttcaaaatcttgaatggatataaaatagattttgaaaaaaactaaaccaaaatctagtttaaaaaccacacccattcaaggtcttaaaactaaaatatttatgtattagttttaaattacaaagataataaaattgaggacagttgaaaaagaagaaaaaaaagtttgtatgtatttggaagttatttttctcaagtagaatactgtgaaagacgattcaacatcccttattttacggttgtgtcaaggaacattcgagaactttttttaataactccttaagggacaagttctctctgtttttcttttttcaatagcttctctgacactttattctttctttctgatattataaacctccgatttggtttagttcaaaactagaagcagcaaaattctgaacacgtaaagctttgtttcactcagtgtttcccgatcagatcca

SEQ ID NO: 5907 - DNA, 3000 bp, Unknown
  misc_feature (1)..( 3000): cDNA_ID_2172593_gDNA_ID_1620824_Annot_ID_169630 3000 nt of promoter + ATG
tagccgagaccaaacttggtctagtgactcagtgtttcttgaccatatctgccattaaaggagaaaccgtttctgatcagtacttggcaaatctcgccctcaagataaacgcaaaggttggtggaacgaacgtggagttggtggataatattttctctttcttcaaaaaagaagataaggtcatgttcattggtgctgatgtcaatcatcccgctgctcacgacaatatgagtccatccattgttgctgttgtaggcactcttaactggcctgaagctaaccgctacgcagctagagtcaaagctcagagtcaccgtaaagaagagatacaagggtttggtgaaacttgctgggagcttatcgaagctcattctcaggcccccgagaaacgacctaacaagattgtgatattccgtgatggtgtcagcgatggtcagttcgatatggttctcaatgtggagttacagaatgttaaggacgtttttgccaaggttggctataatccgcagataactgtaattgtggcacagaaacgtcatcaaacccgtttcttccccgccacaactagcaaagatggaagggctaagggcaatgtgccttcaggtacggtcgttgataccacgatcattcacccgtttgagtatgatttctacctctgtagtcaacatggagcgataggtacaagcaaaccaactcattattatgttctttcggacgaaatcgggttcaactcgaatcagattcagaaactcatctttgacttgtgcttcacgtttactcgctgcaccaaaccggtcgctctggttcctccggtttcttatgctgacaaggctgcttctagaggaagggtgtactacgaggcaagcttaatgaagaagaattctaagcagtcgcgtggagcgtcttcgtcttctgcctcggttgcctcttcatcctcttctgtcacaatggaggacaaagagatcttcaaggttcacgcaggcatcgagaactttatgttctttgtctgaaaaaaagtttgatcttaaaatatttatctaaataagaacgtctcattaacgcagttcttactcctttttctgattagaaaggatgtttgtgcgtgaatctaatcgttagatatgcagtttgtttgtttccttttcgttgttggtgtgttgaaaatagtttgtatttggtattgtaatgctctttagagctgaaactatgtcatgttatggtattttattatagttttcagactttggattcaataaatagttcatattttgctacttctctgttttgtgaagggcttgagaactcagacatgagtactctagttttgggtttacatgttctgccttgtgtctgaaattccttttttctaaaccatctattcatgtggaacattatctataaggttattttgtgtaatgatcaattgatcatgcatctctactttttttttttttttttttctttttttttttgtcgtcgatcatgcatctctactacatatgcattccaacaaaaaaaacataatggtgctcttgttttcgatataatatcagttatgggctctctgtttttattttattttattggaccttactgatatttcttgggttcatgaaccatagctataccaaatcattaaggtggattttgcacgatttctcaatgtttaatttcatgtattatatactcattgattggttgtttgcagaatcttatttactacattgactctcaagagtcccctcctatatttcatcaaatctatcttttcattttataatttttatgtaatgatagattcctcataaatgtttcttgaaaactataaaaaggtaactaacatttttttcctatatatatatatgtgtgatatatatcccatataaaaagtagcaacaagaaaatgattttagagaagtgataccaaaccaaatgaaaaagacatgatagtcgaagtgattcacacgaatcgaactataataatctatactctatcttattcacattttatcatctttttgtgtttcatgttattttcttatgtatatattcatttttcgtatattcttttgtttttatcaaaataaattcatttttctttttaccccactcattaacataagttagccatatattattataagatttttttcttgccaaataaatgtaagagtttctttttcccacaactcattaacaaagtttggcatatgtaaaaaaaagaatgaattttaaacctaatactagcctttaaaattcaacaattattttatttttattttcttattttcgtgcaacagctggagtgttttttttttttttttttgtgttcccagagatcgagtgttttgtgtttcttctctctatcgttcacatttgattaaagctaaagctttcttcttcttcaattgatgctacttctgatttaccctttctctgcttttttctctcactctctcagttttctcctccttgattcctaaagtcttctcctttgcgtgcatttcttcaattttcagattcttcctaaggtacccttctcaaaattcttccttgttttgcgattcttcatcggttcaatggatcctctttgacttcgattttgaatccgagcttcgttatccctcgattgctaatttcactcttttgtttaggattctttccccaatctaggtattgctttgcttctctgtatctatcgaatctgcattttgttagtttcgaaaattttgaaattagggttcatttgtgatttgttcatacatctttgttagattgcagaatctgttcatcatttttcgaattcacataactcagattagtttgaatctattgagattgagaaatttcttaaaaactctggatttgtgtggattaagattagtgttttgagattgatctctttgtcaatatggttttttttggtgtaggtggtagaatgatgaaatgagaatcgatagataagagtttaaagagcaccagaatctttgttatcttgca

SEQ ID NO: 5908 - DNA, 3000 bp, Unknown
  misc_feature (1)..( 3000): cDNA_ID_2172586_gDNA_ID_1620824_Annot_ID_169628 3000 nt of promoter + ATG
acgaatttgtaatctcttttgagcaaaaactacgtcttcttctttttttggtattattgtatttcagactctgcattcagtaattatttcatattttgctaattttgtttctgagttttgttaaaatgctttagatctcggagattagaattacatgttcagtgtgtgtctgaaatttagtaagtgcattaaccatgatcatgttcggtcgctactgaagtatgataagctctgtatcattcaattacttcatcattccttccacttttgccccttgtggactaccacagatgttacaagacaaaacataatctgtaaattgctaatctctgaacctaagacttgatatgaaacatttatttttattcccaatcgttttataaagattctgttgcttgcacaatctcattcaccacactactcatgtactcccaggttaatcaatcaagtttatttgtgtccgaaaaaatggaaaaatatgagaaattcccatccaattttaaggattgtttgaatgatcaaagtatggttgttttagagaaatgaccttaaacacccaattttacgttgttctcgtccaaaactagcggaaaatttataaatttttcaaataccacaagatagtaagagtttgtaagttatggtaagttcagaagaaaagaaaaatacataaatgatagttttttgagaattgaatgcatatttcgtcttagagtcaattagttacaattaacatgattaattaatagttattttgttgttttgttatttgttgtttgtatgaaatggtgttgttatatatacattggatactcttatagaagttgaagctgcaatttcttcgttgcatgacttcaacatttgatactcgttagtcaaaatctttttcgttacatcagactcgatcaggccacataatcatatttagaactaaattacaatcaattacgtattgttccaaacttccaaaagataattgaccacaaacactcatttccaacagaacatgactattactgactgactcacaagcatacactaataactatatccatttctcaacatatatctttacatccatttctcaacataaaggattgaacaaataacttaatttttcatcaaaattaacaataaccctatccctatgaattctcaacaaaaaaaagtttaaaacaacactagctacgagctctcaaaatgtttggtcgtgtgttcgagaacatttatataattaagttttttctcaacttatataattccatttagtgaaaaatctatagatatatttatataattaagttttttctcaacttatataattccatttagtgaaaaatctatagatatatttaaaaagtttactatttctttttggcggtttagagagcaattgttttttttaataattgagttagtatgtttgagtggtcgaactacgtattcactaattaaagacattttaatcttgacatagtcataccattttacataagtatggctaaatcaaaattaaaatgatcttaattagcgcagtgcctaactaaagttattttaattttgacatagtaaaagtctagtttatacaatcgcctttatagtgtataatgtattaaataattctaatcaagcaagtgttttacgcaactgatgcttttgttgaaatacattattagaatttagattaatatataaaccgatgtgaacgttatgaatttaaaacggtgttggctagtgaatgttgtgaaataaatatcagtaaattatgcacaagtcacataactttcagagattgtgctacactgctacgcctatcattcagcaacatgattttttatctgtctagttatctcatgttatagcggtttagtcgaataatatatgattaatcaaaattttacacacaaaatatacgttcgttaattgtatcacatcatcaataataaaacaaaagatcttttgactcgagctaagtaaaccacgttacatacgtaattgattctccaatcttctttattacctttttcaaaaagtatgcgtatgagcgaaccgatgagtaagtaaaagtgatcgttgatctgttggagatgagagtttgtgtaattgacttcatcaatctcttaactaaaaatagcaatgcgtgagggaaatgtttttcaaaagatgaaaagacacataaaaaccaatggaaaatacaacatcaaaagattctttacataaaatggtaaaaagaaaaatttacaatcaaagttttctttttagaaaactggaaacccacgctaatgcgtatacaatactcatcagtatatgatatatcaaatatatagccacatataataagtccattattaaaaagtaccgttattatcatgaccaaaatttaaagacaatacacacgtacaactaatattatttattaagaacataacaagtattattattattagaagtagaaatttttttccaaaagaggaaaacgaaaactttaactttatttacttacctaaaaaccttaatttttgacacctctagtgggttattataatgtcgttttcgatcgaaagtgaaacagagagacagtggacgcaagaaaaaaaccgtgggtggatgaaagaaagtaaacatgagatttttgtttttctttgttaatggtttccttaaataaattacaaacataattataattaagaagagagtttcaaataaaataaaatgaaatgccacgtcttacagttgcatctgactctgttttatgttaattgtgacacaagtttaatacagttgtactttcttactttttggtggtttcgtggaagattacgacaactttacaaactctacgacttaagcttctctgttcctacaccttttgttcttctatttaaagccctctgatttgttacttcacattcacaagttttgaaagcaaacacataaagaaaattctagttcaatcttttgtcactcaagagtcttcccgaccgtatccagtcaaatacc

SEQ ID NO: 5909 - DNA, 3000 bp, Unknown
  misc_feature (1)..( 3000): cDNA_ID_2054231_gDNA_ID_1620831_Annot_ID_169652 3000 nt of promoter + ATG
caatattaacttaagtatttactatggcatggatacaattcaatacgaaagatagctttagtcaagactaggattcagaacaatctgagtacttattaaacgatggttccttagattcataaacatgaagaattacagtatagtgtcatcatcaattttgatatatctttctttatctttttatgtttctgacgccatgtgtttatctgtctttgtttgatctagtaaatgacaaagccaaggtgcctcctagtgatgaagagttgagaaatgcaattgttgatatcttgaaagttgtggacttgaaaacggttaggattcaaacctcaaaaaatttatgtgcgtttagaagataaattgatctataagtctctaataatagctttgttatttcctgacagaccgcgattgctgacgtcctcaagcgacttggtatgagttaagatcagatcgttttatttcttcaccgacgatgtcgtctttgtaacttgctttgttttaaactggttttacagctgagaagttcgaaatcgacctcaccccaagaaagtcatctataaagacgatgatccaaaatgagctcagttcataagaagacaagaccgaggatgaggagtggagtaagttagtaagtgatatgggaaataataagggagcagagacacgtggagggctgtgattaaaagatgaagtaacggccaagatggaaacgagtggattgcctgcgtttaaaagaagctggatcaggaacattttatcataatcgtgaaagttgttgaagtttgttgttcttctctttgaggtttctgggtttcgaatattatgattcatcctctgtgaagaacaatgttcttgcaaggtgaatctagagtctcccctgttttatgaacattggagctcattgttatccttgaatattaatcggaagtgttattttggttgattgatcgattgtttgtgattgaagaaacagatcctagtttttctgtatcagtaagtaagaagaaacttaggatttaacatgaagcatctccttaggatttattcatgcccactttaagaagacctgaaagttagagaactagacttaggaaacaaacaggttcaggtttatttgtatgtgaaaattcagtctggttaaaaccaagctaaacgggttacccattactgatgaacgggtttattattgatgaacatatagttgggccttgttattttggcccaactgttttttatttttttgtcgttttgtcttcctcataccgccggagaaaccctaacgtcagagaaaagggtttgcatccccaaagtttacatttttacttttgaactccgtgcaggtttgttgtgctcatgtctgaagtaaatgttccggtgttctgttgctggaacggttgcatcaaggatggcactaatggcatatactatgaagggtccaattatagaatgaccactgtgaagggaaagactaagtttaacgaattgctggatcatctgtatcaagttactgggttagataggaagagatcaaagtttggtataatcggtagatatcctacagatattcaagcgtttagggttaagtataaacctcttcccgtggtggacgacactagtttggagactatgcttgagattacaaccaaacatccttatattaaagacattgacctgtatttggaagtggaatcgacatccgttggagttattgatcctgctacttgttcatcgccttcagacattcttggtggttcttcgaaaagacagaagaccgatatacatgttaagttagagagggagacggatagaaactcagaatcagatggcgtggtacacttggttgatagcagcactttgaataaagattccatttctggtcatgtttcaaaaccgtgtatgtctagtttgtggcttgacgatcatgacttgcgagtaggattgtgctttaaagatggcgatgagctgaagaaggcagtggactggtgttcccttaaagctcagcaaaagtgtgtagtacgagagactgcaaaggacgagtatatctttgagtgcatcagatggaaatgcaagtggtcacttggagccgctagaatgaaaaagcacggacttgtcgagataatcaagtatactggtccacatacttgtcatcccattgttccagaagatttcaaatcagagtttgaaacagatgagattgaacgtgcggtcaggtatatgcccacacaaacaatttcagagttgaagaagtggtggaaaaaaaaaattggctatgagcttgaaacttctgatgtgcggttagcgaaagagaaagctatcaaaagagtttttggagattgggatcaaagttttgaagattttcccaagttaatgtctgccctttgttcatctaatggactccttgtggactggaagtatgatctttttcctaatcctaattttgcatccttctgtggtgtgttttgggcgttcccacagtctatagaagggtttcaacactgtagacctctgatcgtagtggataccaaaaacttgaactgtgagtaccaattgaaattgatgattgcctcaggagttgatgcagccaacaaatattttccacttgcctttgcggttactaaagaagtttctactgatatttggcgttggtttctcactggaatcagagagaaggttacacaaaggaaaggcctttgcctcatttccagtccccaccccgacataattgctgttgtcaacgaatctgggtctcagtggcaagaaccttgggcttatcacaggttcagtctgaatcatttttactcccaattctctcgtgtttttccaagcttctgcctgggggctcgcattaggcgggctgggtccacgagtcagaaggatgagtttgtttcctacatgaatgacatcaaagagaagaacccagaagctcggaaatggttagaccaattccctcaaaatcggtgggctctggctcatgacaatggtcggagatatggaatcatg

SEQ ID NO: 5910 - DNA, 3000 bp, Unknown
  misc_feature (1)..( 3000): cDNA_ID_2042150_gDNA_ID_1620831_Annot_ID_169654 3000 nt of promoter + ATG
acgaagatgatgatgatccctttgatggttttgctttgcctttgatcttcaacgtacttttagccgccattgattctgatctcagaactctctctctctctctctgcttatctctgtgtcagagtcgatttagctggaagacaaaaaccctaaagggtttaagcacctttttaaagcctctatgaaacactctgtctaactcagagggtcctttattttttattaaaagtatgtttatccaataatgattctctggctcgctggaaaatagctgtcattatttatatttgaagcatacataaataaaatttctctctctttgtttattcgttaggtctcaaaggctctctctgtctctttctcaaaaatcatctgcaggaagtgaatcgtcaaaaccgagtttggaggatctgtcttgaggtaaaaaagctcaatcctttatcggaaattttcaacctttgcttttcctttgtttgttgcgttgctgaatctatctagggtttggttttttggatctaggagtttttttttggttgagaaatggcttcgaaaaggatcttgaaagagctcaaggatctccagaaggatcctccaacttcctgcagtgctggttagtctttacctctcctctcgtaaatcgtgtctgatctatttttgagctttgttgttagatcttataatcttatctttaagcaaacaaaaaaatgaaatcttttttagtcttcgtaattttataacgaagttatctagagatcttgaggtggtaattgccgctaagttatgatcttagtttagaagataccaattgaaagttgagatttttcttagaacagaacaaatttatggctgtactgatccttgattgaaaattacagctttctaataatcatagtctagaagatagctgttaaaaattgggatccatttacccatcctggatactattgatcataattaataagataacagttggaagttgagatttttcttagaacaaagttgagattggtcgttgcagttatcttatgatcatagtctaggaaatagctattgaaagttgtgaattttcttagaattaagcttttggtgttgtatgctgccttgtttatccaagtatccataacggatcttacagacttgatacctcgcactgatagtctttcttagttatctattgcattcaggtttatacatgtttgttttgtttattaaaatatatgataagtggataatgcgtcgaaattgttggtcttaatagagttagaggattgttgtcggagattctcaaactgttcatgcattcttctgctagagaagtctcaggacattgctatggcacatgttttgttgtgtgtatttcagtaaatgccatagatcatcatgtttaaaagactaatctttctattttttccttctatgaacaattgtgaaatcttcaaggcccagttgctgaagacatgtttcattggcaagctacaataatgggtccatctgatagtccttattcaggcggtgtctttctcgtaaccattcacttccctccggattatcctttcaaaccaccaaaggtaaattattcattgttaccaaactgaaatcatgaactggaattcaaaatgctctttttcttgcaggttgcattcaggacaaaagtgttccaccctaatgtcaacagcaatggaagcatttgccttgacattttgaaagaacaatggagtcctgcactcaccatatcgaaggtgaaaaagcactctttaaccaatagcagtggatgatatataatgaatctcctcttattttaatcaaatctcttgtgaatttataggttttgctttcgatatgttcattgttaacggacccaaacccagatgatccattggttccagagattgctcacatgtacaaaaccgatagagcaaagtatgagtctactgcgagaagctggactcagaaatatgcaatgggatgaaagtttgtgtcctttgatccctcacagactcggttttaatagagagagagagagaaagagagaggacttcttcacatagggatcttccatgaaataagttagattcctatgttttatcatctctttgtttgaaacctctttaatctcaaacaaaaacattacttcacctctttattatccatatgttccctatctttgtttctatgctttttccaaaaaattataagaaaaattatttatgtaaagctggaaactttgagcttttacctaacaaagtatgacgatgattaaatgggaacatttgacatttgctaccaaattttcaaaattccgtgtttgagaaaatattgaaataaaaccatttttgcagaaaaataaaataaaaattgcatgattttgaagatgttgattaacatattaattcgaaatttacccttgtatgaaatgcaaagtgataaatttaccctacagaaaattttctccacctttatcatttcccttgcttgtaagggatcaatgattccatatgtgcattaatttaaaaatacctcaaatcaaagaataaaggtacactttatctaccattgaattaagttacctcattatgaaatggaaagcgaaatcaaaaggcatattattacgaaacaataaactgtagatttattggttagctagatcatccaacttttcattcaatctgaattttcatttaatttatgatgatttgaatgtaaaatctgtaaatcatggtgtattattattaaccaatgaaatattctaaatactgaaaataattcatgtagtgatttagccaatcatttaggctatatttagttatttacatagcaactaattacgttcatgttgattaacaaggaaaaacgcgttcattacgcaataccatgcaattggaatccttcattatccaagaaatacctaaacaaattctcatgttttgcacagaaaacaaaaggaatccaaaatatttgctataggtatatctaaaagaaacaactatatatacatgcatg

SEQ ID NO: 5911 - DNA, 3000 bp, Unknown
  misc_feature (1)..( 3000): cDNA_ID_2687185_gDNA_ID_1620831_Annot_ID_169655 3000 nt of promoter + ATG
gcaagaattaaatacacccaacgatcaaaactcagagaaacggtctcaatggttttaatggctccaaggtttttttagttttctcagcttatataagagaagacttttttgccggctaaaacctgccggcgtatctttctaatcactcttttatctatttttttaatcagaaacaaattcttctgctaaagaaaatttctctgttttacagttagagacaaaaactagtttcttcacaatgcaaatcttcttgttcttcttctctttgattctctgttttgttctgatttcctctcagactcttgaagacgacaagaaagctttgcttcatttcttgtctagtttcaattcttctcgtctccattggaaccagagctcagacgtttgtcatagctggaccggtgttacctgcaacgaaaacggagatcgaattgtatccgttagattgcctgcggttggattcaacggtttgattcctcctttcaccatcagtcgtctctcttctctcaagtttctaagccttagaaagaaccatttcaccggagacttcccttctgatttcacaaatctcaagagcttgactcatctctacctacaacataaccacctctcaggtccactactagctatcttctcggagttgaagaatcttaaggttcttgatctgtctaacaatggattcaacggaagcatcccaacctctctttcaggattgactagccttcaagtcttgaatcttgcaaacaattcattctcaggggaaattccaaatcttcatcttccaaaactgagtcagatcaacttgtccaacaacaagctcatcggtacaataccaaagtctcttcaaagattccaaagttcagctttttctggcaacaaccttaccgagaggaagaaacaacgcaagactcctttcgggttaagccaacttgctttcttgctgattctgtctgcagcttgcgttttgtgtgtttccggattatcattcataatgatcacttgtttcgggaagactagaatctccgggaagttgcgaaagagagactcgtcttctcctccaggaaactggacatctagagatgataacactgaagaaggcgggaagatcatcttctttggtggaagaaaccacttatttgatttagatgatttgctaagctcatctgcagaagttttggggaagggtgcttttggtacaacctataaggtaacaatggaggacatgagcacggtcgttgtaaaacgattgaaggaagttgtcgttggaagacgagagtttgagcaacaaatggagatcattggtatgatcagacatgaaaatgtagctgagctaaaggcttactactactccaaagacgataagctcgcggtttatagctattacaatcatggaagcctcttcgaaatactgcacggttagttattttcattgctctcattctgatgataaatcgaaactacaaggttccattttctttgcaggaaacagaggaaggtatcatcgagtaccgttagattgggatgctagactgcgaatagcaaccggtgcagcgagagggctagctaaaatccacgaagggaagttcatacatggaaacatcaaatcctcaaacatcttcttagactcacaatgctatggctgcataggcgatgttggcttgacgacaatcatgagatcacttcctcaaaccacttgccttacttctggctaccatgcacctgaaataacagacacaagaagaagcacacagttttcggatgtatacagcttcggtgtggtattactggagctcttgacagggaaatcaccagtgagtcaagcagaattagtaccaacaggaggtgagaacatggacttagctagctggataagatctgtggtggctaaagagtggactggagaagtgtttgatatggagatattgagtcaatcaggtggtttcgaggaggagatggttgagatgttgcaaataggattggcttgtgttgctctgaagcaacaagaaagacctcatatagctcaagttttgaaattgattgaagatattcgatcagttgatgcagagtgagacaacacaaactagtagtagtaaccattaaagcaaattctttgtttcttcatagatcatttgattttattgaatttgaatcatgcaaaaaagaatgagactttgaattatagaatcagaaacaaatataaatccatttcataaaacgaagaaaacagaacaaatttgggaaaaaaagtaaaagcatctaagaagaacattacgaagaagatccaatttgtggattaaacgggagagaggaggtgaaaaagatgaggtttaggatctgagttcatgccgatgatgatgatcagagggatgaaaccatagtgagtcgcgactttggctttctgtaatgaccagttggtccaatccttgaagaccttgtactttgatgatgcagaggaggacgaagatgatgatgatccctttgatggttttgctttgcctttgatcttcaacgtacttttagccgccattgattctgatctcagaactctctctctctctctctgcttatctctgtgtcagagtcgatttagctggaagacaaaaaccctaaagggtttaagcacctttttaaagcctctatgaaacactctgtctaactcagagggtcctttattttttattaaaagtatgtttatccaataatgattctctggctcgctggaaaatagctgtcattatttatatttgaagcatacataaataaaatttctctctctttgtttattcgttaggtctcaaaggctctctctgtctctttctcaaaaatcatctgcaggaagtgaatcgtcaaaaccgagtttggaggatctgtcttgaggtaaaaaagctcaatcctttatcggaaattttcaacctttgcttttcctttgtttgttgcgttgctgaatctatctagggtttggttttttggatctaggagtttttttttggttgagaaatg

SEQ ID NO: 5912 - DNA, 3000 bp, Unknown
  misc_feature (1)..( 3000): cDNA_ID_2042148_gDNA_ID_1620831_Annot_ID_169653 3000 nt of promoter + ATG
tcatctctatctttaaaacacagtcctaaatgcatgtcatgatcgtcatcaatccacagtctaggcagaagacagggttttaaagcaccagaattgacaactttaaccaagatgccagctgagcctgaattattatccactatttcttgttgtgtgatcctctgtctttttgaggaactatcaggactttccagtggcgatgaacaagtaacaggaacaacgacagcatcagaagttggttgagcttccaaatagaattccaaattgtttacagaaggatgattccttggaacctcaagcatagtctccaaactagagtcgttcaacacgggaaaatgtacatacgtaaagagatccggtgaaacatctacagggtacttaccgaagattttgaactctgatttctgcttatctaatccaaacaattgataaagcctatccaacaatctgcttaaggcagtctttcgcataattgtgatctttttaagaatggatccttcatagtatacgccatcagcaccatacttaatataaccattcaagtgacacaacaccataaccttttctctgactgtttcaatcgccatgagcacaacaaatctgcagtgaattcaaagaaaaaatgtaaaaaatttaggcatagcttcctaaaatgaaaaaccctataaagctcaatatcaacggtaatgtacagctctaaaaggagaaagctttctagctatagaagcagataaactcattcaaaaacataaaccctaaacagtgatactcaaaactaagacttgtaaagttttacgcaactgaaaagaagaaaaacagggaatttggaaatgggtgtcgcagaaaaaagcttagatctttcagaaatggaagtaatttcaccttcgctaacgatttcgccggtgatgttactgttacaggtcaggtcactgatgaagacaactactacagtctacagggaaatgagaaatatagcttttcgaaattttataacagaaaaaaatataaaaaaatcaattgggccgacggaagaaagcccgtgaatatttgtagcttgttttacaactgaaaccagattaatcctacttccctaaagtcataagatgcccggctcggtgcaaactcaaatccatctttcagctcttcttcttagtagcgagaggagtagttctgcatttggtacctgatacgtaagttggaggtgatggaggtggtgacggtggaatgacaggaggaagcaatctcggaactccagaagcttccggccaagctgacatttccggaacatgagagaaaatggtggcgtaagttctttttaaccgttcaagagtgtaacagtcgtctacatactgtaaagggttgaatttcaacttcttgcagacggctagagcgtgtagacatgggaatttgtaacgctgaaaatccccgcatgtgcagctgcagtcgctcagctgaacaatacattcacccttatctaacgctgttgcaacctgaaaggcgttattgtctaagggcgttacaatgtaactgtaagtaacgaaagttgtcctgaattcttcaagcttgtccatgacaggctcggtgtacacatcgccgcagttaagagaacttcggctacaactaaaagacttgtcaaacttggatctcagttcatcaaatagaagaagcacggaacctgtcactacatgaccagcctgctcaaatgcgttacaaactgcaaacaaagcttttgtatttatctccatgattccatatctccgaccattgtcatgagccagagcccaccgattttgagggaattggtctaaccatttccgagcttctgggttcttctctttgatgtcattcatgtaggaaacaaactcatccttctgactcgtggacccagcccgcctaatgcgagcccccaggcagaagcttggaaaaacacgagagaattgggagtaaaaatgattcagactgaacctgtgataagcccaaggttcttgccactgagacccagattcgttgacaacagcaattatgtcggggtggggactggaaatgaggcaaaggcctttcctttgtgtaaccttctctctgattccagtgagaaaccaacgccaaatatcagtagaaacttctttagtaaccgcaaaggcaagtggaaaatatttgttggctgcatcaactcctgaggcaatcatcaatttcaattggtactcacagttcaagtttttggtatccactacgatcagaggtctacagtgttgaaacccttctatagactgtgggaacgcccaaaacacaccacagaaggatgcaaaattaggattaggaaaaagatcatacttccagtccacaaggagtccattagatgaacaaagggcagacattaacttgggaaaatcttcaaaactttgatcccaatctccaaaaactcttttgatagctttctctttcgctaaccgcacatcagaagtttcaagctcatagccaattttttttttccaccacttcttcaactctgaaattgtttgtgtgggcatatacctgaccgcacgttcaatctcatctgtttcaaactctgatttgaaatcttctggaacaatgggatgacaagtatgtggaccagtatacttgattatctcgacaagtccgtgctttttcattctagcggctccaagtgaccacttgcatttccatctgatgcactcaaagatatactcgtcctttgcagtctctcgtactacacacttttgctgagctttaagggaacaccagtccactgccttcttcagctcatcgccatctttaaagcacaatcctactcgcaagtcatgatcgtcaagccacaaactagacatacacggttttgaaacatgaccagaaatggaatctttattcaaagtgctgctatcaaccaagtgtaccacgccatctgattctgagtttctatccgtctccctctctaacttaacatgtatatcggtcttctgtcttttcgaagaaccaccaaga

SEQ ID NO: 5913 - DNA, 3000 bp, Unknown
  misc_feature (1)..( 3000): cDNA_ID_2042156_gDNA_ID_1620831_Annot_ID_169657 3000 nt of promoter + ATG
tgttagacgccattttctttattgaagttcttttttgttccttcaaacaaataacactataacagtgtgtgaatttagccaagaaggaggagactttgaacccatctaaataaataggcaattaggcatatacagctaaaaataaatatggctatgtatatctaaaaaaaagtatgtgaatttgacgaagaaggatgagactttgaccatcctgtgacgctttctttcttgtaatcaaccatgtgtcacgaaggagaagttctaaatcttaggtaacaaaaagtgtgacaaagttaggataaaaagttgacaagatgatgagcaacttactcttatcattatcaatacaccaccaaaccaaacaaatatttatatcaattaacaacaaaagaccaatgcccatcaacaaattacacataatttagaaaaaatggtgacaatagaaagaaatggataaatggagccacaaactttccttggttataaagttggagtcactcatcaagctgcaccaaccttgccgaagagcgactttcggatctacacacatttcaagaaaagatcctttagaacaaaactaaaaatacttaggacaagacaaatgaggtttcaagagttttgaaaccaataagaaggtataagcttaggaacatggtactacaaatttaagagagcaaatggggattttaatttaacctctggaagtttattgcggaaggcaacctccaacctcgcatcaagcgtgttttcacacacgattttcccatcacgagaagccaaaaccactcctcctgcactgttatatatccacaagtgccatattggtattagagtttttgattcttatatagcttttagtattttggtttgatgaaattttaccaggaaagagcatgaggatcatcatctgaaggagcaggaggaaggaaaatgtccttgtctacaataatctcaggagcatgaacctttgctttcttgcaatattcttcactagcatcatccagcatagactcaacaatgtcaagatcttcttcacgacaacggagtaacactgcaggctctttcaatctaagcaaacactacaacacatacccaaaaaatcccaatataaagaacacatttcaaagaaacaaacgagggagctagttgtgcttaagacagaacctgaacaatgagatctttcaagagatgcttatactgatggtgatgatgattgaaaaagccatgttggctaactttcaagagttgcttagctgcctcttctttcattgcattgacaatgtcatcttgcgcttgtagaactttgatcctcgatgcgttcagttgcattgagtaatcactttttacaaaacataagaaacagagcaaactcacaattaacaagtggcctaaatcaacaagatctaaagaacgatatgagtcagctcaaaactagcatctaaacgctcaatgccattaaactaggaattaatgagccaaagaggaacagatctcaagaacaaaatcaaacagataagagagacatagagaagtgaaaagagctctcacatcttctttctgacatcgacctgtttctccttcttctcatactcttgtctaatcttcttcttctctgcttcaacaagctgcaatttctcaatgttgaattcctgtcacatcaaaagaccaatcggttttagactcaaaaccattttttcatgttcagaaataatctcacagaggatcttaagatccgaagatcaatgtaaaacaacagtcaacatattttcaaaagaacaaaccaaaatagtcacgcaattgtcaacagagtcacgtattcgtaaagatcgagatcaaaagagagtggatgtaatgtatggacttacttcttcagaggagatggagatctcgttagccttttcttcggcttcctggcggataaacctaaccatctgctggatctggatggaagcatcggcgtcgttcatcttcgagaaacaagaaccaaagtctgaggatgaggatgaatgatttgatgaagaagccgtttcgtcttattttggtcaccaagcagcagttattatagtagacccagccaaatcatatttctttgtttttatccaatttgattgggtactagaaccatcccatcacacgtgtttctcgttttatgccaatataaatattatttattgattttatacccaaaaaagagtttatatttatcatacattttttgaataatgtataatgttttatgttacattaaatcatttagggcatgtaattctgttattcatatagtatcttctttctgagctttttttttgaatcaattttagactttggagaactctaaagctctatccatttgttagccaacaatcaaagaaaaaaaaagtcctaaccaattacatgaatctgagagacaaacaatgatacaaaataaaatgaatttctaaaattacttaagacaatcatgtttctattaaataatacattgattaacaaacgtacgcatatatgatacaaatgaagaagactttttgttttttggtaggcacaaatgaagaagacattatcttaaaataccacaaaacagaacatttcagctcttggtgatcaaaaaaaaaaaaaaaaaaaaaaaaaaaagagaacatttcagctctttttgtttgttgataattgtatgccaagcctctgaattttaccgcgcttacgttacaggctttaggaatagagttaagagaaattagccgtttggtatgaattttcttgaagcaagaattaaatacacccaacgatcaaaactcagagaaacggtctcaatggttttaatggctccaaggtttttttagttttctcagcttatataagagaagacttttttgccggctaaaacctgccggcgtatctttctaatcactcttttatctatttttttaatcagaaacaaattcttctgctaaagaaaatttctctgttttacagttagagacaaaaactagtttcttcacaatg

SEQ ID NO: 5914 - DNA, 3000 bp, Unknown
  misc_feature (1)..( 3000): cDNA_ID_2054212_gDNA_ID_1620831_Annot_ID_169668 3000 nt of promoter + ATG
acaagaaactagtaacaattcatgaaacgaaatcagtaaaccgattaccgatgattctgtatttccactgccgtatttgctctgtatctgcaaacacaataaagaagatttaaggttcacaatggagaagactcaaagtaagaaacatatttcaatgtttttgtttaaagttcaagaaaccttgagtgcaaaatcgttgacgtctagaagaagtaacttggcatcgaagaaatgagctagggctttggctagcatttgttggtaaagctctgcaaggaaacatattaaaattcaaaacacaaacgaattggttcaagatcaagatcgaatcatcggaatctaaccggcagggccggacaagagaatggctcggctagctggagacaagtttctcgtatattttgaagcatcgaagtgcttcaaatggacataagctgcacttgttagaagcactcgtgtttgttcactgcacaatcccaaaaaggtaaaaacattgatgaacaagactacatgtactatgtatcgatcggtgtgggtatgtttcagtgatcaaaagaataaatccaaacattttgggataaagatcaaagaatctaaatgatagtgacacgtgtcggaactagaaaaacaatgaaatcattatcggcgtatgtaaacagaaattcacatgcttcaccattattatcactccaacaaatatcttatccgtttttgtaaaactacatttaataactaaaacaaataaaaacactatccaaaaaatatgtgatgactcatattatttccttatcatttctatattctcacttgtattatcgtcttgaaactcgtaaactataaactaaagtgacgatcaaaacatatgtatattccatcacaagaattgttttaagatcctaattagaattgattgatcttaaagtctagttgaatgcatgcgaattatgggaactttcgatgttatatgttttaaattacctgagataataaggaaactcatcgaaagtaattttactctctctgccgtcaacaacttgacggagtatctccttctccatcttatccgccgtgacggcgttatttgacgacgagttcccgccggcccattttccgacggcttgaccagaagccaagcctaaacccacacctactccaactccgacgccaagcgccgacaacaacatctgtttgctgtccatttgatcttccaaaagcaaaatatgtattaaaaaaaaaacaaaaaaaaacaaagtattagtattattaatatatagatcaagatctaaaacgttgttactaatcgtaacaacaataaaaattgaatgataacaaacaaaaggtatcgatttatctataattctatattgactatttaacctaacttattcgagaatccaaccgaaactttgaaagtattttcaaagatttaacaagagaaatatataccttgtttcgtaagatatctctctcaaatcttttcttctgcagtttctttgtacttgttttggtcctaacgattcaatagtctgaaaaatcacagagagtagtgagaaccgtgaaaaccagatctatttacacgtcatcaccggtgttgaaaatgaggcaaagacggcggcggatatgagagatttagggttcttttaatgaagatttttttgatcgcttctctgcttttttatttcatgggggtaatatgtttgcacatgaaaactgatgagtcattaccgagactttgcgtacgtgttgtcatataaacggctactaggttggtttttcggcagttttttaattctgatgttgccgcttctttactctaatgccctttagttttttagtttctttaatttattccttgatagtttcggaattgtcattatagtccagctttaattaaattattccggtaaattttgttttcgattgtgggtattctgtgataattgaatatttttataggggtaagttatagatgttggcacaaaattaaacacaaaggaaaaaatgtagataaaacactaaaaaaaaaaggggtgcagactgtagaaagcatgactgtgttagatctggaaggcgtggctcatttagaaccgttggattgtataataggatcccacgtaagggaacaagttgacggcttagattgaaaggtatggcttctcctgtcttcgcagaatcgtaggcattattaaacaaatatatcctactttcaatcttttggtctattgattgactagtgatatttttctagtgattgaatgggctttttgttttggtcctcgaaagaaaaactaaccattcgaaattttgaagtcatatacacactatagggtttcttaaaaatatgtatgggccagtcttggatgttttataggaaaaacatatagcttctgaaaataatacatacactttgtcaccaaaaaaaagagtctgaagattggtatggatattgaaaattatacgattatttacactatatacgtataagtttaacaaaaagtcaggatggccgagtggtctaaggcgccagactcaagttctggtcttcgaaagagggcgtgggttcaaatcccacttctgacatttatttttgtgcatttctttttgtgcgttacttcctaattaatttgttcagagataagtttttgggttatatattattgctaagaaaataagttaatgaagaaaaattagcaatgttaatttgatcggttcaagttcattgataaatttggtccgctcaagttattcttccatccaagtgttgttgccttgattaagtgaagcagagaatgcaattatgcaaatggccaacgaattttgttaaatgtagaaaaatggcatatctaatgaaaagttgaatgggtaatctgctgaagaaaaattaatgcaacatgtttttcataaacatttggctatataaacatgcatgttacattgagatcaagaccataattatttataaaactcacaaaaggcaaacatcaagtagctagagaaatg

SEQ ID NO: 5915 - DNA, 3000 bp, Unknown
  misc_feature (1)..( 3000): cDNA_ID_3078906_gDNA_ID_1620831_Annot_ID_169672 3000 nt of promoter + ATG
gtggtagctacatacttttttagttaaattcgaatgtgtatataatatcgtttcaaatgatatggattatggtccgaaaacacacatttaaatgcacagtgggttatagaaaaatcaaggaaacaaccagccaatgtgattagaccaataaccagaatatgattttgtcttacatgactaacaataaatatgatgagtatgccaggcagaaagcataaatatatagcatcacaaaataaataacatattgtgttctagtgacaaaattaatactaaatctatattatttttatattttagacttaaatctatatttgtcaaaaaaaaaaaaaaaaaaaagctgttatttttataacttcacttaacctattgggctttccctcaagtttcttattggcccaaataaaatctcatcatagcatcgtctattctatgatccctataaacaaatttcccttaaatttcatacgacgtcgtagtcaagcatctaccttctcgacgacgacgacgtgctgaccccattgaacgctacactaacggagacgttaattaagaattcgtcgtctgtcttccgtctcaaagatgttactgttatttaatgattttcttagaaagtaagctattaattcccaacggccaagattgagttaaataaatcgacgggtgagattgaatctgtatcaaacgctcttatttagagagaggtatgactgaaagagacttttcgttttcttctccgtttctcgctcatcgcttactgaaaccagaaacaagtttagggtttttgcggaggtttcaaagttaacaatggcggaagagcacaagcacgaggaatcgatcatggagaagatctctgagaagatccatggtcacgatgactcttcttcttcttcttccgattcggatgacgataagaactctgcgtctctcaaaaccaagatttatcgtcttttcggaagagaacagcctcttcacaagcttttcggtggcggaaaacgtatggatctctctctctttttcaccgatttgcgattttagttactatttcttatcggatctggaatctagccattgattgagacttaggatttgatttgttgcttggattgagtatagattcagaaaatcaggatataaacgaacgatttggtttggtgtttgctggttctggaatctgagagtatctatggaatgagtaatttcgtaagcttattatcatttatttgtttgattcagctgccgacattttcctgtggaggaacaagaaggtatcaggaggagtattgggtgctgcaactgtttcctggatcttattcgagttacttgagtacaatcttctcacactcttcggccacatttcaattcttgctctcgcagtattgttcttgtggtctagtgctagtaccttcattcacaagtaagttttatggatgaatgtttatgtttattgtgagattgatgtttagtccatggtatgttaaagctgattgttgtattacaggtcacctcttcatatccctgaagttcacatccccgaggatgttgttcttcagcttgcttctggattaaggattgaaatcaatcgtggatttactgttcttagggacattgcatcaggaagagatcttaagaagtttctgttggtaaacctttttgttaattatgttgttgtttgattttgctggtttcttgttatttttttttaacattggttcacaaatatgttttaggtgattgctggtttatgggttttgtccaaagttggtagctcctgcaacttcttgaccttaatctacatcggtacgaatccatacttttattgcatctaatcgattaacttcaccaattgtgttttttttttttcgtaatatataatcctcttttgttctgcttccagcaactgtacttctcttcacgattcccgtgctttacgagaagtatgaagataaagtagatgactttggtgaaaaggcgatgagggagatcaagaagcaatacgtggagttcgacgtgaaggttttgagtaaggtgatgagcaaaattcctaaaggagcctttgcctttatcaagaagaaagattagagagtgtgtaagtttctctcatcatcattatccgagattattcaagattgatatataaatctcgaagcattgtttttttggctgttggttaataaccctttattctctcaaatatctgctatatggattttattcgggttttaaccaaattttatagcaatattgaatctgattgaaatttgaattgatccttttttcggataccatggtcgtcatgaatgttattatgataaatctttaaatattccgaacttaatttaatgtttacagaagttgattgttttgtaaagaaattgattgtttctgccattgatttcgcaaagttggttagaactatgaattcgtagaatgtttacagttttttcctaagatttacatgttgcactgattttggtgtcatctttcacattgttatttatctccgttttccataaagtgtatttaaataaatgagttcccctagttttagtgcaagtgtgcaaccattaatgtaaaacgtagacatatgtagaagtttatttttgacatgtaatctaagggatcaaattatggatgattctgtttgtagtttaaagacacattctattatgattctgcattttgggacttgaatatacatttgacagattcttgtaagtgaaacttgttacacagcccaataattttgatccgtgggggaaaagaggttatttaattgcactaaaatttagaaataagaacgatattaacttcagtagctccaacttaactgatgtcaaaatttaactagacttaaaaggaaaagagaaaaaactttattcagttggcaaaaccagaggtcagctaggtccgactagattaatcttaaccggtcaatgtaccgaccaattaatggaacctgtcgttttctgattatctcttatagtacgtacactcatg

SEQ ID NO: 5916 - DNA, 3000 bp, Unknown
  misc_feature (1)..( 3000): cDNA_ID_2042203_gDNA_ID_1620831_Annot_ID_169674 3000 nt of promoter + ATG
gaggctgttctcttccgaaaagacgataaatcttggttttgagagacgcagagttcttatcgtcatccgaatcggaagaagaagaagaagagtcatcgtgaccatggatcttctcagagatcttctccatgatcgattcctcgtgcttgtgctcttccgccattgttaactttgaaacctccgcaaaaaccctaaacttgtttctggtttcagtaagcgatgagcgagaaacggagaagaaaacgaaaagtctctttcagtcatacctctctctaaataagagcgtttgatacagattcaatctcacccgtcgatttatttaactcaatcttggccgttgggaattaatagcttactttctaagaaaatcattaaataacagtaacatctttgagacggaagacagacgacgaattcttaattaacgtctccgttagtgtagcgttcaatggggtcagcacgtcgtcgtcgtcgagaaggtagatgcttgactacgacgtcgtatgaaatttaagggaaatttgtttatagggatcatagaatagacgatgctatgatgagattttatttgggccaataagaaacttgagggaaagcccaataggttaagtgaagttataaaaataacagcttttttttttttttttttttgacaaatatagatttaagtctaaaatataaaaataatatagatttagtattaattttgtcactagaacacaatatgttatttattttgtgatgctatatatttatgctttctgcctggcatactcatcatatttattgttagtcatgtaagacaaaatcatattctggttattggtctaatcacattggctggttgtttccttgatttttctataacccactgtgcatttaaatgtgtgttttcggaccataatccatatcatttgaaacgatattatatacacattcgaatttaactaaaaaagtatgtagctaccacctagccaaatcaaatctctagggcttactattgcgccatcatgccaaacaattagcccgacaagatcagattttcttagggtagtaatattcttctcgtgatcaataggataaagagaacatattgtataactatctgaaatgatttgggatcgacgtttagttaaaatatataattaacttaatcattgagtttgacggaaatagctaagctgcaaatgcaatgaagcgtttttcttttaccagtaaattataagatttgttaaattcgttggagtcaaaatatggatcactctcatccaaattcattttaaaacttatacattatgctattagtgtatcaatctcaaccaaaaacgtaatagcttctttatattttggaggaagtccactaaagctgaatttcggggaagcctatcaaacaacgagtgactagcttctttgacttgcttttgaaagtgctttgcccttttgaattttagataaagcgaattaatgaggagaaagaaagaaatttttgttttattttgacgagagtgtgtcccattcatttgtttaccaactcaagctctataaacttattttcagaaacactaatataagaattatacatgattgcagtatgaatccatgaattggattaagaaattaaatggaatagaaaaaaaggattaataaataaataaatggatcatacgaaatcacgtacacatgtacagtgtaaagggcccatcatctttactgattttgggaacttgatgaggcccattaaagaagggtgataatgggactttggggtctacatccattgaatctgacggcctgaaattttttggcaaataatgatgatgttaataatacgtctcggaactacaaactttacacatatattgtgcatattttttacaagtagtagtaatattaaacattatccagattctttcagaatcagtttagtttttttaaatgctttgtaggcgacaccatcaattttgtcgattcccatatgattaatatattactacttagtagtataatattatgtaacataatctcgtaaacataaaacaaaattgcactaatttgtgtttcaaatgcaagattttctttggttcaaagtagtgccaaaaagtatcactattatttatgtgtactatgtagaaaataaaagagtacgtatataaatactttaatgatctctgaccttttggtctgactgtctcagtctgaaagtcacgtgactcagctgctccctacgcttagcaacgcaacgcaacgcaactctttgccacgttttttcttatttgcctctgcttcttttgttaaaacatggcaaaacaaaatgaatttacaaatttataacaaaataaaatttgttttattgtgaataatttcaatttttaaatacatacaaaaacagtatccaaagcttttttttttctttttgtggttgtggtttattttctttcagccatagctttgtttgtaaaacgtaaacacaaaatttaaaattttgcctaaaattttagttttttttgtctgtcaactatatacgaaaccttttattgtatcaaatcaatattaaattctactgtattagttttattatggtttgttatatttttcttccttgtaaaaaccaatgtttcacaccaaacagtaaacataaaaatattgtcttgcaatgtaactaaaattactaattatagacttatgaactgtaacctatggttattaaagacagataaattagcatagtctttaagtacgttttcttttgtcataactatttcataccatttttatgaaaatggaactaaaagcaataaagaacattatatatatcaagaaaaaataaagtaataatttttatatatatagctttcactcttctcttacaagcactgttattaacccttctttttcatctaaaaggagaggagactttgaagaagaaagaaaacattcaaagctaaaaaacgcagcgttttaggaaaaaagaggtagagagtgattctggctttcccaaca

SEQ ID NO: 5917 - DNA, 3000 bp, Unknown
  misc_feature (1)..( 3000): cDNA_ID_3078902_gDNA_ID_1620831_Annot_ID_169673 3000 nt of promoter + ATG
cctcagtttcggtaacagaggtgacaatggtggtggttccgatggattcaccggcggagtaacggcaaagagaagaagaagaagattcggaggagtgaggaaggaaagtaacagcaccaccactgtttttccagtagttaaggagactgaaagcttccattgttgggaaagccagaatcactctctacctcttttttcctaaaacgctgcgttttttagctttgaatgttttctttcttcttcaaagtctcctctccttttagatgaaaaagaagggttaataacagtgcttgtaagagaagagtgaaagctatatatataaaaattattactttattttttcttgatatatataatgttctttattgcttttagttccattttcataaaaatggtatgaaatagttatgacaaaagaaaacgtacttaaagactatgctaatttatctgtctttaataaccataggttacagttcataagtctataattagtaattttagttacattgcaagacaatatttttatgtttactgtttggtgtgaaacattggtttttacaaggaagaaaaatataacaaaccataataaaactaatacagtagaatttaatattgatttgatacaataaaaggtttcgtatatagttgacagacaaaaaaaactaaaattttaggcaaaattttaaattttgtgtttacgttttacaaacaaagctatggctgaaagaaaataaaccacaaccacaaaaagaaaaaaaaaagctttggatactgtttttgtatgtatttaaaaattgaaattattcacaataaaacaaattttattttgttataaatttgtaaattcattttgttttgccatgttttaacaaaagaagcagaggcaaataagaaaaaacgtggcaaagagttgcgttgcgttgcgttgctaagcgtagggagcagctgagtcacgtgactttcagactgagacagtcagaccaaaaggtcagagatcattaaagtatttatatacgtactcttttattttctacatagtacacataaataatagtgatactttttggcactactttgaaccaaagaaaatcttgcatttgaaacacaaattagtgcaattttgttttatgtttacgagattatgttacataatattatactactaagtagtaatatattaatcatatgggaatcgacaaaattgatggtgtcgcctacaaagcatttaaaaaaactaaactgattctgaaagaatctggataatgtttaatattactactacttgtaaaaaatatgcacaatatatgtgtaaagtttgtagttccgagacgtattattaacatcatcattatttgccaaaaaatttcaggccgtcagattcaatggatgtagaccccaaagtcccattatcacccttctttaatgggcctcatcaagttcccaaaatcagtaaagatgatgggccctttacactgtacatgtgtacgtgatttcgtatgatccatttatttatttattaatcctttttttctattccatttaatttcttaatccaattcatggattcatactgcaatcatgtataattcttatattagtgtttctgaaaataagtttatagagcttgagttggtaaacaaatgaatgggacacactctcgtcaaaataaaacaaaaatttctttctttctcctcattaattcgctttatctaaaattcaaaagggcaaagcactttcaaaagcaagtcaaagaagctagtcactcgttgtttgataggcttccccgaaattcagctttagtggacttcctccaaaatataaagaagctattacgtttttggttgagattgatacactaatagcataatgtataagttttaaaatgaatttggatgagagtgatccatattttgactccaacgaatttaacaaatcttataatttactggtaaaagaaaaacgcttcattgcatttgcagcttagctatttccgtcaaactcaatgattaagttaattatatattttaactaaacgtcgatcccaaatcatttcagatagttatacaatatgttctctttatcctattgatcacgagaagaatattactaccctaagaaaatctgatcttgtcgggctaattgtttggcatgatggcgcaatagtaagccctagagatttgatttggctaggtggtagctacatacttttttagttaaattcgaatgtgtatataatatcgtttcaaatgatatggattatggtccgaaaacacacatttaaatgcacagtgggttatagaaaaatcaaggaaacaaccagccaatgtgattagaccaataaccagaatatgattttgtcttacatgactaacaataaatatgatgagtatgccaggcagaaagcataaatatatagcatcacaaaataaataacatattgtgttctagtgacaaaattaatactaaatctatattatttttatattttagacttaaatctatatttgtcaaaaaaaaaaaaaaaaaaaagctgttatttttataacttcacttaacctattgggctttccctcaagtttcttattggcccaaataaaatctcatcatagcatcgtctattctatgatccctataaacaaatttcccttaaatttcatacgacgtcgtagtcaagcatctaccttctcgacgacgacgacgtgctgaccccattgaacgctacactaacggagacgttaattaagaattcgtcgtctgtcttccgtctcaaagatgttactgttatttaatgattttcttagaaagtaagctattaattcccaacggccaagattgagttaaataaatcgacgggtgagattgaatctgtatcaaacgctcttatttagagagaggtatgactgaaagagacttttcgttttcttctccgtttctcgctcatcgcttactgaaaccagaaacaagtttagggtttttgcggaggtttcaaagttaacaatg

SEQ ID NO: 5918 - DNA, 3000 bp, Unknown
  misc_feature (1)..( 3000): cDNA_ID_2054192_gDNA_ID_1620831_Annot_ID_169683 3000 nt of promoter + ATG
tcttaaattaagagatgctatatcagaaactaatattatattttagttaaaatctatttaaattttaaagtaaactatatattggatacaatataaggtggtgctaaagtcaatattaattaattttaagtttttaccaaaaacataacacataatcattgtaatatctattatgaatattgaataatcatactctagaaacttcacttaaattttatttataattaaataacaaaattcctatatataaaagataagatatttaaattaaaatttcattataaagcctgaaggatcctaatcatgattatcataaaagtgtatatatgattaaaaaagtttagttctcctaacagatatcagattattatatggtatgtatatacttttttttttcccctaattcgaagatgcaccaagttctatcttaattagatactaggcatcttatattttatatatatatttgtgtgctcagaacaaaaattaaaaggaagaaccaaaaacttagcacatcagaaatcgcagagcccttctctagcactcaacacgaagaaaaagcaaaagatggattctttgcaagaacttcttgacaagaagcaatacgacgaagaagcaaaacgtccatgtcaagaagcgatgaagaagcaaaacgacgttgctcttttccttgcgggggaagtaatctctgccgcagacaaaaactctaacgtcgtcttctctcctgcatctatcaactccgttctcaccatggccgctgctacctccgacagtgaagcactaaaatcttgcatcctctccttccttaggtcttcttccaccgacgagctcaacgacatcttccgcgaaatagcttccgtcgtcctcgtcgacggaagcaaaacaggtggccccaaaatcacggtggttaatggagtgtggagagagcaatcacttccgtgtagtcccgagtcgaaagatctctttgagaatttctacaagtctgctttcgctcaagttgatttccgatccaaggtcagtttctgatttcgaatttgctttgattaaattagggcaagagattgtgtgaaacgagtgcttagagaaactacatatcgtattcaatgttttggtttgttgttttgaagtttgaagaagtgcgtgaggaggtgaattcttgggcattacgtcacaccaatggtatcatcaaagatcttctacctcctggatccgttacaagcgaaaccttgtggatttatggaaacgcattgtacttcaaaggagcctgggaagacaaattctataagtcaatgacgaaacacaaacctttctaccttgtcaatggcaaacaagtacatgtgccattcatgcaaagctcacaaagtcaatatgttaaggcttacgatggtttcaaggtccttagacaaccataccgacaaggcgttaatgatacaagtcgccaattctcaatgtgtacctatctcccggacgagaaagatggattggataatcttgtggagaaaatgacatctactgatggattcttggacagtcacattccgagttggagagttgaagttggtgaattcagaattccaaagtttaagattgaattcggttttgaagcttcaagcgttttcaatgactttgcgcttgatgtatcattataccaaaaagctatgattgagattgatgaagaaggtactgaagctgcggctgctactgctctagttggtgcttgtggctgcagcctttataggcctcctcctcccatagattttgtggcagatcatccattttttttctttattagagaagacaaaaccggaactgttttgttcgctggtcaaatcttcgatccttccttatcttcttctgcttaagatcggcctaaataggagtttgggattttaagatttggtttttcatatgatttttgagttttgtttttggttttgctaaatctctatttgctttatcttattatataaagtattaaagttagtaactcaccacagtgttaattttaacggtctcagattttcaacatgtgaaacaaaaaactcatttatttattttaaaagaggaaatttatttatttaaaaaaattaaagaagattcttttttttggtgaagaaaaattaaagaagataattataagaaaactataaatatcttattaaataaaaataaaaaatattttataattctaattaatagctactaattcttgaaaacatgcaaagggaaatttactaattcttaaaaaaaggaaattttcctttaatttattccaaaaaagtatttctaaaaagtcaagagattgaaaatatgaaaactatatctcttattaaataaaaataaaaatggataaataaaaattttaaaaaggattttaaaagttatataatgttcatataaaataatataactaagaaaaatttacattcaattattaattctaaaaggaaaagaattgtgaatctcaccaaatcaccagttatttattattttaaaacaaataatcgaacaaatcaacccaatatcctaaaactttcctcaaatctctcaaaaacttcaaataaacaaattccacaaaatattctaaatttcttgttccaactggaaaaattaagaagaattttaactattttttgttttgggatttatctttatacaataaaaaataattacatttatttcaacgtaaatttacttttgttgactctttttagttttacctacctatttgaaaaaaaaaaaaagaagaagaaatattaactcttttttccagtgagtgtattgaaatatgaagtttatctaaattaaacctttccggattccatcattcaactaattaataaagaaatctacattttaataataatttgaaatttcctaaaatatcatcaatatgttcaatacaaaaagcacatccaccccttaactggtttacatcatgtaaattacatgtctgagtcctctatcttttctcttccgttatagtcttatagatcaaaa

SEQ ID NO: 5919 - DNA, 3000 bp, Unknown
  misc_feature (1)..( 3000): cDNA_ID_2042225_gDNA_ID_1620831_Annot_ID_169681 3000 nt of promoter + ATG
atgagagttacctaagcaactagtagatccttgtccacatatctccttggtgtcgttatctctctgtgtcctcaccgtttcatctaaaaggatcaatttcgtccttctcggagtgccattaccactactacttctagaaagttttcctcttttcctaggagactccgcactttctggactagcaatcggtgaataaccattttgaggctcagatgaattgtcaacccgaagtttagtaagcctatcatgtacaaagtcatgtgaatgcattaacttgcgccataacgatgaatcagacgctccactgctacttcctgctcctaaatcaagaacaagactaaatcaaaacccatccaaccaaacttgaaaaagtttgcaaatttaccaagaacaaaaacacaaatttggatctacaactataaactgtactcagtgtaaagaagaataatttcaaaatccccaaatgaaatttgaagtcaaagtgaagagaaattagctaacctttcttgttgattgaagcactactacaacgctcaattgaagaattaacaccaatcgagacacgagccttgtcacagttgttatctgctttattcgacgaaaccctaactccaccaccacacccttcagatcccataagcttagccggcaacgaaacatccacaggacaagaaatcttcaaaccatccatcacaaacccaaatcgaaaacatcgcagccgtgtaagctgcgatacgaactcatcatctccttttaaaccaaaacccagatagttcgatcgagctttagagaaagctaaatcttagaaatttctggagaatagtgagctacaagagtgagattgatttggtttttttttcctcgatgaagaaacgcaatggtgcggctgcgtgaatcgagggattttaatctagggcaagaaaatgaaagaggagaaaaaaaagatgagtatttatagttttcgggaaattaactttggccttgttttagataagccgtcgacggtgagattgttccggtgagctcgtctgtactggtaactctgacgtggctactacattattgcgaaacggagtgatttagaaccgttggatgttgactgatgacggggtttttatgatcttgttggttaatagagtgacacgtattcaagtgaagatttcacttggttcatgtggtttgatatgagtttccaaatatgccactggtggattctcaggtgtttgcttggagcggagggtgtttttgattttgacgaaattatcccttatctgaatgttaacgccgttagattgtgttggttccgttaacagatttttgatttaactatttcggttcaaggtcttcttgaacaagtcaatgaagttacattgacaaaaaagaataaaacatgaactttacaatattgaagggattgcttttgtatttaaagttagtttttacaggtagtgattgtttggatatgtgctctatttcttttgtttatttgtgttcgtttttgttgagattatggttgtgtaagcgtggtttagtatttgtttaaaactattgaggcaatctaatgttgggtcctcttggaagatcatctttgtaatctttctcaatacatcaaactgttttgtcaaagagttttcggctatgttgcttttgaatgtggtatttatatattccgtgtgctttaaggttcttctttctttatatccgctttttaatttttggttttagagtttttatgtatccgccagttttatttttagaaaaaaatttttttttattaaatataactatacatatcatagataaatcatttagacgagaaaaattaaaaagacgttaattttatgtacccgtcaattttatttttggaaaaaacaaattttcttattaaatataactatacctatcatggatgaatcatttagacgagaaaaattaaaaagacgtttaattttaaaagcataattagtttcagatcattttaaattatggaaatttaatagtaaagtttcttaaaaataatatgtattactcaaaataataaattttctaaaaactttctttatctaaaaaacatgtcttaccaacagttgatcctaaaccaaaacaattatgaatctaaacacttagaagtttttttgttaacaaaatggaataaaataacaataatccagttttgtcttaaacgtataaagccttattgttttatattggattagcaattgggcctgaaagaagaaaaacaatcatatgggccaataggacttggatctatattgcttcaacttattacaatattcatgcatgtgtggaatttggctatgtcatgtggatggataagcgttggcagagtcttcgttacgttttcataaattatctaaacaacttaattacacaatattctcaggtattggcaagaagaaaaaaagaagaagaagagaaaaatcataatataaatatacttctggacacgttgaagagacatatttgatgactagtctaagcaagattccacaaaaatgaagcatcgattttgatcaaattattcggacttcaaaatatgaaaatagtatagaaatattttctttatgtaatattcaagccgcattttgacaaaaataattaataaaaaaaatgtaagagtatccccatctttagtttttaaaataatagaaaaaataaatttggtcaaaagacaaagccgtcccttccggttcacacgagccgcacgtgtgctttccttttttctccttccccgttctctagccgattctctctgtctagggctcctccgtcttcttcttctcataccttcacataccacaaaacctctcttctctctctattgattctctacgaagaggaaagtgattttgaaccatcttgatcggaaacggcgtttcgaaactggaggtcgaagacgaaaaaaactcttatctcatcgctccggtgtaccgaattcgagaggtttttgttaggtttcgtagtgattgattgattttg

SEQ ID NO: 5920 - DNA, 3000 bp, Unknown
  misc_feature (1)..( 3000): cDNA_ID_2042217_gDNA_ID_1620831_Annot_ID_169678 3000 nt of promoter + ATG
ggcaagatatcagatttttatgtgtaggaaaaccaaagaagaagaaaacgaacaaaccaaaagttaagacttttctttactgttcggtacggtatgcttcaagttttaatcatcctacatatatttaagatgtgtgtagtcgtcgagtagtaacacttatcatattttctaatgaatctaaactatgaaactattttgacaaagaatcctaataaaaatcgaacctaatcaagaagaaaacgaatttgctatatcataaaaaaattaccactaggccactactttctaaacttaaagttaatccatcatatttccaaatcgtttggtaatcaatggatcggataaatgaactgattagtgattacgtactatataattaacagtcatgaaaagcaaaccgcaaacgatacgtcaaattttaaaacttgaaaagtcaagcagtgggttaactttctttagatttatgaaacaatgttctatattctaaatagtttcttacagtaaaattcaaatctatatatacacaaatagaaaaatgattggtttttgtaacttgggttggtagaatattcatatcacatttgacatttctattcttcaagaataacttatgggagaagttactttcgttcgaaaactataaaagttgcagaagatagtgaagatagttgcagaattgtattatatatgttatacccagttatgtgtgcatgtgtgtacatatatatatgtgtacactaatacacacgtttttctatgaaatacgagtttgttcaaaaacatctgacttttgttcattcatataaaatgttaaacgaacttttcctactttttagtgaatatatttcgtcaaattgaaattgatgccaaaattaggtataacgtgaaaaacgtatatgttttttaaaaatgagattagttacgtttgaaaatcaaatcttttcacatttcactttcatacttggagtttttgttttgttttataacttgtgtatttactactacaactgtttgcacaacataacattgaattgaaatctttatatattaaaatgaaaacactcaaccccttaaaatagaaatggttcacattcgagtttggttattattttctgataactgaattagatgccgaaccaaaaccatacaaatttccgagagatgtagaatgatgggcattttaatcgtaccaaacagaaccgaaccaaaccaaacaaccgaaccgtagtgacgtagtctacatctaacccatttggttaaacttttttcaaccctaatggttcggtttgaaccattaaccctaactgttttttaatttataattaatttcgttaggtagataatattacatgcttgattttggttatttatcaaaactaagtttacttagttctttcaatccttaaatctctaattctaagctacaattttataaggtatggaaaaaactattcatatctcatttctattccgttacttttcaaaaatttcaagttttttttgactaagaaaagattttataaaaaaaatatggctaataaccacaacgtttttcttgagtattattattaatagactaaacaaatacaaataaagtttaccccactcgaatataaatatttttgaggaaatgtatctactatcttcttaaacaacgtcgtgtcattactcaaaagtgtccaacgggcaatacaagattatgatggacgacccatgattaaacatgttcgatctaatctaaaatctttttagtctatattagtgaagcactgaaaacaaaatgttgttatcaaatttgatttgttcttgttaacaataaattcttttcaaaagtgagcaaaatatttgtagtcgtggacttaacaacaatacatcaatcgctaataaaacactggcttccacaaatgatgtataaaaactatattcaaagtcgtcgtccttgttttttctctcatcagttcacaaacaagctcaactttggataaaacgcgtcggacgtacgaaaaaaagaagacttgcagagaaacaacagtcacacacacaatcacctcagatttaaaaatattcctttggtattacttgaactaacgtcatccgagttgtttctatatatatgtacatatattctttacatgttatttatagctaattggaagtttttagtgcttattgctagctactaattaataacgagtttaattctaatgaaaattggacacaaaatctgatactaagttgcctatataagattagaaatttaaactaataacagttacatatatacaaaatcgtgttgtacctcatataattatggtgcatttgaataagatatctattgaaaaatatataatgaaaaattaaattggtactctaatcaaaaaaaaaaaaaatctttaacacatcaaatgttcaatttttttaaaagtccaaatcgttttgatattgttttttattgaagagcaaactactataagaaaaatatttgaagaaacatagcattttcccatgcataaactagaatgaccaacaaagatactctcaaagtctcacttgtctaaaaaacagataaaaatcatttccaattttgagaaaaggaaaaaaaacaactccaataatactttttgattttcttttcgttgcattaaaataaatgtggcaaaaatccaataatattactattataagttaaaaaaactcaaaaaaaaaaaaaagtatattccgtcaactttttctcagtccggttcaatcatctccatcatcgttgatctctctctctccgtcaacgttctctctataaagcagagagtttcacagcgcgtgaaaaatggcttttcccacttagccacaacgacgcgtttcaattctccatctctccctctctctctctctttcttcaaagattccaccaacctatacatatacttatatataatctatgctacgtgtatatacttccgatatccttcaaccaactctttgaattccgactttggatctatg

SEQ ID NO: 5921 - DNA, 3000 bp, Unknown
  misc_feature (1)..( 3000): cDNA_ID_2054198_gDNA_ID_1620831_Annot_ID_169675 3000 nt of promoter + ATG
atcttaagaatgtgtgagtgtgatcatctctgcaagaatgtttgtacttcgtttgtctcctttggaaaacaaaaatcatatagaaaatgaatgagtatatgtacatacatgagaaataatgtacccacctctttatttttctctgtaatacctttcatatttttcttaacaaacatgtaccatttctctttcattgttggaacatttgttgatggacctaattgtcattgcttctgagccactaagcccaaaaattaaaattattaaaaggcccagtggagtttgtgatcacaaacctaaagaagtttagtgtatgaaccatttaatcaaaggaggtccaatccaatagtggtggtatctatgtgagaaactgctattgttacagataaaggactcagcaggagttggacctttgttgcaataactgtaagccttttttaaaccaataactaagacttaagagttaagaccaaaccttgtaagattttttactttcaagaacatcgatttaagattttggtgaatgtagtcctaaaattttgagctgaagtctgacctaaattgcaagatttcacagttgccatatcaatgttgacgtcgtctaaaagaatacgtcaaggtaaaatattttcttgagttaattttgagttcaaccatttgaacaaattaccataagattactatttcaactgtttgatttcagagttgcctcaagagttgttttctcatacgtatgactgactttgtaaggctggttttcatacaaaaaaaaaaaaaagagactttgtaaggttgcttgcgtatctttatctttgatcatgtctatggtttcttaaaccccgcttactcatatcaccaaaaatactgaaattaattttattttgggatcattgtgctttatgatcttctttttttctcaaacttttgttgaagtatcgaacatgatcacattttatttttgtttcttaacgagaaagttttagaagagacctagtaagtagtaagcatcaccacagtacctatatatcttgatttgttcttaaaactaggtcccctgagaacctttctccattccatttcgcccgatcgtagacaaatgcgaatagtatttattatgagcacattggtccactaatcatcgtcaaatttctccgtacggattctaatttttgaactttaaatcaaagacattaaaagagaaataaaagtcaagtgataggtttcaaaacaaaagaactaatactatttaggtattgtaagtttcccaaaattgatgaaagaagaaaactgaaacccttcaaaggtttctaaaaacaattgatgttagttgaaacatttaaatctttgacgtcgtcttcatctaaagactcttctcctttcttttttttcactggactcttctgctataactcgcttttataaacgaataaaaataaaatcaaaattaacacacaaaaaagaataaaataattaaaagacaaaaatcaagccctccggaaaagacttattaaggataaaaaacaccgcgtaagactctaacttaacacgatcgtgccacgtgtcctccagaaatccctcttttaaccgccaaaaaagaaaccacccactcttccattaacattaactttcctcatcttcttcttcttcttcctctgatctaaacaacaaaacaaaaaatggtggacgaagatcggataacactagctcctaccgagatctatggcaggagtgatgaagaacagagcggaccaagaatctggcgtcggaaaacagaggaaccaccagggaaatgtctagtctattccttaacaataatcgtcatcatcttcgcactttgtctcatcctatcttcaatctttctccgtatctcaaaaccagagatcgaaacaagatcaatatcgactcgagatctacgatcgggaggtaattcaacaaacccttacttcaacgccacgctagtaagtgatatctcgatcagaaactcgaattttggcgcgtttgaatttgaggatagtacgttacgtgttgtttacgctgatcatggtgttgtgggagagaccaagattgaagggagaagagtggaagctcataagacggttaggataaccggtgttgtagttgagatcggttcgtttcggttattggatactaaggatttggataaggatttgagattagggtttttggagttgagaagtgttgctgaggttagaggaaggattaaggttttgggaagaaaaagatggaaagttagtgtgatgagttgtaccatgagactaaatttaaccggtcggtttattcaaaatttgttatgtgaatagtagtgattgattgatcggtttcatgatccggtttaagaagatttatttgtttgttgttttttttttgggtgttgtgtttttgcggtattgtaattgctatggtctttgtatatgaacggaacatcaatattgtagaaaagaaaattagtcactacaaaattgatttgtaaaataaataaataaattgattagtatgaatttgtaggatcatcatttgagaaaaacgaatgagaaaactaagaattttctcaataatttaatatattaaatggtgaaataaagttggaaacttctcaagccccacatgttgacccattcatgcatgtacacatcaaatcgacatacgtatacatccactatattaatagttttttttcaaatttttttttttttggtatcaaaatattactcttttgagtttcgacatctactgagacattacgacaatttaccctaacaaaaagaagaagaactaaatagtgttttatgaggtataccggttctcttgtttataatttttgagggaccgtaaaagtggagaaaatttcatactcaccttctcaaaagtaaacggtgaatagtgaatatgctttttacattttctccaacatatatggctcctccagagacatttttgtttatctaatcgtcaaagttttatcgttaccctaatctcatg

SEQ ID NO: 5922 - DNA, 3000 bp, Unknown
  misc_feature (1)..( 3000): cDNA_ID_2054208_gDNA_ID_1620831_Annot_ID_169669 3000 nt of promoter + ATG
gaacatggatacaatgaaagcgagaagtgctaccggatctccagagactgatgttgatctcaatgagtatgaagcaggattggggttagctccggaaggaagagtccatggtggaagtttgatgatggcgatgttgggtagagatggtggctctggctctaccggtgggccaaagaggtggatgtaagttgtcttcagtttggttccagtcttgaattcaatgcgtgtgggcaagtgagagtgaaagagtctgtggttgttctagttttaggtttgcttagagtaaaaaaaagggtccaaagtctgtgtcttattggtctttgtagatattgaattaaagggtcgaagcataggttattgtgatgttgtgaattatacaggtaaaagcccacctgtggaaattgtcaaaaacagtcttatgatgatgatgataataataataaaactcatgtcttttgtttgcaaattgcaattttatcggtagggcaggtttgttgggatcatgctgagtcgatgccagtgtgtttttactttttagcagttacgttgaaacattcacaagtaggtacttaatatgtagctatatattaaaggactggatagtacaacaactcatgggaggttctatatctattttatcttcttagagatccctttattgtatagacgcgaggaacacttgtcatatatagtttggatcgattttacgtcccacgggaccattacttaagacgtcgtaggagctgaccaccagtacgaagaaccaactcattgatatagtccacaaggaattggacttggtcaaggtctttgatctcagggccagtcttatcgtactccacactgatatcgacgaggctatacaagccaatggcggaatcattaacttttgtagttgatgtaatcatcttatagccttcaaagaattcaggtacggtaaaccgttgcgtcatgcttctcgtttcgtgatccactgactcaatggtcatgtgttctcgttgccaaggccttatctctaataaccaacataaacaattacgaattatgaacaaaacatatgaataaggtgagagttattataaatagatacctgaagggttctaattagatatatgagtcatatggtagaaaaaactatcccagaatagttttggtggaagcgaaaacagaaactgcatctcacaaagtcgtctcaatgccatttctctagctacttgatgtttgccttttgtgagttttataaataattatggtcttgatctcaatgtaacatgcatgtttatatagccaaatgtttatgaaaaacatgttgcattaatttttcttcagcagattacccattcaacttttcattagatatgccatttttctacatttaacaaaattcgttggccatttgcataattgcattctctgcttcacttaatcaaggcaacaacacttggatggaagaataacttgagcggaccaaatttatcaatgaacttgaaccgatcaaattaacattgctaatttttcttcattaacttattttcttagcaataatatataacccaaaaacttatctctgaacaaattaattaggaagtaacgcacaaaaagaaatgcacaaaaataaatgtcagaagtgggatttgaacccacgccctctttcgaagaccagaacttgagtctggcgccttagaccactcggccatcctgactttttgttaaacttatacgtatatagtgtaaataatcgtataattttcaatatccataccaatcttcagactcttttttttggtgacaaagtgtatgtattattttcagaagctatatgtttttcctataaaacatccaagactggcccatacatatttttaagaaaccctatagtgtgtatatgacttcaaaatttcgaatggttagtttttctttcgaggaccaaaacaaaaagcccattcaatcactagaaaaatatcactagtcaatcaatagaccaaaagattgaaagtaggatatatttgtttaataatgcctacgattctgcgaagacaggagaagccatacctttcaatctaagccgtcaacttgttcccttacgtgggatcctattatacaatccaacggttctaaatgagccacgccttccagatctaacacagtcatgctttctacagtctgcaccccttttttttttagtgttttatctacattttttcctttgtgtttaattttgtgccaacatctataacttacccctataaaaatattcaattatcacagaatacccacaatcgaaaacaaaatttaccggaataatttaattaaagctggactataatgacaattccgaaactatcaaggaataaattaaagaaactaaaaaactaaagggcattagagtaaagaagcggcaacatcagaattaaaaaactgccgaaaaaccaacctagtagccgtttatatgacaacacgtacgcaaagtctcggtaatgactcatcagttttcatgtgcaaacatattacccccatgaaataaaaaagcagagaagcgatcaaaaaaatcttcattaaaagaaccctaaatctctcatatccgccgccgtctttgcctcattttcaacaccggtgatgacgtgtaaatagatctggttttcacggttctcactactctctgtgatttttcagactattgaatcgttaggaccaaaacaagtacaaagaaactgcagaagaaaagatttgagagagatatcttacgaaacaaggtatatatttctcttgttaaatctttgaaaatactttcaaagtttcggttggattctcgaataagttaggttaaatagtcaatatagaattatagataaatcgataccttttgtttgttatcattcaatttttattgttgttacgattagtaacaacgttttagatcttgatctatatattaataatactaatactttgtttttttttgttttttttttaatacatattttgcttttggaagatcaa

SEQ ID NO: 5923 - DNA, 3000 bp, Unknown
  misc_feature (1)..( 3000): cDNA_ID_3078914_gDNA_ID_1620831_Annot_ID_169663 3000 nt of promoter + ATG
agtaaaacttttattcttagcttctgtgtttacatttttaacaacattttttatcttctccagtagtccctaaacgaattaatattctttcttgcaaacaatattttatttttaacgttttcactaaattgtatctaatgtttacaattacatagcctacgtggttacattctcggctaataacacaatgttcctttccaaatgatatataatgtatgttacagttccagtggcaaaaaaaaactagaaactctccaaaacggtgagagcagagcatgagggtagagcatggttcatgtacataggattctagcttatttggggcctaagcataaatggtggactggatcagacttatgatgggcttgtggtgtaaacctaatataattcagaatcaaaccctcagggccaaatggagagcagattcggtcacaagtgtttggggccttaactaaatattggctcattcaaatgattactggaaatagaaaaattacagtacctatgtttgaatttggggaaattaggctaatttaaaggagttttacttgacaggattaaaagagtttagcttttaccgttatacacaagtaaaagagttttggtctactgatcgaccatggtgcattgcattctataaaagtaatattttatatgtttcatttttttttctgtcaatgacacattaattaaaatatcaattctctgataatctaatttaaaagacaaaaaaattacaaataaaatttcagaaaataaacttttaggacaacggagtagacaatatgttttagcattacaagaataaagaatacaaaagaatgaggctccatctcttttgtataaaagcatcattagcggcaactaatttaaccaacaaaaaatatatggtaaaataaagttggtaaaaaatattaaatatatttagttttcttagaccaaaaaataatcatgtggtctggagaaaccatgttagaattcgaattggggtgatcaattatactacttgaacctagttggcagagatttttgtctcttttaccaccgtaccatatcgacttggtcaatatatttagaattttgacattaaaaattaaaaatatcttttaaattttagattttctacgaggttgtttgaaataatatgtagaaaattgtttttcttatggaatttaaaaagctatattagagtaaccgacaagtaacaccttgactttgtagattatatataatgagacgaccattttcatccacaactaaattttcttttcttgtttttgtttgttttacatttcttagacgtgggacctaattacaaaatactccaataatttaggttgaaaattgggaatgggcaataatacttgatagtgtattatattgtctcctacccgttttttaagaacattaatatgtattcacccttagcggaaattggtgtggctttgatcgaggttgaactttgattctagtgacaataagaaaaagaaatggctactagatatattttaatttctttgtttataaaaaacattgttttttaacatgttttacgcaaattatgtaaatttctattataataaaaatatgatacgataattttgtagaacaaaaataaaaatttaaaatgatattttttgtgaaacggaaaaaatagatacccttaaattattaaaataaaatattctttcttttaccaaacttactaaaactaaatctcattctcattaattaagactcatatctaagaaaaatgtacatggtgtggtttatatacaaactcatgtgtggactaaaccaaaaaccttaaccaaaaacaaaaataaaatcttctaaactggtttatacttgtaccattgtacaattgacaaatgaacctaagcattatacaggacggatacatcaataacatatttgacgagaccaagtcagtctagtcgtctcaacaataatagtaaaactcatttttttgtccccaaataataaaatatctacttaacttaagttgtggagagttttgtaaaacaaattggttttcgctgtcccaataagaaaacatttctccaaaacattgtataaattgaacttcgaagttctgcaaaacactaaacgacgtcacaacgtaaaatacaaaattaaaatagaaaaatgttattgtcaataatacacatacatacacagagaaatgattttagaaaatacacaagtttcagcttagaaaaatcgacgtgaaaaatgattaaaagacagtttgcaatcagagtaattgataaacaaatattttaaaacaacaatcaaagatatgaaccaatcaggatctaagacatgatatgttctagcaacggaccttctgtgtcaagctcatctatgtggccttcaaaaccagcatatacgagaacagctaacactatcaacaattgaagtcgaactttaaagtgaagaaacaggaaaaaaatccggacaatatcaaactttttcctctaaaaaatattagtttggattgcgcgacatgaaaactttctgattatagaatatgaaagtataacgatgacgttttgtttttgacaaaatacgatgacatctaatttatttatcttttatcaacacacacaacataaagcatagtccacaagcaatctttttttacaatgtgatggaatctgcttgaatattgaagtaacgaaccagtgtccggtttaaccacaccaaaatttgaaatggcataaaccggtgacattgttagtccactttataaggttttgtcttggcctgctctatcagatttcattagtcagaaagtaaatcgaaaaatcttatcacctacttgatataccctacggacactattttcaaaccaagttgttggtttgagatcttatgtatatatatattacatacatacacatatatagaccacataagatactctagggaatcacaataagtcaataatgattatataagtcagacacaaagatatttacatttttgcagacaata

SEQ ID NO: 5924 - DNA, 3000 bp, Unknown
  misc_feature (1)..( 3000): cDNA_ID_1989673_gDNA_ID_1620833_Annot_ID_57898 3000 nt of promoter + ATG
agccttatcttaattcatctttaatcctatagagtaatataagctaattcttattttttcaataatcagttgtcatttgcaacggatttcatctacaattatttgtcacgagatgttacagctagtgtcgggtatgacctcattactagacaggtacatacctcattccttttggtcccattcgagttttgaaacagcaacaaagcgctgttctaattatgggtttggttgtggtttggtgtagtctcgattaagaggaaaggttgattctaacggtgttgtcgctgcttaccttgaagaacaattgcctattggactcagatttcttctatctgcagaggtaaagaaaatgatttaatccgctactatacattttttagtgcatttgttaatgactagtttttgataatgactgatttttgatattaaatgaaccaggtggatcatgtgaagaaggattacaagtttggtttcggtgttaacgccttttaattccatcaaatggccttcacaattagttagaaacctcaagatttggttattttttgatgttcagtttttttagtttagatatttttactgtattgctcccacaagaataaaagccaaggaggtttcttcatttcacattgaggaagagcctttcttgtttattatttaatttaattaatgtgtaaacatcagaactctttttttgttagatttaactttgggagaactatgaaaatagtctaaattttcttttagctttcagttaattttttaattaacaaaatagtttaaagtggaggaattttcaaaattgctccttttgttgtactcattttcatacattttcaaaaatgctttcattaaacctgataatgttagtaaagtttattgtttacatggtacttctcgatagtaactaatttttgaagagtcgatccaagtatttataaggttttataagatatttaaaagtttttataaagtatataaaatgttttctaagatatttacaaggttttatacatgtaagaaatagttttgtattttttataagtttaacataaataataagactttggatgaagtttacttttaacatttttaagcgattttctttcttattattataaaataaattgtctataataaacttagtcaattttatgttttttccaaaccaaggtaattattatgaaattttggtcaactataaatatttacttcacaagatttttagtatttagggaataaagtttccaataactaaaactcgaactatattgtatccctatataaatatacgtctttctaaattctaaagataacaacaaatctactaataccaccacatatttttctgttgtcctacttttgaaacaatcccaatactagaaggctacgagaaaaatcttagtaaaatcttgagactaagtatcggtgctttagtccaaaaggtaaaatctcattttgttgaattctttcaatggcttttttttgtttctaatgggttctgaatttttgctagacaaaatattcgggatccaagattcattctgaaattcgatctaaaaataggttatccaaaatctttggatttagatattttgatttaaaaattaggatatccttattttatataaattgctcaaaaaatcaccaaaaaaaatattttaaatttgttgtgcaatattttaaatttaatccatttgaaaaatagttgataattaaatttgttttatgattaatttggatacaaactttttatttgttttatactattattttaattgtgagttatttatggtggatttgaatccgatattaacggatttggatctggatatgtcgtttctcatatatggtggatgtggattcaagatccatgtatcttaaaattccaggaaatattagtagtgtccaccttgattaatgtaaatgatatctcggaagctcaattttttttatgtcaattagtatttttgaaattataatttacttttatataagaaatttttagtgatatattacattcaaaaccaataagaaacagtactagtaaattttataacaatttttttttttgatttcatacccattttatggagtgagaattcacagtctaatttgtttaattatgttctcaatgatttttttcttttttttggtcaacaatcatccttaatatatatatatatatatatatgtgaagttgaaataatatgggccgagaggtttgggcctggttctgtttttttgttcctactattaatttaatttatttgttgagatttttcctcgttttttaaaaaaccgatgagagcgtatctatatttcttttttcatttttctctccgatcaaaacgccgccgttgcgtctctgattcttcctttgggtcaactgaggaaaaaacccttcctatgaagaacaacaattggcttcacactctctcttttctcaattttgcttcttacttctttccccggtactcactgattctccccaattttccttatttcgtcgtgcccttagggtttcttacatcgaaagtttggtttttgattatgttgtcccgccattgcatgacgttgttctgttttgttctgtcctaattgcttatttgggtttctgaataatcttcaattggagttttttttttgttcaagctgaagagtttcggtgatcgtcctctagagattgatgctaattttttcaaacattacaaagtttccaaagccaccgcccacttgaaacattcttttggtgattatgattgtttatatcgatttagcattactttacaataagcaagtgattctcttcataaagtatgtagctttactttgtttgatcctactcttttggtaatcttagtttcggatttgcctttctcgcaataacagagcgctttgtaaagttttgcgttttagatgattaacattcctttcttgcgtatttcaggctgattagaaacttgaccgcttgattctcttaaaggaggtcttgcgatg

SEQ ID NO: 5925 - DNA, 3000 bp, Unknown
  misc_feature (1)..( 3000): cDNA_ID_2993930_gDNA_ID_1620833_Annot_ID_57905 3000 nt of promoter + ATG
tataatagttaaaccaatgagggaaaaaaaagatgagcaatagaaggtgcttgttgctttaggaaaaataaataaattaagctttctctcctagtcctgattaccgaaaccaatcccctaccttcttttgctgaaaaaaaaatcaagtaatagaaggttttgccggcgtccggatctctgtttcaccattttcttttgcttcccaaagatctctgttttacattgcttttggtcaacttctcaatcaaccaagcctttccctcttaactcaatgtcggatggttattgatcagatgctagagttggatggaggttcccagaaatctcctttgggaagctatgcctactacttttctcgtgattttaaacctaggaagccattcttttacaacagtatctctttctttgaacttgagacgattttctttgtgttgctcagatctcccgattttggctctccctcaatctgcacaaatgccttttcccaccagaattcgccttcggtgacaaactaacctaatttatgtcgatgtcactagattggacattcctttctaccttctgggcttaggcccaattatcatattttcaaagctcaactccaaaaagtgtattccactgttctctctgcaaaagcccatgttttgcataaaacttttctgatcttgcttagcgaatttttgtgtcgactcatggaactgattgttaatggacgtcgattggaacataatcaaacaatcttgctatgctggtataaaacttatctgagaacatgaccattagaattacctaggggtaatactctctattttcaaagcttgaaaaacaccttatatgatagcttcctttatcaaggcttgttgaataggtcgaggagaaacggcattatgaccccgtctctaaggagcaatggttaccgtagcttcttcaaccccatatccatgtattccctgtttatcgagctcatatatgtacaattaccaacttctgggaccttttccatatgctcaaatccaataagctcatgtctgattatttttgttatgtgttaagtcgactaaaaactttgtgtgaaattcttaattttcatggtataatactccatgtgagagaggatccacctattatgttacaaccttatactctttttttacgaaccttggttttagcttcatataatatgttgtggtatgactttctttgcttgaaagactttggtctaatgctgttgaaccttcatgcgagagtttttatggtggcttgggaagcttgtcaaaggaccacccctcatcatgctcgcttaacgtcttcaagtcatacacctcacttcatgtttgctattgtttgcctaacctcaactttcattcggcatcaattctagcaaataaatccaagcaccagagcaccatcaccactacccaaacctttgtcaaagctctacttcatgtagctctcctcgtgccggcgagaatcatgtctttgaccccttcattaacgccacttcgtcttttgacagagacaatttgtttttcctttgaatcgctcttgaaagagtcgtcgataaactttgatctcacaagtaccataagcatctttgcttttggctcaaaactctcaaggaccctttgtcgattagccctatctatctttttatcatttttctggtaacttttggagtatgccccttattgttgtgctttaaactttggaactttttccctttatctttgtatttggcttctacattatggaatgaaaacaaacattgtccaaaaataaaataaaaaaaacaatgaggaaaaaaatcaaacaaaaataggagaatcatagtcatatttttggatttaaattcaaatctttttccatggtacataatctgcagcatttacagcaaaaatgaaacaaaatctgttagttttaaatttaaagatatgtttgcaccctataataatctcacataagttcttaaagattgaaaaacaaaaatggttgcatatgtcaagaacaactttttattggttcatatagtagttttacttctttttgttgtctcatcatatgcaagatttaatacgaaggttacaacagatgaaatatgtggcatgtgcgcacgcagagcagtcaatgcgtcattttgctatgagttcatgaaatcatccactcaagttgcaacattggatacttatgatctcgccaaatttttgatcaattatgattttcaaaacacctttgatctaataaagcatttccagtcactcacaaacagcacaaccgatcccagttctaagggttcttatgagctatgtttacatctttttaatcttatcaatcctcttgaaaccgcacttaaagctttggcaaccaatgactatgacactttaaacaggaatgttgatgctatgtctcaattcgcgatggaatgtgaaagcgagctgtcaagtgtcatcaagcctattccaaagctcttgaaaagggtttctatcgtcgaaaatgtatccgacattatttttgtaattgtggaatgttttttaagaaaagaagaaacttcatgtaaggaatcagtatcaaatctacaataataaattaataatcataatgttgtttggtatgatgttgccattaccgatttacaccgataattaattgttttagtgttaagaaaaatcgaaatccaccacaagagcataccaaatcacgaaaaagcttgtttgatagatcggattggaccggctttcgtatttgaaaaagtcatcgttcacctgtgaaaaattacgcaactccggcgaggactattttcaactatgggcctagccccaattagtccaattagtaaggagcttaaaatggttttctcaaagtacggggcaaaagtaaaagaataaaaaagtagtggaccttgagaaaagtcatcaccagctttccttcctatgccacacaaacgtgttcttctgaatatgagtcaaacacagagaagattaggagaacgtggaagaagaagcc

SEQ ID NO: 5926 - DNA, 3000 bp, Unknown
  misc_feature (1)..( 3000): cDNA_ID_1989663_gDNA_ID_1620833_Annot_ID_57910 3000 nt of promoter + ATG
caaactaagttttaatataaaaccgaaaatgtatcaaagaaaagatttgaagttttttgagattaacgtgtattaataatatacacacatggatgtatatatatgattaagaagatttggagtcatcctttagattcttcactctgtcttgttactgccgtggggttcatgtcagacccacaaggccacaacagtcttgactgtatgtttcttcttgtttttctctgtaatactattagtaaaaatatcttaaaaaggaataattctggtaaggtactatcagttacacttgaaatacatgtcaaagactaacaattattcatgtacttttctattcacatgttttactggaattaacaatagttcatcattttcaaaaattgtagaaataatgattattatgtcagtgtatgattgattcctttataatttctgttgttttgttattgtacagtctcatccgaatctaacaccccaagatcgaacagagatatgtcgatgtctcaactacaagaaactaacaatggagacgtgcaaacagctcgccagaaaccctaagatccctccagaaatcgccattgaagcactcaagtccagatgtgggaatcaagaacacacaacttcagatgttaaagttgcaaacaagagtttttcttgtagatattcagaagagaagaagaagcctgtagtattgcatctcgagataacagagaaattagccgagaggttgaagactaaaggaggatataatttgaaggttatggatagtttcagagaaggcttatgaggaaaatggtaaacgtcccaagtcatgattcagcagtcacatcttccaattcatctggcaatctcatttgcaccccaacagtgtcgagagtcttgtacaaatcatcagattcaaggggtttcttatcatcgaaagctatgaattcacaaagcttgcctttcacttcgatccaactaaatcctggcgatttcaccacctgttgatctttcatttgctttcttacccgagcgacttcatcccagttttgggattccgagtacaaattagccaagagagtgtatctcccactatgactaggttgcagcttgatcacacgggaggctgcgtatttacctaactcatagtctttgtgtaacaaacaagagccgaacagagctccccataccacatttgttggctccattggcattctttctatcaaagctttcgcctcttctagcaaaccttttcttccaaataaatcaaccatacacgcatagtgatccgcttttggctccatattgaaacgtcccttcatgctcaggaaaagccttcgaccctcttccacaagacctccatgagcgcaggcacttaagacagccatgaaagtaacttcatttggtgaaacatgactactcaacatggtataaaagagatcaaatgcatctctagcatatccgtgtgctgcaaatccattaatcatcgcggtccaagtatacacatttttctcatgaagtctctcaaaaacaagtatagcttcctctaaacacccgcacttgacataaagatcaatcaatgtagttccagctgtagtgtttatctcaatcgaattcttaatcatataacaatgcacccttcttcctcggtgaagtgccccgacatgagcgcacgccgaaagaacactgcttagagtcttctcattaggcgcaacatcactctttaacatctcctcgaaaaccaacatccctttatcgaagcaacggctttgcacatatccagcaatcaacgccgtccaagtaaccacgtttctgctaggcatttcatcgaacactttctgggcatcatcataacaactacatttcccatacatatctactagagaacttcctatgaacacatcgcatttcactctccctgtttctaagtaaagcccatgaacgcttctcccaaatcgaacatcttcaaccttccctgcagctttcaagacgctaacaacggtcatttcgttagccgcgactccagtcttcttcatctccacgaaatacaccattgcttccgaagcagaaccatttctcacaaacccatcaatcattgcagtccaagtaaccacgtccttatcttcagctccatcaaaaagacgacttgcaaaatcgaataacccagaactagaataacccgaaatcaacgaattcctgacaaaaggatccgaatccaacccgaatttaacgatatgagcatgaaactgaaacgggttcgagtctctcagtttgaaaaccgctttgagaagcggaggaaacgtgtggcggctagggatgacgccgtttcgccgcatatgacgataagcaagaaatgataaccgacggttgagagtaatcccgccggagaagtgaccaatgagcgaatcccatagttgaatgctcagagtttggagttgacataataaacgacgagcgtagcggaattgagttgcggcggtgcagcagcgacggagaagacgtgagagaaagagatcgcgacgagtatagaatatcggagaagttaggagtaagcaatggatctgcttgagatgaagaaagtgtaatggaagatcaagcaatgttttgagctcaatcatgtgaattgagaagtaagcaaaagagagagagagagggggtggttaatacttcaattcgaattttccagttttcagatttcagatttcaaaggaaccgaaccgaaccgacattaaaccaaaattcccattcaattgaatcgaagtgactctgaatatcagtcggtttagtttttatatattttttttaatagccgtagagggggagacgagggttcgatccacgtgtcaaacagtccagagaaaaaaacagaagtaagaagagaagaaaatgaacttcttcttctgcaatttttctaactttgttagcttctacagattttgctacgagccattggagaaactgttattgccctaaagatatgcgttatttttctccttcttcttcggatacgattcatag

SEQ ID NO: 5927 - DNA, 3000 bp, Unknown
  misc_feature (1)..( 3000): cDNA_ID_1989753_gDNA_ID_1620833_Annot_ID_57914 3000 nt of promoter + ATG
ttaagggatatgcggtacgcagttgctgcaactagggagttacttccgtcgttgatgaacgactactagttttctgtgtccaaatacttttctgaatcagttcatccgagatcttttttccttctgtaaaaataataatattttttcttctttttttgcagatttcttcttatatcacaagtattctctatggctagtctcttattatatgcatctattttgtctactgaagacataacttgcaacatttcttggagtttttggtcttgatcaagtatgttttttctgcctctctgtgattgaaactgtgttctttgaaaactggactcagattgattttagatgtgaatgactctaatcgaattagtactggttcttgttgatgtatctgactttcatttttaactttttatttcttacaggttcatccagttatcatctgtagctggatatgtgaagtgtcttcttgcgaacttatgtcttaactttgaaatactttgaataacgatgataatttggagtaatgatggtaatttgatcaaattgtgtttggctttttggtgtgtccatttgcagagatatattgctttttaataacgagaaaaatgttatttaataccctaattttcaaattataaccgttttatacgtcaactttatatatggtcattttaaacatgatgttatcgttgaccaccatttaaaccatgaatatttcgttgaccaggccaaaaaaaatagtcgttaacggattattcaactcccgttaacacctccgttaaccattctaaacgatgtcgttttcgttactataaatcatgttttacccttttataagcttttaaaatcccttgtaaatcattccaatgccacttacttatgcttaaaaaaacattgtaaaccatgctagccctttttaaaaatccttgtaaatcattttatgccacttacttatgctttaaaaacgatgataaatcatgttttacctttttataagcttttaaaatcccttgtaaatcattcaatgccacttacttatgctttaaaaacgattgtaaatcatgttttacccttttataagcttttaaaatcccttgtaaatcattcaatgccacttacttatgctttaaaaacgattgtaaatcatgttttacccttttataagcttttaaaatcccttgtaaatcattcaatgccacttacttatgcttaaaaaacgattgtaaaccatgctaaccttttttaaatcccttgtaaatcattttatgccacttacttatgctttaaaacgattgtaaatcatgttttacccttttataagttttcaaaatcccttgtaaatcattcaatgccacttacttatgcttaaaaaacgattgtaaatcttgtaaaactattgtaaaaagttttaaaatgatttacaaaggtttaaaaaggggttttaaagtatttacctatgtttttaaagactttataaagattttaagaggttttaaaatgatttacaagggtttttagcaattaccaaagattttaaaaaactttacaaggttttttaaaagagtttttaaaaaatttacaaggatttttaaaagcattttttttgctgggaaacaaaatttacgagaaaaaattttggcgggaaatttatttttggcgggatttttttttttttggcgggaaaaaaaggtttggaggtgttcttcaatgaataggggtgcttgatgaggcttgtattaaatggtagaagtccatggagaaatcgaagtgttcaaaatcggaggtgttcttcaatggaagctttactatggaaatgttttgtttcgttaaagatgaagaagaagaactttaagcgtatataagtatctgtgtttgtatagaatgacagagaaatctttgcaggtagagtggtcaaatgacctttgatttttctcaaatgataggggttcgaatcccaggtctgtcatttctttttaaagaaaaacgaaaacgacgtcgtttagaatggttaatggaggtgttaacgggagttgaataatccgttaacgactaatttttttggcctggtcaataaaatattcatggtttaaatggtgatcaacgataacttcatgtttaaaatgaccatatataaagttaacgtataaaactgtcataatttgaaagttgaggtattaaataacatttttcccttttaataactgtaaccaatatgtaacagaaatccatccaacccaatttgatcaatagcgtaaaaactcattattgttataaaattttaggtagtttacatcaaaataatatcattcattttttatactataaaaatagtatttagattaatatttaacaagaataagaataatttttatatatagatcatatcaatccacataataaaaagagaaaaactcaaatatgaaaaaaattcaagtaacaaaaatatattagaattacatttggttgattggaaaaaaaaaaattacgtgtaaaactatagtattatctgagaaacgaatacaaaaatttgcaacagtagcagcaaaacaaattcaaaacttgcggcaacgacaacagcaacaacaacaacgaaacaaacaataacatgcgaggcagtctcacggctagtggcagcaaacccaacagtttatctaaacgagaaccaaaatttactctcgttttttttttaatgttatcctttgatgaacaaaatgtattttccaaattttactttttttattttttaagtattatcccttaaaataatatatcttgcggaaaaggaatcggattaaataaattttaacggtagaaaataggataggaggagagagagaaggtcttttattggtttgaatgagattagtgaaggcagcttctcttctgatttcttcaaccaaacctccgtctagggttttttactcttcccatctccgccgcccttttttctctcacttccgtttttcttcctcttcgtcgacgtcttcctccgtcgcagtc

SEQ ID NO: 5928 - DNA, 3000 bp, Unknown
  misc_feature (1)..( 3000): cDNA_ID_1989659_gDNA_ID_1620833_Annot_ID_57915 3000 nt of promoter + ATG
attgcagtcttcagtatgttcatcttggatttgtatatatatacaaatgtagacatggcagtaacaccatgaacacaatcatatcagaactgcattgtttgaatttatgtatcggctggcaaataccatgatatagttattgttggttttgcatactaatttctgaagttgtcgttgacagtcacataaatatttttagatttcatatccatgaacaaggttaagcttttgattcacttccaatcatctatatgtatataaactctgtgcctctaacattttttctctggcaatagatttttgacactggacttatagaaggctcgtttgggacattcaatgtatgcaatgtacaaatatttgggggctttgttcttcacattggttatctctctaaagaaactggagaggtatctgtgggtgataaagtgatttgcaaggtaactctctgcatcaaacagtgtttgtctcattcaccatatttggtactatccaatttgtttccaccttcgttttcatgcgtataggttgactatgagaggcgtaaactcatcgctcctaatcatacttgcacacatatgttgaattatgccctgaaggtatcccttttctataatttaagtaacctaaactgtgattttctaattttttctattggatctgaaaatattcatgtcccatgaattcaggaagtgctcggggatcatattgatcagaagggatcaattgttcttcctgaaaaactgcgatttgatttttctcatggtacatttttgaataaagtcatttttattttgatgtggatggtcatcttaattgtctgatgggttccataatttcgagtaggcaagccggttgatcctgaagatttgagaaggatcgaatccatagtgaataaacagatcaaggatgaattagatgtgttttccaaggaagctgtgctttctgaagccaagcgcatcaaaggtctaagagcagtgtttggagaagtaagctgtccatcagttctgtagctatacctttttagtttggtttctaagaattgttaaagcgttctctcttactctttttaggtctaccccgatcccgtcagagtggtgtcaattgggaggaaggttgaggatctcttggctgatcctgaaaacaatgaatggtcattgctttcttccgagttttgtggaggtctgtttccattggcattagctattgggaccaagatattacgttctgaatagaatgttgagtatagggttattttgacaattccaggaacccacataacaaacacccgcgaagccaaagcatttgctcttctatcggaggagggaattgctaaaggtattcgtagggtaactgctgtgactactgaatgtgcttttgatgcattgaatgcggcgtccttacttgaaagagaagtagaggatgcctccagagcggagggaagtgcattggaaaaggttttctccctctctttgtcaaactattgacaaaatgaagacgatgtcgttacttggattcacgtaaaacttattgtgtttgtatttgcacattcacagaaagtttctgctttgaaaagccgagtagatgcagcaattatcccagcagctaaaaaggcagatattaggactaagattgcttcgcttcaggttataagctctttcagccttacagtcagcagctttgtctagatttccctgtaattttgtaatcaaagcaattctgaagtggcaattattgttttcctaacttcgcagaatgaagtaagaaaagctcagaagaaaatagcggaacaaaacctgaaaaaatctgtcaaattagcaacagaggcagctgagtccgcagcatcagatgggaagactttctgcataatccagctggatgtgggtcttgatgcagcagctgtgcgagaggccgtttcaaaagtcatggaaaagaaggtaatccgtattttcttacatcatcacttgtaccataacctgttcatagatagcaagaaagttaaattaacgtttccgtttgattaaccttgcagggtatgtcgataatggtgttcagcacagatgaaagcacaaacaaggcggttgtgtgtgcaggagtgccagaaaaatcagaccagtttaagccgttagacgtcactgaatggttgacaactgcattgggtcctctaaaaggaaggtgcgggaaagggaaaggtggtcttgcatcagggcaggtatgagtcctattctctttagtctacaatgtgatagtatcatctacaaagagatgttaaatcttcaacatgttgttttggttttagggaacggatgcttctcaagtgcaggcggctttggatatggcttcatcatttgcatcaatgaagctcaactgatttggtcgggaggttacataatctgtgaggtcagaataacctctacttaatttgctttcattgtacaccgttttacacatgttttaagaatctgttaaatttctctgttcttgtgatggaatttgtggtatcacactcttttagtcaaagttaccaatggctgttataatcccttgtgaaatgatcctttcccgtttgcgttgaaatggttatttaaaaaaaaaaaataggatttggtatggactggtcggctttagttaccaaaagcataaaactgaattgatttacctaagttcctttaaatttgttttggattgactgaaaatgaattgcacatttctgaaaacagtgatatatatgttactagtagataaaaaactaaatcctaaaatcctagactaaaatatagagaaataatttcaaaagacaaaaacgtttcaattcaataactcataagaaaataacgaaaaagtgtaattgggacagcaatagtaactcaagttggcagatacgagttagctcctgcctttattatatagctggctgaaaaataatcattacaaagtgggtaaggaagtctatctctatctctaaagcaagagaattcatagttgagagattctacagcc

SEQ ID NO: 5929 - DNA, 3000 bp, Unknown; identical to SEQ ID NO: 5926
  misc_feature (1)..( 3000): cDNA_ID_3078992_gDNA_ID_1620833_Annot_ID_169758 3000 nt of promoter + ATG

SEQ ID NO: 5930 - DNA, 3000 bp, Unknown
  misc_feature (1)..( 3000): cDNA_ID_1989667_gDNA_ID_1620833_Annot_ID_169752 3000 nt of promoter + ATG
taatactactaatattatactaccaaagtattggtcaataaaaaaaaatacatttgcatctaacatatattgactaaattaataattaaaaaagtattgactcatactacagtaaaatatttatataatgctatctattttgtaaagttactagcataagcttgtcattttttaaaatctgtcactactaattttactatgactaggtaatcacccgcgctacgctgcggtatttttaaattttttgtatcgtttaatttaaatataatttttaattatctaatcatttacttatataataagtaattattcttaatattaaaatatattttttctaacaacattctcaacaatgcattatacacacaattcctaaacaatgttcgtcttaaactaattaaatagaaggtaatattgggattctcgaaacctaagaatttgatgattaaacttcttacatactcttcaccctcggcgatttattatatagatatataacaatatgcaaactattcaaactattaattaatccatgactactatacactcataatttgagttaagattacagaaaaaaatcttttgagtatgagaaaatcaatcaaattattttattgaaaaacatttaataacaaaataaatttagtattagtacaattaaatatgtaaaattaaataataaatacatcattaatctataaattaaaagttgaagagcttacattaattattcagtggatacatggcaaatgttaaagtgatgatgtgtcaatcatatggagagagttggctaactttcatatatataattagtagattaaaaactcactaaagaatagaacaagttttcttgtaatgagttttcagagaaaaatcttattgctgtaattgacaaaccagtgcaaatggttgacgtaattgaagaaattaaaagagttgaataaacattcaatcaattttttactatttaagttgaaatagttgaaaaaatgattcaattgcactcctaacccatttaaataaaacccaaaaaaaactttatattagtaaatctcattaaaataaaattcttactacgttttggtaatatattcacatcttatcataaataaaaaatgttatataagatgacactaataaaaacaaatttggtatcagatcattatgtgtattgggagttatcaaaggatctcttcacccaaacgaaaagtttggcgcctccgagatttaacagatcaaaaatattaaactgccatccaagttttagattttgtggctaaagttgaggatgaagcaactatccatttaaaaaaaaaaaaaaagcaactatccattccactaccgagcgtacttcccaaaaagaagtagatatatggcaaggttctcaaggatgaacctaaaaggatggatgagtagttggacatacacaatatgtttttttttttgtggattaaccatgacatagttaactatgatacatttaaacatgaactaattaaggaaaattccgtgcaaggtttagttgccccataactaaaagccctccaaactcttataaagagcatgtccaacgttggtgaaaaaataaattctaagattcaaaggtgaaaacaacagctaactggcatatatatgtatgactgtttgtcttggaaataaaagaaattttgattttaaatgctataatcaatttatagacaaaattagctaaatgatgaatatggtcgttaaagattttggacccaaagtttgaatgtgcactgtttgatcctcattcactcttgcttaatagccatcaattcattttgtgaatataagcaaaaaagccacttgagctcttgagaagaagaagtcgtggttcggttaatcaggagacagccgagataaagaaagtcttcatgagatttaatgtgatggttaattacgtaatgaaagggtggctgataattgttcatggctgttgcatcatgtcatgatcacttgacatgtttattctaaagatttcttgttccatcacttttcatttagacttatcaagtacgtacgtagtgataaacttaatttgtaatatcttttctcatgttacaaactcggacttctgtcgtccatgagcctgatatatatttgatgaccaaggcttaggatgttgaactgatccaatcttcattctcggaggttttgctatgtgttcttcgtccagctcattgttaattacaccgagattgacataatgacatgattcaaaaatgggaacgttgttgttgttgttgtttctttttcaatttgcatatatatattacagagttacaaagatgagaaatatcttaaaacctattctattagagaacgtacggtgtgttcataatgacaatgaacatttttgtctacgtagatatatttactttgtttttttcttcattttcaattatctttgtaacgttctctctcaaattagctggaacaacgatctacaatgacgtgtatctaataatcaatcctaaatatatgaaccaaactaaactagaaatgaaatgtctccaaatagactatattatatatacgtactgaacgaaatcacaattagttcacagctaaatgcgactgttattatattaatacaagatcctattttagggttagactgtctttttcaacatatctcttagagtctttatgtaataaaaattacagagaaatgagcggaagttgtcagtaaaaaaacaaaagaaactgtcaaaaaaagacagtaagatctccactaaaactgggtttgaagaacatgaaaaaaataccaaaaccacttcacctattcataagctaagataaatctaaaacagctaatatcacaatcgattcctaataatagataacgaaaattcttatatttaaggagctcacaagctcttcagttttggatcataagctcactagttcttgtttgaataacaaagcaaaaggcaataatactaacaatcaataagtgaagaataaataataatg

SEQ ID NO: 5931 - DNA, 3000 bp, Unknown; identical to SEQ ID NO: 5925
  misc_feature (1)..( 3000): cDNA_ID_2993930_gDNA_ID_1620833_Annot_ID_169751 3000 nt of promoter + ATG

SEQ ID NO: 5932 - DNA, 3000 bp, Unknown
  misc_feature (1)..( 3000): cDNA_ID_3079008_gDNA_ID_1620833_Annot_ID_169745 3000 nt of promoter + ATG
agggcaccaagctcgctgtcgtctaaaagagcttaaaaccggaattactattcttcaatcatgtattgccccttgtctcatttcaatatcttggtttgtatttgttatgtcgttagaaaccatacctcacacatccttctgtttcagttgttcgtggagaaaagatgagaaaggaatacacggagttactgcagaggcatcgagcttctgctgctatacaaagccatgttaagagaaggattgctagccaacagtataaagccacagttgatgcatctgctgtaatacaatcaggtaaaatagggttgattaattctcatgattgaaacaaattaaacctcaaaatatatttttaaaaaatagaagtttcaagaaatgctgaaacctttttctgtagcaattcgtggagagctggttagaagatgtgcgggggatattggatggcttagttctggtggcaccaaggtcctctcaaagctttcattctcttcgtgcatttgactacatgatatatatgcatattgctagactcttaaaccaattctttatgtagagaaatgagtcagacgaggtgctagtgaaggcatcatatctttccgatcttcagcgtagggttcttagaaccgaagctgctcttcgtgagaaagaagaggagaacgacatcctccgacaaagagtccagcagtacgataaccggtggtctgaatatgaaacaaagatgaaatccatggaagaaatttggcaaaagcagatgaaatctttgcaatccagtctttccatcgcaaagaaaagcctagaggttgaggactcagcgagaaactcggatgcatcggtgaatgcaagcgatgcaacagatttagattcaggaggtagtcattaccaaatgggccatggcaggtcaagaagtgtaggcgtgggtttaagcgtgataagccggttagctgaggaatttggacaaagagctcaggtatttggtgacgacagaaagttcttgatggaagtgaaatctggtcaggtggaagcaaacttgaatccggaccgggagctacgaaggctgaaacagatgtttgagacatggaagaaagattatggagggagactaagggaaacgaaactgatacttagcaaacttgggagtgaagaaacaggtggttcagcggagaaggtgaagatgaattggtgggggaggttgaggagtactaggtattaatggttacttccttttcttgagacgcacgtctccttttctacacgtttgatgtaactacggtttttggctttgctgctagaagtgagaaggctccttgggactgaaagagtcatgtttttcatttgccacccaaatctattggcaaattcagtaaataatttttatattatacagtatatctatttgtcaaggattccaaagtccagtgaaccattgctgtatttgaatataaatagtcgttgcaaaaacaaatcaatatttatatttcttaaatagttaagttttttatcaagctaattaaaatggacatagcgagaaataactacaaggtggtaaactatgataataatataaatttccttacaagtttgtttgtttgtaaacatatggagttagaaagggaaaaaaaaattgtatagattttatacaagattgttttgagtttaaaaaatctttatcgtgtttggacaatgtgtattttaaaaactatttaactactagtttttttggccgatttcagtgatatctcgacttagactctacaaaaatttagataatttgatggataaaattacatatgataaatcatgcacttgtatcagatggtcagttggtggaatccctcttcaacaagtgatctttcttggaatgttgtcgtgggttaaaaaaaaactcaatccagcccaaacccgaaatgaacatgtctgagaaaaatcatttctattcttgcagctgagtaaactcttcacaatttaaatttcgaattacctttgcgatgcatcacttttttaagtggaactaagtttcggatcacctctcgaccaagtataaaccaaaccaacaccaatatatactttccgtaatatttggccctccgactagtgattttttcggatgtaatttgaacattggagattttttggtgagacaaattccattttgtcatttttagaggtcatcataacaatacttttccttctcaaattatccctaaccagaagccaaatgggaagacccaaacataaacattgaaatgaatcgagtgaggttcgctcttgaacgatcgtattgctaatgcctatccaagatcattgattcatttctaacatatcccgtacggtctcccacaaacaaccttcctcaaaagttcaacatcacatagatttcgaaatgtgtctttagacacaatttgtttaacaagacttttaaataattttttttaggagtttttaattatcaaaaaggtcttactcaaattcaacaacacatatatcgaaatgtgtttttttaaaaaaattaaaaagaagaaaaaatactataaagaaggtttaagtatttgtggaattttatttaggtgttatcaattgtcacattcaagtagacaaataaaattaccaagaaaagaattgcaaaaacattgaaaatgtgtagtatactccattaaagatttgtgtaatgaagtaatagataaaaattaaattgatgtttaatatgttgccaaaaaaatgattaaaaataaatatccaacgaatagagtttggggatggaggaagaccaaatcgggttcgggtcgagattgtttggttcgttgtgtttcccctttctctctctctccctctttcccccttacgtaaccctaagcggacggagcaatgctctgctagatctatctttctttcaattcttcaccagagatcgtcgagactcaccattgaaatcgaagaaacagcaccaatttccacttcaccaccgaaagagagagacagagaggataataaaaggccgccatg

SEQ ID NO: 5933 - DNA, 3000 bp, Unknown
  misc_feature (1)..( 3000): cDNA_ID_1989670_gDNA_ID_1620833_Annot_ID_169744 3000 nt of promoter + ATG
tctgtggtgatatccatggccagtttcatgatcttatgaaacttttccagaccggaggtcatgttcccgagaccaattacatatttatggtatagactctgactttgggcgtaggctcgtatgacatatcaatatgtaacacatagtttaattatctgtgggggattttctcagggggatttcgttgatagaggttacaacagtcttgaagttttcaccattcttttgcttcttaaagcaaggtaagattttccgtagaaattgtgcgttatatatgtcatggatcgtcatccttccgtttcacactgtatatcatagttctcttgagaatgctctttaagctgtaaacgcattgctctactggaaaatcgatttaacttgtattccaggaaatttatattctaacttactttgctgtgagcttaaaatcactcgtttccttgtatttcaatatgtagacatccagccaatatcactcttttgcgtggaaatcatgaaagtagacagctaactcaggtatgcattattctaatccatttatatctattgttgctgacttgctgtgctcttcacgcagttactggttgagaagtaattttcgctcaattgttataactagttttgaaagtttattttgtacatgtggcaatgccatgctagatataggcatagatgttaactaagatgcattttatgtgaaccctttgcaaccataagttttcttctcggaagctcttgatttatctctatcctacaccatatcctatatcttttaacatccactgtcaaggacgaagattgtagtgatattttgtgccctgcaggttcatttttatagttttcttaaattgtcgtaccaattttatatttgctaggtgtatggtttctatgacgaatgccaaaggaagtatggtaatgctaatgcttggagatattgcacggatgtttttgactatcttacactttcagctattatagatggcactgtaagtatttctcagcttctttggcattgtgttatgatgtgttcttgtataattttatgaatgcataagttagctgtataccatattaaaacgtattgcatcctcaatgtaggttctatgtgttcatggtggcctttcacctgatgtacggacaattgaccaggttaaaatgtgctattttaaattacttttggttttcaccatgcaagtgttatttatgattagattaaatctcatttactcatttagatgttattttgttctctagataagattgattgagcggaattgcgaaataccgcatgaaggacccttctgtgatcttatgtggagtgatcctgaagatattgaaacatgggctgtcagtccacgtggagctggttggcttttcgggtccagggttaccactgaggtatttatatttttttctggggttgaaatttgaataaggtgtgaaaagaaataaatgtatttcagttccctgatctgtggttttgcttcttgtgcagtttaaccatattaacaatcttgatctagtatgtcgcgctcaccagcttgtacaagaaggtctcaagtacatgttccaagataaaggtcttgtaactgtaagtgccttgcttccttatgatcattttggatagttggaagtataatctgcttggtgatgtttcttctctttattttttttgtaaaggtgtggtctgcgcctaattactgctaccgttgtgggaatgtggcttctatattgagtttcaatgacaacatggtgaggcatttgttttctcttttgttactgatctgccacaatatcttgtttcatgttcttcttacttttatgcactcgtcttcggattctacttttcctttttgattaaataagttactgcctttgatacttgtctctcgacccaaacatatacacatgagtgactcttgtgagatagagttatgatgtttaagccatttatttagtaacaattcacagttcgcgtggaatcagtctgtccatattgattgtgctctgtgtgttacttttcatatatagacctgtttctgggaagtgtttaggatctggtcctcactgacagtaatgatttgttaaaatatgcttaattaccaggaaagggaagtgaagttcttcacggagacagaagagaacaatcaaatgagagggccaaggacaggtgttccttatttcctgtgattcatgatgatgatcctacatcattattagtctcgtattgctcttatcaagttagccattatcatgattgccattggcttatgttctttcaaggtatatcttctgatgttgtttacacttccattgttttttttttcctttttccattttggaaacattttcttgtgaaagtgaatgtcactttggtaattttagtggttttgatgcactttaacctgaacctcttctggatgttattattatacgtgctttctttcttgttttgtttcatctttgttctgtaagcaagaccaatttttatcatctcagcttatttgcagtttagcacggtttgattaggttctgggttaatctcaggcttataaaattcatcaagctcaaaaatagtccactacaagaacatagaagaccattaatcaacattcaacagtaatttgtttctaatctaattatttggttttgttcaataatcctagcaaaaattcacgaaagagttaataattttgtaaccggaatcatagataggccggtttatccaaaccggatatgacctgtcctctattaacaaactggtcgcgagtctctaggcaactaaaacggacacgtaatatgataataaggcgtggactcgtatctctcggcactcactttctcgcgactcgtagtcgtcttctccacttcgatactcctctctcttgcctcgttcctcttgttcctcgccgccgctctattctacggctgtcttcttctttttcctcttcctctgaaaccggagctgcgtcagtgcggttgacatcaccgagagacatg

SEQ ID NO: 5934 - DNA, 3000 bp, Unknown
  misc_feature (1)..( 3000): cDNA_ID_1989671_gDNA_ID_1620833_Annot_ID_169743 3000 nt of promoter + ATG
agcatttttgaaaatgtatgaaaatgagtacaacaaaaggagcaattttgaaaattcctccactttaaactattttgttaattaaaaaattaactgaaagctaaaagaaaatttagactattttcatagttctcccaaagttaaatctaacaaaaaaagagttctgatgtttacacattaattaaattaaataataaacaagaaaggctcttcctcaatgtgaaatgaagaaacctccttggcttttattcttgtgggagcaatacagtaaaaatatctaaactaaaaaaactgaacatcaaaaaataaccaaatcttgaggtttctaactaattgtgaaggccatttgatggaattaaaaggcgttaacaccgaaaccaaacttgtaatccttcttcacatgatccacctggttcatttaatatcaaaaatcagtcattatcaaaaactagtcattaacaaatgcactaaaaaatgtatagtagcggattaaatcattttctttacctctgcagatagaagaaatctgagtccaataggcaattgttcttcaaggtaagcagcgacaacaccgttagaatcaacctttcctcttaatcgagactacaccaaaccacaaccaaacccataattagaacagcgctttgttgctgtttcaaaactcgaatgggaccaaaaggaatgaggtatgtacctgtctagtaatgaggtcatacccgacactagctgtaacatctcgtgacaaataattgtagatgaaatccgttgcaaatgacaactgattattgaaaaaataagaattagcttatattactctataggattaaagatgaattaagataaggctggattgtttaccttctctgaaaccttatgaacatagttcatgacagccacaccagtggaagcaatttgcccagaggcaacctgttggataataaaacatttaaagaaattcaaaaaaatgaaaaggatcatactcaagttagcttgaagattgttggaatattgtaaaccaacatagaaaagaagaatcgattttctgattgagttgccttattctaactaagaagaaacatttaccgttttgtcagtctcatatcgagctgcataaccaacacccgacatcagttgctgaccaagccagaaagcctcaccacccaaagacaggtgtggtgtcacatgctggaagaaaaagatatgattcagtgaaaagaaacgaatatctatttagcaactaacaaaagattaactaatgctgacaaaataaacaaaagcttgtccagggataaacggaaaagctacctaactatagacttaaccacagaattttagtagaacagtttaaaatggtaaagcatagtcactttacctgaatatagttagctgcataaacggaattgtttccaagctgaagctgagttctgtagtcagacccctaaataggtgtaaaccgtgaattgtcaaaaccaaataaaagctaaaaggaaaaacatactgaacagagaaaagccctcaccttgtaatcaatgacgaggtggccttgcgacttatcttcttcatctgtcagctggcagagaaaagaaacaatatggttatagatagaaagaaaacattatgcagctactacaacaaagaccagacacacaataatttctggttaccagagcattagccttgacggaaaaattgtcagttaaatcgaacttggctctcgcatttagtctaccgtccgtcgtgatccttccgataagatatagctgtttagaagtttgtaaatgttatatcttgctgatggaaaccattaatagtaccacagaatacaatcaataaacaacatacctttggatcgatgaaaccagcaccaaagtcataattggcagttggaattttgattatttcggatgatggagttggattaggaacctcagttggccccatcaatatgctgttggaagcatcaatacacaggcttggttaagaacacaaataagaatgatgtgccacaaattaacctaaaatctcattacctatggctgagaaaaaacttctggttaagcgacttgttatagtcgaggcggaaaccctcaaatagctctggctttaaagccactgcaaagtgaaatcaaaccagtcaaaacacatgatcttaaaatcacaggctaagttaatacattataaaaggttatggccacagatgtaaaggttacgaattggtagaatcagaagcataataacatatccataataccaaaacactcaattacgattgttggttcaaacgcagagatataaaagaccaagaaatcagcgacctaagacagagacagattgtgatctccaaaagaacagagaacgaatatataaagcagtagagagagagggtgatactgaactggtagcttcacggttgagttcctcatagaggacagggcaagggaggtttgagtaatccactttctcgtcaagtttggtctttgcatcgacttgcgcagtgttaatcggtggtgaaaagccctccatcgctgctgtttaccgtcaaggaagaacttttttgggtcgctaaaagagaaaactgcagaggaatcgaagacgaagagtctttcaagggtttttgggttttgactctgcgtgtgcgtcaagggttttgtaatcgtgtcaatcttagtttggcccggttttattttacttttttgaaacgggttggaaccgacctatttcgggtcatatactttaccggtttaccctcatgctcataattcactattttattttcttttggtggcgaaaaatcagtaattatattaattacaagtttattttcatatagtaaactaaaatttacaaaacaattaagaagatcatcaaatagtcaacaaatctccaaaacaagatttacttgttttggagatttgttgcatatttttctttatttggcaggcgaaagtgtttcactatggatcaataagtttgataacagagccatgtagatcagctcac

SEQ ID NO: 5935 - DNA, 3000 bp, Unknown; identical to SEQ ID NO: 5924
  misc_feature (1)..( 3000): cDNA_ID_3079013_gDNA_ID_1620833_Annot_ID_169740 3000 nt of promoter + ATG

SEQ ID NO: 5936 - DNA, 3000 bp, Unknown
  misc_feature (1)..( 3000): cDNA_ID_1989662_gDNA_ID_1620833_Annot_ID_57911 3000 nt of promoter + ATG
aatgaacttttactaatttagcgagcatatagtgtaagatgctttggtgcattgttctggttagataccagtatttcattttgtttactgtggagtctttaagctcctcgacgttttgcaatagtgggttccttcttccctcctattattttacccagcatcgtctcttacaggttcttgaccaaactgctgactgtggatttgcctcgattatttgtccgaccgaagaaaattgtcttggactttcagaaaggaaaagctgttggacctgttttagaagacctgaaatcaggagaaatgcaggaaggcaataaggattttgtcggggaactatctgttactcttgttgacgcccagaaacttcgatacatgttttttggtaagctatagttcctttacatgtcagtgtttccttcatagttggaaaagtggaatagacagacaatctattgctgaagtatcagcctctttgtgcaagttcagtcgactttcttgggaataaagtagctatactaattgagtctattggtgagatgttttgttttcctcggtaattggtaacaggtaaaacggatccatatgcaattctcagattaggggatcaagttatccgtagtaaaaggaacagtcaaactactgtcattggggctcctggtcagccaatttggaatcaggtgaactgctttggatggttcattcacaatctggtggtgaattatgattatttaaggattgaaatgtaaatagataagtgtgtattctttaactttgcaggactttcaattccttgtttcaaatcctagagagcaagtattacaaattgaggtcaatgatcgtcttgggtttgctgatatggctattggtactggagaggtaaataatatttccttgggtacatatttttttttgtaatctgtagaataataggcgttgagtacgtattctgtggatctctttaatgattgcttgaggaatgttgcttaatatttatgttactgtctgcatagccttattatttagttatatgtccaggttgatctcagatttctgcaagatacggttcctacagacagaattgtggttttgcgtggtggttggagtttgtttggaaagggatctgcgggtgagatactgctacggcttacatacaaatcatatgtggaggaggaagaagatgacaagaccaatgtcaaagccattgatacttctgacgatgaaatgtctgattcagaagaacttggctcatttgtgcggaagggaaagctttcgtcagatgatattgatcaagagtcatttatgaacgtgttgtctgcattgattgtgagtgaggagtttcaaggcatagtttcatctgaagctagagacggtataattgatggtggtgactcacttggggcaccagtaccttctaagccagatactagtaaggggtctgaaagaaacgcagatgtatcaaatttggatttgttagttgcaaattctggtagaggagctggcggtgatggaggtataccgaggctcaatctcttacgatgatttcctttctatgctttcttgacctgaaactgtaaaacctcctaatttcaggattagcattactgtggttcggtattatcacgggtatattggttcttgttgctatcaacatggaaggctcaagtttcttcaacccgtagtatagtactatacatctcgctggagatttctgttgcaagtaagtctcttaatatatacctcgagaacttgaaatttcttcccctgatgtgattggacagacagattctctttttgtcagttgttttccttatattagaacgtggaacaacactggtttgttcatatagtcaagaaccaaacttgaacttcttttttcctagaataattatgctacttgaaacattaaaattgtagattctgttactctttctgctgcttgtagtgtaccgaaagtcaaaactggacatcaggctttgtatttgataaaattatgtgtgaattgaaaatgagtcagttgattcttctaccttgtgtgacatagttcagtccagatattttcatgtcaaccttttgcctaccgtgtgtgataagcttatcaaggcctctttattttgtggcaggtctggtggtcatctcttctcaaccttagatatggcttataacgaggtctcagttttgtaatttaattttgtatgtaaatagccattagaagagggactcttactaaaggcaggaaggtttggatctattctgtccaagctctcactgttgtgttactctttacacttgtggttgatatacagtacataaaaaaagatagaaacttttgtatattttgaccaaaaaaaaaagagaaaattctgacttttcggaaataaaatataatcatcgattgtttcaataggattggtagtaggagcagaacttggttcgtggaaccatccttcatttccattcccttatggtaagattgtggtatttcatgattctcaaataaagtttgacaaagatagactgatcgaaaaggtggagcctcttgttaacatgggacagattagttgtgtcgccgctgaattccatgatctcactgatggcagactcaataatggttatggtattgaatgaagctctcacgtccatgttctgttgaggcttacaagactgttctagttggtggggaagttgtccgaaccggaacataatccaaaccgaactgaattaaatttttaaaattaaaccgaactgtccgaccactacaaagttttttcgaatttgcacattaaattaattaatttttgtggcattttgcgatcagttaacgagtggatatgaggtagcaaacgtagaaaggactcgagaagtcatggcttctgcttaatctcctcttccttaaaaaccagaagatcctttgttccacgtttctcgtttgtagcttcttctctctcagaattcaattcgaattttgacaagtcttgacgaagaagaagaaacagagctgcttca

SEQ ID NO: 5937 - DNA, 3000 bp, Unknown
  misc_feature (1)..( 3000): cDNA_ID_3078975_gDNA_ID_1620833_Annot_ID_169766 3000 nt of promoter + ATG
atttttatcagtagcatcatttttggtactaaatatttggaactaaattaacatatagaaaaattagtgagccatttagttgtttaataagaaaattggacattttcaggcttcatcctctatttgaatttcaatggatattttgagagaaatctctggttttaattttaatttttacagtcgtagagctaatgaacaacaaaaagatcaactttggctgctgcaactggacaagagacgctatgaaatggcgacaacgatttgaggcagcagatgtcacatgggtgtcaagaacaaacaatggaccagcggatcttcttgcaaaacatcggctaccagataattgttcgtttcaatatcactattatgttccacctttcattgtatcagccttacattgtaatcactcttgacttgattaattgaaaaaagtcgataaaaaaaaaaatctctggttttaatccaaacatctaagaggtcacacactagagtcacatgcagtgaactgtcataattttatcacattattgtgttctccatcatgtaaaaaggagtggttcttttgtacgtgttatttggttgtatgttctcggtcaaaagcccaattgtgggatggcccattaatgataaagccccttttaattttaaaaaaacaaacaaagccggcctgaaataataatcgggtcccgggttgactggtccgaccgaccggttcggtgagatattaatgaatgtttttcttcactctcccgatttcaatttttcgggatcgagtccgttccgacaaattaatttaacagtcaatgccggcaaaaaaaaaaaaaaattaacagtcaattggcggcgaagatgacgactcagtcgcagttcttagtgaacctctcttacggaggcctcgcctcccaaaggttcatcttcctttcctctataccccttctatcgctttcttctgttgtgttgctttcttctgaatgattttttttttgtcgatttgtttttgtagtaatctcagagcgaataatcgtgtttcaccttcttcttgtcaaattacacgaacaaatcgctcatgggcattaccagtttcctttaaagttgagaaatttcaactccaacgaggaaggaggagaagaggatcaccatgttttggggagagcgaagggttggtcaaaaatgggattggtgatgctgatgggattataattgttgatcacggttctcgtcgccgtgaatccaatcttatgcttggtaatagctttgtttctcttccttctccttcttcattttctttgttgtccttactttattgtatagtatacttcctttacggctttaccttgtgcgagtttatgtaattgtgttgttgtttctgtatttcagaggagtttgtgaaaatgttcaaagaaaaaactggttacccaattgtagagcctgctcatatggtaactctttctaatgttctcacctttatgcatagtgagaaccatacccatgagtttgatacagtctgatttccgtttcttggtcatcttttgcatttagcttaatatgttctatatcaggaaattagatgactttcaagctctgcttgctgtttgctgatttttacactttacatcaggaattggctgagccatctataaaagatgcattcagtttgtgtgtacaacaaggggcgaaacgtgtagttgtgagcccgttttttctatttcctggaagacattggcatacggtatggctttgttcatctcaatttgttttgttttcttgaagcttctagcttttcttatttatgggattattggaggatgtacattaatggcctagtgagatcatgacccttatttgattcaggacattccctcgttgacggctgatgctgcaaaggagttctctggcatctcatacctcataactgcacctctcggcccccataatctcctcctggtaagttataaagcatattttccccccaaaacgagcgagcactttaaacctaagggatgtgagagcatcctcatgcattagtgaatgccacttttttcccttgaacttccaatgagagcatcctcatgcattagggatcttctgctgtttaatcttcacaagagatctgttcttcttttggctcttgatctttcagtaatctactaatatttctttctgcaggacgttgtaaatgacagaatccaacattgcttgagccatgttgaaggtgatgctgacgagtgtcttgtttgtgctggaacaaataagtgcaagctctacaatagttcttaggtgtacatgtaagaacgtttttgtatatctgctcatcttctctaaccttcggatgcgggaaaaaaaggaggcatagtatattgttcatactcatcatttagtacgcgtcctatgtttcaacaagggagttttgagatttatgttcttttcttcttattgcagaccaatttgaaagactacgataatataataaaagctgtctgttaaatgttgtctctccctcttatcaacaaattaagaaattgaaatttgatgtatcgtatatcagcaatgtttcatggttataaaaaaaatagaagtttctctcgatgctttttctggcctcctttttcttttcttattgggtttcgtgcattgcatttgttgaaccacaaggcagagaccatttttccttattgtaacttctgcaggtaaagataagagggaaaacgtgtggttgtaggagatagcaaagacttttgaatgtctcccaccaaattctgatgaatgaatatgtggatgtggtatttcatggaccagcacaaaagagcatttcaagaagtcgtttggtagctgtaccatctaattatgttcacatgatgctgagagttgaataattcagaaagggacaaagagtgttatgattgcgttgacttggagtcatgtttcatgaaggtagtgcgtagttgactcttttctagtgtaggaggtagagatttgggagagtcactagaacacgaaatg

SEQ ID NO: 5938 - DNA, 3000 bp, Unknown; identical to SEQ ID NO: 5927
  misc_feature (1)..( 3000): cDNA_ID_3078983_gDNA_ID_1620833_Annot_ID_169764 3000 nt of promoter + ATG

SEQ ID NO: 5939 - DNA, 3000 bp, Unknown; identical to SEQ ID NO: 5930
  misc_feature (1)..( 3000): cDNA_ID_1989667_gDNA_ID_1620833_Annot_ID_57906 3000 nt of promoter + ATG

SEQ ID NO: 5940 - DNA, 3000 bp, Unknown; identical to SEQ ID NO: 5932
  misc_feature (1)..( 3000): cDNA_ID_2993114_gDNA_ID_1620833_Annot_ID_57902 3000 nt of promoter + ATG

SEQ ID NO: 5941 - DNA, 3000 bp, Unknown; identical to SEQ ID NO: 5934
  misc_feature (1)..( 3000): cDNA_ID_1989671_gDNA_ID_1620833_Annot_ID_57900 3000 nt of promoter + ATG

SEQ ID NO: 5942 - DNA, 3000 bp, Unknown; identical to SEQ ID NO: 5933
  misc_feature (1)..( 3000): cDNA_ID_1989670_gDNA_ID_1620833_Annot_ID_57901 3000 nt of promoter + ATG

SEQ ID NO: 5943 - DNA, 3000 bp, Unknown
  misc_feature (1)..( 3000): cDNA_ID_4265714_gDNA_ID_1620834_Annot_ID_57919 3000 nt of promoter + ATG
aaaaaatgttcctgagatgtgtttcagagctcaatctctatctgtacaacttttcctaacctcgccgcaaatttctatttacaatcggagactgtaacctatccccaggattagaaagaccaaaaatttctaaaaaagacaaaacaaaaattaggattcaacgagaacgaaagaggaaagatttcagaagccaaatctcaaagcaagagacgacggcattttttgcgtctgtggaaccacgtcttcgatccaaaacgatcaccaaaaccatgcggatctaactctaacaacaacatcttcgaaaacagaaccgattaatcgaccttaccgaagaaacgatcatcctcgccggtaagcgataaagaaaaatctaaccgcgaaactcgtttccttcgccggagatatccaataagcaccaatacaagaccgatgttagaagagagagagagagctcaaagagagtaatcgcgacgagagcacacgaaaatgagaccttatacagttatactgttacgagcgagtctagggttccggtttttttccccctgtaaatataccaaattgagataccggtatagattataaaccggcttgcattttccggttcgattagctgatttctctatgtaacaaaatgccatttacagttttcaaatttaccggttaaaattgacctaaccgaaacaaataaagtggaaatgttttagtttttgattcaactaagtgtatcatcaatggattttatattgtttccatattgtgcaaaatgtaatcagaaaatgatcacgatgtgcaaattggtttgcttaatttaagattgaattacagatttttttttatcgaatattaaaggatttattaaggaaataaggaagatctggtaaaaatcagatgctggcaggtgacacgtgtcactcatgactaaggtcttaaactcttacggataaagaaagcgacaaactgggagcactcttagaagacgaagaagatcgacggcagagatagaaaaaagctaaaaggtcgtcatcgaaaacaacggctaagatcttgttctcggatcagacccaacagaggagagagaaaatggatccgcttttgtgatttggataagatgacgtggcgtccatatccttgggtcgttgggcagagaagagagcagaaggcagtgtgagaggcacgtgatctgtcacgtgatttttgattctttttcactgttacacttccactatcgttcgagctatatttttttttatgaaaaaagaatctaaagatttatcagagttcctcctagagatgctaaatttataggaacagtggtggtccttggacaatagtatgatactaccaaacaccaacagaaatcatttttctgtcgttgtatcatttactgacataacttgattacaaaaatatagtattaattagctttgggagtttcacatattttagtatcaaatcaaatatacaacagaaatcaatactatagtatttggaaatgcccactacctaaacatatactacatttctttttcggtccacgcttacttattacatcgttaatccttatcttcaacagattagatgttaaagtgagtagacaagcttagactgattccaaccatgtgatttgattccaaaaagaacattatagctgtgatgggcttgagtgacgaacaacactgttggttctgtatcaactggtgatgaccattatttcagcccacaacttggagataaaagaaccaaatcataagcagtttccacagactaaagcaccaacaaaaactatggaaagcttttatcgagcaaaagatcacgagtcacaaacataacaaaaaagtacacgaatcatgaaatcaaatttctcaagttccctatcaaaacgctttaaaatacagaaaagggatcccttctcatttattgtgtcgttctctcccaaaccccaaaacactattacccaaatttagagagaacacacaacggttagttgaggtattcagagtttgaatcaattctaattcaagtcttttatttgaagtataagcttattgggctggtttttcacaatgactgtatatttgacccaatccgcccaatgtgacgaaaaggaggacccataactagtggtgtcctttactttctttttcttttccaaaaacgttaagatcataaactccatacctatatacattaatatgaactatgaagtgtcgtctactttgtatgaatgttgctctcatagtctcatctcattatttatttttgtcctttaaaatgacaaaaagatagtgacatttattatttattttttgtttccgtcgcttgtaatatatttatttgattaataaaatgggacgaaatcacaaatatatattagaagaacaaagaacaatagatacaaataatagtaacattatattttactcataagaatatacttcatgtgtggcacatgtctcatgtagtccatacattcgtgtttttttttgttgttgcatatttgatatcttaaacactaaaatttacacatgattcatgaatgtcaaagattcatttctccctagtgcttctttctctaccatcaaaagaaaattcatgactaataatccatacaaataatagtaacattttactcataagaatatacttcatgtgtggcacatgtctcatgtactccatacatacgtgttttttttttttttttgcatatttgatatcttaaacactaaattcacactagattcatgaacgtcaaagattcatttctccctggtgctttctctaccatcaaaagaaaattcatgactagagagatatatacataatttggaaattggaatgacaaatgaaaaacaaacaataaatgaatactttcgtcccaatatttattaggttataaataaattacttgtgacttgtgactaaaggtgtcaacaatcattcttctatccaatcaatatcatcaaactcttcactttactctctctctcactcataatg

SEQ ID NO: 5944 - DNA, 3000 bp, Unknown
  misc_feature (1)..( 3000): cDNA_ID_2990797_gDNA_ID_1620834_Annot_ID_57928 3000 nt of promoter + ATG
tgattttaaaatataaattagcaccaaaataattaatttaaaaaaaaaatatagcgactgtttataacgacaatcaaacgaacaacacatcgacaattattagcgattgtcgctgtaattggtcgttgaatctagcgacagacaaacgaacaatgtatgttgtcgattgttgctgtcgctggatccagcgacagagaaacgaacagggcatatgccttcgaaaatatctcatgttagggttaggccatgcaaatatattggacacttattttattttaatatgtggtctgaacttatttctttttgaacaaaaacaagaatattgttgtttaaaatttccatgaaatgattaagcaatacatatacaccacagaaaacaaactcagcttcttcttagctaagcaggcttaaggggcggctggacttatctataataaaaatttgagtatctaaacgaataaattggagatattcttttagtgttatcctaattatagttataaaacaattataaccttagaaagtttcttggaaatttaatggtaatttcattaccgtaaatagtttttctttcttcttcacgttttttttttttttttgttaaacttcttttctttctctataaaaactaaaaagcaaacttctcctttttggtacacttgccaaatgctctcaagctcaaattagcccaataaagagagaaaaacaaaacaataaaaatattaaaaatcatgaacacgatctttaaaaaattatcctgttttaagaaaaaggttaaatctttacgaatattcgaatccaggtcactctcttcttcgtcttcttcctcattcactcctcaaaagttcgacgtttttctaagcttcagaggcaaagatactcgcaagaacttcgtcagttttctctacaaggcgctagtatcaaaagggattcgaactttcaaagacgacgaggaattggagagaggccgtccgattccgccggagcttcgccaagcaatcaaagggtcgagaatcgccgtggtcgtggtctctgtaacttaccctgcctcgtcctggtgtctcgaagaactcagggagattctgaaacttgagaagctgggtttgctcactgtaatacccattttctatgagattaatccttcagacgtgaggagacagagcggagtagtctcaaaacagttcaagaagcatgagaagagacagagcagagaaagagtcaaatcgtggagggaagcgttgaccaaattggctagtctctccggcgagtgttcaaagaattggtataaatctctgaaactttcttaaagattgatgaatcgggtcgatagtttcagattgaaatctgttgaatagtttctcaaagtttcgattttttctctgtttctcaaatttaaggtctttgtctctgtttctgttttagggaagatctgtcgaatcgtttctcaaagtttcgatttttatctctgtttctcaaagttaggatcattgtttctgtttctcaaagttagggtcttcgtctctgtttctcaaaattaggatcattgtctctgtttctcaaagttagggtcttcgtctctgtttctcaaggttaggtctttttgtctctgtttctcaaggttaggtctttttgtctctgtttctcaaggttaggatcattgtctctgtttcttaaggttagggtctttgtgtctctgtttctcaagcttaggatctttgtctctgtttctgtttcagggaagatgactcgaagctggtcgatggaattactgagaagatatcaacaaagttgttctcggaaaaaccaaggaatgataatatcctaattggtatcgaccaacacatgggggaattgtatccactatttaacctgaattcgaatgaagatgttcaagtcattgggatttggggaagaggaagtaatggtagatcagcactagcaagccacgtttaccaaaacatcaaacatcactttgaagctcattgttttctcgaagacgtgagacggatttcgctacatttccgtgactctcatttacaagatgagcttctttcaaatatgcaaggagaaggtttgacaacaaagaactgtcataggtgtcttaagactatcaaagcaaggctaaggaacaagaaggttcttcttgtggcgaacgatgtagacaaacttgaacaatttgatgcacttgctgaagaatttagctggtttggtcctggaagcagaatcatcataaccacacaagatagacaattgcttatttcatcagtagtgaggagtgtctacgaagttaagctcttgagatgttacgcagttcgtgagctctttaggtcaaatgccttcaaagaaagagaaagagacgatcctgttgggttcgaccagtctacatatcgagccatgtatatatcaggtcatgtgtttttgaccttgagatatattttcactttgttgtgtgatagaggtcaacttagagaaaggataaatgcaatagtacatagtctttagattcattaatccttttagatacaaggtgttgtatttaggtcgaataagttggttagattcaggaatattaacttaatgtgtttgtttgttctatagtgaatgttacgccatttttttacatatggatgtgccacttgtgtatggatttgtgtactatccatttggtaaactattttattcttaagacggttcacaacaaattcatttaaacttgtaattgttttataaattacctatatcaatctcgtccgtcagttgacttagttgtaaccaccagaaaagtaagatgataatttatgtttatccatgttcattttcttattttggcggctcatcttctctttctgagtagtttagtgaaacagaagctgacaaacaaaaaatgaaaatgccaggaaacacacactagagcagaagactcctagttcaacttctcttgtgttaatgtgcctataaatatcctttgagatattcatagagtatcagaaataaaaaaaa

SEQ ID NO: 5945 - DNA, 3000 bp, Unknown
  misc_feature (1)..( 3000): cDNA_ID_1989733_gDNA_ID_1620834_Annot_ID_57931 3000 nt of promoter + ATG
gatttctcagggtcgccactcagcgcatctacacgacgagtttctgagaaatattaaaagagaagactctaacaaacaatgtcttaagaatcaaaaggttctgcttgtggcagacaacgttactaaggttaaacagttagaagctcttgcaggggatttcagcagttttggtcctgggagtgttgttattatcactacagacaacaaggggttgttgaattcttatggtataacagatgtctacgaagttgagcatttgaagttttgtggaatcttacgatcattgggctttaaaaagagagctgctgcgttccagcgggctttgtgtagagcaaagagttttgccacggaatgtttttgttgtcaaagtagtagtatatctggttatgggaaagtgacagatttagtttaattaagttgaatcccttattagtcatatgcattaagttaagtaaacttaataagttgtgtggcttagaaataatattgttttgtctatttttggagtgggttgctcttggggtgtagaaaaatgtcactcttcattggattaagtaatatacatttttttgttccttagtttttaagacatttttttacatctggatgtgccagttgtttgtaatatactgttctttccttatagaaataaatattacacaattttttaaaaaagatttatgtatttgggagggttttttgatgtttggacatgcccaataaaattaaaaattaatacaggagacacaaagtcgctaactttccaaagttggaatctacatatgtctaaaacagagaagaaaagcttttaaactttttacatgacgatcctccaataatagtaatacactactacagttcaaagccactgacaagtttctcgcttttttcccttaatgagaaactcttttaacctgcttttctgatttatgctctttgggtacgtggaagatttcaatcacagactaacgtaattaaatcatttattggaaactgtgagtcaagctgaataaacttgatgcaaacgaatagatatgaaagaaattgggttgatcaacaaaaaaacaagccgacaaaaactgaatctcatgatatgttttcgtccgtcagttttaaccgttcgtttgatcggataatcaaaaccagtaaatgccaataatacacaccagaaaagtaagatgataatttttgttcgttagtagtattttattattatcatgctcatcattttcttactttggcggcccatcttttctcttcccctctttctgagtagtttagtaaaacagaacctgacagaaaaaaatagaaaatgccaggaaacacacacttagcaggaagactatgggagtctctaaccaatgcacatgctttatttagttcaactactctctagtggtctataaatatcgttgagttctttatttctattactcatcatagttctcaatagagagaatcaaaaatcaaaatgtcttctcctactgcgactaagtacgacgtctttctgagtttcagaggactcgacactcgtcgcaacttcatcagttttctctacaaagaactcgttcgaagaaaaattcgaactttcaaagacgacaaggagctcgagaatggccggaggatttctccggagctcaaacgcgccatcgaggagtcgaaattcgccgtcgttgtggtctctgtgaactacgctgcgtctccttggtgtctcgatgagcttgtgaagattatggatttcgaaaacaagggttccatcaccgtgatgcctatcttctacggcgtggatccttgtcatttgaggaggcagatcggagatgtcgctgaacagtttaagaagcacgaggctagagaagaagatcatgagaaagtagcttcgtggagacgagcattgaccagtttagcgagtatctccggcgaatgttcattgaaatggtgaaatttcgtagcgttggttagaaagattggatttttatttgatatgtctcgttactaaagtttcgatttttattttgttttctctctgtagggaagatgaagcgaatctggtggacgaaattgctgacaagatatcaaaaaatctgatgactgttacaacaataagcaatgggagggacctagttgggattgatacacacatgaaggctcttaacaaaaaattggatttgaattccaacaaaagtttgagagtggttgggatttgggcaagaggatacaatggtagatcagctttagctaaatatgtttatcaagacatctgtcattggttgaaggttggttggttgaaggtttatcaagatatcaagacagcttccaaactttatgttttaactcgttggttgaaggttgcacatttgcttcatagatcacatcactcttttaaaactgagtagccagccaatcaataacccgaatttcactgagaaatccccacatttgttatgtttccatactacaaaatcatctattgacaccactagttagctgtgatcttataaagatgagtaagccaaccaaaccaataacccaaattggaaaatgtgagtcaagccgaataaacttgatgtaataacctattcgttctaacttgaaattgttattaaaatcatccttatcaattagcctttctcgtccgtcaattgacttagttctaaccattcgtttgatcgataatcaaacaaacagttgaatcttcttcaaccaattaaattagactacgagtaactaaatgccaatacacgagaaaactagactaagaggagaatttgtgttcgttaatatgttatccatactcattatcttattttggcggcccatctattctcttccctctttctgagtagtttagtgaaacagaagctgacaagaaaaaatagaaaatgccaggaaacacacagttagcagtaggaagactcttataggtcaacttctgtagtggtagtgcctataaatatccttgagttttttatttctatcactcattgagaatcaaaaatcaaa

SEQ ID NO: 5946 - DNA, 3000 bp, Unknown
  misc_feature (1)..( 3000): cDNA_ID_1988891_gDNA_ID_1620834_Annot_ID_57929 3000 nt of promoter + ATG
ggcaagcgttggccgctttggcagatatctccggcgattgttcagggtgaaatttcttaacttggtgataaagattgaattgaattttaaccaagtcgccttggtccagtggtaaaaggaagataattcccgccacctggtttgatggtttccccggacactaagattagtcttccggtttaggaaaaaaaatagattgaatttttattgttagatatgatttgaagagatgctaagtttcgattattttttattttttttgtctatgtagggaagatgactcgaagctggtggacgtaatcgctgacaagatatcaaaagagctgatgatagttacaagaataagcaatgggaggaacctagttgggattgataaacacatgaacgaacttaaccgattgatggatttgaattccaacaaaggtaagagaatggttgggatttgggcaagaggaggaagttgtagatcggctctagctaaatatgtttatcagacatcctgtcaacactttgatagccattgttttcttggaaacgtgaaacggatttgtcagggtaactactttgaaagccatctacacaaagagtttctggataatattcaaggagaaaactctagcaaacaaagtctcaagaagcaaaaggttctgcttgtggcagacgacgtcgataagcttgaacagttagatgctcttgcaggggatttcagcggttttggtccggggagtgttgttatcatcactacaaaagataagcagttgttgatttcttatggtatacagcttgtctacgaagctgagtttttgacattccagaaattttgtcgtagcttccgatcattggcctttaaaaagagagacgacatttctgctgcgttcgagtgggctttgtatatataaagcaatgaattttgccacggaatgttttagctctcaaagtagaagatctggttatgagaaagtgttggaatcagtttaataagttagatcccttgagtcatatgcattaagttaactaaacttaataagttgtgtggctttcaaataaggttgttttgtctatttttggagtgggttctcttggggtgtataaaaatgtcactcttcattggattaaataatatacaaattttttttgttataatcaaatttgtgtattttagttataacctaaatgttgtatgtctctttctagacttaagaactaaagtctatgttttccttaaaaacaaagtttgtataatttcttgggattcccatgaccatttgttctttgaatacccgaattctcaaaggcagtttggttgtccctcgcatcacatgttttccatagccctcttctgcacttgctaaagaagttaattggtttggtcttggaagcagaatcttcataacaacacaagacatgcaattgcttatttcatcaatagtggggagcgtctacgaagttgagcttttgagatgttacaaagttcgacagctatttaggttagatgccttcaaacaaagagaggatcatgttggttttgagcagtctacagagtttttaagaatgttagagcaccctaaatgggggtttctaaacaagtttcttaacaaagaataaaaaatttatatgatttaaatattacataagtctcttaaatttgatgaaacttaggcaaattgtctcttagttaagagataattggtcttggtttcaccaaatttaagagacctataattaaaaatattatttatctatacttacactttaattttgtttaagagacttaggcttagagactaccattgaggatgctcttaaacaaccatttttaacatctggatgtactagttgtttgtaatactgttctttccttataagaaataaagaatacaccatttgaaacctgaaagatggccaagcttgaggcctattaaccactccaactagaaccacgtcctccacaacacagacaactctgcggctaaccatactctccaccgcccagacaacgcaaagaaaatgggcttccaatttagttttaatgtttgtgaatgccggatgactatgcagcaaaacatgtcctgattcctctcttagaactcagtagacaactgccacaaagtttcttttagaccaggagaagccaatattacactgagccctttgacttgtaccagaaaacacataagtgacataaccagtagggctagtccctgtttcaagagaatttctttcagactacacttcctacgcagcaaaccaatcatccacatcctctctcactttctttatggtttccaaagcagagaatgtttttccttcaaaaaacatgaggtttctatttttccaaattctccaaataatccatgggaaggggcatgataatgtgacatgcctcaaatttgtctagagaaaatagactctccatcaagaccacaagttggcatctgcagtccattttcacacccctatgcgtcagaagatccataacatgtacaactccacttagaatcttccaaagaaaaacattaatttttggttttagtcttgagcttccaaacttaatgttttaactcgttggttgaaagttgcacatttgcttaatcatccttatcaattagcctttctcgtccgtcaattgacttagttctaaccattcgtttgatcgataatcaaacaaacatttgaatcttcttcaaccaattaaattagactacgagtaactaaatgccaatacacgagaaaagtaagaggagaatttgtgttcgttaatatgttatccatactcattatcttactttggcggcccatctattctcttccctctttctgagtagtttagtgaaacagaagctgacaagaaaaaatagaaaatgccaggaaacacacagttagcagtaggaagactctttgttctaggatgactcttataggtcaactcctgtagtggtagtgcctataaatatccttgagttctttatttctatcactcattgagaatcaaaaatcaaa

SEQ ID NO: 5947 - DNA, 3000 bp, Unknown
  misc_feature (1)..( 3000): cDNA_ID_1989682_gDNA_ID_1620834_Annot_ID_57946 3000 nt of promoter + ATG
caatttaggtagaatatcaaagatctcctcaatttgctgtataatggtcatctaatttccaacttatcaacttccttgttaacaatttaggtagaatatctaagatcttctttctattattggcgtcaatcagatcgattataatctgtcaatatccttcaaggtgtcaatcaagttctattttgtttccctctttcctctctcctcttgcccttgtctctttataacatgcgagctccatttgtacatttttcttgattttcaagtctcagatggagaatcttgggttgttccaaattcttttgctattctgtctctttgtctcggtccgcatagtttctgtttcttgtttaaattcagatgggttaactttactctcgcttcggaagcatttggacaaagtaccaccagaattaacttcgacatggaagactaacgcatctgaagccactccatgtaactggtttggtattatctgtgatgattctaagaaggttacgtctctcaacttcaccggttcaggtgtttcaggccaattgggtcctgaaatagggcaactcaaaagcttagagatattggatatgagttctaacaatttctctgggattataccttccagtttagggaactgtagctcacttgtgtacattgatttgtctgaaaatagtttctctggtaaggtccccgatactctcggtagcttgaagagcttggccgatttgtatctttacagcaactctcttactggggaattgcctaaatccttgtttcgcattccggtgttgaattatctgcatgttgagcataacaacctaaccgggttaatccctcaaaatgttggtgaagctaaggaacttcttcatctgcgtttgtttgacaatcagtttactggtacaatccctgagtctattggaaactgcagcaagctggagattctgtatctgcacaagaataagttagttggttcattgcctgcaagtctcaatcttttggagagtctcactgatctgtttgttgcaaacaacagcctaagaggaacagttcagtttggctcaaccaaatgcaggaatctggtgactttagatttgtcatacaatgaattcgaaggtggtgtccctcctgaactgggaaattgcagtagccttgacgctttagtcattgtgagtggtaacttgtcaggtacaatcccttcctcattgggtatgttgaagaatctcacaattcttaacctttccgagaatcgtctttctgggagtatccccgcggagctcgggaactgcagtagcttgaacttgttgaagctgaacgataaccagcttgtaggtggaataccaagtgcattaggtaagctgaggaagctagaaagtctggagcttttcgaaaaccggttttcgggcgagattcctatcgagatatggaagattcagagtcttacgcagttgctagtttatcggaacaatctcacaggaaaattaccagaggaaataaccaagctcaagaatctcaagatcgttactctcttcaacaatagcttttatggagtgataccacccaatttaggtctgaacagcaacttggagattatcgatttcattggtaacaattttacaggtgagataccacgaaatctctgccatggaaagatgttgacagtgtttaacttaggatctaaccggcttcacggcaaaataccggcatccgttagtcagtgcaagactctaagcagattcatcctcagagaaaacaacctttcaggctttcttcctaagttttcgaagaatcaagatctttcgtttctcgacctcaatagcaacagcttcgaaggaccaatccctcgtagtctcggaagctgtaggaatctcacgaccatcaatctgtctcggaacaagctcacgaggaatattcctagagaacttgagaatctacaaaaccttagtcacctgaatcttgggtctaacttattaaacggtacggttccttcaaagtttagtaactggaaagagttgaccactttggttctctccggaaaccggttttcaggattcgttccgcccgatcgccactcttagagagaaggaaaacaaccatgtattccagtgacatcatatcaaacatttttactatacaacatactctcttttttttctttgcttaaatcgttgtataccttttcaccattcttattgccgcttagtacatttttaattgataacacaaaagtttcggttgataagatccaaattcataatatacaaaattcttatttaacattcaataagaaaaaacaaaatttgctaatgctacgatgttacccactcggaagcttaccatagtctgttagtcatagtttgaaagtcaatttggtcagctgtagcttacggttaggctgttcttatcaaataacaaaaagaatgtcaaacacgtattttatcgtattcaatttagggcacgttgataacgtttccaaaacaattattcaatagttggtaatgaaaattaatgaaagacccaaacctaatgaatgttaaccactaattgaccattcaccaaccaattatttaatgaaatatctttgttagtttcgttatttagtattgttaacggtttcttactctttttgactacatcagacggacgtaaaacgacatcgttgtcgaatattcaaaagattcacaatttgacaaagagaaacagagacgacttgtttctaaaaaaaccacgtgtgtctgaaaacggaaaaaaagaagactgaatgagaaacggcgtgtaaaaagaaaacgcgttgaaggttaggctctcacaatcgttggtatacagagagaccaaacatctcgtcataaaaaacggcaagaatcatcagttactttatacccatcaatcaagtcttgtcctttttctccttctctctctcatacgagcttctttcctgctgatgaggcttgagctttaaattttcaatcttgattgagattctgcatgtttctcgatctttaaactcag

SEQ ID NO: 5948 - DNA, 3000 bp, Unknown
  misc_feature (1)..( 3000): cDNA_ID_1989685_gDNA_ID_1620834_Annot_ID_57943 3000 nt of promoter + ATG
tgatattctacctaaattgtaaatattcctaaaatagtttctttgtcatttcctatgatttttcatagtctgcgtttgtgtttgggtggagcagacactatcataattggactgagttatatatagaaaacatattgaaactatccttaatcattcccattaacatctcccaaactctctctaccaactttgcacatatacaagtgtaaatatctcaatcttgagagacttaacaaacttaccaaaagtgtgaatccatgacttggccatcgttcagttacgccaattagatgatgcctcgagctccacatcctcttcccaccaagttgccgactgcaacaccatcagtttcggaccagtttaagcttctatgcgcatatacaagaaagagacaaaaacaatctagacaatgtgctaaaccttgtatcccctgcgcaggaactcgagtgagcttcctttctcttcttgtagtcccagaacctgtaacagctcttccttcgtctgtttgcatccacatcaataaaagcttgttacttttttcccagagattggataaaaaagactatattcaaaaggttaaacgcttttagcgcacatacttcacccagcgtgaaacgagtagggctttctgcaacacacgcaaatgaaccatcagtttgcttaagcatcacctgccatggccctgcattttttttccatatcagatatggatagagaaaacactctctcatgttcaggacactggaattgagaatgattatgcaaatctgatagagagactgagacaagcatcacatcatgcttagtgatcaaggaagtcacaatacaaataggtacagctatgatatatattgttttagtcttgtaaagaatagtctagcatttaccaggatattgtcgaaaaagtgctccgttgtagttcaacacaaatggtgccactgccactgtcttagccaagcaacacaaacaactattatgctgcttcatttctgtaagcagccaagaaaggtccgctaagaaaatatcatcctaattgtatagtacctttgaatactctctggttcggatataaaagacgggaataaattgagaaagaaaccggtagtgcagatctttagggggaaagccaagaagccctaggtcagcactgcactaaaattcaattgtcaccacaagtgaggaaaccgagagagattgagttacgcaaaaaactgagatctcaatagtgataataccgcaaagtatctagctcaagattgaacagaagagctggggttgaactggcaaaggtttcctgcaagtatagaccaacaacttacagaactatatagaaggcacaaagaaaatttaaaaatgaccatagacagtgaatatatctaaaccaagttccatgtaacgataagaaaagataaaaggattcaataccacaaacttctctatgaaagagagttcccgagtgctgcaattgataaatatataaagggtcggtggctccttgggctcccaagttcctgtaggaacacataatcctcatgactaaaatgcaataatccatctgttaaaataagtaaaaaggacagttttagctataccttcgttttcatcttcaaaatcaaagtccagggtactccttatggacctaaagaaattggtgacagaagtaccaggtatatcatctagagagccaatacttatgccatcaacctgatgagacactcacaaataagccgttgttaagatccaagtgttcaatatcttattcctaacatgtgcaaaaacttgcagcaaagtggaagttctatttgtaccgaatcaaatgccgctttgaagcgttgcgaagccctgcgcttctcaggcttgtcaggaaaaacctggaacatgtttgatcattcataggtcagaagaaccaaataaaaaggatgagtaatatatagagtaatgaaggagaaagattacaatgcatgctctggtctcgattttctcctgaagtttgcgaacaacagtcacggccagttgtatattagcatcaataaagtcgtctgaagaaccctatacaatgtttgcaaaaccaacacagttaaaatttcgctaaaaaactaagtcacaatggtaacaagttaaaaaaagcttaccttgtaagaagaaatgctactgggtaaaggtctacacatgaacaaaaagagccaaagaagccattaaaatcacgaacccagagcacaaaattcagataattgagatagagtaagagcagggagattacggaaaatcgatttccaaacgagattttgaatcctggagagcgaaagctagagaattggcggcgtcagtggctagaacctcgtatgatttgggcttatacaagggaacacctctcctaggatcggaattagaagaagtagatgagattgcgccgccgctgtttgcggtggctccgcatctgattctgctggttagaatcgaaggagaagagaagagcgccggtaacatcgcaatcgccatagccatttttgctctctctctctctctgtgtttagacggtagtgataacactggctacagtctaatctgcacaacctcatgacacgtggctaaatcctgttatcttcccttaaccggattgaaccggaatttgattggcagttatcaaatcggtacttttacaacaagacgacgacgttaaagggtccagagacggttgctaacggcgtcaaatatattgcatgctattatccactgcggtagagctcaggactacttctcttgacaaccgctgatctcaacttggtctaaacctcatcgacggctgtgattacttttatatcagagttccagagctgagaaactctctctataacagaatccaagcgccatttaatttgagtcttcttttttaactacttttactctgtttctctctctaactgagaaacttctcactttcccgagaaaatttaattttctatcagctccgagaaaatcttcaacagaagaacgagaatg

SEQ ID NO: 5949 - DNA, 3000 bp, Unknown
  misc_feature (1)..( 3000): cDNA_ID_3079076_gDNA_ID_1620834_Annot_ID_57942 3000 nt of promoter + ATG
ctcttgacaaccgctgatctcaacttggtctaaacctcatcgacggctgtgattacttttatatcagagttccagagctgagaaactctctctataacagaatccaagcgccatttaatttgagtcttcttttttaactacttttactctgtttctctctctaactgagaaacttctcactttcccgagaaaatttaattttctatcagctccgagaaaatcttcaacagaagaacgagaatgacgaaacggattgattcttctcttctctacacggcgctcgtagtgcttcttcttcttggagtagttcatcgctctaatgcaaggccacgcgttaatcgacgtaagtttccgagaaaatttctgtagaatctcatgttaatgcttgaaacatcataatctttggcgacgaagaagtttttgatgaggtttctttgatttccttgtatcgcttttgagtaatagcaagaaaacgatgatcgatgtttagcttatccctaatttgattttgagattcttctctttcattgttgtttcttactgttggaaccttcgttgcagctcccggtttcatgcgattcatatcgaacgcaactgattttgcgtcggaggattactacgattacataatcgtcggaggaggaacggcgggatgtccactagccgccacactttcgcaatctttccgagttcttctgctagaacgcggtggcgttccctacaacagacctaacgtgatgtcacacgacggtttcttgaccactctcactgacgtcaacaatttcgactcgccggctcagtctttcatctctgaggaaggagttcctaacgcgagaggtcgtgttcttggaggaagtagtgcgatcaatgctggattctatagccgtgctgataaacagttctttgagaattcgggtcttgtttgggatctgagtagtgtgaatcagtcttatgagtgggttgagagagcgattgtgtttagacctcagctcaggacttggcaaactgcaattagggatgcgttgcttgaagttggtgtccatccgtttaatggcttcaccttggagcataaagtggggactaagatcggaggttccacgtttgatcgtactgggaggagacacagctctgcagatcttctcagatatgcaaggagttccaacattagagttgcagtttacgcaactgtagagagagtattgcttgcttcatctcctagtgtctcaggttccaacgtttctgcgattggagtggtttaccgtgatcagctgggacgtttccatcacgcattgatacgggacagaggagaggtgatactgtctgctggtgcactcggtagcccacagttgctttttcttagtgggattggtccaaggagttatctttcaacttgggggatccctgtggctcttgaccagcctcatgtgggggattttgtgtatgataacccgaggaatggtatctccattgttcctccggttccaatggagaactcactgatacaagtcgtgggtgttactgaggatggggcttttctggaggctgcttcgaatgtgattccgtttgcatcgcctttacattctgtgttcatcagagctccagcttctcctttgtacgtccctgtgacaactataatggaaaagatcctaggtccagtgtctattggtttactaaggttggcgtcaacggatgtgaggattaacccagttgttagattcaactacttcagtgatccacaggatctagagagatgtgtcaatgggactaggaagattggagaaatactcaggagccgagctatgcaggactttatgataagggaatggtttgggaaccgtaggttcaggtttgttggagctccattgcctgtggaccaatcaaatgatcttgtgatggcagatttctgcagacgaactgtgagcacaatctggcactaccatggaggcgctgttgtaggaaaagtagtggactctgatctcaaagtcattggtgttaattctcttagactcgtggatggatcaaccttcaatatctctccagggactaatcctcaggctaccttgatgatgcttggaaggtaagaagaaaccatcaaagtgtatactcttcgaaactgtatcagtcctttttgaccagacttaaaaacaaatttcattggctttaattgcaggtacatggggctgaagatgctgagagagaggatgagatagaaatgatttccgcaagatgggctctttcgcattttctggattagtttgctgattctttttctgttatacgttcacctgtagctctctatcagatggttctacagttagtttgttcattttttctttctatcattggactcctcggttaattcatgtaataacggagtacaggagttcgtctatagttcatgtaaaaaaacaggattgagatataatgataaatggcctgatcttactttcagagtaaccattatggcaaatttcaaaccttcctgtgtcagaaagcagaggacatgttcatatagcatagtacatactagagcaaacttaaatattgataatgtgaaaacaggaggtaatataatattcctctcatcttctttttggcactatgatgaacacttttggaatttgttccacgtaaatgtttcttcttgaagttttctggaatctcctagttctttatgtaaagaaagataagacaattaaacacatatctatcgtcctcttacattgctgtcctggaatccaataccttcccatgaagcatgcacgtctttttatatgcgtgttgcaaaagctaaactctcaattcttgttcttcattgatctgcaacctgttttagttccaaaaagcttcagctacatcgaagaacgagtttgattctccatagatggtatcagattaatagcagcttcctctttgttgtaaaactttggtttcttagcatcttcccttccattgtgtttacaaaagttagctgtcatttaaacagcaggacgactcatg

SEQ ID NO: 5950 - DNA, 3000 bp, Unknown
  misc_feature (1)..( 3000): cDNA_ID_1989687_gDNA_ID_1620834_Annot_ID_57940 3000 nt of promoter + ATG
gcactatgatgaacacttttggaatttgttccacgtaaatgtttcttcttgaagttttctggaatctcctagttctttatgtaaagaaagataagacaattaaacacatatctatcgtcctcttacattgctgtcctggaatccaataccttcccatgaagcatgcacgtctttttatatgcgtgttgcaaaagctaaactctcaattcttgttcttcattgatctgcaacctgttttagttccaaaaagcttcagctacatcgaagaacgagtttgattctccatagatggtatcagattaatagcagcttcctctttgttgtaaaactttggtttcttagcatcttcccttccattgtgtttacaaaagttagctgtcatttaaacagcaggacgactcatggatcaacaacaacaaggtgataagaatctgacagtgttcgtaggaccctggggaggaaatggaggaaccacttgggatgatgggatttatgatggtgtccgtgagatcagacttgtttatgaccattgcattgactccatctcggtgatctacgataagaatggtaaacccgcaaagtcagagaagcatggaggtgtgggaggcaacaaaacatcagaggtatgttcctctatcactctggattatgtctctctttaacttcctccctcagattttggtttcttttacatgaaccgaatttctgcagataaagctgcaatacccagaggagtatctgactggcgtgagtggctactactgtccaatggttaacagtggcactcctgtaatcagatcaatgaccttcaagagcaataaacaagtgtatggaccttatggagttgaacagggaacacccttcactttctcagtcaatgggggacgcattgttggtatgaacggtaggagtggctggtaccttgactccatcggcttccatctatcacgccctaaatcaaccaagatgatcaacaagctccgaaagaagattcactggctcacaaggatagtagcatgatttaagccctttgcatagaatgtaaaactatactctacaaataaggatgttagatgtatcttagtccatgagaccaaaagtgactgagcaaaacactctttaatgaacaactcaaaaggaaagcatatcattcaaatggtaaaaactaaaaacacacgaaggttttttatataaagttataaacaaagcatatttcaaagtgagcaatatacacaaatacgcccgtgtttgcggataatagaagcaacaattcgataaggatcgcatgcaaagtggcaggtaatccaagcatgaatgttggttagcgcatttatcctctggctttaagctccgcaagcctcctcgacaaatcatcctcatcgactttctcctcagtcttagtaggaatggcatgaccagcaggctgaggaagccccacagagacttccaaaccatagtcatctgccacctgctgcataaggctgttgacttcgccttctggagtggacaatgaagttgaaccagccatagcattctccatgaactcagcttggacctccatgttcacaaactgcttctcgaatgaatccattgtctctgacatcttctgtagattccctggtgaaggatacagaaaacagataagaaccaatattgtaaacagccccaagaaatcaaattacatttgtgctcaaatgaactaaagatgaaacctttcatatatttccatataaacaaaaccttcctgatctataatcagaatcatccttcaagtttacattacctctcttaactcttttaacttttttttttttggacaaatctcttaactcttaactaatacaacataaaccatggtgatcatacatatccaacctatcgaagataattcgtataattcacagacgatgaaatacctgtggcaagagaagactcaagggatttgacgatattggtcatggatttggtgatggtggtcatcttagcctgagtatcaagacgagcaacaacagcgtcaaggcgagaagcgagacggagatagttcatctgctcgctacgcttacgaatggcgttctcagcgtagatccgagcaccatccatattacccttctcgatagccttcttcaccttcaatttctctgctttctcttccttctcacacttccttgattgcctttgcagagactttgacgtaaatttcaaatcgaatatctgattcatcagcttatctgtgttacccatgttggatcaattcctctagatcaattcgcttggatctatcggtagaaaaattctcaaaaacagagactttagggtttctctgtatttggggaaaatatctcgacgcgttgatgtttgaagaagaggggaggaaggaagctaagtcaaaatcggaattgaccggttcaatcgaaatgtcggtcattacccggtttgatttatatatcatggtgataataaacagtcacacacacaaggcacgcgtgtcaaaagtgactcagcaccgtccgatgtgtcactcttttttacacgatggatcaatcatcatctgcgtgccaactcatagcaaaattaaagtattttggattgttttgcatgtaatttctttccaaaattcaatctaagtttcaaattcaaaccccaaatgcttttgtcttgtctcttccatttcccagaaacgtttttttgaagtaatggaagattcaaattcgtgagagatacgtagtaaattaggtccttttcgtggaatgttggaatcgaattcttgatttttgcagtgttctgacttaaaaccctgatccccttttgtggcccagaaaccggaaaattagattaattacagaggagaaaagtagttcagaggaaaaaaagtgaataaaggtggattctttggtgaatacacatttgggcattttgagtcagatcttagaaaaaggaagctttccagctactgagaagaaatctcaaaattctgcttgtgtgatagggtttttggaaatg

SEQ ID NO: 5951 - DNA, 3000 bp, Unknown
  misc_feature (1)..( 3000): cDNA_ID_2109538_gDNA_ID_1620834_Annot_ID_57939 3000 nt of promoter + ATG
tgtttcataatctagatgaatacaaatctctataatatcaataacatatatttaccatatcttcaatatcttctagatccttctatgtatacgagtacacaattttcaatacatataaatatatgaatgtgattagtgtttattattgttctacgttgttatccatcctaaaccgatcgaattactaatttaacttctaatgttgtcgtaatgatataaacttaagtatattaatacagttcaaatttcaaatatatgtatgtttacgcgtgatatacttaatagaaattcgcgtgatttcagatttgctaagcacacacttcaaaatgtcgtatacgttagatgtttaactattacagtattaattcccaattattattagatcctagaatattggatcgttttcgacaaaaaaaaaaaaaaatgaagaatattggaccgcacgatacttgggaacttggcatgcagctttagtaagtgcgattaggattttaatgggacatagatggcgtggcatgtcacaaatagaaaaggacgaatttactttttaaaactgtttcacaatcacaaatcagcgagtgtcgcttttgcatacgaaccgcatataaaataatcgtgtactaaaatgagaatttctatcaaactttggattcttcattttttgtgctaatataatcaacggacacaaggaatatcacgagcttatattctaatgacgattctcggatcatgtcagtgttgttaggctaccgaataagtgtatgtgtcaaactataatttgtaaaacatgttgtagtgtttggaataacatttaactttcagaaatcgatgaatcatcatatgatacgtgagaagaaagtatggaaaaaaaaaaaagtgtggctagacatgagacccttccataaaactcataattctaaacagtttacgaaaatagcttgtaatttggtcataacacaacacttgatttaacgtgaataatatatgacgaaatagaagggaatgtttgctcaataaataaaaatgcatggttatcaatgttcaaagcaaatgcgaatatcacgtttgctaagtttcgaaagctgacgcgtcatgtatatcacatactattgttattatgattacaaggcaacgtgtttcttatagatctttatttggtggcagcttatggttttgccattgctctagtgtcacggatccaactttatctatttattgacaactgtttttctctacaacatttgttgattattgacacgcacctatttgtttttcttattttacattaattgtttttttcttaactcaccatagctattcgaagtgctcattaagtattcaaatacgttacaaaagctttttgctcttaatcaaaatttgtgtaaatgaaattagtcaaatttttagagctaaatatatataattcagtcttaaaccgtggaccgtctgtcagttttttttggtaaaatatgatcttctggttttcttatagtacaattaattggaaaaatgagtgttgaaatcaaatggatgaaagtaaacaatgaaagcctgtagccaccgaaaaaggctgctacttaattaggatattcttcttattattgttaatctctgtccctcacgattccttgcaagtgccttcctatcaagttccaataatcatatcacataaaataaagaaatctcaaaatagcataatgttataagagttcatttttgccaaagaattaactacaatgttaagattttaaaagaaaaccaacaaaaactatgtatatatacaataacaatcaattttaaaaaagtttctagaatatatattactaaaactataactatattggtttgaattatctaaaattccattctcttttaaatcgtagatcaaatttttatctgatatagtactgctttttagttattttctttgatatttatttatttgaagtaaggatatatttgggtaacggaatattcttctcttattcccgcgttacctcctcctcatcttttttattaaacccaccaggaaacttctaaaaaggcaagaaatcaccccagagccctcacaaccgttggatctctctacaagactcaagtttgacccgtaaacgtcatcaaatccaacggttctcagaataaaatcaaaagtattctaatttgttcttcttttttttgttaccttgaaggtaatattccattggcatctccgataaaatcccccattgtttctctccattcattagtataaatacctaaccacatttctattctcctcaattcacaaaccaacaagaactcaaagagagatccatcaattagaatcactaatttctttagaaatttcctgagtcatggcttacaatagcaatagcaataacaacaacaacaacattgtcgttgttttcgacttcgacaagaccatcatcgacgttgatagcgataattgggtaatcgatgaacttggcttcactgatttgttcaatcaacttctccccaccatgccttggaacacactcatggtttgttctaccttcttctctcatctgttttctcattttccttttgaaatttcgaataacttttcggttttgtattcgattattatcttgcaatttcaatcctttataaaagcttttgttatcttgcaattttgttatcgaataaaaccctaaatggaattgtataaaataacaggaccgtatgatgaaggagcttcatgatcaaggcaaaaccattgaggagatcaaacaagtcttgagaacaatcccaattcatccacgtgtcgtccctgccatcaaatctgcacatgatttagggtaataatcttcattattattctttctagtttttgtttgtaactatcaaattttacatgtctaacaatattttttttctattaaaatatgtctaatgttagacaaaacccaccatttctgatccgatatttacgggttcggtttcaggtgtgagcttaggatagtgagcgatgcaaacatg

SEQ ID NO: 5952 - DNA, 3000 bp, Unknown
  misc_feature (1)..( 3000): cDNA_ID_1989689_gDNA_ID_1620834_Annot_ID_57937 3000 nt of promoter + ATG
tgatcattgagaggattcaacaatctttagctaaagaagggaagaagaaaatgatctatctaggagatggagctggcgattactgtccaagtttgaaactaaacactgaagattacgtgatgccacgtaagaatttccctgtatgggatctaattagtcaaaatccaatgctgattaaagcagcgattagagaatggaccgatggccaaagcatggagatgatattgataggaacgatcgaggagattagattggaggaagagaaggagaagatgttgactagtgcggagaataattgcaagatgcagaccatctctatcgggattaataatgttcatcatgaaccaatattgcctcgtgctcttcgtgtgtctcagtctagttagacgtttttgaaatagtggaggaagaagatttacaactgtggtgtttcttcttcctcatatatgcataatttgtagtacgtacgattccaaaaagattgaatttatcctaaattaatattgtatgacgatgaaattgcaagaagattgcgatctttgtttttattagttcttcattggttgataattcgaagaaaaagaagaattatggagttttgtttgataattatataatttcttgaagaatgaacctcgtctaatattacgctgttttgtcattcatttttcacgtgtgttttgtcaccctagaaagtagttaacaaatctatcataatttataagttcataaatcgcaattaacaattggttttcttgatgttccaaatccaaatttatagaagccacgtgagccatgcggtcccaaatatccaaatacagacagattcgtatttcgaatcatctgacacgaatattcttcatggtgttgcaatgacgatacgtgtattcgttttcttcatggtttcaagaaattttgtaacaaatgctgaaagatgatgcaccaagtttctatcaaaaaaattggactgacttttatttttgacagccagcatttttctactgatctatatataatttaactagatatacatagattattttatattcgaatgtttacttttactttacatataattgaactcatactgtaaatatcaataacacttccatctaacttaagtgacttctaattttcaaaattaagaaaaatccaagcatgaaatttttcatgaaacgtgaaagtatagagaaaagagtaataatcaattaacttcagtgccgatagtatataaatttgggatagctgccgaaagcaaacaaatatatatagttgggtcggatcatttcagggatttccttatataataattactaagcccattatagcccatagttttatatacacacctcacattccacacaaacacatccgttgaacaaataatcggcccatttatggcccattatatacaccacacatgacattttcaacacaaacactttcaggtcggagaagccgtggaaatgacggcgagattctgtagattcgacttaacgaccgtatccacaaacatccttgtatcttcttccgtgttaccttgtggtatatcaacaatgtaagactccaataccacactatacactctcttcttcttatccttttccaagacgacgaactcgttgaccgatgtaaccgaccggtaattatttaaccggtgttctcctccaagaacacgaaaactcaagattcgtttctcttcgtcaagaacttcgagtatctcaacgcttgttgacgctggaagaccagagaccacgctaacttcccttatagtcccaactttaatctctttgatgccgttaccgttaactctgatggtgcaactcttgatgaagtgtttgtatttgtttggattggcgaagtcgcggacgaatctccatatggcatgtgccggtgcgtctacacggtgtgctatgagtgatgtgcacgtgtttggcgatcttgggaacgtgtggtgtgttcggatgatggagtctagtgttgagaactcgtcctttgttaatccgtatggtgttgacgatgatgttgttgttgttgatgatgatgatggatcatggattggagcaagattcatggttttgggtgtactttaattttgagaagaaaattgtgtacgaaactaggactaattctcttgacatacgtatatatatagatatataatgtgttatgactaatatttggagttgggctgcacgaaaatgcctttgtcatttggctttttagaaaattgggtgtacaagtgtgaacgtgacatcaaatctcattattgtatgactcattggatccttcagaagctacctatagatcaactttttggataaacaatacgaaaatgaagcatcaaaatggaatctaaactaaatttgttaaattgaatatgatatgcaagacgtagaagaaagatcaacgcccctattaagggtgtatatggtggaagaagagttgtttctgatttagactttcgtatgggcattggtttgtatgcaagttgcgtgtattacaaagaaaaaacaaatcaagattagtgtaactttgagttgagcccatgtccaatacactacacacaatatgtaaattttattttgttgactttagtccatactctaatcaacacgtgatgtgcacgtgataacgaagtagtgatgttgtcgtcaaatccgagccgtttacttttccggccatgggggcttgaatttgccggtacgatagcgatagcttcttaaaccaatttgatagtttttggtagcttgtccttttcaaatctgggcttgttaaggaacatcaagttaggaaattgattggtatacttcaacttcttcttgttgcagtctgtctctgatgtggtgattgtatccgtcaggtttctatgatacagtatgcaaacccggcattagttcaccggaaccgatgtctcccggtttaggagttgaattttgctaaaaccggctaaaaagtgcgcaatttggccaagcgtactattgcagaagagggacgatg

SEQ ID NO: 5953 - DNA, 3000 bp, Unknown
  misc_feature (1)..( 3000): cDNA_ID_3079088_gDNA_ID_1620834_Annot_ID_57935 3000 nt of promoter + ATG
gtcattcgattgggggatgaacctgataacatcgagaagacactaactgtagctctgctggatccaacaaagaatgatacttctaagaaaagcatcacaacatctgatccactggcttcaagcacttgggatgaggtgtgtataactctgctgcgatgtgtttcaacttcagttgattctcgatcttaacagatatgaactcattacttttataggttccatcatcaagaactttgatcacaccggtgcaatgtaaatctatatggagacagttcaagacagaaacagagtatacagtgactcaagccatatccgcacaggcatgattactttcctcataagttagctcttcactctgcttatatgaatacttatataaagtgtttatactaattcaggaggcgaacaggcgtggaaataactggttacctcctccatgggcaattcttgcattgatcgtccttggattcaacgaattcatgactcttttaaggtccatcaaagcttagtattcactgcttcatatccaatgatgatatgtaacattctgatttctttacctttttgatgtaacagaaaccctctctatcttggtgtcatgtttgtcgctttccttctggcaaaagcactgtggacgcaattggatatccctggcgaattccgcaatggtgcagtaagtgtttgccaaccttctcaaatcccattaaagtagtagtagcgtttcaagaatcatggactcgagaaaacttcaagactcaagaattcttgataataatactcatatgatctatactacctgtggtttcttcagcttccagggctcatatcgatatccgcaaagtttgttcccacagtaatgaaccttatcaagaaccttgcagcgcaaggcgaagaccctcctgcagctaatccagagaaccgtcgttcgagcaacaacacttcttcatcagaaaatccaccagatcacaaaagctcctcaaaagaggactaaagaggagagaaacaaagaatcttcttactctccaaaggtttgatctccagttcttgacgtttttttctccttattccctcactcatgagtccaaaacgctgcgtttatagggaccttttgctctgttttattagaacttctcattatacacacgagtgaattagaacttgaaaacgttgtggcatcatttgaatatttttccttcaaataaacaaaaaaaaaaagatgaagatgaaaaccaataataaatatatgtacgttctataataactcgtttcatgaaagtggaagcatgggatgagatgccaatcccatgaaaagtgagcaaaaattaatatttacattaactgctgagtgggtaaagtttaataaccattttctaaaaataacttttattcagaatccaactcatggattggtgtgtgtatttattatcatcatttctatacacatatccacccccaataactctgtcaattatacacctcaaaatcactgtaagttataaaaaaatgaatttctacaattaatcaaagaccgtccaaagccttcgtggctaattggtgttaaactattcacatttttagtcaagtatttttgcatattatatgagattaattttgccacacaagatcgttaataaactcgacatgatgattctgtttatgtggcttctattaactaggaaatgaaacaatgtagttatagttgtgactgatatgaagtcagagaaaatggctacgtaatcttatatgaccagaccaacgtacgtgatgcgatgtgacatttttcattcaacactaaagttaaaaccttgattgtttttgtattacatttggcaactaatccaatatgttttgttagttgttagtactaagtactgactgatgatcacattcacgctcaaccaaataaaacggatgatattgtttttggttaggtgaaagaacaattaaattagttgccaaaaacataacccgtgaagatttatgttagtaaccaacctacagtcataattaataagtttatgactaatagtaattaaatgacttgccaaaaacatggctctgtatagtatagtttttagattttggttaggtgaagatgattaattgatacactatgaatctatgaagacttgatccaacggctaccagatctccgacttcaactgttttcatatcgccattaatgatacagacaagctgtactactatcctttttatctctttattgttttatatgattttacagtaatactattactaagtactaacaaattgtttttctttgcagctggtcccaaaagtcaaaatcatgggacaaaaaaacgagttattattcttattatcatcaccaaggtaaaaaaatgtgaaaggaaatccttttaaggcttagtttcaatataaatacaaagatgttatttgatagtgattgttctttgtaacgaagtacttatcattaatttcaatttgcaacaaacaattctgtaacaataagtctaatgtgaggaaagttactagctggtaaaataaattagtaggtaactattttttatgagtaaatgagggaactattaattgagtaagatgattcatatgtccttttcatttgctatattcgacagaatgggacacacctaaaatcaaatttacgttttagtgtagaccaccccaacatctctttattacacaacttgtgtttttttttactatatgatttttttaccgaatgttgttgtctaaccaaaattcaatgtaccgtataagactataagttatacaactcgtagaaatggttacatatatgtaacaatatatagagacacatgtgggtgtaattaatatagttgctctgttggatcgttagtgttatttataggagaagaaaacacacaaaacaagaccattcatcaaaagccacataagaagttgatgcagaagcaataataacaaaacaaaaaaacattaaaaaaaaaagctcttcagttttggtttctgcagtctcca

SEQ ID NO: 5954 - DNA, 3000 bp, Unknown
  misc_feature (1)..( 3000): cDNA_ID_1989691_gDNA_ID_1620834_Annot_ID_57934 3000 nt of promoter + ATG
aaggaaattgtgaaaaaaagaagttaatttggttttgaaatatgaatgtttttgttttttttttggagtattttgtttgtaattttgaatagactaactaatacaatatacaatttttcttttaaagttttgggtttgatgtttccatatgcacaacaaacttatacctaactaaagttcatagctcaaagttggaatctaaaatgactaacaacaagataaaacagagaaagggaagcttttgaagaggaagatcccaaaaacgtgaaagctgtcttcttctgctttctctcactgacactgtagaatttttctgtctgagaaagacaaaagaatgggtacaatttctctatctgtctgccagtatccttcgtccgatttatgctttttgataccttgtttgcttctttctcaggcttttacgtctcatggacccgttttcatgactttttttatgggaacaacaaagtgggctaaagcctatagatggtaactgaaattaaacaaagaaaaacaaaacaatcagaaaaggcccagcccaaatagggagaaggaggcccaaacagaaaagaaaaacggagcacaaaatggttttaccggcggcaagaaaaccggcaaagtctctcggccggaagcctaatctaaaatattgcactgcattgtgtcatttcattgagttgactttgatattttcttggttacaagctgacaaaaataacaaataagaaaatgcgaggaaatttaacctgtctctgaagcatgaagaaggagtctctgtaaaatcctcccacacggttacacgtccacggctattaatcccacttattccatttctctttagaatcaatgaaatgtcagattcttcaaacaccctcccaaagtttgatgtttttctgagcttcagaggactcgacactcgccgcagcttcatcagtttcctctacaaagaactgattcgaagaaacattcgaacctttaaagacgataaggagttgaagaatggccggaggattacgccggagctaatacgcgccattgaagggtcgagattcgcagtcgttgtggtctccgtgaattacgctgcgtctcgttggtgtctcgaagagctcgtgaagattatggatttcgaaaacatgggctcgctcaaggtcatgcctatcttctacggcgtggatccgtgtcatgtgaggagacagatcggagaagtcgctgaacagtttaagaagcatgagggtagagaagatcatgagaaagtgctttcatggaggcaagcgttgactaatttggcgagtatctccggcgattgttcatggaaatggtaaaaatttcctaactttgataataaaggtcgaatttttattgttaatttgagtgaatggattgtaaagtttcgatttttactttgcagggaagatgactcgaagatggtcgaagaaattactgacaggatatcaaaagagctgatgattgatacaacaagaagcaatgggagtgaccttgaagggattgatgcacacatgaaagctcttcaccgtttattgaatttaaattctaagaaaagtgtgagagtgattgggatttgggcaagaggaggcaatggtagatcagctttagctaaatttgtttatcagaacatctgtcaacacttcgaaagccattgtttcttggaaagtgtgaaaaggatttctcaggatcgccacctgtctcacttacacgaagagtttatgatacggattcaaggagaatgcttgagtaaattaaggctcaagaaccaaaaggttctgctcgtggctgatgatgtgaataagcttgaacagttagatgctcttgcagaggactttaactgctttggtcctgggagtatagttattatcactacacaagacaggcagctgcttatctctgctggcataaaacttgtttatgaagtagagcttctcagattccagaaagttcgtggactcttcagacaattagccttcaaagagaaagacatttctgctgcgttcgaggtgtctttgtatagggcaacgaatgttgccatggaatggttaggttgtatatgtggtagatcaggttaggggaaagtgttagtgttagaatcactttataaagctgatcccttttttcatgtacattaagttaagaatgactaaacttagtaagatgtgattgtggcttagaagtaggaatgttttgtctatttttggagtgtgttgctggtgtatagaagaatattattctttgattggattaaatgatatacaaattctatttcaagtttgtgttttgatatttccatgtgcccaacaaatttgtagaggagatctaaatttcctaacttgcattccttgcttttgccttttccaaggaaaaagaataataactcaaagttggaacctaaaatgactgacatggaaaaacagagaaagggaagcttttgaagagtgagatcctaaaagcgtgaaagctctgatcttctttttctcactttcactttgagaattttctgtctgagaaagacaaagaatgggtactattttctctccctgtgtggctttttccttttatcagatttatggcatttgattgattcctgatagttggttggttctttgttgtttcgctagcaatgtagatccatatatacgagtacctttttctctgctttcttcagaaagaatgtcattgttattggtttcagaaagtaatgcctctgcatgcgtaaacaatactaagaccaagtcgtttctctcgtttcatttcaaaattgtttgctttggttgttgaataaaatatctcaattaggagacagtgattgtgtttaaagggcttctgtgacgagctacataatccatattagatgcagataaaagcgagggatgttgttctgtacagctcatcgacggagatggtatatacaatgtctctcgcatcgatcatttcattaaagatgtgaaacttgcagactgtggcctttcttatgctgttgtctctatt

SEQ ID NO: 5955 - DNA, 3000 bp, Unknown
  misc_feature (1)..( 3000): cDNA_ID_1989677_gDNA_ID_1620834_Annot_ID_169813 3000 nt of promoter + ATG
taggatttttcaaaaagaagaaaaagagacttaacaatcttttccaaggaagtctccaatgaatacatcatcgatcatgccgcttcgtgccccaacggctatgttaacattatccgattccgcgccaagcctatagagataatccttcccttctgaatctttaacttcccatgacgattgctccgacaacttcttccgcggctttgcgccaccatcgtcattagccactttgccgccgtcattagaggagggtttcgagcaaacgattgaagagagttttctggtattgattaaagtagcattgaacgaggaagaagaagaagaagaagattgtaaaggtggaaacttgaaacgcagagatatgtttgcaagcgccattaacccaccaaatcacttcacaattaaagcttctacctttttccctcaatttaataaaaaaagatttatacttttctcccaaagataggattttgaagaagaagagccatttgttctcgtctgatagtggctaattctgtggttcttgaagtcaaaagatagttttggccccacttgttactacttgcatgtttgtatctgtctgaaactatagcaattccaatttgtaagaatggatataagttttttgtttggtggattttggatcaaagctttagttagtcattagaaggtacattatgaataaggcagcagttaatctacatgcattggtagtttggtacgtaactcattttgtaatcatcattaattattcattatcattggttatatgacaatatatttccacttaattacacatatattttatggtttcccattagaacaatagacaataatatagagacttcgagtcttcgacgagatcgagatgagaagagagtcactcgagactaatggatcaagagaaccaattaacgagctcgtccgcgtggctgccagctggaggaggaggcacatcttgcatcactttctcttgtccctttggatagtatattcccgtaccttcatgtggcacccaactactcgccggcgacgacgtttctccggcgccgtagaagcctctcatcgtcttcacctcctctccggagctagagccctcagtcttcaccgtatccctcactatatcatgcgaggcactcttcttgtgaattgatttcctaagcatcggcctatatatatgcaaattgcatgtgttaatgatatataacatgatacataattaaacgatcataacaaccaaaagtgtatgatctaagaatcaatatgaatagagagaaaattagcatggtttatgcgtaaagattgacatgcacgaaacaaataatgcatatgctcaacactaaatttaaggtaaacttacttgacgaacatggtgttcatggtttgtgccccacgagaagagaaggtagaagtcgccatgtaaatctctatggtctattgattacaatgtgtatgaagaatctgatgtaggtaaatatatttatattatgtgtttgttgagagagttgcatatatatacatgagacatcataaaatgtgaatggaatttcaacaaaattaaaataagataaagaatttgggatggaaagaatgatggagagggatcatccagatgcacactccccgaggtagatttatcgtcagacccatgcctcttttgtgccattcccctccacgtggcataatccacgtcttcttattttggatcattcttcttcaaaacgtatgcgtacacatgatcatgttttggtcacttgtggcgtgcatgattcatgacccattcggactactttatttctattgggcctactaaattttataagcccgttaactttagataggtagcccaataaaagcccggaatctatatgtaactttgggctggtattggattctagtttaaaaagaattttgatgatttaaaatcatataaagtaaataaatgaagagaaattggtagagagtattatataattttgttaattagtttttttcgtaattttgtaaagtttcacgaataatttctctattttgacgatatttttatgacgaaaatgtataaaattataaattaataatataataatttagtttattaataataaaaaaaattatgttgttttagttgaataacccaaagttttttttttcaacaactttatcaaattctaaatccaataacctagagttataaagattttttacaaatcacaaactaataacaccaaactcttaattaacttttattattgaataacaatagattctagtaacatttaaagtcattaaatcactatttaaatcacaaaccaataacactacttttttctttttttctttttttaattctctaaattgaatttttattatggatctggttgtaatcctaaattagaatccttttctcaaaaaataaaaaataaaaaaataaaaaaaaatcttaaataagctctttagtatttatttattgttgtatgatgattatgttgaggcctttttctcgtttcttcctctgttgtactttccttcttactttctcaggtaaattcttctctctttccttgtttttctcatctatgtttactttgaatttcagggtttatctccttttgattactttctctgtttttcatctcaaagtctcgtttttttatgtaattcgatgcgtctatgagtttctctttttcagcgatcttcgtgctcgggtcacaaatttgagatagctgtatagtacagtttttctaaattattcatcttttccgattaagcatctgagtttcgataaaatctagacctagtgattagtgatgatggcaaaattttcaggatttttgagctgtttcttagtgaggacctgtttttgttgtttgaaactttcatcttcttattgcgatcaagtttggaataacatgatatttttcaactctttattattctgatgatattgcctaaccaaagtttatatttttgctgcataattttcgtatagcgtgagccatc

SEQ ID NO: 5956 - DNA, 3000 bp, Unknown
  misc_feature (1)..( 3000): cDNA_ID_2175085_gDNA_ID_1620834_Annot_ID_169811 3000 nt of promoter + ATG
ctacactatcctcgcctgaaaaaacccaagagtttccagcagaagatttctgagaggttaaactgttactgatccaagactcatcatccgtaattattggtttttcatcaccaagagtagtgtctgatgtcagattagcatcacaatgctcttcgagcaatggagacttagagagtatttcttcttcagaaaatttctgaggggttaaagtgttagtgattagagactcatcatcggtaactattggtccttcaccaccaagagtactggttgatgtcagattagcatcacaatgctcttcgagcaatggagacttagagagtatttcttcgtcagacaaggaggattcaactctaacttcttgtacactttcctcgcctggaaagacagaagagttttcagcagaaaatttctgaggtgttaaagtgttagtgatctgagactcatcatcggtaactattggttcttcaccaccaagagtactggttgacgtcagattagcatcacaaagctcttcaagcaacggagatgtggagagtgtttcttcaccatccaaggaggaggctgatgaattctctccgtgagctatattctccactaaaatgtcaccttgaactcgttcctcaacccgaacatgtcctaaaatgtcaaagttctgacatggcggtgaatcagaaggactattacaacttggtgaattagaaagacttttagtgatatgcgactctttatcagtaactattggttcttcatcaccaacactagcggctgatgtcagattagcatcatgatactcttcaagcaatggggatgtagagagtctttctccatcaggaaatatctgagactcttcatcagaaactaattgttcttcatcactaagagtagtggttgatgtcatataagcatcacagtactcttcatgcagtggagatgtagattctatttctccatcagacgaagaggaagctgatgaattatcctcaaaactatctctttgaactacattctctttcaaaatatcgccttgaactcgtttctcaaccaaaacatgtcctggaatgtcaaagttctgatgtgacggtggatcagaaggactttcacttcgcggtgaagcaacacgatcatgacgtccttgtacattagaagaatggtcctctgcaacttcctttgattcacctctaacatattcgaatctcggaggttcacttgatttcaaacaaagcgtgctctgtgccaacataagaaaaccatcactcattctctctattctttagacattattagctaaaattgataatgacaatcaaacaatggactaacctgagaagtgaaagagtcaacctcaacaagcaaattttccaacttgttgtagattttactaaaccatgctcgtcctttagattctggtcccatgatggctcacgctatacgaaaattatgcagcaaaaatataaactttggttaggcaatatcatcagaataataaagagttgaaaaatatcatgttattccaaacttgatcgcaataagaagatgaaagtttcaaacaacaaaaacaggtcctcactaagaaacagctcaaaaatcctgaaaattttgccatcatcactaatcactaggtctagattttatcgaaactcagatgcttaatcggaaaagatgaataatttagaaaaactgtactatacagctatctcaaatttgtgacccgagcacgaagatcgctgaaaaagagaaactcatagacgcatcgaattacataaaaaaacgagactttgagatgaaaaacagagaaagtaatcaaaaggagataaaccctgaaattcaaagtaaacatagatgagaaaaacaaggaaagagagaagaatttacctgagaaagtaagaaggaaagtacaacagaggaagaaacgagaaaaaggcctcaacataatcatcatacaacaataaataaatactaaagagcttatttaagatttttttttatttttttattttttattttttgagaaaaggattctaatttaggattacaaccagatccataataaaaattcaatttagagaattaaaaaaagaaaaaaagaaaaaagtagtgttattggtttgtgatttaaatagtgatttaatgactttaaatgttactagaatctattgttattcaataataaaagttaattaagagtttggtgttattagtttgtgatttgtaaaaaatctttataactctaggttattggatttagaatttgataaagttgttgaaaaaaaaaactttgggttattcaactaaaacaacataattttttttattattaataaactaaattattatattattaatttataattttatacattttcgtcataaaaatatcgtcaaaatagagaaattattcgtgaaactttacaaaattacgaaaaaaactaattaacaaaattatataatactctctaccaatttctcttcatttatttactttatatgattttaaatcatcaaaattctttttaaactagaatccaataccagcccaaagttacatatagattccgggcttttattgggctacctatctaaagttaacgggcttataaaatttagtaggcccaatagaaataaagtagtccgaatgggtcatgaatcatgcacgccacaagtgaccaaaacatgatcatgtgtacgcatacgttttgaagaagaatgatccaaaataagaagacgtggattatgccacgtggaggggaatggcacaaaagaggcatgggtctgacgataaatctacctcggggagtgtgcatctggatgatccctctccatcattctttccatcccaaattctttatcttattttaattttgttgaaattccattcacattttatgatgtctcatgtatatatatgcaactctctcaacaaacacataatataaatatatttacctacatcagattcttcatacacattgtaatcaatagaccatagagatttacatg

SEQ ID NO: 5957 - DNA, 3000 bp, Unknown
  misc_feature (1)..( 3000): cDNA_ID_2175081_gDNA_ID_1620834_Annot_ID_169810 3000 nt of promoter + ATG
caaccaaaacatgtcctggaatgtcaaagttctgatgtgacggtggatcagaaggactttcacttcgcggtgaagcaacacgatcatgacgtccttgtacattagaagaatggtcctctgcaacttcctttgattcacctctaacatattcgaatctcggaggttcacttgatttcaaacaaagcgtgctctgtgccaacataagaaaaccatcactcattctctctattctttagacattattagctaaaattgataatgacaatcaaacaatggactaacctgagaagtgaaagagtcaacctcaacaagcaaattttccaacttgttgtagattttactaaaccatgctcgtcctttagattctggtcccatgatggctcacgctatacgaaaattatgcagcaaaaatataaactttggttaggcaatatcatcagaataataaagagttgaaaaatatcatgttattccaaacttgatcgcaataagaagatgaaagtttcaaacaacaaaaacaggtcctcactaagaaacagctcaaaaatcctgaaaattttgccatcatcactaatcactaggtctagattttatcgaaactcagatgcttaatcggaaaagatgaataatttagaaaaactgtactatacagctatctcaaatttgtgacccgagcacgaagatcgctgaaaaagagaaactcatagacgcatcgaattacataaaaaaacgagactttgagatgaaaaacagagaaagtaatcaaaaggagataaaccctgaaattcaaagtaaacatagatgagaaaaacaaggaaagagagaagaatttacctgagaaagtaagaaggaaagtacaacagaggaagaaacgagaaaaaggcctcaacataatcatcatacaacaataaataaatactaaagagcttatttaagatttttttttatttttttattttttattttttgagaaaaggattctaatttaggattacaaccagatccataataaaaattcaatttagagaattaaaaaaagaaaaaaagaaaaaagtagtgttattggtttgtgatttaaatagtgatttaatgactttaaatgttactagaatctattgttattcaataataaaagttaattaagagtttggtgttattagtttgtgatttgtaaaaaatctttataactctaggttattggatttagaatttgataaagttgttgaaaaaaaaaactttgggttattcaactaaaacaacataattttttttattattaataaactaaattattatattattaatttataattttatacattttcgtcataaaaatatcgtcaaaatagagaaattattcgtgaaactttacaaaattacgaaaaaaactaattaacaaaattatataatactctctaccaatttctcttcatttatttactttatatgattttaaatcatcaaaattctttttaaactagaatccaataccagcccaaagttacatatagattccgggcttttattgggctacctatctaaagttaacgggcttataaaatttagtaggcccaatagaaataaagtagtccgaatgggtcatgaatcatgcacgccacaagtgaccaaaacatgatcatgtgtacgcatacgttttgaagaagaatgatccaaaataagaagacgtggattatgccacgtggaggggaatggcacaaaagaggcatgggtctgacgataaatctacctcggggagtgtgcatctggatgatccctctccatcattctttccatcccaaattctttatcttattttaattttgttgaaattccattcacattttatgatgtctcatgtatatatatgcaactctctcaacaaacacataatataaatatatttacctacatcagattcttcatacacattgtaatcaatagaccatagagatttacatggcgacttctaccttctcttctcgtggggcacaaaccatgaacaccatgttcgtcaagtaagtttaccttaaatttagtgttgagcatatgcattatttgtttcgtgcatgtcaatctttacgcataaaccatgctaattttctctctattcatattgattcttagatcatacacttttggttgttatgatcgtttaattatgtatcatgttatatatcattaacacatgcaatttgcatatatataggccgatgcttaggaaatcaattcacaagaagagtgcctcgcatgatatagtgagggatacggtgaagactgagggctctagctccggagaggaggtgaagacgatgagaggcttctacggcgccggagaaacgtcgtcgccggcgagtagttgggtgccacatgaaggtacgggaatatactatccaaagggacaagagaaagtgatgcaagatgtgcctcctcctccagctggcagccacgcggacgagctcgttaattggttctcttgatccattagtctcgagtgactctcttctcatctcgatctcgtcgaagactcgaagtctctatattattgtctattgttctaatgggaaaccataaaatatatgtgtaattaagtggaaatatattgtcatataaccaatgataatgaataattaatgatgattacaaaatgagttacgtaccaaactaccaatgcatgtagattaactgctgccttattcataatgtaccttctaatgactaactaaagctttgatccaaaatccaccaaacaaaaaacttatatccattcttacaaattggaattgctatagtttcagacagatacaaacatgcaagtagtaacaagtggggccaaaactatcttttgacttcaagaaccacagaattagccactatcagacgagaacaaatggctcttcttcttcaaaatcctatctttgggagaaaagtataaatctttttttattaaattgagggaaaaaggtagaagctttaattgtgaagtgatttggtgggttaatg

SEQ ID NO: 5958 - DNA, 3000 bp, Unknown
  misc_feature (1)..( 3000): cDNA_ID_3079064_gDNA_ID_1620834_Annot_ID_169809 3000 nt of promoter + ATG
gtaacaacagtctacaagggccggttcgtttcggatcacctaattgcaagaatttgttgactttagatttgtcatacaatgaattcgaaggcggtgttccacctgcattgggaaattgcagtagccttgacgctttagtcattgtgagtggtaacttgtcaggtacaatcccttcctcattgggtatgttgaagaatctcacaattcttaacctttccgagaatcgtctctctgggagtatccccgcagagctcgggaactgcagtagcttgaacttgttgaagctgaacgataaccagcttgtaggcggaataccgagtgcattaggtaagctgaggaagctagaaagtctggagcttttcgaaaaccggttttcgggtgagattcctattgagatatggaagagtcagagtcttacgcagttgctagtttatcaaaacaatctcactggtgaactacctgtggaaatgactgagatgaagaagctaaagatcgctacgctgttcaacaacagcttttatggagcgataccaccgggtttaggtgtgaacagcagcttagaagaggttgactttattggtaacaaacttacaggagagataccgccaaatctatgccatggaaggaagttgagaatactcaacttgggttctaatctgcttcatggtacaataccagcttctattggtcactgtaagaccatcaggagattcatccttagagaaaataacctttcaggtcttcttcctgagttttctcaggatcatagtctttcttttcttgatttcaatagcaacaacttcgaaggaccaatcccgggcagcctcggaagctgtaagaatctctcgagtattaacctatctcgaaacagattcacggggcagatacctccacaacttgggaatctacaaaaccttggttacatgaatctttctcgtaatcttcttgaagggtctctaccagctcagctatctaactgtgtgagtttagagcgttttgatgttggcttcaactcattaaacggttcagttccttcaaactttagtaactggaaaggcttgacgactttagttctcagcgagaaccggttttcaggaggtattccacagttcttgcctgagcttaagaagctgtcaactctgcagattgctagaaatgcttttggtggtgagattccttcgtcgattgggttgatagaggatctgatctatgacttggaccttagtggaaacggattgacaggtgaaattccagccaagttgggagatctcatcaagttaacaagactcaacatatctaacaacaatttgacaggatctttatcggttctcaaaggtcttacctcattgctacatgttgatgtctccaacaatcagttcacaggtccaataccagataacttggagggtcagttgttatctgagccgtcgtcgttttcaggaaatccaaacctctgcattccacattccttctctgctagcaacaatagccgcagcgcgttaaagtactgtaaagatcaatctaaaagcaggaagagtggccttagcacctggcaaatcgtgctaatagcggtcttatcgtctttattagtcttggttgtggtccttgctcttgttttcatttgcctacgtcgtcgcaaaggaagaccagagaaagatgcttatgtcttcactcaggaggaaggcccatctttgttgttgaacaaagttcttgcagcaactgacaatctaaatgaaaagtacaccattggaagaggagctcatggaattgtgtacagagcttctttaggctccggaaaggtctacgctgtgaagagacttgtattcgcgtctcacatccgcgctaaccagagtatgatgagggagattgatacaatcggtaaagtcaggcacaggaatctgattaagttagaagggttttggctgaggaaagacgacggtttaatgctgtatagatacatgccaaaaggaagtctttacgacgttctccacggtgttagcccgaaagaaaatgtgctagactggtctgcacggtacaatgtagcacttggtgtcgctcatggactagcctatctacactatgactgccatcccccgattgttcaccgtgacatcaaaccagagaacatactcatggactcagatttggagcctcacattggggatttcggtttggctcgccttcttgatgactcaacggtttcaactgcaactgttacaggcaccaccggctacattgcaccaggtaatgcatcttctcattatacatagtggacttggtataatctggtttagtgttcaaaccgagttagttaccggttaaaaaagtctgttaggaagatactctgtttcttattagctaatttcacaattaaactgcagaaaacgctttcaaaaccgtgaggggaagagaatcagacgtttacagttatggagtcgtgttacttgagctggttacgaggaagagagcggtggacaaatctttcccggaaagtacagatatagtaagctgggtgagatctgccttgagcagcagcaacaacaatgtggaggatatggtaacaacaatcgtcgatccgattctcgtggacgagcttctggattcgagtcttagggagcaggtgatgcaagtgacggaactggcactgagttgtacacagcaagatccggcaatgagaccaacgatgagagatgcggtgaaactgttggaagatgtgaaacatctggcaagaagctgctcctctgattcagttcggtaatctcgttactttgtgcagagcagaaggaggaaactaaaggactgttatcagtggtaacgtaactgggcttaccggtaatgtaactgggccaataatgtaaaatatggcttattgaaggcccaaatatgacggccctttaattgtaaccgtgtttgtttgtgaaataaaatctcgtttatcaaatttctgtttcctattttatttttaaaaaaagtgttgggaaaattttcgtttggccggag

SEQ ID NO: 5959 - DNA, 3000 bp, Unknown
  misc_feature (1)..( 3000): cDNA_ID_3079072_gDNA_ID_1620834_Annot_ID_169806 3000 nt of promoter + ATG
aaggtattggattccaggacagcaatgtaagaggacgatagatatgtgtttaattgtcttatctttctttacataaagaactaggagattccagaaaacttcaagaagaaacatttacgtggaacaaattccaaaagtgttcatcatagtgccaaaaagaagatgagaggaatattatattacctcctgttttcacattatcaatatttaagtttgctctagtatgtactatgctatatgaacatgtcctctgctttctgacacaggaaggtttgaaatttgccataatggttactctgaaagtaagatcaggccatttatcattatatctcaatcctgtttttttacatgaactatagacgaactcctgtactccgttattacatgaattaaccgaggagtccaatgatagaaagaaaaaatgaacaaactaactgtagaaccatctgatagagagctacaggtgaacgtataacagaaaaagaatcagcaaactaatccagaaaatgcgaaagagcccatcttgcggaaatcatttctatctcatcctctctctcagcatcttcagccccatgtacctgcaattaaagccaatgaaatttgtttttaagtctggtcaaaaaggactgatacagtttcgaagagtatacactttgatggtttcttcttaccttccaagcatcatcaaggtagcctgaggattagtccctggagagatattgaaggttgatccatccacgagtctaagagaattaacaccaatgactttgagatcagagtccactacttttcctacaacagcgcctccatggtagtgccagattgtgctcacagttcgtctgcagaaatctgccatcacaagatcatttgattggtccacaggcaatggagctccaacaaacctgaacctacggttcccaaaccattcccttatcataaagtcctgcatagctcggctcctgagtatttctccaatcttcctagtcccattgacacatctctctagatcctgtggatcactgaagtagttgaatctaacaactgggttaatcctcacatccgttgacgccaaccttagtaaaccaatagacactggacctaggatcttttccattatagttgtcacagggacgtacaaaggagaagctggagctctgatgaacacagaatgtaaaggcgatgcaaacggaatcacattcgaagcagcctccagaaaagccccatcctcagtaacacccacgacttgtatcagtgagttctccattggaaccggaggaacaatggagataccattcctcgggttatcatacacaaaatcccccacatgaggctggtcaagagccacagggatcccccaagttgaaagataactccttggaccaatcccactaagaaaaagcaactgtgggctaccgagtgcaccagcagacagtatcacctctcctctgtcccgtatcaatgcgtgatggaaacgtcccagctgatcacggtaaaccactccaatcgcagaaacgttggaacctgagacactaggagatgaagcaagcaatactctctctacagttgcgtaaactgcaactctaatgttggaactccttgcatatctgagaagatctgcagagctgtgtctcctcccagtacgatcaaacgtggaacctccgatcttagtccccactttatgctccaaggtgaagccattaaacggatggacaccaacttcaagcaacgcatccctaattgcagtttgccaagtcctgagctgaggtctaaacacaatcgctctctcaacccactcataagactgattcacactactcagatcccaaacaagacccgaattctcaaagaactgtttatcagcacggctatagaatccagcattgatcgcactacttcctccaagaacacgacctctcgcgttaggaactccttcctcagagatgaaagactgagccggcgagtcgaaattgttgacgtcagtgagagtggtcaagaaaccgtcgtgtgacatcacgttaggtctgttgtagggaacgccaccgcgttctagcagaagaactcggaaagattgcgaaagtgtggcggctagtggacatcccgccgttcctcctccgacgattatgtaatcgtagtaatcctccgacgcaaaatcagttgcgttcgatatgaatcgcatgaaaccgggagctgcaacgaaggttccaacagtaagaaacaacaatgaaagagaagaatctcaaaatcaaattagggataagctaaacatcgatcatcgttttcttgctattactcaaaagcgatacaaggaaatcaaagaaacctcatcaaaaacttcttcgtcgccaaagattatgatgtttcaagcattaacatgagattctacagaaattttctcggaaacttacgtcgattaacgcgtggccttgcattagagcgatgaactactccaagaagaagaagcactacgagcgccgtgtagagaagagaagaatcaatccgtttcgtcattctcgttcttctgttgaagattttctcggagctgatagaaaattaaattttctcgggaaagtgagaagtttctcagttagagagagaaacagagtaaaagtagttaaaaaagaagactcaaattaaatggcgcttggattctgttatagagagagtttctcagctctggaactctgatataaaagtaatcacagccgtcgatgaggtttagaccaagttgagatcagcggttgtcaagagaagtagtcctgagctctaccgcagtggataatagcatgcaatatatttgacgccgttagcaaccgtctctggaccctttaacgtcgtcgtcttgttgtaaaagtaccgatttgataactgccaatcaaattccggttcaatccggttaagggaagataacaggatttagccacgtgtcatgaggttgtgcagattagactgtagccagtgttatcactaccgtctaaacacagagagagagagagagcaaaa

SEQ ID NO: 5960 - DNA, 3000 bp, Unknown; identical to SEQ ID NO: 5948
  misc_feature (1)..( 3000): cDNA_ID_3079076_gDNA_ID_1620834_Annot_ID_169805 3000 nt of promoter + ATG

SEQ ID NO: 5961 - DNA, 3000 bp, Unknown
  misc_feature (1)..( 3000): cDNA_ID_2109538_gDNA_ID_1620834_Annot_ID_169802 3000 nt of promoter + ATG
ttatttgtgaattgtgatgctataatttagataatagagatcgctatacttaatataaaaaatatataatttatcatatagagcatttctcaataatgtcatgcacgttgtatgttttgtttttcaaaattaccatcacaatttaaaaaacaatataaacttttaaatttagaagggataattttaaaaagtgtaggaaaataaccacttactaaattttaatatccattagatctttaggattatatgatactgaaaagaatcagcacaataatatttagaaacaccaccagttaatttttttttggcaaaactaataatttattttctaaaagtcaaattagtggagacagtaagcaacagggaaaaaacataaaagagacgtaaatcatcaaaaggtttttgaaaaaaataaaatagagaaaattggagcagcaaaataaaatggtgcaataacatttcatagacgacgattgatttagttgattttcgccgcgtcatgtattaaagacacagcgtcgtggcctatgcatgcagtcactcaaaggtgtataatagaaagatcatttagaatttcctttagagaaagtatatactatagaaagatctagaatacatgttaaggttaattacatatttatagtgtttcataatctagatgaatacaaatctctataatatcaataacatatatttaccatatcttcaatatcttctagatccttctatgtatacgagtacacaattttcaatacatataaatatatgaatgtgattagtgtttattattgttctacgttgttatccatcctaaaccgatcgaattactaatttaacttctaatgttgtcgtaatgatataaacttaagtatattaatacagttcaaatttcaaatatatgtatgtttacgcgtgatatacttaatagaaattcgcgtgatttcagatttgctaagcacacacttcaaaatgtcgtatacgttagatgtttaactattacagtattaattcccaattattattagatcctagaatattggatcgttttcgacaaaaaaaaaaaaaaatgaagaatattggaccgcacgatacttgggaacttggcatgcagctttagtaagtgcgattaggattttaatgggacatagatggcgtggcatgtcacaaatagaaaaggacgaatttactttttaaaactgtttcacaatcacaaatcagcgagtgtcgcttttgcatacgaaccgcatataaaataatcgtgtactaaaatgagaatttctatcaaactttggattcttcattttttgtgctaatataatcaacggacacaaggaatatcacgagcttatattctaatgacgattctcggatcatgtcagtgttgttaggctaccgaataagtgtatgtgtcaaactataatttgtaaaacatgttgtagtgtttggaataacatttaactttcagaaatcgatgaatcatcatatgatacgtgagaagaaagtatggaaaaaaaaaaaagtgtggctagacatgagacccttccataaaactcataattctaaacagtttacgaaaatagcttgtaatttggtcataacacaacacttgatttaacgtgaataatatatgacgaaatagaagggaatgtttgctcaataaataaaaatgcatggttatcaatgttcaaagcaaatgcgaatatcacgtttgctaagtttcgaaagctgacgcgtcatgtatatcacatactattgttattatgattacaaggcaacgtgtttcttatagatctttatttggtggcagcttatggttttgccattgctctagtgtcacggatccaactttatctatttattgacaactgtttttctctacaacatttgttgattattgacacgcacctatttgtttttcttattttacattaattgtttttttcttaactcaccatagctattcgaagtgctcattaagtattcaaatacgttacaaaagctttttgctcttaatcaaaatttgtgtaaatgaaattagtcaaatttttagagctaaatatatataattcagtcttaaaccgtggaccgtctgtcagttttttttggtaaaatatgatcttctggttttcttatagtacaattaattggaaaaatgagtgttgaaatcaaatggatgaaagtaaacaatgaaagcctgtagccaccgaaaaaggctgctacttaattaggatattcttcttattattgttaatctctgtccctcacgattccttgcaagtgccttcctatcaagttccaataatcatatcacataaaataaagaaatctcaaaatagcataatgttataagagttcatttttgccaaagaattaactacaatgttaagattttaaaagaaaaccaacaaaaactatgtatatatacaataacaatcaattttaaaaaagtttctagaatatatattactaaaactataactatattggtttgaattatctaaaattccattctcttttaaatcgtagatcaaatttttatctgatatagtactgctttttagttattttctttgatatttatttatttgaagtaaggatatatttgggtaacggaatattcttctcttattcccgcgttacctcctcctcatcttttttattaaacccaccaggaaacttctaaaaaggcaagaaatcaccccagagccctcacaaccgttggatctctctacaagactcaagtttgacccgtaaacgtcatcaaatccaacggttctcagaataaaatcaaaagtattctaatttgttcttcttttttttgttaccttgaaggtaatattccattggcatctccgataaaatcccccattgtttctctccattcattagtataaatacctaaccacatttctattctcctcaattcacaaaccaacaagaactcaaagagagatccatcaattagaatcactaatttctttagaaatttcctgagtcatg

SEQ ID NO: 5962 - DNA, 3000 bp, Unknown; identical to SEQ ID NO: 5952
  misc_feature (1)..( 3000): cDNA_ID_3079084_gDNA_ID_1620834_Annot_ID_169800 3000 nt of promoter + ATG

SEQ ID NO: 5963 - DNA, 3000 bp, Unknown; identical to SEQ ID NO: 5953
  misc_feature (1)..( 3000): cDNA_ID_3079088_gDNA_ID_1620834_Annot_ID_169798 3000 nt of promoter + ATG

SEQ ID NO: 5964 - DNA, 3000 bp, Unknown; identical to SEQ ID NO: 5945
  misc_feature (1)..( 3000): cDNA_ID_1989733_gDNA_ID_1620834_Annot_ID_169794 3000 nt of promoter + ATG

SEQ ID NO: 5965 - DNA, 3000 bp, Unknown; identical to SEQ ID NO: 5946
  misc_feature (1)..( 3000): cDNA_ID_1988891_gDNA_ID_1620834_Annot_ID_169792 3000 nt of promoter + ATG

SEQ ID NO: 5966 - DNA, 3000 bp, Unknown; identical to SEQ ID NO: 5944
  misc_feature (1)..( 3000): cDNA_ID_2990797_gDNA_ID_1620834_Annot_ID_169790 3000 nt of promoter + ATG

SEQ ID NO: 5967 - DNA, 3000 bp, Unknown
  misc_feature (1)..( 3000): cDNA_ID_1988786_gDNA_ID_1620834_Annot_ID_169781 3000 nt of promoter + ATG
cgatctggttcgtgactttatgaacgaggaatattctcaagaggtaaggctctcttctctataatctgttccctttaaccccctcataagctatatttttaagttgtgacttgattgattctcattttgcacgtaggctccatttcgacttgtttgtataacgaaatactcaattgcttctaccaacaatatgcgaacctcatggagggaacctatgaggatcaaactacctaagattaaagctgcccccaagcttgtgggattctttgtccaaatcatggttgtttgcgaaaagcccttccatctacagtttccagcgttttcttataattgggactgtgaaggtagcaggttatatcggattaacctcaaaccaaatctctatcaatcatcagagatgatggaggacaacaataatagaccatataaatggcatcacctggtcattgtccaaatcccaactggcatcatcagcgcagaaattgatgaggtgcaattcgaatcccatatccaagttccggagccgggcgacgagataattttgtgtggagttgaacacgttgggttcgttttaaagtagctggtgcggagatcaattcttaagatgatgatggatctgcagatttctaaacacaaggatttgtaccaattttcgttttggaactaaataaattactacccatgtaacctcgtgtcggtttgcttttataatcggtttggtatttttcggtttaattgtgacttgattttatttttttccttttaagagaaccaattttttctttctgctttgtactcgatgtctgccctttttgctcaacaagctttaccagattgtattctggtatttcatcaggctagaaatggagaaagaaaagttggagctgccaaacccacaggagttgtgttctcactggaaatgttacattaaatatcattgcaaaacaactactaatacattgaatctcctttgattttggtccaaagaaaggtgaataacttttgattttggtgcatatgggatgatgacggactgatgagtacccaatatccagtgcccacgtgtcctaattcttatggatcaatcaagggcttaaaagcccataaacattaaacagagggaataaaggaatgctaaaaactaattaagaaaacatcaagtaacaattattatgttttggttgttacttgttacttccaaggataaaggagggattcctatgcttgacttgcactagagctttatttcattgcaaaaaaggttaggtacttgattaagaacccaacctaagttttagtattatacaatcctttttcccatctcattttacatgcttacactttcattaaactattatactcaaggaaactggttgcaggtctataacttgtaaattaaaactgttcgtgttatttattcccatgataaaattgtaagagcgtgtgaatcacgagcttaggagagcgtgtgaatcacgagcttaggagagcgtgtgacatcaatatggggaggggcggctaaagactaacgagtaaaggcataagggggaaattaaggactgttcagagttcagaaatgtttttagtctggaaacgacaatacactttggacaaaaagctaaataacattttaaaagcttcatacaaattaaaaatataatcaaacaaaagctaacgtggccaagatagctaattacttttttggaatcattattagagataatggaaattaagaaatcatacagccaaaacaaaccgtagttattatattcgtaacaaaagatgggggaaaagttaatataaaacaaaccttatactagtatatataatacatggctcataatacattactgctaaatgagcaaaaacaaataaaggtaaagttcttaacggctttgtagagataggaatcattaattttagagaaaaaaaaatcttgaattgtacgtttacctttccagaattacattatttgttggcttttaattgttaatcatttttgttgtgtttttcctccaaattataaaatttaaaaactgtgtcagggaatttaggaatctaatatagttggacgatttcgtattaataaagattttcaaaaaaagagtctgctctaatcgttatttgggggtaaattgattctataaggtagggttagccagagagccttattctgtgttttgggttaaagtgagaccaaataaattaagatatttaaaatgaataattaagagcacttaagacaataattaacccagaaggagaagctggtgtagtggtggttctcatggcgatgttggtttcccaggaaaggtaaaagagaggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggtttctttctctatctcttatctatttctttctgcatctgtagtctctttgttcgaaaaaaagatgtttaatttctgtcaaatttttctccttttttctttgttcgattattggtgtatctgtcttgtggcgtgcgattgatgtttactgattctgaaaaattcttgctaaaataattcatcttcaagtcaacgactttttgcccaaaagtgatgacgggaacaagaaatttttcttggtcggaaaattactaattttagccaatcgtagcgatctctgcaatcgtgttttggttacccaagatagtacgatcgaatcagttcgtttagagaattaaaaaattactcaaatttagaaacttccaacttctgtttctttctattctgggttttttcacccacttggattattagctttaaaaatctaatctttgagtcatttttgattgttatttaggttgttggttgtgagaataattagcttgttaaggaagacgttatgatg

SEQ ID NO: 5968 - DNA, 3000 bp, Unknown; identical to SEQ ID NO: 5943
  misc_feature (1)..( 3000): cDNA_ID_4265714_gDNA_ID_1620834_Annot_ID_169778 3000 nt of promoter + ATG

SEQ ID NO: 5969 - DNA, 3000 bp, Unknown
  misc_feature (1)..( 3000): cDNA_ID_1989675_gDNA_ID_1620834_Annot_ID_57953 3000 nt of promoter + ATG
ttaaactaacacctttctaaattgaaaccattgtcacataacacatggctaacttgaaattcttgctgtgcttgttcttgatctgcgtttccttatcgcgttcatcagcgtctcgaccgatgttcccaaacgcagacgggattaaacgagggcgtatgatgatagaagcagaggaagtgttgaaagcgagtatggagaagctaatggagagaggttttaatgagtccatgagactcagtcctggaggtcccgatcctcgccatcactaagtcttattctcgtagttttgaattcgaggatgtatattttgttcttgatcgagaaccggtttagaagaaaacatatcgatcctctttgtttgttttttttgccttgtttgttcgttcggtgtaaccaatatattgatgtatctgtttcgttacacatttatgatttgtgcatgctttacgtaccttatacattccactatatagtagtctagtagagaggaggactttgcatataaattgttatataacaagaaagggtaaagaaatatagtatgataagggaggattgaattaatttaatttatcctgttttttcagtctctaatggctcgtgtagaaaagtatatattatatatggactcttttgcctcatcgtccaccaatgaaatatcacataaagagagaacgatagtgattgaagtttttcaaaaagaaaaaaaaaacaggggaaaacagagagaattatactttttaagagcgaagcaacgtcttcaaatcttcaatttttcagagatcaaacccttgaaatgctgctctttacgaaactcattttccaaaatctctttttcatcactttcgttacaaattcacaaaaagttacaagtcgtgacaagcttgagcttaagtatgtgtatgaatagtgtgaccaaattgttttgcaagagatcaagtaacttgttacaaaagaaatgattcaacgtaacttacaaaactataccaatttaccaaatcagttatctgtggaaagagggtacctacagtacctctcatttttcatacacataaagaatctctcataagccgaagccatttgagtcgctgtaaacatcgaaagagcgtatcccttacaagctattcctttcatctccaaaaccctaggcccatctcttacaacagaatccaaagtctcaacaagagatctcacgtttggagaaaatgtgtacccaaaacgctcgtccacaaccactgtcccaacaatgcttggataattaggtgccacgacaggtttcccacactgcatcgcctcaatgatcgtcaaatcaagcccctgtggtctcaacgtcggattcacaaacacatctaaagcgttgtagaaaccagagagctcctctggctctaaagctcctaaaaccctaacgttttcgcctaattccgcgtatcttttgccccaaggaccagatccagccacaagcaaatagactttcgggtgcattttaacgagcaaagcaaacgcttcatatagaagtggatgtcctttgtctctcaccaaacgtccagacacacccatcacaatatatgtcccattgtcaggaataccgtgtttcgccctgaacctagctccagattcaggagaatacacgaacttggtttggtcaacaccgttgactataacgtgaacttttctcttaggaagttgatagatgttaactagtacctcgcgcgcgctgttgctaatgcaaatatgctgtttatattttgggaagaatctgatttcatcgacgagtctaggcatcgtttgttgaagatcagagctaggacgatcattggaaagttcttgaaaaagatttgaatgcataatctcgtaccagattccgtgccatgtcacagctatgtcaccattaggcaccattttgactcgccaatgaggcagagaaacactctcagtgtgaacataatcaaaggaatgatgatctagactgttgattttatggaagatctcaaaagctcgagagtggttaagtgagccgtgttcgtttggagcaaagtagacatggagatctcctttgttgtagtactcttctcggttacttctgtcggaagaaaccgtgaagacgtgaatctcgtgacctcttgaggcgagagaagtgtagagtgtgtaagcatgacgctccattcctccggggatcgaaccaacaggccatgacttgcagaagacagcgagtttgagcttctccgagattggtccaagtgagagtttgttccaagggaatgtcaggtctcgaagatctcctgcgaaaggaggattttccggtgaagaagtcaccggagagtaatcaaactgtgagaagaaaatgtagtaagaagaacaaaagatgaatgctaaggtaatgattgttgtgaatctgaatgaaaatgaagtggaagaagaagaagaaagagttgttcttgaagaatggttcttgaaggccattgttttggtttatttgatttttgtgaattgagtgcaactattgatgttgattctttgcttaaatttcggatctttctcgagttattatatcaaagttcatttctcaatgacattgcacatggcttagctaatttttatatggtttttacattcaattgaaagtcaaatctctcttaaccaactgagatttgtaactaaaccgggatatcacacctaattagttttcccggtttgatattttgttttgtacacgtaggcgtgtgattactccgtcacactttacacatgtgtaattcccctaatttatcgggtttctttaggcgcgtgagataatgcgcgtgtgtctacgctattcttgcgacgctgtgcttcctagggtttcgtcgttgcaaacacagtcaatgttcatgaaccacggatcctaatctccccgatcttcgattcattgtttcagaaatccccaattactgtctctgtgcgtaaaatctctagagaaaccttaaaattttccgttcagagaaattgtcaacgaaggtaatg

SEQ ID NO: 5970 - DNA, 3000 bp, Unknown
  misc_feature (1)..( 3000): cDNA_ID_1989676_gDNA_ID_1620834_Annot_ID_57952 3000 nt of promoter + ATG
gaaaggaggattttccggtgaagaagtcaccggagagtaatcaaactgtgagaagaaaatgtagtaagaagaacaaaagatgaatgctaaggtaatgattgttgtgaatctgaatgaaaatgaagtggaagaagaagaagaaagagttgttcttgaagaatggttcttgaaggccattgttttggtttatttgatttttgtgaattgagtgcaactattgatgttgattctttgcttaaatttcggatctttctcgagttattatatcaaagttcatttctcaatgacattgcacatggcttagctaatttttatatggtttttacattcaattgaaagtcaaatctctcttaaccaactgagatttgtaactaaaccgggatatcacacctaattagttttcccggtttgatattttgttttgtacacgtaggcgtgtgattactccgtcacactttacacatgtgtaattcccctaatttatcgggtttctttaggcgcgtgagataatgcgcgtgtgtctacgctattcttgcgacgctgtgcttcctagggtttcgtcgttgcaaacacagtcaatgttcatgaaccacggatcctaatctccccgatcttcgattcattgtttcagaaatccccaattactgtctctgtgcgtaaaatctctagagaaaccttaaaattttccgttcagagaaattgtcaacgaaggtaatggcgtctggtcctatagctggtggtggagtttcgaagacgaagcataaatggagtgatagtggcaacaaaagccaaaaacgatccaagcccacggtggcgaattcgaattcgcttgggttggaagataatcatcagatgatgaagataagtttaagctcaatttccaagcttgaagttaggaacttgaagcggaaactacaagctgagcttgaggaagttaggagcttgatcaaacggctcgaaccacaaggtaacaacttcgctcccgtgccgaacaagaagctgaaaacagcaaacggtggtaagaaaggtggagtacatggagctgctgctgataaaggtactgttcagattttgaagagctgcaacaatttgcttaccaagttaatgaagcataagtctggatggattttcaatactccagttgatgtagttacgcttggtttacatgattatcacaatattattaaggagcctatggatttaggaacagtgaagactaggttgagtaagagtttgtataagtcacctttggagtttgctgaggatgtcagacttacttttaacaatgcaatgctgtataatcctgtggggcatgatgtgtatcatatggctgagattttgttgaatctgtttgaagagaaatgggtgcctcttgaaacgcagtatgagttacttattaggaagcaacaaccagtccgtgatatcgatttccatgctcctgtttcgacaaacactcataatgtagaggcgttaccgttacccgctcctacaccttccctgtctcctcctcctcctcctaaagtagttgaaaataggactttggagagagctgaatctatgacaaacccagtgaaacctgcagttttacctgttgtccccgagaagcttgtagaagaggcgtctgcaaacagggacttgacgtttgatgagaagcggcaactaagtgaagacctccaggatttaccttatgacaagctagaggcagttgtgcagattataaagaagagaactccagaactctctcaacaagatgatgagattgagttagatattgatagtcttgatctggaaacactttgggagcttttcagattcgtgactgaatataaggagagcttaagcaagaaaaaggaggaacagggattagactcagaaagagatgctgaatcttttcacaatagtgtgcacgaatcggtgagagcaaatacctaattgttattcacttctcttacttttaccatataactcttactgggctaatgatatcatatttcttcttccgtcttcacagaacacgctagtaactggccttgaatcgtcaaaagttactgaattaggtgaaattttaattcttaagatagtatcaagctcttctatattggtcgtttagccccactacaataactcttctttaatgtttttgacacttgaaaaggtcatgtggcatctactgttcgacaagaagtaaatgttggaggatcaagtagttctaacagttctagtagtggctcaggctcgggttctagtggtaaatgttgaagctggtttaccttcttctcccttatgagcatcacagttccaaacaagtttactcacattcctcttttcgttatgcaggctctgacagtgatagctcaggacatgaatctgataccggtaattaaccacgattgtgaaagtatttagcataggtgggagccatcgtggtgtcaacttccaacttttttttttttttttgcatctcttaaaatagcaaagctaggttaccttcttttccaccatcggattgtttctgtattactgtattagggttcttgttaattgtatagaaaagtggacataagtcttttgtttcgggcttgtgtcatcaattgaacaggcttgttctgtacttcttagttggtttttttttgtttggtcttacgttcaaatttgtgcattgattttcgaccagtcttgctgggccagatcggagaatagtttgacctcaaaacccaagcgagacctttattggcaaatttgtgttgttttcagtatcatatcactatttttagatcaatcaccaaaacaaaggacatgctacctaatgtagaaagatcaccaactggtggttgcatggaacaaagtcgtttttttatgcttgtatgtgaagacatacgcttctctcaaacatccaacatagattcatcagctcaatagcaagaagtagttctaaacgagctaattactccgagaagtctgtttcaaatgtctatacaaacaactgcagattcgaggatg

SEQ ID NO: 5971 - DNA, 3000 bp, Unknown; identical to SEQ ID NO: 5955
  misc_feature (1)..( 3000): cDNA_ID_1989677_gDNA_ID_1620834_Annot_ID_57951 3000 nt of promoter + ATG

SEQ ID NO: 5972 - DNA, 3000 bp, Unknown
  misc_feature (1)..( 3000): cDNA_ID_2175081_gDNA_ID_1620834_Annot_ID_57949 3000 nt of promoter + ATG
gttactagaatctattgttattcaataataaaagttaattaagagtttggtgttattagtttgtgatttgtaaaaaatctttataactctaggttattggatttagaatttgataaagttgttgaaaaaaaaaactttgggttattcaactaaaacaacataattttttttattattaataaactaaattattatattattaatttataattttatacattttcgtcataaaaatatcgtcaaaatagagaaattattcgtgaaactttacaaaattacgaaaaaaactaattaacaaaattatataatactctctaccaatttctcttcatttatttactttatatgattttaaatcatcaaaattctttttaaactagaatccaataccagcccaaagttacatatagattccgggcttttattgggctacctatctaaagttaacgggcttataaaatttagtaggcccaatagaaataaagtagtccgaatgggtcatgaatcatgcacgccacaagtgaccaaaacatgatcatgtgtacgcatacgttttgaagaagaatgatccaaaataagaagacgtggattatgccacgtggaggggaatggcacaaaagaggcatgggtctgacgataaatctacctcggggagtgtgcatctggatgatccctctccatcattctttccatcccaaattctttatcttattttaattttgttgaaattccattcacattttatgatgtctcatgtatatatatgcaactctctcaacaaacacataatataaatatatttacctacatcagattcttcatacacattgtaatcaatagaccatagagatttacatggcgacttctaccttctcttctcgtggggcacaaaccatgaacaccatgttcgtcaagtaagtttaccttaaatttagtgttgagcatatgcattatttgtttcgtgcatgtcaatctttacgcataaaccatgctaattttctctctattcatattgattcttagatcatacacttttggttgttatgatcgtttaattatgtatcatgttatatatcattaacacatgcaatttgcatatatataggccgatgcttaggaaatcaattcacaagaagagtgcctcgcatgatatagtgagggatacggtgaagactgagggctctagctccggagaggaggtgaagacgatgagaggcttctacggcgccggagaaacgtcgtcgccggcgagtagttgggtgccacatgaaggtacgggaatatactatccaaagggacaagagaaagtgatgcaagatgtgcctcctcctccagctggcagccacgcggacgagctcgttaattggttctcttgatccattagtctcgagtgactctcttctcatctcgatctcgtcgaagactcgaagtctctatattattgtctattgttctaatgggaaaccataaaatatatgtgtaattaagtggaaatatattgtcatataaccaatgataatgaataattaatgatgattacaaaatgagttacgtaccaaactaccaatgcatgtagattaactgctgccttattcataatgtaccttctaatgactaactaaagctttgatccaaaatccaccaaacaaaaaacttatatccattcttacaaattggaattgctatagtttcagacagatacaaacatgcaagtagtaacaagtggggccaaaactatcttttgacttcaagaaccacagaattagccactatcagacgagaacaaatggctcttcttcttcaaaatcctatctttgggagaaaagtataaatctttttttattaaattgagggaaaaaggtagaagctttaattgtgaagtgatttggtgggttaatggcgcttgcaaacatatctctgcgtttcaagtttccacctttacaatcttcttcttcttcttcttcctcgttcaatgctactttaatcaataccagaaaactctcttcaatcgtttgctcgaaaccctcctctaatgacggcggcaaagtggctaatgacgatggtggcgcaaagccgcggaagaagttgtcggagcaatcgtcatgggaagttaaagattcagaagggaaggattatctctataggcttggcgcggaatcggataatgttaacatagccgttggggcacgaagcggcatgatcgatgatgtattcattggagacttccttggaaaagattgttaagtctctttttcttctttttgaaaaatcctatattttggaatttggataagtacaatgactctgattgtggagttgacagaacttgtgtatatctgtgaatttgcagctgatattgtgtttgattaccgtcagaaggcgacgaggtcctttgaacatcttcaaggagattattacattgctccatcgtttctggtaaatgtttattcttcttcttgtaatctcattttgaagatatcctaattaatgattatctatttatcttgttaaaatgctttcaaactaagctttgatttgtgggaatatgtcaccaagttttcttataagaacatgtgtcttctttcttgacaggataaagttggtaagtcatattgaactaagccttggtgaagaagattagaggaatacatcagtaacaacaaattggatgatagggttcatatttgactgcctaaagtttggaacttttgattcatttgtgatgtttctttcttcctttctgtttaccttaatatggcgattttcgcatgttttctgcagcggtccacattgtgaagaactaccttgctccttctctaaatataaaaatcccattgattttaggtaatgaatgccttcttcttctctgtttagtagcagtgtttgaaattttgcaaccatctcttgaacatggatgtgtttttttatggctgcttaggtatatggggaggtaaaggacaaggcaaaacatttcagactgaacttatattcaaaacaatg

SEQ ID NO: 5973 - DNA, 3000 bp, Unknown
  misc_feature (1)..( 3000): cDNA_ID_1989692_gDNA_ID_1620834_Annot_ID_57933 3000 nt of promoter + ATG
caaactttccaaagttggaatctacatatgtctaaaacagagaagaaaagcttttaaactttttacatgatgatcctccaataatagtaatagtgtaatggtactatactactacagttcaaagccactgatttatgctttttgggtacgtggaagatttcaatcacagacaaacgtaattaaatcatttattggaaaatgtgagtcaagctgaataaacttgatgcacacgaatagatatgaaagaaattgggttgatcaacaaaaaaacaagccgacaaaaactgaatcttatgatcttttttcgtccgtcagtttcaaccattcgtttgatcggataatcaaaaccagcaaatgccaataatacacaccagaaaaggtaagatgataatttttgttcgttagtagtattttattattatcatgctcatcattttcttactttggcggcccatcttttctcttcccctctttctgagtagtttagcaaaacagaagctgacaagaaaaaaatagaacatgcctggaaatacacaattacaccactttagcaggaagactatgggagtctctaatcaatgcacatgctttattcagttcaactactctctagtggtctataaatatccttgagtcctttatttctattactcatcatacttaagttctcaatagagagaatcaaaaatcaaaatgacttctcctactgcgactaagtatgatgtctttctgagtttcagaggagtcgacactcgtcgcaacttcatcagttttctctacaaagaattcgttcgaaggaaaattcgaactttcaaagacgacaaggagcttgagaatggccggaggatttctccggagctcaaacgcgccatcgaggagtcgaaattcgccgtcgttgttgtctctgtaaactacgctgcgtctccttggtgtctcgatgagcttgtgaagattatggatttcgaaaacaagggttccatcaccgtgatgcctatcttctacggtgtggatccgtgtcatttgaggaggcagatcggagatgtcgctgaacagtttaagaagcacgaggctagagaagaagatcatgagaaagttgcttcgtggagacgagcattgaccagtttggctagtatctccggagattgttcatccaaatggtgaaatttcgtagctttggttataaagattggatttttatttgatttgaatcgttactaaagtttcgttttttattttgttttctctctgtagtgaagatgaagcgaagctggtggacgaaattgctgacaagatatcaaaaaatctgatgactgttacaacaataagcaatgggaagaacctagttgggattgatacacacatgaaggctcttaacaaaaaactggatttgaattccaacaaaagtttgagagtggttgggatttgggcaagaggatacaatggtagatcagctttagctaaatatgtttatcaagacatctgtcaccactttgacagccattgtttcttgggaagcgtgaaaaggatttctcagggtcgtcacttatcgcatctacacgaagagtttctgataaggattcaaggaagtaaacataatctcaaggaccaaaaggttttgcttgtggctgatgatgtttataagcttgaacagttagatgctcttgctgaggatttcaacgggtttggtccgggaagtgttgttatcatcactacacaagacaagcatctgtttgtttctgctggtataaagcttgtctacgaagttgagcttttgaaattccagaaagtttgtgaactcttccgacaattcgcctttaaaaagagagacatttctgctgcggtcaagttggtttactatagggcaacaaattggttaggttgtctaagtggtagatctggttaggggggaagtgttaagaatcaattttgaagctaaatctcttttcataggcaaatagacattaagttaagggaatgtggctttgattaagtttgaagcctctccaaataaccttccggttctcgtttgggataccatcctatccttttattactttgttttcctttccactcgtgtaaaagcgagttccttggcaaagagttccgtttgcttaattgtgattttgtatctttggtttaattaatcttaaaggaaattgtgaaaaaaagaagttaatttggttttgaaatatgaatgtttttgttttttttttggagtattttgtttgtaattttgaatagactaactaatacaatatacaatttttcttttaaagttttgggtttgatgtttccatatgcacaacaaacttatacctaactaaagttcatagctcaaagttggaatctaaaatgactaacaacaagataaaacagagaaagggaagcttttgaagaggaagatcccaaaaacgtgaaagctgtcttcttctgctttctctcactgacactgtagaatttttctgtctgagaaagacaaaagaatgggtacaatttctctatctgtctgccagtatccttcgtccgatttatgctttttgataccttgtttgcttctttctcaggcttttacgtctcatggacccgttttcatgactttttttatgggaacaacaaagtgggctaaagcctatagatggtaactgaaattaaacaaagaaaaacaaaacaatcagaaaaggcccagcccaaatagggagaaggaggcccaaacagaaaagaaaaacggagcacaaaatggttttaccggcggcaagaaaaccggcaaagtctctcggccggaagcctaatctaaaatattgcactgcattgtgtcatttcattgagttgactttgatattttcttggttacaagctgacaaaaataacaaataagaaaatgcgaggaaatttaacctgtctctgaagcatgaagaaggagtctctgtaaaatcctcccacacggttacacgtccacggctattaatcccacttattccatttctctttagaatcaatgaa

SEQ ID NO: 5974 - DNA, 3000 bp, Unknown
  misc_feature (1)..( 3000): cDNA_ID_1989695_gDNA_ID_1620834_Annot_ID_57926 3000 nt of promoter + ATG
aaccggaaaaaataaccgtaaatattttgacagagaattacaatataggaaggttgcaataaaagacacaagcgagaaaaaacaaccgtcaatattttttacaaaaagttgcgattaaaagacacaaccgttcagagtgcaaaaagacatttatttaaatttaatttaatttaattatttttaattatttattaatttatattttttgatcgctaagttgttcgtttgcttgtcgctggatccagcgaccaaaagcagcgactaatcgctgaaaccagcgactgatcgctaaaaatttcagcgaccaaaaattgcggtcgctgatcgctggcgactgtcgctacttttggtcgctgaaccagcgacaggcaaacgaacaacttttggttgttgtcgctggttttagtcgccagcgacaggcaaacgaacagagccatagtccaaaccaggactagacgccaccgtacatccttctagatcacgtgaaatttacgctgaaaaaccgagtttatcttaaatcatcagaaaattgttttaaatcacgtgaaatttacatttagagacatgtttacgtgtaaacgcccatataaccaatcaaccatcctaaagttgaaaaataaatttggataaaatcttggaattgtttttgtcgcaatcatatattctaaagtaattattcatttattttgtataacacatgcgacgtcacagaatctggagatatatttgtgtatttgtaccttataatttaataaaaacgttttgtttgctgaaagtattcgccgttgaaagattcgaacatattttatacgttttgttctgtagacaatcatcgagttcgcaacgtagttaacgtatgctactatacattgccgagtcatatgttcgtcgaccgtacgtacagttataatctcgaccaaatatttttcattatctatactatcattcaatttaaagtggccaactggccatgaccaatttcttcgtgctttattcaataaagtcatatgcagttttttttttttttttggccggatacattgtttttcttattcaagagcaagagtcaaagatattaccaactcataaggagaaagagtcataagctaaacatttgatctgatttctttagtttgaaaagtcgataaagttgtgaaatttctctgtaaatttttctaatttacttttgtacacggaaactggtaagacattcaaactagagtaaccacaaacacaagttacaaaagttttcgcaagtatttaaagaaaattcaaaaaatggcaaaatgttaaatacaagtttgataagattttgacgcataattgaacaaaaaaaatacttgtggataaattgatttttgacgattccaatgctatttgttgaataaaaagtgattaccgaaggtgaattggcattagataaacacaatttttttaaaattttttttttgtcaaagtagtgtataatggaataatgtttgtcgaccgttaatcgaatagtcaggcttttttttttggtctgcattattcttgtgggctacttaagtttggcccaacacatttcctagcaatgcataaactagaaacagaatgaaaagtccatccaaaaatgaaagagaacacaatgaaccattcttcttagtttttacttcttacctttgaatttgattatcaagcattacattttttccccattattcttctatatctgtaaagttctagaagtgtttgtagccaactgttaaaagatctaaagactaaaaagcaaaagaaagcccaaatatttgagacaactaaaatagttttttttttttttaatttgttaagcggactaaggataaggtgcaaaaataaatactccaattcgtttcactttacaacggtttatgcattcctttttttacaagatgtattcctctctttatttgggtcaatctttatgttttcctttaaacaatgaatgtcatcgaatacaagaataattatcacgacgtgacgatcacttcaattatcaaaacaaaaggagctaacctttgacattttatgattacgaagacaattctcacaatcactccataaccctcgcattgacgttttctaattcgtttgttgactttgagaccctacaatattttgccatccataataagctcaaaatcatttatcattaataagtaatgctaactaacaaaatcaactattagttggagttggagtaagctaccaaatagacaaacttagaaatgctaatttttcccatcacctataacagattttaatttgctactatatcctaatctaaacttacttaactcaaaaggctaatttttgacagaaataaaaaatatttaactagcatatgatctagcaacaattaacatttttaattttgcaaccaacatggtactataatgttgtcggttcaaactatatttttccaatatctttaaatgtatgtcataattcttcttattacatctgataactgtataattattagatgtggaccatttataatatgtttcatctttttgaccatagtgagaataaaacaattaatattaccaaaaatacataaataaattgttcaagatctataatctatatgtctttatgcataattaaaatattattttaatttaaaatattattttaatatttacaaaaacagtttcctaatttcctattggatggtttcggattgaattttaataatatttgtttttgtctgaaaataaattgcgcgtcattgttcttcttctttcttcttctctatctaagcggaggaaactcaaattgttacagttcacaagtaatctcttcttcaagctttctctctctaccaattaaagtatctctctttcttctcctctctctctctacgaaaactccgttagacccgttctctctgttctaattttattcttcttcgtgttctcgttagggtttttgattctttcaacacagacccaaatcaatttctctcgtgtctttacgatg

SEQ ID NO: 5975 - DNA, 3000 bp, Unknown
  misc_feature (1)..( 3000): cDNA_ID_1988786_gDNA_ID_1620834_Annot_ID_57921 3000 nt of promoter + ATG
tagcgatctggttcgtgactttatgaacgaggaatattctcaagaggtaaggctctcttctctataatctgttccctttaaccccctcataagctatatttttaagttgtgacttgattgattctcattttgcacgtaggctccatttcgacttgtttgtataacgaaatactcaattgcttctaccaacaatatgcgaacctcatggagggaacctatgaggatcaaactacctaagattaaagctgcccccaagcttgtgggattctttgtccaaatcatggttgtttgcgaaaagcccttccatctacagtttccagcgttttcttataattgggactgtgaaggtagcaggttatatcggattaacctcaaaccaaatctctatcaatcatcagagatgatggaggacaacaataatagaccatataaatggcatcacctggtcattgtccaaatcccaactggcatcatcagcgcagaaattgatgaggtgcaattcgaatcccatatccaagttccggagccgggcgacgagataattttgtgtggagttgaacacgttgggttcgttttaaagtagctggtgcggagatcaattcttaagatgatgatggatctgcagatttctaaacacaaggatttgtaccaattttcgttttggaactaaataaattactacccatgtaacctcgtgtcggtttgcttttataatcggtttggtatttttcggtttaattgtgacttgattttatttttttccttttaagagaaccaattttttctttctgctttgtactcgatgtctgccctttttgctcaacaagctttaccagattgtattctggtatttcatcaggctagaaatggagaaagaaaagttggagctgccaaacccacaggagttgtgttctcactggaaatgttacattaaatatcattgcaaaacaactactaatacattgaatctcctttgattttggtccaaagaaaggtgaataacttttgattttggtgcatatgggatgatgacggactgatgagtacccaatatccagtgcccacgtgtcctaattcttatggatcaatcaagggcttaaaagcccataaacattaaacagagggaataaaggaatgctaaaaactaattaagaaaacatcaagtaacaattattatgttttggttgttacttgttacttccaaggataaaggagggattcctatgcttgacttgcactagagctttatttcattgcaaaaaaggttaggtacttgattaagaacccaacctaagttttagtattatacaatcctttttcccatctcattttacatgcttacactttcattaaactattatactcaaggaaactggttgcaggtctataacttgtaaattaaaactgttcgtgttatttattcccatgataaaattgtaagagcgtgtgaatcacgagcttaggagagcgtgtgaatcacgagcttaggagagcgtgtgacatcaatatggggaggggcggctaaagactaacgagtaaaggcataagggggaaattaaggactgttcagagttcagaaatgtttttagtctggaaacgacaatacactttggacaaaaagctaaataacattttaaaagcttcatacaaattaaaaatataatcaaacaaaagctaacgtggccaagatagctaattacttttttggaatcattattagagataatggaaattaagaaatcatacagccaaaacaaaccgtagttattatattcgtaacaaaagatgggggaaaagttaatataaaacaaaccttatactagtatatataatacatggctcataatacattactgctaaatgagcaaaaacaaataaaggtaaagttcttaacggctttgtagagataggaatcattaattttagagaaaaaaaaatcttgaattgtacgtttacctttccagaattacattatttgttggcttttaattgttaatcatttttgttgtgtttttcctccaaattataaaatttaaaaactgtgtcagggaatttaggaatctaatatagttggacgatttcgtattaataaagattttcaaaaaaagagtctgctctaatcgttatttgggggtaaattgattctataaggtagggttagccagagagccttattctgtgttttgggttaaagtgagaccaaataaattaagatatttaaaatgaataattaagagcacttaagacaataattaacccagaaggagaagctggtgtagtggtggttctcatggcgatgttggtttcccaggaaaggtaaaagagaggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggtttctttctctatctcttatctatttctttctgcatctgtagtctctttgttcgaaaaaaagatgtttaatttctgtcaaatttttctccttttttctttgttcgattattggtgtatctgtcttgtggcgtgcgattgatgtttactgattctgaaaaattcttgctaaaataattcatcttcaagtcaacgactttttgcccaaaagtgatgacgggaacaagaaatttttcttggtcggaaaattactaattttagccaatcgtagcgatctctgcaatcgtgttttggttacccaagatagtacgatcgaatcagttcgtttagagaattaaaaaattactcaaatttagaaacttccaacttctgtttctttctattctgggttttttcacccacttggattattagctttaaaaatctaatctttgagtcatttttgattgttatttaggttgttggttgtgagaataattagcttgttaaggaagacgttatg

SEQ ID NO: 5976 - DNA, 3000 bp, Unknown
  misc_feature (1)..( 3000): cDNA_ID_1989699_gDNA_ID_1620834_Annot_ID_57922 3000 nt of promoter + ATG
catgacggacatagtcaagaggtaaggttacctctcaattgggttaccctagctggaaactttttccagaacctcatttcatgttttagaagttgaccactgccttcgttttaagcttgatgatggtgggtcaaaatggtttgaaattttctgctttctttgatccctctacgccattgccatgagacggcaaattctggatcttctcacccagtaatccgccgcaaatctgcctgccccgtcacctgatgattctgcttgatttgctgttttcgtttcatctattttgtttatttcatatgaaacctccgagttcattcccgagtcaactcattaacccaaatcatactgaaaataattctagcccggttttgttttggtactctctttgagattttggttttatattaggaccgatttgggttttgaattccggttcaatttggtgtacgaattataaccaaaataaatcagcggtaagtaaattcaaaacaaccggctgatctgattctgcataaaaaaaaatacaggtttttatgaatcatgattacttgcgagagagtcgtcttctcatctgcaattctcgtcttcttcatgttcactggagttgggtaacttgatcgggtctctcctcaatccaaatcttaattcatcctccagagtggttatccatcagagaccacttgtttgtcttctgccgtttcaagaaccctaagacaaacaattggacgagttcggcttcgaatcccatcggcaaattcccagaagagtagcttttatgtggtgcgcgcttaatctctgaatatgtctcagcagacaaaatcaacatggagcatcaataatctatctcaaagaaaaaatcactactttggtaagcctttttgagttttcgtttcaaaatacgtttttttcctttgggcaaaatttcacaacgtatatacgttaattaaaatctctaattgcataagttacacactttatagtgagatgcttcattagcttaggtgaaaataagaaaatctcagataaaccgcaatgttcatcagtgataatgtcatattatacattaatgacaacagatctacaacttgttgacattaacagatcatcacttttttaatatcttcttgagtgattcattcacttattaatcatcactcaagagaataaatgatgtgattttctctttatcttcttctttttttcctgctcttgtgtatctcttgctcgtgatttccataatagctttctcttggtctccctccagttgttgcagttccttctcccaacgctcttcatccttgcctcgtagagaagacccgaggattttaagtgtcagaggaaggaaacccgatatatggacagcgcgaagggatagtgattcaaaactagtgggagggtgttgctggtcaaaagcagagtgagaaaatagttgaagagcttcgtcgtatctcagagactgaacttcataagcatgctccacaccagactcaactaacaggttcctgtcctgtgtaacaaagatcactctacttcctggaataaaccagtgagcaaggtatactatctcctttaactgtttgatgttatcaacgcaatcaatcacgatcagaccttttcggtgtccaaatgttgatttgattttatcaatccccacatctaaaccctgtgttgtacctttttctgttaacaactttaacagatcccggtcttggtgacaaatcttttcagccttgtctacaaacacatgaactttgaagttgctagatatttcttcataagcgtacctcgctagcgtcgtcttgccaatgcctcctggaccccaaattcctatcaaacgaacttcttcagcagctttgaaatccagcaatttgtagagtgtttgcatctgacgatccataccaaccagtccatcacctttggctgttaatggctttctattcgagatactcaagatttcatttgcaattaactcaatcatgtccgcttcgttgctcctatgataaaatcaaaaacataaagggaaaagaatcatgaatccgagtgaaaaaacccttgaatattcttacgtacagattaagcttgtgttttaccaatatcgtgaatccagggcaggtatgttggtgagtttagtgagagaaaccctccattcttgaatcttgtcatctggatatccttcaccaagctcttgaaagggttccgcgagatatccagtctgttttctaacattataaggatcaactccgtagaaaatggggaggatggaaagtctaccttcgctgtgagagtttacgatcttctcgagctgattgaggcacaaaacagagattggatagctctctgagactacaacaaccgcgagttttgactcctctgccagaaacgagtcatctttgaaattggtggtaatgtctttttgttccaaccaacggtccagaacagagacaaaagtttttgaggggtcttcgctgcagaaactaaggaatacttcaaatttggaggatgaagacattgctaacgagagattgagagttgcgaattgttaatttcttgaattacaattctcaaacgggaagaaatggaaaacgaaaagtatctgtttgccaaagaaagcgatgagtagaagctgccaaagtgcgcgagagtcgagatttgactactcaactatcgtgcacttaaaggtacgaaggataatataaacttttgttttgtattgtttaaggttaatttatagcagagtttgtttttgaacaggataacataaactatcttcaaactaactcacttcaattttgattttcttttttattcagttaactattttaaaaatcaacctggctctattcgtatcatttcagcgtggcttcatagcgggagctccgagacagctgctttgtcagaaacctccatgtgatcaaattgacccgacccggaaactacgaggaatactaaggggaaacaaacgaatgcagaatattttcccatttttctctttccatg

SEQ ID NO: 5977 - DNA, 3000 bp, Unknown
  misc_feature (1)..( 3000): cDNA_ID_1989696_gDNA_ID_1620834_Annot_ID_57925 3000 nt of promoter + ATG
atcaagaaactctgaagtggccttaactttccgtcctttcctcataagcgatccaaaaccacataatattgtttttttacgaggttcttgttgctgctccctctttgtcaattcaccaggtgcttgttgcttctctttctttgtcaatttatcaggtccttgttgctcagtagtaaaactgagatgatctacgttgccatcaagccaaaacatctgaatatgtatgtttcctccaatagatagatttgcaatggacctcgtttccacttctttacccgagaaatacaaagcaatttgacggccgctcctattcaattcccttatagtgatataactagcaagctcctcacagtatgagacatcaagcgtcgtcaatctagtaaggtagctgatggactctggaattttcttcagcctcttgcagccttgagttatcaattcctccaaattaacggccattgaaagatctggaagttgttccagattttcagaatctgacaagtccaatcttctcaagtttggcatcccctgagcatattcaacaaagaataggaaaattgcgagaatgttaagtaccagaagatacattgttataagcatagatctgttaagagcttttaccacggtttctttccagaagcttgtgagattgctgcgatgtagaatgatttcaacaagatcttgcggctggaatcggcaagggaaggttgtcaagggaaatgcgtcccaatgtagtaacctaagccttgatgaaagtagatttgtatcgtcaccactgaaaagcagcttggacttaatatggttcgagtgcttgtagatcttgaggaatttgagagtatcgtggtacgctgtataccctcccagatgcaatgcataaaccatgtcacacatatgtagtgccatgcaattggttggttcgcttgtctgtgggattaaatacgataaaattagttggcctacgaacaagcttagtgcagaaacaaccatgaacaacaacgatgttacagatagacactgtaagtgcttaccgtgttacgtttcagtaattcataaatttcataaggattccacaaaactcctcgtccatggcgcctctgcatggattcttgattaacaattgctcttgcagtttggtctaccaaattatgcatctttatatacccactggctgttatttcaatgagagacttctcagccaatatttttaatcccagacaaccctgtagtacaccatcatcgagaagggtagtggcacgccggagaggttctccattaaagagacatgctacatgaaggaatacatttttatctgtttcctctaatccatcgtagctaattttcaagatctccataacactttcatcaggagcttctataaatctacataatgcatcgtcccactcctttaaagatgtcattcttcggaaaaataatccataagcttcaatagcgactggaagaccttgagcaagccaagacgctcggattgacagtttttcataaagttcagaaggaggaagcgctcctttgaaagccaactggttaaataactgaagagcagcatcattatccatgcacttaacttcatatacagttcttactccgtatgtattgagcaagcccttgtctcgtgttgttatgattattcgactgcctggcccaaaccagctcgactcttgagcaaaagcatgcatttgtctcatgtcatccacattatcaaggacaacaaagactttacgacatccaaacctcgccttaatctcctggggtccaagttttacgcccgaacccttcatcttcttcttagacagaccaagtgtagttgaaagaaacttttctgctaaagacgagacaccaccctttctataaatcttggaaacgttttcaaggaaacaacgagctggaaatccctgtgaaaactggtcaaagagacacttggcaatggtggttttgccgatgcctcccattccccagattcctatcatacgaacctcattctcagagtccatactcaatagaggactcaggcgctccatgtgagcgttcatccctacgatgtcgctgaaatctactggctgcataatcaacaacttttttgaaatgtctttaacaatctcttcaatcatcgacgcctcgtcttcactagaatatagaacatgataagaataattattatcagttccatcgatattgtacactaaaaaccatatgttggtggtgaaaacttaccaagtttcaaaatcctttcctgctaaactggcgatctgggtgagagcttctctccaagttgtgaccttgttaggcattttagagtcttggtacttgtcaaatgtgaaactcccagtctgatgtctcacgtgagaaggatcaactccatagaaaatggggacaactttaatcttattctttaggtgaagatccattaccatgcggagctcgtccaagcaccaactagatgaagcgtagttctccgatagaatcacaagagcatatgtagagttttgaatggctctgctgatttcttcggagatggagtcgccgagctcaagctttttatcatctttgaacgtaacaactcccttatcgacaagttgtttgtgcaaatgactgacaatgttcttgcgggtgtcttctccccggaaactcaagaacacatcgtacttccagataggagatgaagaagatgaagccattagtctctctctttatggatcaactatttggccaagaaggaggatgaagaaatcatatcaagttcttagtacaagataatcatattgtcacaaacttgcacgttgtccgtataatgatttcaaatccatggttcaataagaccctcccccaagccaccctgttgtaacacagttgcacgtcgtcaattcgttgacttttggaagccaaactctctagatattacaaggcgtcattaactacatcaatatctcatttctttggtcaaaattcaggcatcaatcatctatctctccactatcgataatc

SEQ ID NO: 5978 - DNA, 3000 bp, Unknown
  misc_feature (1)..( 3000): cDNA_ID_1989697_gDNA_ID_1620834_Annot_ID_57924 3000 nt of promoter + ATG
tttccgtgactccattttctctccttccaaaaacggattcagaaactcaagccgcagcatcagaatggatctccaaagcccttaactctgatcaatgaaaaaggtcatactcgtaaattatgttacatgatttggccaaaactctcccaacaaatctgatttactggattctgcaatttgtttgttcttgtggtcttgttgtcatcttaacccttttgtttattttatttatttgatctccctacaagtctgggttgctcttgttggcttatttgtttgtcactagctgttttaacctttgtaatcggaaaaaaggtcggtctgcgttttctctatttcgaattcagacaatttgtaaaccttttgattgagaagaacgatcttttacctaaatactatggctgatagtttgtaattaacgcatctctttggctatcggttaaatctgagcagaatgatattgaatcatgtcattgcactacttttaagtctcaaatctctggcaagcatcttgtctcacattttatcttcttcgatctcagtccttcacgacaacacctaggaatcgcatttcaggatacaagaagtataaatgtaaattgcaacttttgcatagatactaacaccttgcactatccaggtactacaagagggacaagaccactcccccccctgttagtcttattaaatgctgaacaacattaatataatgagcgaacaacatagataacagaaacataaccaaatgtttcgagtaggcttatgcactttgattgtcaaagtgacatgatatatgaaggtgaatattcttcttcatctggacttacatattgttccaattctatttgacgtcttggaaggtattcacctgccccgatgtagttagagacataacgacgatcgttatcttgtgatgcttctagcttgtgcaatgttcttttccaactctcttcgtctttatcatatagaaatgaaccgagtactttcagggacagaggaagacgtccagcaaagtggacagcacgaatggagaatagttcaaaaccaataagagggtaagttttcttgaaagcgtatagagagaagagttgtagagcttcctcatatctcagacactccatctcgtattttgccccaccgaacttaagcgaagacttgaatctagatgtcatgataattctactgccaggaccgagccaacgggtaaccttcatggcatcgttaaattgttcattgtaagtagcatcaacaccatcaacaacaaacaggacttttcggtttacaagacttggtttgatggcatcaaatatgtcttcagaactccttctccttgtaagatgttttagtaaacttggtgagatgcggttctgatagattttattggcattggttaggaagcagtagtgttgaaagtggcttgagatgtcgtcgaaaacacattcagcaagtgtcgttttcccgacgccttggaaaccccaaatgccaattgtacggacctggttcttagattccaaatcaagcaatccatagaccgctttcttatgacgatacatcccaacaagaccgttggagtcgtcagatgtgggagaaggcgattcatttgacatatcgtccataacagatgtggcttcaagtgcatatctctcaagtccaaatccagattctacagacccagacagactgttgagtttgtacttcatatcgatatctgtcatcaatcccagaacgctcgcgtctaggccaactgtcgtttctgcgattatatctacgtccggtgtgtagtatttagaaaaataaatattgattagtctgatgattagatcatcgatcatcttggaatcatcctccctgtcaaaaaacataaaatatataggacttttggagaaaggttaagagactattttactatgatttcttaaaaaaatatatgtaacttgtagagagttttaattatgttggaaagaatataaaaaaaacttttgagaattattttgtttgaaaaagtttagtttatgggacttttaaaaaaaaaggtttttaaaactttcaaaataaataaagcaaaaaaagtctaattagcaaaaaaaaaattggaaagactttaaactctttttaaagctttgaactagccaatcaccccctatgagttagcaaattttttaaaagtaaaacaataaaagaaaccactacaataaaaaaaccactacagtaatcggtgattaccaattgcgcgaacaaaaattactgttggtgatgctaaccaattggtccagtgcatccctccaacgattcacggttctccgattttctctcgcttcatgcctcctgaagtcgtcggcgaatttaccagttggtcttgtcaaatcccccggatccacttcgtagaagactgtttcgattttgatgagaggcaaacgctcaattatcttcgcgagtacgtccaagcacaagacggaagagacgtagttctccgatatcacaacgacagcaatcctagactcgttgatagcctgcttgacctcagaagatatcctctttccgtctcccgcctgctggttttcaaatttgtaagttcgaatttctttttgatccaacgaacggtatagatggctgacaaaagttctaccggtgtcctctcttctaaaactcaggaacactttatgctctgatgaggaggaagaagaagccatgattatcgatagtggagagatagatgattgatgcctgaattttgaccaaagaaatgagatattgatgtagttaatgacgccttgtaatatctagagagtttggcttccaaaagtcaacgaattgacgacgtgcaactgtgttacaacagggtggcttgggggagggtcttattgaaccatggatttgaaatcattatacggacaacgtgcaagtttgtgacaatatgattatcttgtactaagaacttgatatgatttcttcatcctccttcttggccaaatagttgatccataaagagagagactaatg

SEQ ID NO: 5979 - DNA, 3000 bp, Unknown
  misc_feature (1)..( 3000): cDNA_ID_1989710_gDNA_ID_1620835_Annot_ID_57956 3000 nt of promoter + ATG
aatttaaaagtgctcatgagaaacatacgtttcagttttcactctcaaaggaacacatttttggtcaactcagttcagttagtttgaagacttgaagttaagaaaactaaattcaatcgaaaggaaaaaaaaactttttcacttttagtttcttttactttttcagacagcttcgtgacaaaacaatataattggttacaactgaaaaacaatcaaaaagaagtttgatgaacatattttgaaaaatgagaaagaagggggttcaaatgttagctttaaaaagattcatatgagacgacaaaaaaaaaaaaaagaaagattcatatgattttaatgtgaatgtgatccgcaaataaataatctaatgtttttttaatagtacaatggtatcttacaaaattaaatgctatttattctatagaaaacttatttttgctaaaaacgtaagatatacatttctaaaaaacataaatttatctaaaaccagattggatttaaaaaaaatagtaacaagtatttgaacctaaaaaaaaaaaaaaaaaactcagataaacagaaatcacctttaaaattacttgatgttttttcttcttctgttaattatacaaatgttgtattactaattatacttaagctgaaattaaacgggattgtggttggagacttggagtgtgtgggaaaccaattcgctttcaacatgcaagcatgtaagtatgaatgctctcattattatcacgttacgttcgccgataataaatgtatttaatttgtaatacaagtataattagtggtaacgaacacattacacatgaacggctatgttacttacttggccattaattccgttgaccttaagagatggcatatttatgagtttctttgactatttgtatatcgacaacttctccaccaccataggcaccactttccattttcttttatgccaaaactatatcagcccacttaaatcaatattttattcacttttatttatggatttatgaatcacacaattctccacaattctaaaattaataaattttgaagaatgaacataaaaatttgttaacatatatcatatattacttgtagatccttctttttggaataaaataaaagtgttgttagcgtcaatatacttcaactttgttaaaaatgagtaaatgaccacaaattgtgaaggaaaaaaaagtagacttgatcttgatttgtcgattgttgtctttcttcggtgtgtttatgattacctaaggtgacaatgaatttgaaggatttccaaaactagagctgcggaacaaaactgtgacggtaggtttctcctagctagtagagaacttggtttagaggagacacgatttctacagatttgctccatctgttgttagtaaactgccaatgctggttttagtgtagtaataacaccgacgtaacgttgttctctttatcaaaaaggaaaaaacaaaacaccaactttattcactattccttccaagagtttgtagatatgcatatatctttcaaagtggagatatttggtggaacatgaagacatttggtgactgagttcattgaaggttttaaggtagggaataacgtatgcttaacatgatgcacggtagcacgtcatctgtccgcaaaatgaggttgtgattattccttgattccaaaagttatttgacactatttgtctattcaatacaaatcgctactcctgatttaataagtgtccctttaaattaattgttctatttttttaaaaattgtcgtttctttataactttgaactatttttcaatttttgtgtcatctctaaatagagagactatactaattttctctgtactatttctattttattggatactccaaagatatgattactgttttacgatttaatatataatttttaacaaaaaaaaattaaatttattcctatttcatattaaagaaaattcaaaatatagtcaatttgttattaggagtataatagaaaatttaatttattttgttaataagtttattgaattgcttgaaaatacaaaatatagtcaatttctgattaagagtatataaaaaaaattagtttattttgttaataagtttattaaattgcttgaaattacaaaatatagtcaatttcttattaagagtataataatagaaaaacattatactattaataattttattaaattgcttgaagttacaaaatatagtcaatttctattaggagtatagtagaaaattttaatttattttgttaacaattttgttaaattgctttttaatccacatgaaaatatccaatctgcaagaagtataaaatcatcattttcaaaatatagaaagaaaataatggttttgaacattgaaaaaaatgatcttattgacaaagaaaggagctttcgacttttggaaacataatccaaattttagataattatgctaatgtatctaaaaatcttaaaacaggataattataatacgttagtgtcatcattatcatacatttcaccaaaataacgaaagaatagactagcaacaaagatttgattttctgagaatatttgttccaatccaaagtaaaaccaatcagaaaaatagaaaatttctatattcacggtaaaaaatatatattttaaaaacagaggctgtgatattttttacccatcatttctagaattttggggaaatgcaaaacactaatccataaaaattaaaaaataattaaactaaaaataaaacaaaacaaaaccaaatcccaaaggattggtccaaaatctgtgtttacaaaatatcaatggcaatttcgtagtaaagataaaaaacaaggatattgtttttaatctttctattaccctattattctcttatatatatatactcttccctccggtcaaatctcgtcgtcttgtttggtctctgtttttcacgccggagatagagagagagaagtaaaaaagcgagaaaaagctagaaactttagaatacccaataatg

SEQ ID NO: 5980 - DNA, 3000 bp, Unknown
  misc_feature (1)..( 3000): cDNA_ID_1389239_gDNA_ID_1620835_Annot_ID_57960 3000 nt of promoter + ATG
ataatcttgttgaagagtcatctcccaaaactaatgagcatgtataggctcttgttgaagggtcatttcccaaagctggcaaatcataattacataatcttgttgaatggtcatctcaggatcacagtttgtcaaatagaaacaatgtcatctgggttaagaaagttgaaagtggacatgattgacttggcttagatgattgtgtctctatggttgtactttgtgaagccttctttatcattatttgtactatgtaaccttttgtttgtgtatttctttttcatatcttcttgacccgtttttatctcgttcattcagaaactgaagacgcgtgtgattaataataactgtaatccagtgtggaacgaacaactgaccctttccatcaaagatgtgaatgatcctatccgtctggtaagctatcgtgtctattacaatttacgacggtcttctaaagaaaccgattgttggctcatattatggtctgtttatgcagacggtgtttgataaagatagattctcgggagatgacaaaatgggtgatgcagaaatagactttaggccgttcctagaagcgcatcaaatggagttagatttccagaagctccccaatggttgtgcaatcaagaggatccgtccaggcaggaccaactgtttagctgaagagagcagcatcacttggagcaatgggaagatcatgcaagagatgattcttagactaaagaatgtggagtgtggggaagtagagctcatgcttgagtggactgatggtccaggctgcaagggtctgggacgcgaaggtatgttaacaaatcctcggtttttgacttgtgcatatctatgattgcgattaacatgcgagcattggttcttttaggatccaagaagacaccatggatgccgacaaaacgattggactaagatgcagaaatgttaaaacagagaccgtgaagatgtgatggtattttttcgttatgttcatggaaagacgagtttgtctttgtctcatcagagtttaaattgacaaaaaaggctctgctttggtctttagttgtacatgtcgaataactcaacccttatatatattgtatctgtttctactaattgaagaaataaagcaaaccctgaatttctagaacctctttcaatcttatttctctggttctggtaacattagaattagctcacctatatcagtatgtatacaaaattatatttgcagggtagtaccttcttttttgtgaaatgtaatgatgatatttctaatgtcaatgtcagaaaaagacaggagatatttcttatgaatagaatctagaaggtatttgtgtgtgagtaacgcgtagatgataattaaagtgagttagcaggaaacaaaaagttggaaaagagaccttttgaattcacctttccttttcttttttgtttctttcttttaataagctgatttaagtagcatcgttgaatttgagtcggtgattgtttgtaagtgaataagaaaagtagtagagtcaggagacaggtgtgctttctcttcaaagctcagaagcaagatggagaaaacagaggaagaggttgagatgaaggaactggtagggcttgtgagaatcctagtgaagagagggatcgatcttgctcgtcgagacgctctaagcagcgacccttttgtcgtcataaccatgggtccacaggtactttttctctctttctgattctaatctgatttggttctcttctgtttgatgtttctatttctgttcttgagatgtatggtttctctgtttactttcttcgcagatggaagaccaaagaatcgacctttaagaaacatgattaataatcatttaaaaagattttacatttcatgctacaaaatgaaaacaatctatagctataggatgttgtgttgcattcgttctaactgaaattggttgtatctttgaattgcaccagaagctgaaatcttttactgtgaagaataactgcaacccagagtggaacgaagagttgactcttgcgatcgaagatcccaatgaacctgtgaagctggtgagtactagtacccgtcagtaactaccggaatcatgaattttcaactcaaaaccaactgatgataagtggttggttccatatgtttttgtttcgtatgagtgcagatggtgtatgataaagatacatttacagcggacgacaagatgggagatgcgcagatagatatgaaaccgttcctagacgttcacaaactcggtttgaaagaacttccacatggaaaagagctcaagagaattgtgcccaccagagataactgcttgtctgaagatagcataatcgtctccgataatggcaagatcgttcaggacatgattcttctgttgaagaatgtcgaatgcggcaaggtcgagatccagcttgaatggcttaaaaatccaggtggtagtggactctgaaaaaacagagatgaagtagctttatgattttctgtgtgtaataaaaaaaatctcagttaataaaatagaacagagtactactactctgttttgtaatggaaatatatttggttttagatctaaccgaaaccgttttggtttcccgcgagttttctcttcatcacaaaaaagaaaaagtgatatttatgttttatattggtttggtaaacatgttcttggaaaagtcaacggcttaaaccttttgtccatagtcagaaaaaaagaagaatcaagaagatattattaccaaagatgttcgtgagagtaacgcgtagatgagaataatatagaaacaaacacctggaaaacgaaacctattatatagatggtctttattttttgtttctttattcgctctatcgtccattgataagccaatttttaagtggtcctcgttgaatttgagccggtcattgtttagaattaaaaaaaaagaaggtaaaagagtcagagccgcctagagaaatcgatcacaaattcagaagaaaagaacagagaaaacagaggaagaggtgag

SEQ ID NO: 5981 - DNA, 3000 bp, Unknown
  misc_feature (1)..( 3000): cDNA_ID_4370980_gDNA_ID_1620835_Annot_ID_57962 3000 nt of promoter + ATG
gaacgaacgacatgaaccgcgtaacatgcatgttttcttaaagatcaacaacactacatgccaataacaaatatgtcaaaacgagaatttgcagaaggaacgtacaacctaaaccgcgttatactgaatgatctctagatcatttatatgatcaaaacctaattcaaccgttatccattacaaaaattcagtaggtgagacaaaaagatagagtcatgatatcagaagggatacaaaattgcaattaataatgatttgttttcttcttcagccgttacctccctcaatcctctacaaaaagaggctaaagaactcaaaagggactcattttctctcaaaatccttttaattttcaagttaaacaaagagaagaaaaaaatggcgactaaaatggccggggcagcaatgaatttagcaaagagagagtcgtcaagtttgtgtgggaagctagagacagatattgaaatcaaagcttcagctgggaagttccatcacatgtttgctgggagaccacaccatgtctccaaagcaactccagggaaaattcagggttgtgagctgcatgaaggtgactggggcaaagtcggctctatcgtcttctggaattatgttcatggcaagtgcaaagttatattaacttttatcggaaaaaaaagttctaatatctacatagaatatgttcttaaacttaatatttttatcaatgaaaaaagtgagcagaaatgcatacttgatgtgaacttctggccaagggcacatctcagtgtcataaatccttggctccccatttcattacaaaaaacatttattcgattcttacaatcaaatccacagatatgtaatgacaaaagtatagattaattaaattttatgtttataacatttttgtgaattaatattcataccgattttttagtcaaacccaaacaaatatatttggtgcagatggagaggcaaaggtggcaaaagaaaggatcgaggcagtggagccggagaaaaacctgatcacttttagggtgatagagggagacttattaaaagagtataaaagctttgtgatcacaatccaagtgacccctaagagaggaggacctgggagtgtggtgcactggcacgtcgagtatgagaaaattgacgacaaagtggcccaccctgagacctttcttgatttctgtgtggaagtctccaaagagatcgatgaacatctcctgaacgaggaatagagagtactctttaattgagtatctatcatatgtgtatatgtatgttatgaagcacgcatgttcttgtgtatgatacaataaacaaggagagttgcccaatatatgtgagtgatacataaaagctttgtactctaaatgtgagtatgtcatgtttggttttaataaaagcttgtgagatatgtttgtggaaggctcgtctctctgatatcatgaatgttgaatgttggaatcatccatttctgatatcatgaatgttggaatcatccatttctttgcttccttgtttgagtcttttgttgtattagcgagttctgggggcttcatgtaacaaattcgaaaaacgcgttattctcgttaataaagcatactaatatggaaaacaaagttagaatcaatatttaattagccaaattagacgtaaaaagaccaaaagaacgtaactattgatgcacacacatgtttagcgtattcagatatgagtgtttgtagttgtcactgaaaattgtatcgatcttacctattttctctcaagataaacgtgtgataatgtgttattcaagttttcaatcgagaatccattgattttaaagagaaagattttacaattttcaaaagttatacgagtgttgggaagagtgttgtctaccgacatactcatatcacaccattttcaacacctagtctaccaaaaacaaaagtgagcatgaaggccaaaatgatctaaaatggcattttgttactctcattattattttcccaattattagactctatctataaataaatatttttctatatccgcagaaataatggtataagaacgatcgatataagtaaggaggtatagctccagggtaaattccagttggactatggacgcggtcacatgaaagaagaaaaaatgagagattttgttattagttcttttgtaattaaagttgtgaattgtagacaacattgatctaattcgattgtttatataagcgtaaaaaaaatataactatgcgtgcataatgacggtgtgcttcaaagaaaataatatttaacgaacaatggtaatcatgtgtgtgcatcaatagttgacgtttgttttacctcccttttcataattttgtaacaactctattattttcccaattgttagacaaatagttattatgtcttcactttttttttccacattggaaaatcgcgatccccaacattcgtttgtaaagatctttgggaccgaaacaatctggtctctctcatcatgcatgtcttgtagatttcattgacaactacaaacactcatatctggttaattagggatgtaacaatcaactgcatgagcatttacattgaggttccagttccacggactaacaaaattcaattcttaccaaatgtttggtctctcgaaacgagcttaaaagttttatttgtcctacgagttcctctctgtaatattttctaggcaattaatattttaaaattaaaaaacaccactagcaataataaatccatctgagcatataaacgttaacagagaaaggagtgacgtgaaaggacgcaaataattcagtattattattttggttaacaaaaacaaaatcttaatgaagattttttgctaaatcttattttttgctaagaaatacgcatttaaatgaagataagattttaggtggaaatcttaatgaatctttatgggtcatttctctatttatagggctatcgaagccccaagaaaactcactctctatacctcctcaagaaaatcaaagcagcagttatg

SEQ ID NO: 5982 - DNA, 3000 bp, Unknown
  misc_feature (1)..( 3000): cDNA_ID_1572397_gDNA_ID_1620835_Annot_ID_57966 3000 nt of promoter + ATG
gtagatggatttgttagtcatgagcagttgattcatctagagttaaaaaaaaaaaaaaaaaaaaagagcagttgattcatctttttttttttctctttactttttttttgttacagagtagttgttgtatctaaatctctacttttgaagtacaccaaacaattaaatgaaagatggtaatagtaatagactaatagtcatctgagagagaaaactattcacacttactcaattagtaggggtaggtatatgttgagagcaaagagaaaaaagtggaattatgagggcagatgctgaagaaggaaagttaaatatgattcagagcttcttctgcacgcactttctcaaattcaaacaccaaaaccataccatctcgtttcttgaaacattacacatcagatgagatgattcatagttttttctgtactagccttctcaaattccaaacactaaaaccataccttctcatttcttagaaaattacacaccaaatgagatgatttagggcgtcttctgcactagccttcacaaatttcaatcactaaacccaaataagacattaaagagttcaacattaaaaccacataccatctcacattttcttgaaacattaattaaacaccatataagacatcataattttctgtgacatgaaacacaacaacattgtaaccgttgcaacacttaacaacatcacaattttatctttagatagtttactctcctttagttgttaggcaaaagtggcgtatattctttaaattcttaatactaacattaaaagagttcaatatagtcgaaccaaatctaccctaaatacctaaaatataatcgtttctatgctccataaagacaaaaacaaaaggattccaactttcaaaatctatgacaaactcgattttacactagagtaccttcggatcgcgattggcgttccacgtttgcgtcttgcgttttgcttgtagcccttgtaggttggtgaagggggtaagtgataataatagcaacacgtaaaagttagttgtggagaggattgggacccgtgtgaactactctcttgtcgtctccataaatatcatctctgctcaatggcccacgaaacggtgccgtactgtatctcagagcctttctcggcggaggcggcggcggcgacgcgacgaggtgaagacgagaataaccaacagaagccgatgacgacaaaactatctgaaaactgacatagaagacgaagaagaataagaagaaacacatggtcatattcacgtcccatcttctcttctttccttgtccctgtcttcgtaccaacacgtgagtcatctcacaaaaccttgttccggaggagtaaccaaaaacagacgaacatgaagacaaagtcacaaagagacagtgaaagtcaaaggaagaaaaaaacaagagagaaggaggagaaagaagaagaagaagaagtggttttttggaatgcaagtttgtttgttgtcttgtgggtaaaaataagatttattgactcgtaaaaagtttctgatgggtcttcggatccttctaagatctggcactattctttcctctaaaaggcaaaagcttttacaagaattctctttttctctctctttctctctttgtctcggaagtcgtaagcaaaaaaagagtgtgtgtggtctgtagaagaaagtacggcaggaggtattaataacggctgtcacctctttgagtttattcgagggaagagtcttcgaaagcactctcttctctttaccattctatctcactttttgtttactaattacgaatttggacgtactaataattgtaattagggtttttcttggtaatgacgatgagttgtttatgtttgatggtgaaacacattggccaatgttcttttgaggcattgactttgtaggtttagacagctcactgtgcttaaaataaaataaatgttagcaccctacttttctttttttgtcaattattacggtcaaagtagatgagattgggacgttatagccaatttttttatttttatttttgtgaataccatttaatcccccggttatattagtatattactgttacacttactgtattcagtttcaaaatgatacaacaggtgatgtcttgactctttgaccaaaaaaaaaaaaaagtgctgctatctgattccaggacttttatataaactgataacatcatatgatttttagcgtagcagaaattatttgtgaatgacaaactcagattctaacatcacggtcgatcttaacgatatcttgtttcattcaaccatgattaatagcttatgaaacaatacttcaaatatcacaaaaggaaaccaatattagttatcaatttttgtttttggaaaagtaagcaatggtctctacagctctaaaaacagttattgtgtatgttttcaacagaattgttcatcaaatcttgaagagttttataactataaagtctataatctactctcattcccacgaggcccactacaatcgtgccttgattcctcctctaccactttcggtgggctttaatctattgggctaaaactatcatcttggattcaattatatttttcttgtggggtttaatactagagtgtactaattgtaaaaacattggtaactcttgctcatttacatcagaaaacctcttattctcacgaaattttcaacacacgacaaagaaattttgataagctgaggagatatttggtaacgcctcacgcaaatgaacccatgtgaataaatatgatcgatcaataatatcatatcatcaagataagacgcagataattgtaaacatgatttattatgaatttatgataaggtcccgaaactattcatgatattattttaacgatcaaaaatggttctatcatttaatactttctcactcattcttctacaaatagaggctaaataactcaaaaagaaaacacactcatctcctaaattccttacataatattttcttaagataagcaaaaaaatcatg

SEQ ID NO: 5983 - DNA, 3000 bp, Unknown
  misc_feature (1)..( 3000): cDNA_ID_1989705_gDNA_ID_1620835_Annot_ID_57968 3000 nt of promoter + ATG
cataatctattgtttttttacataaatgcattgtgttaccgttacttcaaattcatacattgcaatatacggaaaaacttttatagatgatatctctttacaaaacctaaaaataacactagaacgatacttttgcgacactgaaaaatattatcacatcatcattatgattacaaagatgattcagtcgtgtacgttataacatgtcgaaattcatggtcacaaatcacacccatctgtcattctctttcttggacttcctaaataacttttagcctttttcccagattatattcaataattgacgatcgataactttaaactattcattctttaagagtgagtaaattgaaaagtttatgaacatttcacattctttaatcacgtgtttaagccaccagtagccatcattgttcactttcaagattgtctaaatcgcttcgacgtaccacttcttttgaagaactggaatcaatattgatcgtccgaagttttaaccactcatttgatttgtatcaatatataactgccaaattcttatgtgttttagtgtttatttcatacggctaaaccgtatacttttgttcacgtgtatctttgattatttaaccacaaacataattttattgcatatagtgtgtttattaaatgatactgtactttagtttctgttttgtataatacttctttttctttacaataatattttagtactctattgaactcaaagtttgaccaaaattttagatgatatttttgtaacaattaaaagagggcacatttttaaacttagccataaacattttgagtcactcagtcatagccttatacgcacaacactgtgtgtactagctttattgtggaatatgtatatttttgtgtagatctttatgtacattagctagaattatcaattatataaacacttaaacagatggaataatttggtagttaatggaaatggttaagctgacatatgaagtgcttccaaaagttccctaaatcttttgccgatatctaggattatttattttgttaattgaatgtcaattgagtgaaaatattaagatataataataggttgattcgattatgataaatagttgaataaagtgtataatatggttttgtaaggacggcagattttatcttagcttaaatcacaattaatcattcatgtttggacttattcgaggaagttgtgtcaagtaatattttatgcaatcagaaagatacagcaacactaagtcacaagaaggtcacgacattctctgtctcagccatttactcatgtgaaactttggctctgtactaaaaaggtagtaatgcccatatcgggaaaaaaaattataagaataaaatacaggaaaatatttttttctactatataagtgatttaatgatatattaactaaatttatacaataaattgagctatttggttttgtaaaactcataaataaaaatgacatatattaactatactcataagtactacattgtgatgataatattttaaaactcaaatatcaaatcaataaatgtctaatatcaatttcattgataattcatttttgaattttatttctctattaatctatttaaaaagatatgtttaccgctagcctccaaccactagttagaggttaaccactgtagttctaatttcagttcatctcaatttttgttttggttaaaaagtttaaaccgatcatctctacactaaattcagattttagtttatgtgaacaaataattccgaagcgacgtgttaactaatatcatgaaggggaattagacagaagcttaacgatgagaatataggctaaaatttatgtcgtccaaggagtaattgagtgttgcctacttcacgagacaaataagtaaacctaacaataacacatagacacactcgacgccattagccaaattccatttgagccatccaattccttagtggatcttctttgtctccagcccatcttgtctccttatttttctaatgattactttataaaaagtgttttatcaaacatcacaaaatataaaaagaatttccaaatacttttgatatttaactattgcttttttgattattagccggggtaccaagatattagtttttaatttagtaatatacccatatgtttaatattgatatcgatattgatttattcatattacgaaaatggattagttagagaatgtgaaagaaaggtaaagtaaaatattgaaaagcaaagattaggggacagaagagaaaaggtatgtctctgccatgcccatccccaaaagtagagtgccacatgtagaccttcttcttaagatctaactcagatgctatttgtacaagtaaaaaatgtggcagactcagtttctatttttccatattttactttaatcttcatgaatcataaaaaatgaaaaatcaagcacatgaatgtcactgaaattattcaacaatattcttatttatcagttattttaattatttgactatttatgtgtatgttgttatctacaatatgtccgtttcaatcagtcgaacaaaaaatactagattttagttatgtagtataaaatataaaaatgttgaaaaacactctaaccattaatttgtattattttaaactttccatatgatgagatgtattattcaatataataataaaaagaatattatttaataattaaacaaaaacataataaatcttataaacaatatcttaaaagaaaagaactatattgttatttttttgataagatcgataaaaaatgtaacatactaaagaataaataaaataaaataaattagtaaaaaggaacttgggtggtcacgtatttgctgtataaagaggtgtaaagtggcatccttccttaaattatatcctcaaaaaccaaacttgctcactccacacacacactgctcccaagtcctctcacttcttcttcttcctccgacaccgttgcttaacggttttccatttttgtcccttcaag

SEQ ID NO: 5984 - DNA, 3000 bp, Unknown
  misc_feature (1)..( 3000): cDNA_ID_1988785_gDNA_ID_1620835_Annot_ID_57971 3000 nt of promoter + ATG
gtttttaagtcatccgatccctttcataaatatcagcaagttttgacgtatgacaattttttattgttcatgtaattacaaacaattaaagtgggatcgttttaccaaattttgtttttactaaaacgtgtatgctgacagaaaatctgtcaatgtaatacttgtattcgaataattaaactactaaaacgtgtacattgaaagagaatatgttttactttcatgctggtatccaataatctctatggtaattggtcggtaattttagtaagtttttaacgtgtggaactaatttaacatttcttcctttggttttagaagtaaagcatgaattataagttaaagatataggcgttttgcgactcaacaagtaatcacccactcacagcattagtaacaaactctgagattcttctctataaatatcacttgtgtgtgttcaagttaaagaagaagaaaatggagaataagaaagaaaagaaaagaaaaagaaaaatggagaattcaagttccgaaacacttcatgttgaagatttacaaacggagataatgtcatggctgcctctgaaaagcttgttgagattcgtcatcgtctcaaagaaatgggcatctattatccgtggagaacaattcaaagctctttacttgcgtcgatcgatgacaaggcctcggctgatgttcatggtccgacgaattgcaaccctaccacccgaacctgagatggtgtggtttcagtctttttgtaaagaggaaagatgtattcccggccaactcgaagttgagttcttgtttcactctgtttatcaagaaaagataccgtatttttcatctggtcaacagcagttgcgtgttcctcctaatacaaactatacgtctgtttctcaacccatcggaggtttgatctgtcttcagtcagaaactaagtttgcgctttgcaatccgggtacgaaaaagtctcgggctttacctgatatccaagcacatgaaaaagcttttataacaagttttttaggatacgatgaagctacgaacgtattcaaggtgttatgtttgacgatggtatgggcccatgaaccatcaaaacgagtttatgagtatcaagtcttgacggtggaatccggtgtagagtcttgttcttggagagggatcacatgtaaggagaaggatcacacaccagaaactcaaggactatgtaaaggaggggttttgtactatggagctcggtccactagtgaccatcgacctctggtaatgagctttaatgtgaggtctcaagagtttaccgccattgaacttcctgatcaactacatattagttatttttggaattttgtgatttacaatggggatattgccttagtgaacgaatctgactttgaccctagagttgtgaatgaaccgaatgggaataaagtttttcacatatgggttagggatgcaactgcacaagaatggcagagaacccgcatcgagattcctcgttgggaacaaaatgttggacatgtggactatgttttcagaggtaccactggaacaaaagaacttgttttcgcccaagactctcgccattgcgaagatgatttctttgtgttgtattacgatacattcacaaaagatctcagaagatttcagattggagtgactggccctaaaatttctgttcgaacctgcttggatcatgttgatagcctttggcttatgtgaagaccaagatctcagtctctcttcttgatttatgctaaatattaatgttgtctctatagtagtaatatcttattttagttttcatttcattaatctttatttatgctaaataataatgttgtttctcaagtagtgctatcttattgccattgggatggtttgttttcatttctactgtcgtttatctttatttatgctaaaataataatatgtttgttctattcagattataacttcaataacatttctaatttctatatatatatactcactatttctcaagctctgagagccttttcatgaaaccaagggggttccattccaaaaataaaaaagaattgagtacagaacaacgttgtaagatatgcaagaataaagcatggaagcaaatattagccagaaagatcaacccagagtcgagatgaaaaaaatgttccaagtaagaaatcaaacattcatatataatacttgttcagataatcaatagaaacaatggtaagaaaaagtaccatataaagtctctcaatcttcgctataacagagttaagacgattaggatgaggtttaattcaccatttcattctctgtttgtgccccctgcatttgatatatagcaaaatcattagacaatgataaatatccacattgaaatcactatacagctttagttttgtttcagtttcaagagttagtttattgaaaccctagctccaaactcaatgtcaagaaataaattttccaatttcagctctcggaatgatacaatacaaaaattgttctaacagagacagagaaatgaatacgtgagaatatgcatgtagcagctaagaactcaccgcaccggtgcaaggcgaaactcgaggttaggaagccgaaacgaacaagccgccgttttccttgctagcctcatccataagcttcttccatgatacgagcgtggtggtctcctattggagaagttcgactttaagtactttccgatcaccggcagtcaatatctctgacgagattttacacgattcgccgaaagttggaccgtcatcggttgggaccgggtcagagttagactctgtagagacccgaatcggagaggaagtgaaggcccatgaataagcccatacaattacaattccaaggaaaagaagtatacaaagacacgttttggagctgcgtaaactgtccccataatcctttgccatcaacaacttcgattccggggactacaagcctctgtcttctctctcgtttagggttttattccaaaattccgtgcttcgatcccgaagatcagaaaaa

SEQ ID NO: 5985 - DNA, 3000 bp, Unknown
  misc_feature (1)..( 3000): cDNA_ID_2039305_gDNA_ID_1620835_Annot_ID_57969 3000 nt of promoter + ATG
taataattgaaatccaatatataaaattcatgaatcaacaaaagcaaaattaaagagaaaagtaaacgtgaatagattgagagagagaaggacagatgaaggtgggtgtcggccgaaccacggacaccggtcggagtctcaagacaaaggaaggtttgcgtctggggaccattcacactacctcaatacaacacccatgccaactccaaatccattcttaattctttttattttcagtaaccaaaacataaatctactaatatcatttaatggaactaatttagtttaaagctttttttaatgttgctaatgaaataagcaccttaagtatattctcccattggtgatatgttttcttatcggttggtttgggtaattttcgacacttttggaaaatggacaacccatgttgtcatttccctttagattttcttgatggttatggtgtggctagtttttttttttcttattttcttatttttggtatttaagaagagaattataaaggaaagagaaataagtgtatagtttaaaaggaaaaaaaacaaaggaatgtaaaggcaaatacaagtgtatcccggcattagtttggttttgcgtacttgttgttgtgagcttcatgttctttagcgacttttcgtcacgttatctttggttcccttcacttattttttcaatgtaccatttgataatacatattttttcgttgtttctgaaatgcaacgtataatcttggcgtgattttacatatttttaaagaatacacgatgaacaacaataacatgaaacaaatgtctaagattatactctcccggaggagaacatgcattcacccatcctaatcctatgaaacagttattttacgttttgaccattgactctagagtagcagctgtattaaaatctggtacaaagagatttcacgacacattttaatgcatggcatcagatggatgccatttatgtcgcatacgctacccaaatatgcacaccatcaattaggctacatagggccataggatcgcatgcccaacaaggtcagacaaaccaacatcaaagtctacgtactaactttgcagcagcaggcgaatccaacccaaagaccaacaagtatcaagatccaaatcatgtaacctctataaacatctccttaaggaaagcaaatcttgcagttcttcaacaataacggccagtttaagctaaaacaatgaaaccatgagagtgctcactattcgagatgaactatacaagaattaatgtctcgatgttaatagtatattatctacgatcacaagtaagaaagctaacttgaataaagcaaggattcatccgcgtttgcttagaagtcttatctcgagttctagcctcattcccatcgttttgcctttaccttctcaaatgcattcatcttgttgatcctgaaaaactatatccttcagatacgaaaatgaacaacaaaggtttttgctttaatgcttaaaacctaatttatgtttgccatgtccttggtcatttccttttctctccatttgccatcctctccaatcaccttcttcaaatcttttaggctcctaaaaccatcaacgttgatgcatgatgataataaaggcaaactcaaatatcgcaaatttgcaactgatattagcacacatttttgcagtacatagactatatttgtattaattactctctattcccaaatttgttacacaatctctttcgattcttccaaaatttgttctgctttgacttctttttatttttttgataaacatgtgaagattcataccaattttaaagtttctacagagtacagagattcaacgaaaaaagcagaaagcagaaatctacaatctgctttgaccagctttgctttcataatttttactgtacagagaataataaccaacctaaatcagaattcaatatttcctctaccaacaaaaaagataaaccctgaaacgttttgtaagagaatcacgtgagagaccacgtgaccatttttttccctaagcatcgttaatcttaatgggctcaagaaaagtttcttaattggatcttattataatactgttgagtgagccttagtccattattatgacgtggcataaccctgccactttcagggtatcgatccacatctgccgttaaaacagtaaaccgccgtctaaactttatagcaaagaatctggaccgttgataaacccctaaataaacgggaggactgataacggagaacgtgagcatcctctgacaagaaaaagacaaaaaaagaagaagaaaaaaagcacatgacatgattctttcaccaccctttcgtcttccactctcatcaatctagattctcttctctcttctctatattccaaagcttttacatttcttcaaatcttattttccttgagatcaattatggcaggagagattcaggacccgtttagtcttagttttcaggtaaattcttctactacaatgtcacacttttacttgtttttcttctaactcttttcataattgctcttgacgaatcttggtaaattatgtatgttcgttttaagatcaatctaaatggacttgaaattctactgttttcagctttacttcaacgaaatttgctaaatttaaccgcttagtagcatgtatgcagagtagtgcttcatgtcttgggaaaaaagtcaattgctaggtcacattttgttagatttgtgtattcagtttgattaatgtgtttaagaaatgctaggtcttaaatttatttaatgtttattgtggagcactcaaatgaacataggcaagactctgaatgtatgtaatacgttttagcattgttcttattggtttgatgaatacaaactacaggggaactctatccactctggatcgatatcctttggaagattcgagaaagagggtttatcatgggagaagaggtcatctttttctcacaataggtatcttgaagaagttgacaagtgttctaaacctggctctgttactgag

SEQ ID NO: 5986 - DNA, 3000 bp, Unknown
  misc_feature (1)..( 3000): cDNA_ID_3079122_gDNA_ID_1620835_Annot_ID_169874 3000 nt of promoter + ATG
gtaatactgcgagagaaatcttatgaaagaatcgaaatgtgttttaaaaaaattaaagttttaagttttttttttttaatattgttaattttgtttagtgtttaagattatataattatattataattgttaattataggttttttttccgtagcatatcatcctatgttataatccactcaaacccgtcacaccatataaccccgtcccatgaaactaaacacaaatttgtcattttattataaatttcaaatatgtataaaattataaacttcaaaaaagattaatattgacccaaacttcatcattgaattttgagtgttatatctaagatttctctcgcagtatatcgtctcatattaatatcttttatattttgagtgttatatataaaatttgaaacttaaaaaaatacaatatcgaccttgattatatttaagacttttcctgtaatatatatcgtctcatattaatatattttatatatatttataatgtttaaatttctttaaaattcaatttataatttttaaaactttataagttttaaaattataaatattcaaagaattttttaaagataaactttataaaaagtttttaaaattataatatttaacttttgataaagttataatatttataatttcttgaaacattttaaagtttcaattctttaaaataaaaaaacccgagtaaatcggataactattttaattttggacgcctgataaatcaagcttcctgctcattcgtaatcagaatcattttggtccttttataatatgggtctgaaccattgtccaatttttctaagcgatgtgggacattgtacacatattatttcttcataggttgaataatatatgtctgttttaaaaaatttaaattacatcatatgcagaaaaaaatataatattttattaactatatatattttatataaattcaaaataaataaagtataagatcaagtaaaagtgaaagaagaattatatatttatgtttaaattaggtagaaatattttaggaaattagttaaggtaaataacaaatatggttagtttagagatattgtttatattaaatttggtaattaaatcattaattttcgtttttaattattagtttttaggtaacttttccaaaaattaatgttatccaagatcagaacagaattaaacatgttatccaagatccgaacagagttaaaccgggtaaaacccacccatttgaattaattgttgaattatggctcaaatcttcaacattatcttcaaaaaacgtttacaaaaatgtatatatagataactacaatataatacggttttcatagtaacaaaaatatatatctatttatatatagatattttcgttacttttaaaaatatatcgtacaatgcagtttaatcttaattcaaaatactgcaaattaattaatgatacacaaataatcaaatgcttttaattagcctatcaatagagtattaacacattttttttccttttttttttgtgtgcaagctattatacatcttgatatgcaagctattataattaaaacaatcataaagttagatcatttctcacttctccaattatatatgtatatttcaaaagcgtaacttaatcataatttcgatattatttcatttacaattcataaatttggttatcttttcgttttaatattttctatagtaaaagaattatgaagaaatttgattagttaatgcttataattttgattttttcatttacatgtcataaatttggttatcttttcattttaagttttcctatttataaatattaaacagtaaaaggattatgtaatattttgaataattaatgctttcattcaatatcagattcacatgtttgttgtggaaattaaagttttaggaatattatgagatcttctataattaataatatactcattaaataggtttatatctgctgttggaaaaaatgtgaatcaaaaagaaaaagagaaagaattttggatataaatttaaatttatcaaaatagttacacaaaaaaagaataacgccgttgatgaatggtgaccaattgaaaacggaagcttgaagatggagtcactgtcctgtcaaataaaaagactttgaaggtctttgtcatgttttttcttcaaacaaataaatacttaaggaaaacaaaagttatctatcaaaccatatatattaaaaaaaactaagaaccctagttgaattaaaaaataaagaaaaaaaaggcaaggtaaaggggaacagaggagagagaaaaaggtgtgaacagttaatggcggagcagtataaggaatcgcttctctctagaaatcttttgccatagctggatttcatttttttgatctctctctctctcttctcttgtaataacaaagctcacaacataaagaaattattacagaacaagcaagcaagaagaagaagaagaagcaataaaaattagtgcttttttatttagtgagagagaaaagctctgaagaagaaggaagttgttttcgagatgcgagctagtaaaggaaccttctctgtacttcttctctttctccttttgattctcattctgcccagtctttaattttttttcctttttcttcttcttctttcttcttcttcaatttcactcttgttgggtaagtcaagaatcgtccaaagtctttttttttttcttgggttgtttggtattggatctgtttcttggttcttttaaagattggctaatactttgattttggggggttttgatttgatctagggtttctagttagagtctgaagacctttggatttgatgtaggactttgttttttgttctaaagttaaaaaaagaagaaaaaaagaaaaagaatctgttttctcatccaaatctacccaccatttttgttgtgggaggtttttttttttattattacaaaaagaaaaatatagagagaaggagagatttgttttaaagtaaatattttgattgttt

SEQ ID NO: 5987 - DNA, 3000 bp, Unknown
  misc_feature (1)..( 3000): cDNA_ID_3079134_gDNA_ID_1620835_Annot_ID_169870 3000 nt of promoter + ATG
aacagccgctccaaactgctggtcaatgggatacaactctcctggtggacccgtcatgtatatgtaagtggacggaggcggtggacaataagacttcttcggcggtgaaggaggtagtggtggtggaggacaagcttgagacggcggtggaggtgatggcggtggaggtgacggaggaggaatgttttgaagacatggtgtacattttataggatcctcttcgagttttctattggttgatgaatctgaagcgttgatgatcattggaaacgtgagaaacaccactgtcgtcaagagcgtggcggcgagagcctttgtacggcgagttttctccggcatggtgagagttgttatatgcctggagaatcgaataaagagaggtttgggaagattctttggttggacgtaaaaagagttgaaaatttggtgaggtggtttggtaagagggtgcatgggactgatatactagctagtacttcttcaagactataaatttctgtctaaattttgttttttattttatttctattgataagatacaaaaatactttacaacatgcaagaatcaaaagaagaagaagaatatattctatagggaaaattgaaatcggctcttagttacatgtgagttggagcttcaaataaggggtcccatatggaccatctaacataaaatcgtgttacttgaaatataattaaatacaactatagtggaattattagcctttaatccaccgtcgtccacccaaaaataaaatattcacgaatttatacgcttaaaagcttccaaataattgttaccaataataagaacgtttgatgacacaatgattgatcgtaatctgaattaaaaagctaaaagcataaatgtatatgactctgtagcctgtaaaatcgttgctaaagcgtgaattggtcgctttttctatcatatgataatccttaattgtattgtattagatgagaaaaaaaaaacgttacgatttggtaatagtagagaaataataattaggaaaaagactatactacagcgtctctatactgtattccatgacggttcttttggtagcaattgcacatgcagtgagaataaatgaatgagttgacttacggccacatactacgcaacgcaaattgctccaaagatttattataacagatatatgttctaacaattacacaaactttaatgctcttatttctgttaagaaaatgacaaagtagttggaaatctattccaaagctggaaaaggggatatacatcgaccgactcaatgggctgaaataaggactttagcccaaatcaaaaattaattcggaacaaagattagcccatatccaaatttgttactcatatcctcctttttttcctttttgataaaacgtaaaaagatattccaaatgccattgttttgatattattaaaaaaggtcgttacaagcatcagaaaaaacgaaaacgcaattacaaatcgatgcttcttaacgaacattgttcccctacaaaaattatccaatgctactttatccaaaacgtgaaaaccatagctagagcagaatctatttcttggaccagaagtcacagaagtgttgagacttggaagccagagttttctatctgcttaacaaaaacagggtcagtgattcctcattagtcacagtccgagtctcctagagatgcaaatccaaatatgcgagattcagattcttcgattctttcccacgaaaatcgatatagttcagtagctgctttgagaatagaactcaaagcttgaaagcggtagagacatctgtgaatgccaatcaggcgtttggttcaagtcgaaattcatttgcattgattggttctggaacaatggttctgattggaactcatagaccatgtcatcgaccattgtctgtagctcttccaagctgtattgcttttcctgcacgtcaatattatcaaaccgtttacttgtgtgagaagaaacaaaacaagatcagtgaatttatgtacaaaaatgagatttacctctcttttagtctgagacataagtgaaaccatctcttgaacaaaatcgaagtacccctattgtagtgaacaaaacacaaacatatcagctttttgtaataaacaaaaacaaattataaatatttgaaaacaatcacaatttgaagtaaccatgcatacctcatcttctccagaatcatagagtccaacgtcgtacgagcttcgtttcctctcatccgacaaaactaaacacaagaaaattgtttccagacaacaatgtcagtcatcggacaagaaccaaaaaacctcaaaacaaagtctgaacagatctttacctgaataagcttcttgaatctgctggaatcttcgtttagcttctccagatctaaaaggatctttcgtccaccggtcaggatgccatatcttagcaagcttgtgatatgctcgtcgtatctgctccgccgaagaatcaacggcaacaccgagaatctcgtaatacgtttgcctaatgccaccttccattggttattacgtaaataagcttaaagcattacactttacgaagagataattacttgtaagtgtggtttggggtttatataaaacaggagttgtgttccaatggcggttatatggaagaaagatttttacaaaagaagttctagaagatttcggcttaccaaaaatatcttgtctcaagattcaagaacgttcgggaacatagtaagaaggcagatattatccacacaatctttagatattttttcattggacggccgcgattgaatggacggtcgcgtcatgatcttaacatgacacgtggttttaaataactttatttggaaattgtgagatttgttatgttttttgtagtttaatactttacttgtggaagcagacaagtaatgcttattcacattcagactcggtgaacaagacatggatttttcttatgcacattcaaatctatcttttggctaattatctaaaaagttacgtaaacaaaaa

SEQ ID NO: 5988 - DNA, 3000 bp, Unknown
  misc_feature (1)..( 3000): cDNA_ID_3079138_gDNA_ID_1620835_Annot_ID_169869 3000 nt of promoter + ATG
aagcatgcttgttgaatatacacatgagcatattaagagtcgttaatccctaattaaggagtcaaaagtttgcatttttttttgctttttccctttttttttttgataattctgtggagctaagcaatatgtgatatattaacaaaaaagaagaagttaaatgtgatgttaaagccaaagccaaggtcgaacagacaacgaagataagatggaaccagatcgggactgctcctttgacaagtgtttgcactgaattcaaaaactttgatgggcttatacatatcattatatatgtgcatggttcgatggagtggaataattagataatatttctaatagagaaaattaattaatagaagcggaagatcgaggcatatggacctcaaacactaccaaccccccaaaacccaaaaccaaaccaaactcacacctctatgtttgtctctttgtctactctccaaaacccttcgggtaggtgtgttttcgacgtgtgattcatgtcttcccaccattcctttaatttacgttgattttaatatctaattcaatttattaatttgtttttataaataaatttgattacatcgatttgattttgttctttaatttttagtgaattttgatgtaagtttaataactaccacatcgaaagcttgtatgcatgcatttaaactaaacggcaatatacgtgaaattatacaatattgaatcagtacagatatcttgaattcttgcatagattaaataaaacaatgccgaaccgacaagaaaaaacgtggcgaaaagattatagttgcgttatctaattataaacttagttttgaatttttccaatacatttttattaatgtttccgatattttagaccttttcttttatcaattataacgactacatctttctcccttttcatgaatcgatgcagaagtagttaatagtgactttagtaaaatagaaaattatcgttgaacagcaaagcaaataaacattaccgatcgagatggaacaacatcttgaggtatctccaaatacgtgcctatgccaagtaagctgaaacaaagtttcccatgttttcctatttcacatgcgtctcatccatatgacaaacattttagtcttcgacagtaaaaaaaaaaataataataataccgaagaggtttcgtagggtaaacatgaaacacgaagtgataattcaaaattgctagacaaaaagaaaaggtttcaatttaacataaacaataaaagtgaatactattgcactgtatgaaaatgaaagcattttttaactggtttatgacttgtataagagagtgaactatcttattcaagtaataaatatactgaagcatctttttcaagtattaaatatagtaaatacttgaacaatatatgtagtgaagatatctaccatggtctcaattacatttaatataaaaaaatgaaatgaagacatatgctagtgaaaaaggaagagaagtattagagcaaaaacgaagtactggtttacaaatgattgtatatatcgacctaggccttgacattcaagtacttgagttgggtccgggtctctccggtaaaagagtccattatccaagtaaattaaaaaattggcttggtttcggtttagattctattaaatttgggttggatcggatataaattttcagaagcactaaatacctgttaaaagaacttacaggtataaattaggatttaagataaaattttggatattcgagtattttttgattcaggatctagttagaacttttagataaagggttttgagatccaataagataaatctaatttttgagttcgaaagggggttaaatttttgggaccatttccgcttccggttaggatactcattccagtttttatgttcaaaccaacaccaatgtgttttgtcgtcagtttcaactaacaataccacttttcaagtggtcttctttgttgaagttaggtagactgcgtctgtaaaggctcattagcccaactataataaataataggtacatattaacagttctttgatctgacctaaaaaaacaaaatttgattgacgaaatagttgttatacacaaccaaaaaaaaaagattgaagaaaaagccaaatttttaggtgcgagtgaatggggaagtatcacagtaatcttgattatttgactttaatattattctaatctttttcgtttcattttattttacttttggtacaatgcaaagagactaaattagattaaaatttagggacaaagagagttcagttaatttctgctggttttttgtttaatgtccaatctaacatgtatactatcagtctatcatgtatttatttagtcatcgtaaataactaaatgtctgaattttataactacatcgcaaatatttggtgtagatgccaatttttcatcaaactactagactgctatgtttgacagtttgagtaactattttcgtaaccaaccctataaacaaaaacaatagttcatggtctaaacccaacattttttgtttacgtaactttttagataattagccaaaagatagatttgaatgtgcataagaaaaatccatgtcttgttcaccgagtctgaatgtgaataagcattacttgtctgcttccacaagtaaagtattaaactacaaaaaacataacaaatctcacaatttccaaataaagttatttaaaaccacgtgtcatgttaagatcatgacgcgaccgtccattcaatcgcggccgtccaatgaaaaaatatctaaagattgtgtggataatatctgccttcttactatgttcccgaacgttcttgaatcttgagacaagatatttttggtaagccgaaatcttctagaacttcttttgtaaaaatctttcttccatataaccgccattggaacacaactcctgttttatataaaccccaaaccacacttacaagtaattatctcttcgtaaagtgtaatgctttaagcttatttacgtaataaccaatg

SEQ ID NO: 5989 - DNA, 3000 bp, Unknown; identical to SEQ ID NO: 5984
  misc_feature (1)..( 3000): cDNA_ID_3079143_gDNA_ID_1620835_Annot_ID_169865 3000 nt of promoter + ATG

SEQ ID NO: 5990 - DNA, 3000 bp, Unknown
  misc_feature (1)..( 3000): cDNA_ID_2039305_gDNA_ID_1620835_Annot_ID_169860 3000 nt of promoter + ATG
aatatttaatatgttaaacaataagatagaattctaagataattgaccacatgtctataaataaatttgataaaatatattcatacatagaaaaatagcatgataccaagaaaaataacgtgtcttacaacactgagaggatacagataaacagtataaatgagatacctacgtaaaaaataacatgttacgaaaaatgatatgtatcgaaatagtcaaatgaaaaaatgaaaagataatcgtccaacatggtcaaaatccacttttatcatatgtgcaaaaaagtaatcaacgagtgataatatgctgatatttgttacaagaattcgaatatgagatatgtgtatattgacatattgtgctggatagataaattatattagggttaactttacaagcatattttccttatgattactaattttcacatatatagattttatatatgactatcagttagtcaaggatttttgtgagaataaggtaaatggagaactgaaagaagataactggggaaaagtttaatgagagggtatggtggtgtcctcgtgtgcgtggctgcattctcgtggcatgccatctcaatgctaataattgaaatccaatatataaaattcatgaatcaacaaaagcaaaattaaagagaaaagtaaacgtgaatagattgagagagagaaggacagatgaaggtgggtgtcggccgaaccacggacaccggtcggagtctcaagacaaaggaaggtttgcgtctggggaccattcacactacctcaatacaacacccatgccaactccaaatccattcttaattctttttattttcagtaaccaaaacataaatctactaatatcatttaatggaactaatttagtttaaagctttttttaatgttgctaatgaaataagcaccttaagtatattctcccattggtgatatgttttcttatcggttggtttgggtaattttcgacacttttggaaaatggacaacccatgttgtcatttccctttagattttcttgatggttatggtgtggctagtttttttttttcttattttcttatttttggtatttaagaagagaattataaaggaaagagaaataagtgtatagtttaaaaggaaaaaaaacaaaggaatgtaaaggcaaatacaagtgtatcccggcattagtttggttttgcgtacttgttgttgtgagcttcatgttctttagcgacttttcgtcacgttatctttggttcccttcacttattttttcaatgtaccatttgataatacatattttttcgttgtttctgaaatgcaacgtataatcttggcgtgattttacatatttttaaagaatacacgatgaacaacaataacatgaaacaaatgtctaagattatactctcccggaggagaacatgcattcacccatcctaatcctatgaaacagttattttacgttttgaccattgactctagagtagcagctgtattaaaatctggtacaaagagatttcacgacacattttaatgcatggcatcagatggatgccatttatgtcgcatacgctacccaaatatgcacaccatcaattaggctacatagggccataggatcgcatgcccaacaaggtcagacaaaccaacatcaaagtctacgtactaactttgcagcagcaggcgaatccaacccaaagaccaacaagtatcaagatccaaatcatgtaacctctataaacatctccttaaggaaagcaaatcttgcagttcttcaacaataacggccagtttaagctaaaacaatgaaaccatgagagtgctcactattcgagatgaactatacaagaattaatgtctcgatgttaatagtatattatctacgatcacaagtaagaaagctaacttgaataaagcaaggattcatccgcgtttgcttagaagtcttatctcgagttctagcctcattcccatcgttttgcctttaccttctcaaatgcattcatcttgttgatcctgaaaaactatatccttcagatacgaaaatgaacaacaaaggtttttgctttaatgcttaaaacctaatttatgtttgccatgtccttggtcatttccttttctctccatttgccatcctctccaatcaccttcttcaaatcttttaggctcctaaaaccatcaacgttgatgcatgatgataataaaggcaaactcaaatatcgcaaatttgcaactgatattagcacacatttttgcagtacatagactatatttgtattaattactctctattcccaaatttgttacacaatctctttcgattcttccaaaatttgttctgctttgacttctttttatttttttgataaacatgtgaagattcataccaattttaaagtttctacagagtacagagattcaacgaaaaaagcagaaagcagaaatctacaatctgctttgaccagctttgctttcataatttttactgtacagagaataataaccaacctaaatcagaattcaatatttcctctaccaacaaaaaagataaaccctgaaacgttttgtaagagaatcacgtgagagaccacgtgaccatttttttccctaagcatcgttaatcttaatgggctcaagaaaagtttcttaattggatcttattataatactgttgagtgagccttagtccattattatgacgtggcataaccctgccactttcagggtatcgatccacatctgccgttaaaacagtaaaccgccgtctaaactttatagcaaagaatctggaccgttgataaacccctaaataaacgggaggactgataacggagaacgtgagcatcctctgacaagaaaaagacaaaaaaagaagaagaaaaaaagcacatgacatgattctttcaccaccctttcgtcttccactctcatcaatctagattctcttctctcttctctatattccaaagcttttacatttcttcaaatcttattttccttgagatcaatt

SEQ ID NO: 5991 - DNA, 3000 bp, Unknown; identical to SEQ ID NO: 5983
  misc_feature (1)..( 3000): cDNA_ID_1989705_gDNA_ID_1620835_Annot_ID_169857 3000 nt of promoter + ATG

SEQ ID NO: 5992 - DNA, 3000 bp, Unknown
  misc_feature (1)..( 3000): cDNA_ID_2992212_gDNA_ID_1620835_Annot_ID_169853 3000 nt of promoter + ATG
tcaactgctcatgactaacaaatccatctacacatctccaaagtgtacaaaattttgtccatttcaaacatattttaatagtttttaccatctatactcaaattttacaattccatggcaaccatttacaactagtataaaccgtgggtctgtaagaataaggccaccacaaaatgttaatacgcaagacatcttcggattcagaccattttccattcgttatttaaaaaactaatgtatcagttaagtaagagtaaaaataggcagtatagtacaattggaccattagtcttttaaaatccactaaaatttaccatttgtagtaaacagtacacgtattaaaataagtttaccgccgcagctgataataaaaagagaggaaacaaaagaggatggaaaaaaagaagtgagaaatggatgtgaaaaaaaaagtttgcacataatcaaagtttgactttattcatatcatccatattttattatctaacttattttttataaatttgtcgtcattgatcactttatcttgcattttcttctacatgtttaacattttttttgttcaaacatgtttaacatttaaaactagttaatatgaaggaaataaacggattgagtgagtgatcagggttaatattatttgttataaaggacacatatggagaagagaaagaaatggtcaggcctcagggctgtgagtctgtaacactgtccatcttctttattgctcccatctgcctctcttctctaccttttccttctttattatatatattcctcacttttctccatcttcttaaatataggcattcccgtcaataaatgtgtataatctcgattagtgattcatttccgggttttaaacattggtaagatgttttttgcaaatccactacgaggaaaacatccaaccgaagtctaaatgaccaagtaatctatgggttgtgtttttgcacttgcacacaatgaaatcgaacatggttccgtagcaccttcagactttgaaaaatataaagaactacgtaattcaatagattgtctcaataatatagcaagacaaaatcggccgacaaacaaaataaagaagaaaacataggggaaacttgaatttcaaccaaggaagacccaaccacgtcagaaacaccttgggaatagtgtaactagatttaaatatttgtgcattacttcttactataccatcaacactcttataaatgtattaccacgacacataacggtcttaattatgatgcaccttttttagcactcccaaagattctctagctataagtatcggtcgaaagtattcattaatgcactatttgttttacctaagtttgaattcatttcataagaatgtgtgttcttaattaattttggcacactggtcgctcactagctattttcttctttgggcatagcatttagccttttagtatatatagaaactagttaatgttaagaaatggtgtttgatcattaatgatttagcaataacttgtatttataaccaaaaatgacaatttgtattctaagattttgtctttatctttttcagcaatgtatttgttttatctcatgtatatatatttttttgtgtgcacttgtgttctcttttgtgttttctcacattcttgtgtggatttttatttttttatttttgtgtggatttttttatattaacattccaattaaatttgattttctaagcagttctttttttttgggttaattttctagctacttaatcaattatcaaacattcttgataaattttaaaaacaaatctttgtttatgtacatgtatattaacttctcttttttactcgtgttggtatgaagagaaaacgatgtatgtaatgtgtacacggacaaaaactatagatcaagacatagcctataatgatttatgctagtgttgttgatgtgtcactatttaaaatttaaatcatgtgatatgtatatgtaggttcaaatttgaaagatatgtgacctaatcaatgtgagcatgtgatccaaacaaatgattagtacaactaatatttttcattttttggacaaactatataatttattttatgcatgatcaattttttgtatatatatttgcaactaccatagacatgtgaatccgaccacaattgttatcagacaggtcatgtatcacattggtgacagaaacaagactaagcccgtaaggtagcaacattgggctcaaccaaattcggcccatgaatttagactagagaaacagaaccggattaaaccggggattcggtacgaggagaaacagccgactgttgtagaaagaatatgccaaaagagtcaaagattcgtgactcatcatctctgtcgctgttccttttcttcttcttcttctcctttttttccaaacttttctctctgttacttacttccattattttcgagcttattcttatcttcatcgcttaaggttcgaattttcgaattcgatctctttttgtagctataccaatcacaaggtccgttctctactcaaatctcgcatattccttatgtcatcactgagctaaatcttttctgtattatgattcaatcgtgtctatgctttgtctctgtttctccggtaacctaattcgttgcaaaattaataattagatagaattcgaatctattgcatgcttaccagatcaattttggataaattgaatccagtaatttacgaaactcttggaacaattagtgttaatcctatgaattcttgttgttttaaacagttagagcaaatctaattatagatgacaggatcttaaaacgacttgtacctaatttctcaatctggcaaaacttaatttattagttagttgattagtgttttttttgtttccaaaattgcaatttattgttaatggtgaatgtttttattttcttgtggtgattgtagcagtagctgaaatcaatagtattaagccaggctagctagaccagcaagtaaatttgctggctagcaggatcctc

SEQ ID NO: 5993 - DNA, 3000 bp, Unknown; identical to SEQ ID NO: 5982
  misc_feature (1)..( 3000): cDNA_ID_1572397_gDNA_ID_1620835_Annot_ID_169849 3000 nt of promoter + ATG

SEQ ID NO: 5994 - DNA, 3000 bp, Unknown
  misc_feature (1)..( 3000): cDNA_ID_3079158_gDNA_ID_1620835_Annot_ID_169848 3000 nt of promoter + ATG
ttttggaatgcaagtttgtttgttgtcttgtgggtaaaaataagatttattgactcgtaaaaagtttctgatgggtcttcggatccttctaagatctggcactattctttcctctaaaaggcaaaagcttttacaagaattctctttttctctctctttctctctttgtctcggaagtcgtaagcaaaaaaagagtgtgtgtggtctgtagaagaaagtacggcaggaggtattaataacggctgtcacctctttgagtttattcgagggaagagtcttcgaaagcactctcttctctttaccattctatctcactttttgtttactaattacgaatttggacgtactaataattgtaattagggtttttcttggtaatgacgatgagttgtttatgtttgatggtgaaacacattggccaatgttcttttgaggcattgactttgtaggtttagacagctcactgtgcttaaaataaaataaatgttagcaccctacttttctttttttgtcaattattacggtcaaagtagatgagattgggacgttatagccaatttttttatttttatttttgtgaataccatttaatcccccggttatattagtatattactgttacacttactgtattcagtttcaaaatgatacaacaggtgatgtcttgactctttgaccaaaaaaaaaaaaaagtgctgctatctgattccaggacttttatataaactgataacatcatatgatttttagcgtagcagaaattatttgtgaatgacaaactcagattctaacatcacggtcgatcttaacgatatcttgtttcattcaaccatgattaatagcttatgaaacaatacttcaaatatcacaaaaggaaaccaatattagttatcaatttttgtttttggaaaagtaagcaatggtctctacagctctaaaaacagttattgtgtatgttttcaacagaattgttcatcaaatcttgaagagttttataactataaagtctataatctactctcattcccacgaggcccactacaatcgtgccttgattcctcctctaccactttcggtgggctttaatctattgggctaaaactatcatcttggattcaattatatttttcttgtggggtttaatactagagtgtactaattgtaaaaacattggtaactcttgctcatttacatcagaaaacctcttattctcacgaaattttcaacacacgacaaagaaattttgataagctgaggagatatttggtaacgcctcacgcaaatgaacccatgtgaataaatatgatcgatcaataatatcatatcatcaagataagacgcagataattgtaaacatgatttattatgaatttatgataaggtcccgaaactattcatgatattattttaacgatcaaaaatggttctatcatttaatactttctcactcattcttctacaaatagaggctaaataactcaaaaagaaaacacactcatctcctaaattccttacataatattttcttaagataagcaaaaaaatcatggcagaagcgtctagtttggtggggaaacttgagacagaagtggagatcaaagcttcggccaaaaagttccatcacatgtttaccgagagaccacaccatgtctccaaagcaactccagataaaattcatggatgtgagctgcacgaaggcgactggggcaaagtcggctctatcgtcatctggaaatacgttcatggcaagtacatcctatatatattttcctttgcataactagtggattcatgttgattcgtaaatttaaacctagggaagtaaaatgttgaacaaatggtgcagatggaaagttaacagtggggaagaataagatcgaggcggtggatccggagaagaacctgatcacgttcaaggttttagaaggtgatctgatgaatgagtacaagagcttcgcatttacactccaagtgacccctaagcaaggggagtcagggagtattgcgcactggcacctggagtatgagaaaattagcgaggaggtagctcatcccgaaacccttctccaattctgtgtcgagatctccaaagagatcgacgaacatctcttggccgaggaatagaaaaatactcctcgtctgtgtgtgggtctttgaaacttaagcaagtctttgaaactgcaataaataatgaacgggtccgtctttatgtaagagaaaagagatatatatatatgtgttggtgtgtgtaatgcgtgtatgcctactactacggttgagttatgttggaatagtaaaagcatataatctattttggttcaagtgtttgactcgtagtgaacttgagaaaaactctttgttcaaaggctatacaaactataaaaactagcgatccaaagttttatttttctatttttggttcaaatactattttgtgctgacatttttccgacaaccatatctcgatcttatattgtattttcatctattaccgctttttattattattaatttgtgttattttgaagagaaacttgatagtgaaagaaacaacatgaattgtgtgatcgatcaataatatccatatagtttggcaggttaaacgtcaaataaagtattgggtaggtgaattataataacgggaccgtgatgacatggtgctactaattaaagctaatcatgatccttaccaaaaaaaaaaaataaagctaatcatgatatgattttaagaaacaaaaaatcgatatattctttaacaccttttttttgggtaaaattattcttcaatactttctcactcattcctcttcaaattgaggctaaagaactcaagaagagaaacactctcctccccttaaatcctttacttatattttcttgagataaagcaaaaatcatggccgaagcgtcttagtttagtggggaagcttgagacagaagttgagatcaaagcttcggctggaaagttccatcacatgttcgtcgagagaccacaccatg

SEQ ID NO: 5995 - DNA, 3000 bp, Unknown
  misc_feature (1)..( 3000): cDNA_ID_3079161_gDNA_ID_1620835_Annot_ID_169843 3000 nt of promoter + ATG
taaaacctcacacttaatatataagaaaatcatatttacataatgttcttgtttttattaacaattcagaacatatatacatacataaaattaattttaaaaataaaaatttctattgtcccttttgtaccgtcccaattcttatccggaattgcacaaagaaacagaccatttttgcaagagacacggccagataaaacgatctttttcaaattgtggtgtggcaagtcctcaacgggagaaaacaaaaacagataaacatatgtttattatatcatttaaaattatgaaataacgtgtattccatttacaaaagatatgatctcatagagttgacaaaaaagctatacgatctttttggatgatttagaaatataaaatactgaatagtacatgaatcagttggcttatgaaatactgatactccttcaaaatcttttgtatgacacgagctacggactataatttatatggctatatatagccttagttttgacatttctttaaaaaatatcaaacaattaattctgctttatcatcagttagcggcagatggttaatgtgatcacataggagaatgacttgatcaaaatattattatcaattagccataaaataaaattcagtcttgttctcgctctattcattcctctcttaaaaggagctaaagaaatcagaaggaaccaatttactatttactctcagaacgcaaaaccctacgagacacagaacttagtgggagatcaagaatggcggaggaagtatctactttggttgggatccttgagacaaccgtagacctaaaatcttcgacagaaaagtttcatgacatgtttgttgggaggccacacaatatctccgatgtatctccatccaactttcaaggctgtgagctgcatgaaggcgaaatgggacaagttggtgctatcctcttttggaattacgttcatggcaagtcaaattcatttttctctatttatataaatttttataagattcatcgattttcaaatcaaaataaataggaaacgggtggattaactcatatgttttatatattactttagatcctctcatcttatttcaatgtgtgatttctaatactctcatacctataaatatacatcaacgttatattgatcagatggggaggcaaaagtagtgaaatagaggattgagtcaatagatccggagaacaatcgggccacatatagggtgttagagggtgacctaatgaaagagtacaagagcttcttgatcaccttccaggtgacccctaaggaaggagaacctggaagtgttgcacattggcactttgagtatgagaaaatcaacgaggaggtggctcaccctgaaactctcctccagtttgcaatcaaagtttccaaagagatcgatgaacatctcttttcagaggaatagaggaagagtcctcatgtatctatacatgtgtgtgtgtgtgtgtgtgtgtgctctttatagttcagtctttgaaagtgcaataaataaagactaaagagccttgaattgatgaagaaagattatgagtgtgtcatgagtgtttgtttactatcgtgaaagttgttagttttgaaaagtgacgaaataactcaaaatttatgctaagatttatggacgttcaatccaaaatcatcaattgacaatgaatgaatcaatattccaaaatcaaagagaacttacatatgtattagaaaacatgtgtttttactttttaacaagacaatatatataggccttgtctttcagccgcaaatatttaagaacccaatttttatctcattgtatagagattaattttattttacatctttaaattgacaagatctaattcataactaattcttactatatggaataacgggagttagtggagtcgaactccagtaaaaaagacagagtcaaatggactataccgtatttcatgtatgttagttattaataacactaaaaagcaggtgagatatgatttgataaataagcatcgtcttcaatttctgccttcatatatttaagaaccatttcgtatcatattgtattgagagattcaatgaagcatttataccaagataagaaaaagatatgtaacttgtacgatttagctcgcttggcctccaaaaaggaagaaaagtcagcacaaattatggctcaaataaagattttgtcaactaaataatgcgaataaaagattctctcaagattattaatcatcattgtattaaccaaagggccaaggccatgtgattattatactgtaataatcaaagtagaagactataggcataatgatgaaaatcaaagtgttaagtgataaatcaggttttgagttgtttttgacgacaggtttagttgttttaactattcatttttatttctaatatttttagatactattgcatgttttaatattttcatatcaatatatatatatatatatatatatatatagatatatcatatttgatgaaaaaagaaaaaaaaagatatatcatatttagcgtgaaacactatatattctttactgtcattttatctttttcttatttcaatcgttttgtaacgttgcatttaaggttgaaatggtaacattaggtgataaaaaagaggaaatggtaacaataattatatgtttaagtacaatagaaatgtatgtcagcaacaacctactaccacttaacaaaatcatatatacaagcagagacttagaaacagggaaaacgaaagttacaacgtacgtcgtgtatcataattcaaataattaaaagattagataattttatgaacaattcaaataattctacggctgagtcataatgatgggatcggaatcacatgaaacacaactaatcataaaattagtttaatgaataaaattcttaatgtcttcaacagttgctcaaccattccactacaaatagaggctaaagaactaagtagagtattcactcctctctcaaaaccctaactgtttccaagataatg

SEQ ID NO: 5996 - DNA, 3000 bp, Unknown
  misc_feature (1)..( 3000): cDNA_ID_4370980_gDNA_ID_1620835_Annot_ID_169841 3000 nt of promoter + ATG
agtttagaatcaatacattgcaaaaatttgttacaagatcgttaatctaaccaacgttggaatatgagttacatccaaactagagcagaaattggtttgggctgtacaaacctttaattatcttcatcaagaggtttcttcatttttttttaataattaagttgtttaaccttatatgatttaattgctacatttatagatacagttgcatgttacaaaatatttatataccatttttcagttttttttacggattttatacacatataatggaaaagaaaaagagaaataccctaaaatagcatcaaaacaagttttgtggacaatttatacacacactttacacattgccaataataacattaattgttgatacaatgatgaatctagttcataaattgttttaagacatattatttaggaagcttttcaacaattaagtaagacaaccctaaatattttcaacaattaagtaagaatttcctaaggatattttaatcttttaacactaaatttgtgctattttggaacattccaaaatgtgtgttatttgtgaaacaaaacttatttttgtgctatttgtgaaaattgccaaaaaagaaatccatatattgattctaatcatatttatccattaactttttttggttgaagcatgtttatccaataacatagttaatgactgttatatttgttttgcatagaactgtacgtgccttcatgaacgaacgacatgaaccgcgtaacatgcatgttttcttaaagatcaacaacactacatgccaataacaaatatgtcaaaacgagaatttgcagaaggaacgtacaacctaaaccgcgttatactgaatgatctctagatcatttatatgatcaaaacctaattcaaccgttatccattacaaaaattcagtaggtgagacaaaaagatagagtcatgatatcagaagggatacaaaattgcaattaataatgatttgttttcttcttcagccgttacctccctcaatcctctacaaaaagaggctaaagaactcaaaagggactcattttctctcaaaatccttttaattttcaagttaaacaaagagaagaaaaaaatggcgactaaaatggccggggcagcaatgaatttagcaaagagagagtcgtcaagtttgtgtgggaagctagagacagatattgaaatcaaagcttcagctgggaagttccatcacatgtttgctgggagaccacaccatgtctccaaagcaactccagggaaaattcagggttgtgagctgcatgaaggtgactggggcaaagtcggctctatcgtcttctggaattatgttcatggcaagtgcaaagttatattaacttttatcggaaaaaaaagttctaatatctacatagaatatgttcttaaacttaatatttttatcaatgaaaaaagtgagcagaaatgcatacttgatgtgaacttctggccaagggcacatctcagtgtcataaatccttggctccccatttcattacaaaaaacatttattcgattcttacaatcaaatccacagatatgtaatgacaaaagtatagattaattaaattttatgtttataacatttttgtgaattaatattcataccgattttttagtcaaacccaaacaaatatatttggtgcagatggagaggcaaaggtggcaaaagaaaggatcgaggcagtggagccggagaaaaacctgatcacttttagggtgatagagggagacttattaaaagagtataaaagctttgtgatcacaatccaagtgacccctaagagaggaggacctgggagtgtggtgcactggcacgtcgagtatgagaaaattgacgacaaagtggcccaccctgagacctttcttgatttctgtgtggaagtctccaaagagatcgatgaacatctcctgaacgaggaatagagagtactctttaattgagtatctatcatatgtgtatatgtatgttatgaagcacgcatgttcttgtgtatgatacaataaacaaggagagttgcccaatatatgtgagtgatacataaaagctttgtactctaaatgtgagtatgtcatgtttggttttaataaaagcttgtgagatatgtttgtggaaggctcgtctctctgatatcatgaatgttgaatgttggaatcatccatttctgatatcatgaatgttggaatcatccatttctttgcttccttgtttgagtcttttgttgtattagcgagttctgggggcttcatgtaacaaattcgaaaaacgcgttattctcgttaataaagcatactaatatggaaaacaaagttagaatcaatatttaattagccaaattagacgtaaaaagaccaaaagaacgtaactattgatgcacacacatgtttagcgtattcagatatgagtgtttgtagttgtcactgaaaattgtatcgatcttacctattttctctcaagataaacgtgtgataatgtgttattcaagttttcaatcgagaatccattgattttaaagagaaagattttacaattttcaaaagttatacgagtgttgggaagagtgttgtctaccgacatactcatatcacaccattttcaacacctagtctaccaaaaacaaaagtgagcatgaaggccaaaatgatctaaaatggcattttgttactctcattattattttcccaattattagactctatctataaataaatatttttctatatccgcagaaataatggtataagaacgatcgatataagtaaggaggtatagctccagggtaaattccagttggactatggacgcggtcacatgaaagaagaaaaaatgagagattttgttattagttcttttgtaattaaagttgtgaattgtagacaacattgatctaattcgattgtttatataagcgtaaaaaaaatataactatgcgtgcataatgacggtgtgcttcaaagaaaataatatttaacgaacaatg

SEQ ID NO: 5997 - DNA, 3000 bp, Unknown
  misc_feature (1)..( 3000): cDNA_ID_1989708_gDNA_ID_1620835_Annot_ID_169839 3000 nt of promoter + ATG
agaccttttgaattcacctttccttttcttttttgtttctttcttttaataagctgatttaagtagcatcgttgaatttgagtcggtgattgtttgtaagtgaataagaaaagtagtagagtcaggagacaggtgtgctttctcttcaaagctcagaagcaagatggagaaaacagaggaagaggttgagatgaaggaactggtagggcttgtgagaatcctagtgaagagagggatcgatcttgctcgtcgagacgctctaagcagcgacccttttgtcgtcataaccatgggtccacaggtactttttctctctttctgattctaatctgatttggttctcttctgtttgatgtttctatttctgttcttgagatgtatggtttctctgtttactttcttcgcagatggaagaccaaagaatcgacctttaagaaacatgattaataatcatttaaaaagattttacatttcatgctacaaaatgaaaacaatctatagctataggatgttgtgttgcattcgttctaactgaaattggttgtatctttgaattgcaccagaagctgaaatcttttactgtgaagaataactgcaacccagagtggaacgaagagttgactcttgcgatcgaagatcccaatgaacctgtgaagctggtgagtactagtacccgtcagtaactaccggaatcatgaattttcaactcaaaaccaactgatgataagtggttggttccatatgtttttgtttcgtatgagtgcagatggtgtatgataaagatacatttacagcggacgacaagatgggagatgcgcagatagatatgaaaccgttcctagacgttcacaaactcggtttgaaagaacttccacatggaaaagagctcaagagaattgtgcccaccagagataactgcttgtctgaagatagcataatcgtctccgataatggcaagatcgttcaggacatgattcttctgttgaagaatgtcgaatgcggcaaggtcgagatccagcttgaatggcttaaaaatccaggtggtagtggactctgaaaaaacagagatgaagtagctttatgattttctgtgtgtaataaaaaaaatctcagttaataaaatagaacagagtactactactctgttttgtaatggaaatatatttggttttagatctaaccgaaaccgttttggtttcccgcgagttttctcttcatcacaaaaaagaaaaagtgatatttatgttttatattggtttggtaaacatgttcttggaaaagtcaacggcttaaaccttttgtccatagtcagaaaaaaagaagaatcaagaagatattattaccaaagatgttcgtgagagtaacgcgtagatgagaataatatagaaacaaacacctggaaaacgaaacctattatatagatggtctttattttttgtttctttattcgctctatcgtccattgataagccaatttttaagtggtcctcgttgaatttgagccggtcattgtttagaattaaaaaaaaagaaggtaaaagagtcagagccgcctagagaaatcgatcacaaattcagaagaaaagaacagagaaaacagaggaagaggtgagatggaggaacttgtagggcttctgagaatccgagtgaagagagggatcaatcttgctcagcgagacactctaagcagcgacccttttgttgtcataaccatgggatcacaggtcttttctctctctatctctgtctttgattctaatctgatttggtctttgtggatttcttctgtttttgagacatatatctctttttatcaaaatattgtcctccaagaagcatgataaatttcaattaagtatggaaaaataagagagtttaaacaacagagaaatgaaatcaatagataggtttagtatatgattttgatttttgatatagagaaaatcgtctttcgatattaggatgttcatatcttgcatgcactctaatagaattctttaaaatgcaccagaagctgaagactcgtgttgtggaaaataactgcaaccctgagtggaacgaggaattaacccttgcgttaagacatcccgatgaacctgtgaatctggtgagtacttctatctgtctatttttttattactggctctaataggaatcatgaatttccaactcaaaaacaattgacaattagtagcgtttttttacagatagtgtatgataaagatacattcacatcgcacgacaagatgggagatgcaaagatagatattaaaccatttctggaggttcacaaaatgggtttgcaagaacttccagatggaacagagatcaagagagttgtgcccaacagagaaaactgtttggctgaagcgagcagtatcgtctccaataatggcaaaatcgttcagaacatgattcttctgttgaggaatgtcgaatgcggtgaggtcgagattcagcttgaatggattgatattccaggttctagagggctttgaacatatctctttctgtgtgtaataaaaaaaaaactcagttcgttttgggtttttagacaaaagtcacaataagtagaacagagtactactctgttttgtaattgaaatatttggttttagcacctaacctaaatcgttttggtttcccgcgagtttttttattctgttgtttgtttgcagatgaaaaaaaaacgtggagaagaaaaaaacaaaaacgatctaataagcttggaagtttgcttgcagatattttttttttgaaaatttttgtggttaaacatgtgaaaatgcagagatattcaaacgtaaggttatggttacatctagtaacgaatcttatccatctccaaatcccaaatttgaaaaacacttccaagggaaaaatcgcggatacatacaagattgcaaatatctaagcttggaattatatttgttttctttctttggatctctgctttcaagtctgaaacttgaactctgtttctaatttacttcaaaagct

SEQ ID NO: 5998 - DNA, 3000 bp, Unknown; identical to SEQ ID NO: 5980
  misc_feature (1)..( 3000): cDNA_ID_1389239_gDNA_ID_1620835_Annot_ID_169838 3000 nt of promoter + ATG

SEQ ID NO: 5999 - DNA, 3000 bp, Unknown
  misc_feature (1)..( 3000): cDNA_ID_1456167_gDNA_ID_1620835_Annot_ID_169836 3000 nt of promoter + ATG
atatttcttagatagatatacgcaacatttatcatggttatcgacaactttagtttgatttttggcatatacctaaaattttgtaattttctaaggacttggttctaattaagaggctcgtccgctaggcgctaagcatgtttcatgtatgttcttcattgtcttttattaacttttcgaagcgttgaaattcacttctttaacatgaattggggatttaattttggagttaggtggatttaagtcatagaaagaagaaaacctgtcattaatgtgaacgaaaaaatgtaacatctataaaaaattgatttgtataaattggtttgtaagtctctaaagatgaaattgagtcaaatcctttttttagctaatcgaatttaataaattgacaaacgcgttaagtactagagaaacaaaataaacatgattagctagcaacggcggaatataaactctataaagatcacgaatcctttcgcatcgatatcttaattgccgtatgaacagtataattaatcttctcataatatggttattatactaataaattatatgtatagccttgtaggtaaatggaattattatggaaacagaatcaggtgcagagaaccataatgggccatgatcttgaatggtgcagagccaattcaaaatcatattatgactaaagacagagagcacatgactcacggataggaccagaagtatagagaggtcgtaattcagtttaagagaagacagctatcgatctcatttcatatgcattatgatctctggtacatctctatatatatcacctaacttcgtcttatcatatcagctcctcctccatgtcttatcctgagtcgcccattgtgtcacaaaccggttaacctaattgtatgattgatcgtgtttgcaaccatttataccctaaatgttgattacctcgttaataatatgccgtagattttattaatatgtatatgtgtgtaccaaattacaacgctaaatgaattttaaatccttggcagaaaaacagttcacaattttatatcctttgttaaatttaggttgtcgtgtccacattgtatgatctactcataagctcatagcatcgagtcattgacatcaactcattgttctggataatacaattgattatacatgtgtcacacctgatgataacttttagaatttttaaacgtgattttatacggacatctagatttgtttggatttcaatttaaattgttttttttggtttatatatttagttatttacatgttggttagtgttttattttatgtaagatattttcttacaatatctgtatatctatccacatctaatacatttagattttaaaatatcacatacggttaggatttgtattccctcagtcaaagacaaaggagtgggcatatagtatttataccctataagtaataacaggtcatttaaaaatttgaatagcttattccaaattaatttcatccatagaaaaaaacctaattaatgtgacagctgagctgaccatatattgttttttttggcacaaccattgtgtttatataaatcttatgattttatttcaaacgtacgataaggatttaggaaacgaacaaataaaatgggaaacggctcctctttaattattgaccagccattctgtgtctgttcaattagcgactagccagattcccaaatttcctcattgtccattgatttcaattatacgccaactcttctagattcagaggtaggtccatgaacttcaacatgacacacgttattttacttatctcagtctatatcgtaccaattgctccatattatacaatatcttataactctaaatgtcagtcgcatctaagattcgccactagttattatcaattcacccaactagaatcctcagttttcagtcgttctcaaaaaagtataaaaggattttttctattaaaaaatgtatatatatatatatatatatataaaacatgatagaaaatagaaaatttaccgaataaaaaattaaaactaattcagccgtgacaaaatacctaaaaaattatcggttttgtttattactcattctattgatcaaatactcaattttatatacaattattagatttttgctacggaacttagcgtgataaaactaaaatttcaaaatttaagataatcaaatggaatgtttagcccatatgtcacggttttaacaaattttgtttggttatgtatgttaacacatctatgagtttaattatatgtcaaataaatagtagaagtcaaatgattgaatactaaaaatattttcactgaacatgtttctatgaaataactgaattttctaattatattcatatatattaatttaactacttttaattatgtcaaaacctaaaaatttgataaatactttaaatgataaaacaagacattcatattaattaaacgtgaaaattgtataccatatatagtattcacaatatataatataattactttttgtgctttgcttaagatgcagtaaatcgatttgattagtctctaaagaataaatcttttatttggtcagtttgggtctaagcaataattactggtattaactttaaaattataagagtctagggactaaaaaagaaactaaagatatcggcgacatgaatgatgaatgagaaacagagaactctaaagaaagtaaaggagcagcgatgaaatcggttgtccgcaaacaacggatagatctgtcgatgtttgtttttggaactccgcgttgaatcagcgtcgatgtttctcgtaagtttgcataatccaaaaactcgttttcgaattataaatttcatcaaatccccgcttattttgggtaaattcaggcaaaaagggtttttgtgttcttcgatattatctcttattactattaggctattatcatcgccttattggggaaaaagcttcaaacttttatataaagtctcttcctttttctttctttctcggtggaatttgcagca

SEQ ID NO: 6000 - DNA, 3000 bp, Unknown
  misc_feature (1)..( 3000): cDNA_ID_1024639_gDNA_ID_1620835_Annot_ID_169834 3000 nt of promoter + ATG
tataaaccaaaaaaaacaatttaaattgaaatccaaacaaatctagatgtccgtataaaatcacgtttaaaaattctaaaagttatcatcaggtgtgacacatgtataatcaattgtattatccagaacaatgagttgatgtcaatgactcgatgctatgagcttatgagtagatcatacaatgtggacacgacaacctaaatttaacaaaggatataaaattgtgaactgtttttctgccaaggatttaaaattcatttagcgttgtaatttggtacacacatatacatattaataaaatctacggcatattattaacgaggtaatcaacatttagggtataaatggttgcaaacacgatcaatcatacaattaggttaaccggtttgtgacacaatgggcgactcaggataagacatggaggaggagctgatatgataagacgaagttaggtgatatatatagagatgtaccagagatcataatgcatatgaaatgagatcgatagctgtcttctcttaaactgaattacgacctctctatacttctggtcctatccgtgagtcatgtgctctctgtctttagtcataatatgattttgaattggctctgcaccattcaagatcatggcccattatggttctctgcacctgattctgtttccataataattccatttacctacaaggctatacatataatttattagtataataaccatattatgagaagattaattatactgttcatacggcaattaagatatcgatgcgaaaggattcgtgatctttatagagtttatattccgccgttgctagctaatcatgtttattttgtttctctagtacttaacgcgtttgtcaatttattaaattcgattagctaaaaaaaggatttgactcaatttcatctttagagacttacaaaccaatttatacaaatcaattttttatagatgttacattttttcgttcacattaatgacaggttttcttctttctatgacttaaatccacctaactccaaaattaaatccccaattcatgttaaagaagtgaatttcaacgcttcgaaaagttaataaaagacaatgaagaacatacatgaaacatgcttagcgcctagcggacgagcctcttaattagaaccaagtccttagaaaattacaaaattttaggtatatgccaaaaatcaaactaaagttgtcgataaccatgataaatgttgcgtatatctatctaagaaatatcacgcctaaaagataaattttggtacaactctcctcaacgttcatttttttaatactctgaaataccacaactatattccatatagatgaggtttgaggtttctaagacttttaaaacttaaagtcctagaattaaagaaacgtgtaacctttcaagtttaatatgggggaggtttggatcggcggaagctaaaaacagcaaggatcaggacaacaatggcctaacgaatgacacgtgatgctcttttcatgttgctcaacttcgatagcgaccgtttttctatttttatcactttcatattttacccccaagaaaaacaaaaacaagcgagtccgatatgtttaagagtcccaacctaaaatctattttcatcaccttccctatatagcccgcacaccgcacacaactaatacctcaaaatattaatttgtttgtgtttgcgcttgtttttatgttcttaacatcagggtaaaatgtatcttatgtgattagttttagtgggatactctacatagcattcacatgtctattagtttaaatacgtgtatgtcaatctaatgatacaattcagttcgcatgacttgcaaaacataaacgtaaaaagcaacacatatgaaccacttaccacaattttcgctacaactttttccaccatattagcaaaaaaaacaagggcgaataacattcatttggtataatccataacgatcaaattatcgattatcatcactacatttagctagagattttctagcctttctatttgccaaaccttttaatccattcttccttttaaaaaaaaaattatttatttcttttcaatttttatgaaaaccgtatctttaactaattgttatccttgctaatacatgcatcaacattttcttaaagtttttggtaaaattaacacataagaaataagaaatagttttcttctttaaactcgtccttatcacaaattttagattgtatgatattaaattcgatcttatcttaaatactttaaataacgttttatttactcttctcatattacaaatttactacactgttgcttttctatgttttacaattatatttaggagatcttttgttgtattatcaatactcttagatattcatttatgtagttaaaatttattaagattacttagattttattgagctttgaaatatattttaaaaaaaaacttttaattacacgttggtaaaaaaaaaagacacgtatgcaaaagcaccaaaaaaggtaaaaccggaaaaattctcaaatttcaaaattacccaaaaaagcctttaacctaaccaccttactttataaacaacctcaccgtctctcttagctcaccaacaatcacattcttctcccataagaaaaaaaaaataatcaaatcctcctcctctgcttcaccaccaaaaagcatattcttctctcgtcttctccggttaatcaaaatctctccgtgtgaatcgtttgtgaatggtggaaactaatccgatcggtggtaagtttacgctctccctttccatcaaaagggcgagcttttctcttcctctctcgacatcctctgttttcgctttcggatcttgcaaagaaggctggtactttcgctgccttggcctcgacccgtgaacgattcgcccctaaaattcacaacccggaaccctaatttcctaaaaagtggttctttttttattgattctgttacttgtgagatttgctctgttttttgttctctcgatttcgaagatg

SEQ ID NO: 6001 - DNA, 3000 bp, Unknown; identical to SEQ ID NO: 5979
  misc_feature (1)..( 3000): cDNA_ID_1989710_gDNA_ID_1620835_Annot_ID_169831 3000 nt of promoter + ATG

SEQ ID NO: 6002 - DNA, 3000 bp, Unknown
  misc_feature (1)..( 3000): cDNA_ID_4262201_gDNA_ID_1620835_Annot_ID_169830 3000 nt of promoter + ATG
gagtttttaaatagatggactaatatctaactttttttataattaaaacttttatatttaaaaggtttttctattaataatttaactaagggtttttaaagtaaattggccaattcgtgaaggatatttcatttaaatccccaaaaattcatattcattatgctgtcgtacaatgaattgaaaatcgattaataagaaggtgggtaacaaaatttcctttagtttccttttatttaagaacaccactttacttctttcattattttgaccaagtttaactaggcccgtaaggagaaccataaagagaggacaagaccttgttacagcttacaaccaaaataaaggagaccacagttaaaaataaaagaggtttaaaaacacttctactaaaaaacatggttgataaaaaagttggcggtatccaattttgaaagtatgcaactaactatgcatcattcataaacaattacatatgtaacgtgtgtagtgtagacaaggtaatcgatattcgaaatgagcaaataaataaagaaattgtgattaaaaaatttttaagagttaatggaccagtctaacattatgtgccacttcatttttatatttcacatcaaaaccgaattcattttaattaattagaccgtgtccatttttataaaatattgacgggacatttcaacattgtgtatgaatgttataatattattattctcttcgttagccgaatggttcacattgacatcatagggacatacaaatattgactttttcgaagacacattacaatatatgtcgttttttgaacctcgtggccttgtcaacttataatttgcgtgtttgcgaagagataatcatcaccaaatgtatgttaaacatgtaagtaattaatattcaaaggggccagtatatcccacttaaacttatactatgtcagaaaattaattaatattattgaaggtattaaccatatcaaatattcgatcactataccatagagagatattggaaacttgtgatttcgattatttgttttagcaacaaaataatttctgtgaatgaaaagggccatgtggtgttggccgtggctcatacaaagtttaatgacaggtcactcccacctcactgttttgcctaataatttactacttaattatagtatagaatctttccgaatttttgtttgatttggagtttacatattcatcgtagttttaagatttctaaggtataaatattggtaggtgcatgcaatcagttgaactttcacatcatttcttgatcgtttgttgatttagaattaaacaggtgatcgtgagaaacgctcctaagcaaatatatagtaaatggaaatcgattaattcaaaaaaattgaagtattattattctattaccatgtttattatactatgtacttatttgattttaattttatcattgaaaacaagaaaggagaagcgacctcaatgattaacattcgtcggccgaatcaatatagagactttaaaaattaaaaaaaatggtggtggggtttgcagtctaagcttttaggttaagcctttaacatgtgattaactttccacaccaatggctctccaaaatcccggaaaagaagaaaattatttcgaaactcacttgggattctaaaaatgtgaaaactaagaataactcgctagtcacttccatgaaaaaagtagtggtaacacttaatttgaaattgaggaataacattttatttttgagaaagaatttgattgttagagtatgttattattagttttctaaataataataacatgttagaaaaatggtaatggtatgggagattttattttttattttttataatgagtaaaaatggtgagagaaatgatggtgaattgagagttgttggaggaggtggggggtccaatggcccctctttttattccttattaaaaagtaaaataaccattacatagttctgattaattttgcaattaatagaataatattaagagtaaattttacaagatgttattttgactaactttacgggtgcttcatacacaaacgtaaaagaaatctatgtacagatgaatagtatcatgcaaatctaaaaaaggttacaaaataatgtaacaagtactttatcaaaaaaaaattaacagtgaaacaaagcatgtagtgtgttatgggagactcatgtcttatccgtttcaagatccatgcaagaggaaacattggaatgtctctgtcagtgtctctactgtgaagaacattaagggacagtagtttttgtctggttcgttctcaggttctgcattgtaacaataccacacactcatcaatgtttctctttatgtaatgaatgaggatcaatcaaatagcttataagcaagcaagtgaaatctcacaataggctactgtgaaatcacaacaaaaaacaactttatctgtatcaggtttcaacagtttctttctaattgaacagaatcaaatctttatgccaatttcattctatctacaagttacaacaaagtaaatcattatcctagttatgctcacttgctcagtcattatttagctagctttctattgaagaataacaataatcaaatatcgaaaatgctatttctctgttggatcaaaggatttcagcttcaagataatgacaattgacacatttcaccattcttgatctctctttggttatatctactctaatttacatcaatttacttactttgaactgcctcactttcaaagacatgaaccaaattacagaaacggcgatgcaactataaaatttggaatacatgtggaatttggaatgagattattcgtttttatttcattttcttgaaataaaacactatatgccaaaatcaaacgtgggacctccttatgacacgtggaatttatgtgattcagacaaaagtaatcctagaagtctctgccattagaaccaatctcaagagataaggaaacttcacaaccaaaaacaagaacaacagacacatagag

SEQ ID NO: 6003 - DNA, 3000 bp, Unknown; identical to SEQ ID NO: 5986
  misc_feature (1)..( 3000): cDNA_ID_2993407_gDNA_ID_1620835_Annot_ID_57974 3000 nt of promoter + ATG

SEQ ID NO: 6004 - DNA, 3000 bp, Unknown; identical to SEQ ID NO: 5992
  misc_feature (1)..( 3000): cDNA_ID_2992212_gDNA_ID_1620835_Annot_ID_57967 3000 nt of promoter + ATG

SEQ ID NO: 6005 - DNA, 3000 bp, Unknown; identical to SEQ ID NO: 5995
  misc_feature (1)..( 3000): cDNA_ID_1988890_gDNA_ID_1620835_Annot_ID_57964 3000 nt of promoter + ATG

SEQ ID NO: 6006 - DNA, 3000 bp, Unknown; identical to SEQ ID NO: 5997
  misc_feature (1)..( 3000): cDNA_ID_1989708_gDNA_ID_1620835_Annot_ID_57961 3000 nt of promoter + ATG

SEQ ID NO: 6007 - DNA, 3000 bp, Unknown; identical to SEQ ID NO: 5999
  misc_feature (1)..( 3000): cDNA_ID_1456167_gDNA_ID_1620835_Annot_ID_57958 3000 nt of promoter + ATG

SEQ ID NO: 6008 - DNA, 3000 bp, Unknown; identical to SEQ ID NO: 6000
  misc_feature (1)..( 3000): cDNA_ID_1024639_gDNA_ID_1620835_Annot_ID_57957 3000 nt of promoter + ATG

SEQ ID NO: 6009 - DNA, 3000 bp, Unknown
  misc_feature (1)..( 3000): cDNA_ID_1829661_gDNA_ID_1620836_Annot_ID_50802 3000 nt of promoter + ATG
ctgcttgatttggatacagctaccgagtttgaccctactttgacattcccctacaagttcagggcagtggctttggtggaagaaaaccagtttggagctgcaatcgcagaactgaacaagattcttggattcaaggcctctcctgactgtctagagatgagggcatggatttctataggtatggaggattacgagggtgctttgaaagatattcgggcgcttttgacattggagccaaattttatgatgtttaactggaaaatccatggtgatcatatggtggagttgctccgtccgctagcccagcagtggagccaggctgattgctggatgcagctgtatgatcgttggtcttctgtggatgatattggatctctagcagttgttcatcatatgcttgcaaatgatccagggaagagtcttttacggttcagacagtctcttcttctcctacggtataatctaaacctctctttccgcttctcaatgaattttttttcttgtggtgcatgttgttttagactgtaagtgattttaacaagtgctggttgtatactgacaggctcaattgtcaaaaggcagcaatgcgtagtctaaggctggctcgaaaccattcaaagtcggagcatgagagacttgtgtatgaaggatggatactgtatgatacaggccaccgcgaggaagcccttgccaaagcggaggaatccatttccatccaaaggtcgtttgaagcgtttttcctcaaagcttacgcccttgcagactctacgcttgacccggactcctctaattatgtgattcagctccttcaagaagcgcttaagtgcccctcagatggtctccgtaagggacaagtaagtaaagagttcaacagttttcatttatgtaattcaatttctcaataagtcaattccttttctagagggtttgttggatcatccttcagactgccatagtatcagaatcccaatgtaaaactttttgttcttggtgcctggaataacttgttgatagtggaatgtggtcgcatctcaggagccaactctcttaaaaaccgtttagtatatttggtcaaaaggttatcctactaaatcatatgacattcaatatcatgaactcccgtttggtgtatttgcttgcaggcattgaacaacctggggagcgtatacgtggattgtgaaaagctggatcttgcagctgattgctacacaaacgcgctcaccatcaagcatacacgagctcaccaaggtcttgcacgtgtttatcacctgaaaaaccaacggaaagctgcttatgatgaaatgacaaagctaatagagaaggctcagaacaatgcgtcggcatatgagaagcgctctgaatattgtgaccgcgagatggctcagagcgacctttgcctggcaacacaacttgaccctctccgaacctatccttacagatacagagccgcaggtatgttaatgacacaaccaagttcttgtttatcctccttttgtctgttgtttataattggatgccagaaacaagacaacaatggctgatcctttctgagggattctcccacgtataaaagtgttagaaaaacgtagaacccagcttatgtggtgatgaaaacggaaatgataatttgtgaccccaacacatgaaagaaatgagatttcgatcatctttctggagatagaaacagaactgcgagtgttatatacttctgtacttataccgaattgatatgcagtttctctggtttggttttggtgaatttgaatatgaaaaatagttttgctaagaccagagtatcaagttttctttttaagtttcgctttgtttaacatgaactcttggttgcagttcttatggacgaccacaaagaaagtgaagccatagacgagctttcgagggcgatatcatttaaaccagatcttcagctattacatctacgagcagcattctatgattcaatgggagaaggagcgtctgctataaaagattgtgaagcagcattatgtattgatccaggtcatgcagatacactcgagctctaccacaaagctcgtgaaccaaacgaccaaaagtagaacaaaactatcaatttggtttgatgggcaaaaatatttctcttcttccctcctggtatggcttctacactgtttcattttccttgtgcaaaacagaacttggagcaaatcaaagaaagcttggtttgagtgaaccagggaaaaagcaagcatagccatgtaaatagaaacttttttatatattatttttttttctctataattttggttattggggggtgagaggatactttataagtagtgcagagagtgtttcttgctgctaaagataatacgttttctggccaacaaaaaaaagggaaaaccacgaagaagaacttacctctggtgaaattggacttcttcttctgtcctatttctagatgtattattgcttctttctttttatttatttttttcatcactggaattatgtaaaattgtatctgtaacttcttcaccttttttttttttacatgtttcttgtattgattctccaaaagcatccggggatttgttttttatcctcctgaaacaagaaaacaaagaaactattcattcttcttacatttcaacatgtttcaccaagagtatcctcaatatttcaacattcttttttatcacttgatgaggaaatcatctccttacttctagatttgggtttgagttcttgtttggtttcatgatcgattttatcaccacatggttggattggaaactcaactttttccaaagctctcctgacctgtgaacacaataaagaggccacaaatatcggttttgcatacacgagaaagtttcaaactttcaacaacttctcattaaatttcaactttcagctaacaaactagaaaagaagagtgtcaacacaacaaagatctctcccaaactcacaattttgccttctttgggtcgcaaacaagaacatacccttcccactcagatg

SEQ ID NO: 6010 - DNA, 3000 bp, Unknown
  misc_feature (1)..( 3000): cDNA_ID_1829657_gDNA_ID_1620836_Annot_ID_50803 3000 nt of promoter + ATG
tgcttattgaaactgtttatctttttgattattgttaaatattggaaaacgaccatcgtctttatcttctaatgtatagatatattatatatagtatcggaaatctacatctctgttcgttatgttggaataatccctgggaatagtctttgatgtctctcagtctctgtcgtgcctaattggcttatgtcgtagtactaaagattatggctacgagttttggagacacttttgcatatgtgtttccatgttctagtaatcgggagctcaagttcaatttgatgatagcgatagtgttgcaaaaatgatttatgtttactgttacatgtttcaatccttataaactacagcttcgagggaagattgcctcaaactgagaagtacacactacaagccaaataatgcaaagttaaggttagtttcatttcaagagtacgatccgtgctttttggataaaaaatacattcttacccaaaaactagaagacattcttagctgtctcacccacatgaccatacgtttcattctcaattatatgttccatggaattatatttaatctatataataacattcttgtgccatcacataaactaataatccactcagcagtgattagacttaatcatagcttagcagagatttaattacgattacttccttaaccatttatttatataacaaaaaaaattaacagtaaaacgtgttgacatgacttcgccgttcaatgtgggtggcaaaagccatttgccggctatctaacagcacatattattatttattattttctcgaccatttattatgttctgtcagataatattttaattttaatttatattctattctgtgatgatttcttacgctttgtatcggtaaacataattggatttgcgagaaaatatcagcaatgtataattgtgtcacgcacaaccggtatgtggcagcctcaacatttgaaaggtacttaatacttatgaatataaatgataacgacgaatctctgcataaatattgtttatgaaagattctgacagatctatggacgttgtttttttttgcgtaatttaaactggccaaatagtagtaaaactagaatttattttggtcaagcggaatatagttttgacagattctaagagatgagtgattcaggatttttatattcaaattaccaacgaaataactgataatattagcagattattttaagcttaatcgatggactaactgaaacattttttttgtcaaatttttgatgttgttaagagtaattttcgttcatgaggttccaataactcagctcagctcgcttcacttgagtgtcaaatccatgaagaacatacttctagcaagacgtttccgcctcggctgcacacgtctactatcccaatggttctcccatgcttagcaaactcaactagtttcagtttctatgtaatagttatctacggctttttaattttttttaccataaaagctccttgcccccagctttgtaaataacctgtttccttttggtaatataattcacattttatccaaaaaaaaatccatgaagaaccaacctttcaatatataaaaacaagttaatccatggagacagtcattgattagtgaacatatttctaataaaagttaatatgcatggctaagagaacaaaaaccatttatcatggtagtttatttaattaaaattgcaaaattatgaatccaatattttgtttattattgatttttttttatcaaaattagactcgtctctagtttatgcggaaaaattgaaatatttttttttatcatttacaacatttatacactatagtagttaacagttatgaaaccgcaatggaaagatataatattttactagtaacacttcctttctgatttgtgagttagcaaaaatataaaaatgtgtcatttggtgtttttataatgaaaatataataaaataacagattaattacaaccaatcttgtcaaaagggaagacaataaataaataccaaaaaatgatggaatccactcttcttcaagctacaatagatatgaatgttggcactgtttcaaggcacccaaaagtaaaagttaaaattcagccagagaaaatggttaaaagaaaagtaagcatacacatattagacttaaacaaatagaaaaaagggaaacaaatgtaacatagaagcatgctaaagtaaaaagtggggggggggggatcaataaactgtcaaagtaaaattaaaggccattactttcacataaatgtttaattaatttttttcaacctttttggagattgtaaaaagtgccgcgaaaatctaagaaataaaaaaaatggcagttgataacgttagaagaggattaatttaagcctttaaagggaaataaataaactaagcaaattactactttccacaaaaactaacaagaggacaaaaataaaaaaggcaaagataaataaaaaaaacctgaattaaaaaaaagataccacaaacaaacacatatagtaataaaattttaattttgcattattagaagtacgcatgacttctctctgaaaaacagattggtaataaaaaagaaaaagaaaaacaataaacgaaaactgagagagagattgaaagagagatcgagcggaggaagattcttcctccaattaccatctctctatttttacgggaagattcgtaaaattagtgccatcaacccaaaaaaaaaaacgaaccggatcgatgaaacttacagtgcaaaaaacaccatttccgagaagaagaagaagacgaagaacaagaccttcgttgagaaactttatttgaaaaaaaaaagaaacgatttttattggttaaagggacagacctccttttggtggattggctccgtgatccaatcctcggaattgtttttaaggtgacggaacaaatttgtaaatcttgtttttggtattgacccagatctttggataaatttgaaatttttattggttgtttttgatttgaagatg

SEQ ID NO: 6011 - DNA, 1943 bp, Unknown
  misc_feature (1)..( 1943): cDNA_ID_1829627_gDNA_ID_1620836_Annot_ID_169907 3000 nt of promoter + ATG
caacaaccgtctctccttatttgaccagagtccttctgtttttttttgttttttttttgtggataaataaacagaataaattagggctcgaaatacttatgatatgtattccaaaagacatagctttgatcacttaaacaagccacgcctagctgagaaagaaaaggctttggctggtttataagaaattaataataactttctggcctttaatttagataaatagaacatttaatttgtaattatatattttaatcatgcaaataataaattatctcaaccaacattataattttatatatctttgaggtcattatttttgtaaagaaaaacgctagaattgaaatatttattaatttagacgaatataagttggacaatttaatccatgtaagattaagattttgtatgccatcaatctaacaacttgtctagacaactaatgtttaacaataatttttgatactgcaaaatttgtttatgtgaagttacagaacttgtaggagttagattgttaacgttacaatactatatatagttgattcacgtgtttataggcaacatatcaaattaacatgtttgctttgcagttaaaaaattgttcaagaaataagccaaaattcatcgacaaatttggagctaggggagattcggtaggtacaaattatacaaaacttattcaagtaattaacaagtaaaataaataatcgtttaccacgtgcccatccagctgtgattccacttcaacttctgactaaggaacggaaaggcattccaagtttcctcaattaggctcaacttttcagagatgaaaagaattagtatgtgcaaaataacgtatagattcacaggatgatacaaaatctttcaatgacatggttagtcaacgtaaacaaatttgttttggaagggtccatagagatttttactaaagcaacgtggagttttcatgtgtttgcaaccgttaccaaaacccaacagttagttaacaactttattataatgaataaaaataacacacgagaattaatgacatagtgtcaaaaagaagaagaacaagcatgatattttatgccgactaaagtattgtgaccatttgttgttgctgaatcgtcatctccaactcctaacgttaggcacgttcttgaaaaatatcccataacgcaaattctagattaagcccggtaaagtaaacttgaaaaaattataatatacaggttctttatttaaaggaaaatgtgacatggcagtgaggagaaactaacccatcttcctaatggacaaatgtcagcagagccatacatttataaagtattttaatgattaaggggacgatgatgatgtcatcagtagttgagttgggggtagaataggtaattcaagaaatatgtgattgaaagtggaaacgtaagctttctggcttttgtgtcctctctgagtctcagtgtcgggacaagacatgcatcagcatcacacatccgtgaatcggtgctttatcctcttctatcttttttaacttcacgactagaaaattgatttttaaattttgttttacacaaactgatattaactacaaattaagaataacatagaaattaagaataagtttctagaaatgtacatcaagtattggccgttaagtttcaacatatttataccatctggcctcaattacaatcataattcataaataatcttctgacacttaataagataacttttcaccgagtgatatattcctgaaagtaaattcaacgctttagaataatgttcttatatatttaattatttaccaaatacacactatgcttcaaactccctataaaaagaagaaaccaccttatagcacttctcctcattcctcacttccaaccgccaaagaaaaaaatcaaaaactccaacaaaaaaaacctcccaaaccctacccgagcagtcgccagatg

SEQ ID NO: 6012 - DNA, 3000 bp, Unknown
  misc_feature (1)..( 3000): cDNA_ID_1807217_gDNA_ID_1620836_Annot_ID_169904 3000 nt of promoter + ATG
atacaccctccggttttattttattttatatggtaacttaacataacctaaccgggaaacatggatacaaattgtatttggaaccaaaccaaaccggtttgtaaccctaagtaaatcgtgttgacttgaaccggatataaataatcattccggtaatcaaagatggttatgtgatgtttctcttcttgattgtgttacagaaacaagccgatgtgaacttcttcttgctgcttatgggcctgttgtgtcatttgctgccattattgttaaaatatgcagcaaccggcgaagtatcgacctctatgattaacaaaatgtcgctcactctgtcgcggacaagcagcatagttatgcttattgcttacattgcttatctcatcttccagctctggactcaccgccaattgtttgaggcacaacaggtacctaagagttacgtcatgttttcatgcgaataaaatgtatctataatcaattttattggtatctaggatgatgatgatgcatatgatgatgaggttagtgttgaagaaactccagtgataggattctggagcggatttgcttggctcgttgggatgacaatagtcatcgcattgctatcagagtatgttgtggacacgatcgaggtactgattatgtcgatatacgtttgaatcccaacatgaaaaagaaagaaagaaactcacaagattaataaggaggtttcatgttggtcaggatgcatcggactcatggggactatcagtgagtttcataagcatcatattgcttcccattgttgggaatgcggctgagcatgctggagccatcattttcgcattcaagaacaagctcgtgagttttcttttttcttgctttacaagtattctttgtttgtgtttggttttatgtttagtgtgaatttcttccaaatgaacccacaatatttagcattgaaaaaaaaaattgttgcaaaaatatcttataaaactccaacatgtaacactgcctgaaatctatttttgtggaatggttaattataactacaggacatatctctaggggttgcgttgggctctgcaactcagatttctttgttcgtggtaagttcttcttcgccttttatattatgttgaaatctgaaagatgacaaatgttgcgtgcaatataagaaatctaaggcaatgttaatgtgtgtgtttcatcaggtcccattgagtgttatcgttgcgtggatcctgggaataaaaatggatctcaactttaacatccttgaaactagctctctagctttggccattatcatcacagccttcactttacaggtaaaacgttttgctttaaacacaagtttgatttggttgacctttctagttaatcattatcgtttgtttttgggccggttaggatggaacttctcattacatgaagggactggttctattgttatgctatgtcatcatcgcggcgtgtttcttcgtcgaccaaattccccaaccaaatgatttggacgtgggacttcaacccatgaacaatttgggagaagttttctcagcttaaagttatcaaatgacttgtaaaaaaagaagaagagaagaaatcagcaaattatgatttgattgattcgtcatccaaaaacggagagactttgtcagagggattcctcaagcatgaatgagggagggagcttgatgaagacagaggttcttggtgtttaagaaatgatcacattaatttctgtttgctttctttttctgtttgttgttggcatttttaagtttttcttgtatattatatgttcttttgctgagtaatgtggactatattttctgatatattcgtttaccttacagacttaactgatgatactgtatatgcaactttttctttttgagttaagttgcaaattagtcactttttaaaacttaattggaaaagtagtcactttattatttataatttgcaaaatagtcatttttcattgtttgattcgtacacttagattgtacaccacttttagtgtacagatatatataaaaaatacacagcgtacactttacatttgtacactaaaagtgatgtacaatccaactgtacgaatcaaactgtgaaaagtgactactttacaaattatgaatagtaaagtgactattttcctaattaagtttgaaaaagtgactagtttgccaacacaccctttttttttaatttaccccaagatacatgtagaggaataaaccaaaaatgaagttttccctatcatatatcatggtgcatgaaaaatgttaaacaacttcttgtagcataaaccagcaacagaaacaatcaacaaattgtggaagcattgccataaaaagttatctaataagataagacttccttgcactgcaacaatctttggttgtggatcccaattacactcacatatacaccatcatccccttcttgtccttgagtccatttgagatacacattgttactaatgttgtcaaaaataaaaatcaccatacaagaaagtggcttctgaggttcatcacaaattcagcaaaaactcttgttctgctttaacataatgttagtcttattcatacacacaagcatataaataaaaatgggtgtgttggcaaaatagtcactttttcaaacttaagtggaaaagtagtcactttactattcataatttgcaaaatagtcatttttcactgtttgattcgtacacttagattgtacaccacttttagtgtacaaatgtaaagtgtacgctgtgtatttttatatacatttgtacactaaaagtagtgtacgatgtaagtgtatgaatcaaacagtgaaaagtaactattttacaaattatgaatagtaaaatgactacttttccaattaagtttacaaagtaacttaactcaattataatttggtttataaggaaacgtgtgggaccaatctcaagtagacgaaaccatttcttaaggtttttgaaaacctttgcgtcttatcttcttcttccctctctacaac

SEQ ID NO: 6013 - DNA, 3000 bp, Unknown
  misc_feature (1)..( 3000): cDNA_ID_2135701_gDNA_ID_1620836_Annot_ID_169903 3000 nt of promoter + ATG
agctctagaggtcaaaactacgctaatcattttgctacctaattgtctgccaatatttagcccaatccctctgtgtgcagcagaaactatatcactaggttattgccttattggattggatatttgcattgcattttagaatccaattacaatgttgtgttattcaatcaataatttacatatttaaattgacaatgctgtatttcacaattattagttatattttggtgttattcaatttatgatttttaaatacaagttatatgttagaccaaaataaaaagaaatataagttataagttgctgaaaataactataggtgaaagaatctataaaccacaaaaaataactccaagctcggattttttttctccgaataaaacaaaatattcactaaaatcattaagcagagacgccaacacaacacaactcaactctttgtgtctttgtacagttgtacgaatggtcatgtactatgttattattattattccggaaagctccactactctctcaatcattttgaaattgtctcctcaatattttgtttggctcactagctttgttatacgtatggtatgggcaacgatatgaaaggtatataaatcacacaattaaaattcaagatagtgatatttgaagttgtgttttgcacaaaaacaaagctatcgttgttagcttgtgagataggaaatttcgaggaaggtctttatatgtaattctcgcatgcatgtgagatgttgatcgatcattttccccacaatatttacgagatttctgtccctataaaaaacgattgtgatgataatagtcaagtggaattcctaagcaaactaagtgtatgctttactccctggaaccgaaccctacatatcttgaaatttgttatgtaaattcagccgatcctctagtccagtttcgcccttaaccgttacctatttcaagttttgataagagccatcgtggtatgaatgttaacccgctacttaactagttacaatttacaactacataagttttggagtcacgtgttatatgatttatagacatttgaattattggctaatattggcccagtcttggtctctccgtgataatggatattctcttttgattccatgtcccttgtcaaatctctaacaactacactctgatgatttggaacaagctggaaacaaaaaaaaagttcttacataacaaccctaaatgattgatcagtaaatgttatattctaacttcagatttagttgtatcatgtataaaggaaaaaaaaactaatcatataggattgttaattaaccaaagacatcaatatatgactattaatccaatgcaataagattaattatatagtttttaaatatttaaattaatttaattaacttgaaaagctttcaaattattattagtgtacttgaatgagcgaaattggccaaaatgcaaacagccgcttatcgcctttatgtcttggtgctaaaactgctgccgcttcgaaaagccaaagccaaagcgttaattataaattttttggtacaacaaaagtgataacgagtgatgattctactgctaccacactttgagcccatcacacaagtttacattggaacactcctcttcaagtacacgtgtagtgtacaacacaattaaccttctgtttttcttgtcctatctttcaataaatagccatatcatacctacctaaaacgtaacccactaattttcatcaattaatgtcgagcaaatactatatcttaagtttgaaattatcaaaccaagcagaacaacacatgtagttataatcatataattatctttaaaacatttacaagttcattagaatcttcgtacagatacagccatatgcaactaatgaaagtctcaaactcataaatcaaagaaagcattaaactcaatgttcttaagttaaatatgtcaaatcatcacatataattccgattaataattagtcagttaagctgtttaagcatactctaagcattaataattagtcagttaagatatatcattgatccattctttcaagttaatgtcctttacatacatccaaattcatttgcacgaaaagaattaacatagagatatatagttacataaacacatacactgaccaccatagatttatttgaaccttatatataacaaaagatcgaaatgttaccggcacatatcggtgagaaatgaaatgcaatttattgttatagaatggcaagttaaagcacaaaagagtatatattaaagatttttttatacacgtgtcagtgaggattgcacatcacatgttaaatcacatatgtttaagcaaaatggaattctatatttgcctatagattagacgtcaaaaatagacgacaactttctaataaaccaaaaaatgtcgctcaaaatgatatattatatttattatgtattgtactagctagagtacgaaatcaactaagatcacaaacggatagtcggataccaatcaaaagtgttcaattctgactcttgaaaaactttatttatcttcattttgaattgaatacaattatctaactgtaactttttttcttactcgtcaatctatagaatcaagttaccctttctagagaatcaactaactagtagtctagtaccttcctcaatacaatagtcgtacgaacgcccatttatctaggtaccctcaaattttgtgtcgtctcacttattagttatctattactagttgattactcaatacaaatttccctaaatagagaggatatgagagttgcgtatttaaacaaacctaccaaaatatgattttcgtcaaaccaaagcaaaaacctaccaaaagaaattatttcttaaatacagaaaaaaacaaaaaggaaacttccgggaagctgcgtacatagatggacccaacataaaccaaaacaataacacgtagtcgccacctatatataaaaaacctgacgcaacacaaacagatgtagtagaatcaaaacgtcttaaaac

SEQ ID NO: 6014 - DNA, 3000 bp, Unknown
  misc_feature (1)..( 3000): cDNA_ID_1395806_gDNA_ID_1620836_Annot_ID_169900 3000 nt of promoter + ATG
ctaagatccacctgaacaactatgacaatgaataaaaatatggtaattgtacgtacaaaataaaacaaataattttttggttctaatatgccatttaagattttgaaatgtcatgatagaaacaactaatgatagaataaaaatcttgaaaatgttaccatttaagattttgaaatgtcatgtgctaatcttttttggttctaatatgccatttttagactcataattcataaaacaacaagttatttcatagaaagaaaatactaaaacgaacatttctagtttattttgtaaatctaagaacatagatgcagaattttttcccattgtaaatccagtattcatttgatcaaaaatgagctggccatttcaaaaaaggtatgtaacatgcgaacgtaagtggtatgagcctaggagactaggaggagattgaaaatttgtgatgtttctaaacgatcgtgtggtcaatgtcaacaatcatttgtttggcctttgggaaagtcctttttttttttgttataaaggatttgcattagaatggtacatttatatatctaaatttaattgatttgaattatacactaattactttcgaaatatccacaaagctctacggtgtaaaatgtatcttccaatgtcgacatatcaaagatagtagtatcatatcttctactagaggtctagagccatctacgtgtattatggtagtttaaatggatgtgatctgaggatgtccatctatctaaaattgcggaatttacttcatttttagataggttggttgcatcgaatagttcaaaatgatttaatttctacaacttttttaaaaatgatcatagtttttcaaaatcaaaagtcatctgaggctttttgtcccgcacacatgaatttttttctgggtatcatatatgtcgtatcatgtaacacatagggcggtagataagacgaagtccaaaacgcgatgaagaaacctttggtttagcatgagtaaaatcataacgataaagatacaaacttttttcattcccaaaccctaaataatggtgcttttgagagaaaaccaatttctacttaccatttttggaaacccatcaagatgcgtaaatctagttgcaacgtccaccacatgtcttatttggtggagcgtggttcacaaaaatgtttgaaagttaacaaacgcgcgtctaaattattattatatactattccaaagacgcgttcacatttaacccaatgttaaccaaccaaatctcaagatgtggagatgcattcacacatacaacaagatatatatctacttaacttatctgaaatgcgttcacatcacacgtatagtagtaccaaagacttgccatgaataaagaagataagatgtctagacagatcaatttgtaaccgtcatcatcttccatttttgcatgacgtccaaaagatcacttgaacttttttcatttcgtggtgaagattccattggacaacgtgtgactatatttttggctcatcacttttttgtagtgcgatcatctaccatcttgcaacatagattctcttataattggcaaaatccattaaaccgataacaaaatatcataatgtcacacacactagtgattcctcgtgaacccatccatattctttgcttgaccgcttccataaacaatccaccccgaagcttttacatcgtgatgtctttgtaaatttaggaaaacacagacacagttggtcaatgataatcattacagattctaaaagaatttggtagccactagtcaaagaacttaaaaggcaagatttatcgggacattaggacaaggtaaatgaatgcattataagaaaataaaaaaaccctttaacattttgtttaatagaaaagaagtagaggttgattagttattgttaaagtaaaatgtgttgggcttgtcttttcctcaaatgtcgcgaagctcaatggtataagcgaaagagaaagcatagcatgatgggccatatataaataaaaactcgagtatgctacaaaaacaaggtttcaatgcactcatatctcgtttaacattttctaattttattcttttcatgtgtcccccattggcttggcaataaagttgaatttgtattgatttatatctcattctcagtacgagctaaaattcttaattaaaatgaaaaatatgctataaacaatttaaatgattgcaagtctcaccttgaacaacatcagttaatatttttccgtagcatgttgcatatagcataattttggtcttaagtaacaccaccacctcacacgtacgtacgaccaattatgcatgtctcaaatccctccatgatttctatatggaagaccaaggtttcaagattagcaattttaacggattaaaaccggttcaagattttattttttatttatttttgctaaatcctacaatttggtctcatgacaaaaaaaatataaaaacatagaaacaaataacaatgaatctatcgacatcaacaaaagcaattaaactttccgaatcaatgaagcgataaccggtagtatcttcgagacttcatatacgatcaaaatgctaaagtaactattcataatcttttattaataatgaattatcaaagcttctataattcatacgacaaagacaaaggaatagcaacaagttatgttcatttcgctgtcgtttaattcaacaatgaaacgttaacgaaacgattttgtcgagatttttaaacgtctttttcaggttctacggctaaaattcctaacatttcatcacctgtcgttatcgttaatatcgtccttgtcagcagaaaaaaattgaaatcaggataagttgataacttctatgaaaaaaacattatcttacaaaaatccaaatactccgacttaaccgggtcggatcctggtgagtactagtatctatctcattacaattcatatccttccttcaacattcgatcatcacgaagccaaagaacaatttctccgtcactatcataaccatg

SEQ ID NO: 6015 - DNA, 3000 bp, Unknown
  misc_feature (1)..( 3000): cDNA_ID_1807281_gDNA_ID_1620836_Annot_ID_169898 3000 nt of promoter + ATG
ataattccacagctactgcaaataaaccagtatcgaagcatgaaactatcattttaagaagacactgcacatgaatgagatcctaacaaggatatacctgcaataatgagaacttgaaaccattaatctccactatttgttcagattcgacaaaattagcagcgtccccttcaagattggctcctcttctccacatacgtgtacctgggatgccaattccaataagactgtcaaacaaacatggatgccactgaattttctggcagaactaattaaaccctacctagacgtcgtgtacagcgcctggacattatcgataccacagcaggagaattcttgagctttagctcagcaacttggtaacttaagccttggttaatatcaaacaacatgtattggagtactgtctattaaaaagcatatttgaaaaacgcaacattacatctataaacagtccaagaacaagctaaacagaagattaagaagataaagaaaaggatatttccttgaagtataggaataataaaaccatccagctgccacaataagagaaggttagatcattaacgtttgacaaggaatgaaaatcaattaaatttaaaccacacaacttactttgcattcaattaagtcctccaaaagatgccagttccaaacatatcgagggtcagcctgacaagcaaataaaccttcagcctaactttaacgcgatgaacttaaattcagacactggatccaaagaagatactttttttaaagataaaaaatcatacgaataaacaacctgcttccacataggcttacgattccaaccttcagctagcttgcaccttctttgaagactgtaaaattggatgaatgtatctaactcaagccgcggaactacttaaaactcttaatatcatgagatagtgaaacttacttcaatgttagatctgtttcatacgaaaaatacaatccaggggttgtctcaagtgcttgtaacagagtcctaaaatatgtttcgtcctttttctgcaaaagccagtgaccaagttctttagacaacttaacttgttcataaactccaaaacccctacaaaatcgtatatcgattgaaattcacaataaccttacttcttgagcagtagcaaacctcaaagcctcattgcaaggtaagaatttcatagccgtaactctaaaaatcggtaaaccgagaaaatttccaacttcctcccgagacgttataactagcaagtatgttcctatatatgaatgaaatcgaaaccagcatataaaaatcactgttggatcccaacacagtacatagagaaatgttgaaaaacattttccacctgctaagagcctaatagttcctcctacgccatagatagtagagactctagtaggactcccagaagatgcgttttctgcagtaacaaagaaacagtaacatcaaatacactacaacagcctaatactcttgcttcatatcatctcttgccaaattttgtcttgaaaccaaaacagggaagggagagagctgagaatgaagagtggattaccatcaagaggtttgatattgccatcgcgccgattgacggagaagccttcctcaggcgattcgatgggtttgacgacgtacttgtcaggaaactccagaagctcgaattgatcgtagagcttgaatctacttgtagatggagcaatctccattaacgtaaattatgagatttcaaataaatttttcaaaataggaaaaataatttgaaggatgatgatgatgatgatgctgttggagtttgttcaattaagaactggatcaggagaaacaaaaaaaaatgtcaatgattgttcattatttttcttcaaagttgactgttgccacgtgtctctcaaccggatactagtgggcttctttgggcctgaaatttaaactgtgcccaatagtctttcgtccggacaaattgttacagtagttaaatcaaaggccaccaaaactgttacgtagacatttaaagcgaatctccatcacctaccgactcttccttgatttgattgttccacatgtagtaaaaatagagacttgaaggtaattttgccttgagggaacatgaagagactgaaggttgatatttttattagaaagttaaaaaaattatttcagttaatattatatttataggatatatattaaaagatatatcgcgggcttatatttttatcaaatacatgaattttttgtttttaagatatcaactacaactagatgtatcataatccccttgttagatttattattctttttgtcttaatatcttataatagttaatagtcattaataaagaagtaatagctttcattgaagtgagtctactctaaataggatttccacagtaggaaaactagacatcaggaaatctattcaatcaagacgacttatgtagtagagtaatccccggaggtattgagcaactatagatatatgttattgattatttaatgtatgatacaattcgggatgattttataattaaaagatttgaaatttgaaattatatttattttgttaatattgttagttttggttagcttttaaaattgtgtatttgtatttttattgttaaattttatgatttcacccggtatatatcatcccatattaatattagatttattttttgggctttatttgggttttcgatttaaactgggcccattctgcttcaatgaaaccctaatgggttttgtttgggctttggatttaaaccgggcccattctgcttcaatgaaggtcctttgtccaacaaaactaacatccgacacaactagtattgccaagaggatcgtgccacatggcagttattgaatcaaaggccgccaaaactgtaacgtagacattacttatctccggtaacggacaaccactcgtttcccgaaacagcaactcacagactcacaccactccagtctccggcttaactaccaccagagacgattctctcttccgtcggttctatg

SEQ ID NO: 6016 - DNA, 3000 bp, Unknown
  misc_feature (1)..( 3000): cDNA_ID_1829649_gDNA_ID_1620836_Annot_ID_169896 3000 nt of promoter + ATG
ataattaatcaaattcttgtcactcgtctgattgctacactcgcttctataaactgcagtttaaatactttctcaaggaccctgtcaaatacgacgtcaagtaccaggtaagtcaacttagtacacatgtttgtgttcttttgaaatatctttgagaggtctcttaatcagaagttgcttgaaacactcatcttgattacaggcaagcgcgcagccattcttggtgctcggaatatttgtaacggcattagcatcgcaacactgaaaaaggcgtattttgatggggttttgtcgaaagcagaggtgttgacacatcaaatgtgggcaagtgatggcatcaactagtttaaaagattttgtaaaatgtatgtaccgttattactagaaacaactcctgttgtatcaatttagcaaaacggctgagaaattgtaattgatgttaccgtatttgcgctccatttttgcatttcctgctcatatcgaggattggggtttatgttagttctgtcacttctctgctttcagaatgtttttgttttctgtagtggattttaactattttcatcactttttgtattgattctaaacatgtatccacataaaaacagtaatatacaaaaatgatacttcctcaaactttttataatctaaatctaacaactagctagtaacccaactaacttcatacaattaatttgagaaactacaaagactagactatacatatgttatttaacaacttgaaactgtgttattactacctgatttttttctattctacagccatttgatatgctgcaatcttaacatatcaagtctcacgttgttggacacaacatactatcacaagtaagacacgaagtaaaaccaaccggcaaccgcattacataacataaccgcataccatttgaacggtacaacactgccgttagtacaagccatacatagttatatcacacacatataaaacacaaaaaacctaaacgcgctacattagaccctagttaaaatccacgctgccaaacacggaacctacaagcaggttacttattagatgatatataacagactgttgcagcggacactagtagctcgtaactactatcacttgttggtgaactttgactcatcgatctcaatcccttcttcctccgcacgctctccaccagatttttccatcgtactgagtcctcctttacgtcccatctccttataaccctcgtgccctagctgctccttcctcgcctctcctcctttgtgtcccatctcctgataaccctcgtgccctagctgctccttcctcgcctctccacctttgtgacccatctcctgataaccctcgtgccctaactgctccttcctcgcctctccacctttgtgaccgatctcctgataaccttcatgtcctagctgctccttcctcgtctgccctcccttgctccttcctaacaagtgtacatacatgcattccatgaaacatggagatcatagagtaaactttaggttcgtaataagtagattaatcttatcttaagatattaagatctaatgtttctagccttataaaaccattacttacgaactaaagaaaataaaaagagtgtggaaaagttgtaatttacggcaataccttcagcaagatgctcttgagcttcgaggctgtggccaccggtgccacctgggacgacggtctctccttgcttcgccttctcatcaagctcttctctgctcagttgctttgacgccattttttgaagaaaaaaacacgaacgatatgtaattaagtaagttgcttttaatttggatctatgttccgacacagatacggacgacgtaattattcctataaatagaaacgtttgtgttccaaaggaaacaaaaggagagaaaaagtgaagtgctacgtggaagagaagacgcggcgagactagaaataatgggctttacggagatgacacgttgatgcttactcagtcaacttgctacagttattaacgagctgcttgacacgactccgattaatcttaatccattttctgtttcccccaagaaatcaagataattacccacatttgggattttttataaaactgttttccgtgttaggtcttttcaatatcagttagatagtactattatttatctatttgaaatctaagtgcaatatttcggataaatatgttttaaagttaaaagttttatatttattcacatcataagaaaaatataggtgttattagaagaagagatttataaatcgatcacacataataactgggaagagaaggtagcttcgaggattagttggtttacttgtcgacaaagtcatatctaccatgtaataattaggtctttttcaagttttgagtttggagacatttatttgagtttgactttggtcttattatatgcttgggctattgtacacgtttgactcatgctgattagagtatgtatagttaaatataataattaaaatgttagaatctggtgtggattagactttcgcgacattgttgaaaatttgtgaatgcatctatctaaaagttggtttagtggagtttctatgtgcacaactgaagtacatcactatatttggacaatattgaattatatttgaatttattgtcttgaagaataatttgcaacattacataccaaatgttggctctcttacggagagcgtataagcgccacttgacgtgggcttatatgggcccggttaagggtaaatgtttagtggccacaattctgaaacagcttcccttcttcggcccatactggagtacaaaagtaacgcaattaagaaaaagcgttacaggattaatccaaaacggcatcgttagaagaagagagcacacatagcgaaaaccctagtacctttatttgagccaacactttcatttctctccttctccaccagttttcccccaatcgctcctccttaaaccctaacatttttgcttcccctgtttcgattctcgagagttatcagagatg

SEQ ID NO: 6017 - DNA, 3000 bp, Unknown; identical to SEQ ID NO: 6010
  misc_feature (1)..( 3000): cDNA_ID_3079201_gDNA_ID_1620836_Annot_ID_169891 3000 nt of promoter + ATG

SEQ ID NO: 6018 - DNA, 3000 bp, Unknown; identical to SEQ ID NO: 6009
  misc_feature (1)..( 3000): cDNA_ID_3079205_gDNA_ID_1620836_Annot_ID_169890 3000 nt of promoter + ATG

SEQ ID NO: 6019 - DNA, 3000 bp, Unknown; identical to SEQ ID NO: 6016
  misc_feature (1)..( 3000): cDNA_ID_1829649_gDNA_ID_1620836_Annot_ID_50806 3000 nt of promoter + ATG

SEQ ID NO: 6020 - DNA, 3000 bp, Unknown; identical to SEQ ID NO: 6015
  misc_feature (1)..( 3000): cDNA_ID_1807281_gDNA_ID_1620836_Annot_ID_50808 3000 nt of promoter + ATG

SEQ ID NO: 6021 - DNA, 3000 bp, Unknown
  misc_feature (1)..( 3000): cDNA_ID_1829643_gDNA_ID_1620836_Annot_ID_50809 3000 nt of promoter + ATG
caacataaaaggtttgccaaaagagtaccccagctatgctgtacaagagtgttagaacaacaacatctggcgtaagagtgccaaacaatgcttggccagcccacctatcagtcaagtgagcaagaaacaaatcaatgagatgagaacaacgccatatattattgatacacgagatatcttaccatggcaaactaatatagcttgctccaagtgcaaaatttccaacccatccattttgttttagctgcaatgagatcagttcagatatcgatattcaaaactccaaaacttggatggagtgtcttatcactagagagtggaagttaggaataaaacttaccttaagaggtggagcagagtatatataagatagcaatgatcctcccaaagcaagatagaagacagtgggagtggtatgccctgcctgataagggaagattttagcaaatctgatgtgccctttaactgtactagttaatgtcagaagggccaacttacccacacatctaatattccagcaataccaagacctcccaataatagcacccagacttgtgtaataacctgcattttaaggagtaaggagaaatcagaatcacaaaagagataaaagctcacaatgttctgtctcagttacctctggctctgatattgctccagatggaattggacgatatggctcattaattgcgtcgatatctctatcataccagtcgttgattgtctggaaatcgacaagtctaggttattgtagcaccaagcaaatgcactagaataagaacaagtcagctttttgttgtgtaaaaccagacctgtgtatagccagtaagacaaggaccagacatcatcatgcaaagaatcgacttagcaacatcctctggggtccaatgaaagttccctgccagaagaaacaattggaaggaaaatgaaaaaactttctgtacagtattgcatgatccaaaagaggttcgtatgattacctgaagcagcagcaccacagacgactccccaaaccagtggaggccaagtgactggttttgtaagctgaagacgaatcttccatttattctgaatacagaatataacaacaaactctttttagctaacaaacaacattttcacatcatttctaagctaaaaacaagacttgtcctcaaaagagattacctttagtaggaaaattcctaaactaacacatcattatccacaaatatgataatttaaaagattctgaggagatgaacaaaattacagtttcttgagatgctcctttgataccgagaagctggttaatgcttgaaccaccggctggtgccttgtcaggtgtctgagatttaactgccgtcggaaattcaaacgccacagtgtttgaaaagagaattttgaagagagagaaaataaaaacaactaaaaaatcatacctttatcagtatcagtctccgccgcacgcacaacaaatctccgccctacgagagatccacaacaagatcagtaaaaaaaaaatcgaagaaaacattcatcaatctatccaacagaatgctaactaccgggtgattcgtagatcaacgtcgagaaaccagaacgccggcgagtgaactcaacggaatccgaattccgaagagagaggactccgactcgatcgacggaggtaactctggaagagtggatggtggagacagtgttgagaatcgaagtcatagaaccgacggaagagagaatcgtctctggtggtagttaagccggagactggagtggtgtgagtctgtgagttgctgtttcgggaaacgagtggttgtccgttaccggagataagtaatgtctacgttacagttttggcggcctttgattcaataactgccatgtggcacgatcctcttggcaatactagttgtgtcggatgttagttttgttggacaaaggaccttcattgaagcagaatgggcccggtttaaatccaaagcccaaacaaaacccattagggtttcattgaagcagaatgggcccagtttaaatcgaaaacccaaataaagcccaaaaaataaatctaatattaatatgggatgatatataccgggtgaaatcataaaatttaacaataaaaatacaaatacacaattttaaaagctaaccaaaactaacaatattaacaaaataaatataatttcaaatttcaaatcttttaattataaaatcatcccgaattgtatcatacattaaataatcaataacatatatctatagttgctcaatacctccggggattactctactacataagtcgtcttgattgaatagatttcctgatgtctagttttcctactgtggaaatcctatttagagtagactcacttcaatgaaagctattacttctttattaatgactattaactattataagatattaagacaaaaagaataataaatctaacaaggggattatgatacatctagttgtagttgatatcttaaaaacaaaaaattcatgtatttgataaaaatataagcccgcgatatatcttttaatatatatcctataaatataatattaactgaaataatttttttaactttctaataaaaatatcaaccttcagtctcttcatgttccctcaaggcaaaattaccttcaagtctctatttttactacatgtggaacaatcaaatcaaggaagagtcggtaggtgatggagattcgctttaaatgtctacgtaacagttttggtggcctttgatttaactactgtaacaatttgtccggacgaaagactattgggcacagtttaaatttcaggcccaaagaagcccactagtatccggttgagagacacgtggcaacagtcaactttgaagaaaaataatgaacaatcattgacatttttttttgtttctcctgatccagttcttaattgaacaaactccaacagcatcatcatcatcatcatccttcaaattatttttcctattttgaaaaatttatttgaaatctcataatttacgtta

SEQ ID NO: 6022 - DNA, 3000 bp, Unknown; identical to SEQ ID NO: 6014
  misc_feature (1)..( 3000): cDNA_ID_1395806_gDNA_ID_1620836_Annot_ID_50810 3000 nt of promoter + ATG

SEQ ID NO: 6023 - DNA, 3000 bp, Unknown
  misc_feature (1)..( 3000): cDNA_ID_1829639_gDNA_ID_1620836_Annot_ID_50811 3000 nt of promoter + ATG
tccatatagaaatcatggagggatttgagacatgcataattggtcgtacgtacgtgtgaggtggtggtgttacttaagaccaaaattatgctatatgcaacatgctacggaaaaatattaactgatgttgttcaaggtgagacttgcaatcatttaaattgtttatagcatatttttcattttaattaagaattttagctcgtactgagaatgagatataaatcaatacaaattcaactttattgccaagccaatgggggacacatgaaaagaataaaattagaaaatgttaaacgagatatgagtgcattgaaaccttgtttttgtagcatactcgagtttttatttatatatggcccatcatgctatgctttctctttcgcttataccattgagcttcgcgacatttgaggaaaagacaagcccaacacattttactttaacaataactaatcaacctctacttcttttctattaaacaaaatgttaaagggtttttttattttcttataatgcattcatttaccttgtcctaatgtcccgataaatcttgccttttaagttctttgactagtggctaccaaattcttttagaatctgtaatgattatcattgaccaactgtgtctgtgttttcctaaatttacaaagacatcacgatgtaaaagcttcggggtggattgtttatggaagcggtcaagcaaagaatatggatgggttcacgaggaatcactagtgtgtgtgacattatgatattttgttatcggtttaatggattttgccaattataagagaatctatgttgcaagatggtagatgatcgcactacaaaaaagtgatgagccaaaaatatagtcacacgttgtccaatggaatcttcaccacgaaatgaaaaaagttcaagtgatcttttggacgtcatgcaaaaatggaagatgatgacggttacaaattgatctgtctagacatcttatcttctttattcatggcaagtctttggtactactatacgtgtgatgtgaacgcatttcagataagttaagtagatatatatcttgttgtatgtgtgaatgcatctccacatcttgagatttggttggttaacattgggttaaatgtgaacgcgtctttggaatagtatataataataatttagacgcgcgtttgttaactttcaaacatttttgtgaaccacgctccaccaaataagacatgtggtggacgttgcaactagatttacgcatcttgatgggtttccaaaaatggtaagtagaaattggttttctctcaaaagcaccattatttagggtttgggaatgaaaaaagtttgtatctttatcgttatgattttactcatgctaaaccaaaggtttcttcatcgcgttttggacttcgtcttatctaccgccctatgtgttacatgatacgacatatatgatacccagaaaaaaattcatgtgtgcgggacaaaaagcctcagatgacttttgattttgaaaaactatgatcatttttaaaaaagttgtagaaattaaatcattttgaactattcgatgcaaccaacctatctaaaaatgaagtaaattccgcaattttagatagatggacatcctcagatcacatccatttaaactaccataatacacgtagatggctctagacctctagtagaagatatgatactactatctttgatatgtcgacattggaagatacattttacaccgtagagctttgtggatatttcgaaagtaattagtgtataattcaaatcaattaaatttagatatataaatgtaccattctaatgcaaatcctttataacaaaaaaaaaaaggactttcccaaaggccaaacaaatgattgttgacattgaccacacgatcgtttagaaacatcacaaattttcaatctcctcctagtctcctaggctcataccacttacgttcgcatgttacataccttttttgaaatggccagctcatttttgatcaaatgaatactggatttacaatgggaaaaaattctgcatctatgttcttagatttacaaaataaactagaaatgttcgttttagtattttctttctatgaaataacttgttgttttatgaattatgagtctaaaaatggcatattagaaccaaaaaagattagcacatgacatttcaaaatcttaaatggtaacattttcaagatttttattctatcattagttgtttctatcatgacatttcaaaatcttaaatggcatattagaaccaaaaaattatttgttttattttgtacgtacaattaccatatttttattcattgtcatagttgttcaggtggatcttagatatttcaaagtataaaatttgtgatcgtattttagatgattacacacatatcacatatgtaatgcacataatatttccaaattaaaggtaaaatattatttttaccggagtatgtatatattcaatccagattatttttaaaaaattagattttttttgaatgatcagtcttatcaagaattcaaaagatagtgttgttgtcaatcaaaattactaaaagaaaattgtttagtcaacatatatacgtaccttaataaatatttttcttagaatctaaaggaatttacagatgttaaaataaaatccaataaagtgtaaatttaccaaacaagtaaagaccatttttcaaaaagaaaaagaaaccaaggagaccaaattatgattgagttttacaaaatacagaaaataaagaaattaaataaatatcaaaaactcaaaagagacctctcttctctctctctctctctctctcgctactctcatcttcaccgtacgcttcttcgatctacgcttctctctagctatagcttccattgtcacgattcctcccaaagcgtagaatgtggaaccctagatacctcaaattcagctagagatctatctactttcacctctattactttctacttctgaaacccctcatcagagctacacacagtg

SEQ ID NO: 6024 - DNA, 3000 bp, Unknown; identical to SEQ ID NO: 6013
  misc_feature (1)..( 3000): cDNA_ID_1829635_gDNA_ID_1620836_Annot_ID_50812 3000 nt of promoter + ATG

SEQ ID NO: 6025 - DNA, 3000 bp, Unknown; identical to SEQ ID NO: 6012
  misc_feature (1)..( 3000): cDNA_ID_1807217_gDNA_ID_1620836_Annot_ID_50813 3000 nt of promoter + ATG

SEQ ID NO: 6026 - DNA, 1808 bp, Unknown
  misc_feature (1)..( 1808): cDNA_ID_1829627_gDNA_ID_1620836_Annot_ID_50816 3000 nt of promoter + ATG
caacaaccgtctctccttatttgaccagagtccttctgtttttttttgttttttttttgtggataaataaacagaataaattagggctcgaaatacttatgatatgtattccaaaagacatagctttgatcacttaaacaagccacgcctagctgagaaagaaaaggctttggctggtttataagaaattaataataactttctggcctttaatttagataaatagaacatttaatttgtaattatatattttaatcatgcaaataataaattatctcaaccaacattataattttatatatctttgaggtcattatttttgtaaagaaaaacgctagaattgaaatatttattaatttagacgaatataagttggacaatttaatccatgtaagattaagattttgtatgccatcaatctaacaacttgtctagacaactaatgtttaacaataatttttgatactgcaaaatttgtttatgtgaagttacagaacttgtaggagttagattgttaacgttacaatactatatatagttgattcacgtgtttataggcaacatatcaaattaacatgtttgctttgcagttaaaaaattgttcaagaaataagccaaaattcatcgacaaatttggagctaggggagattcggtaggtacaaattatacaaaacttattcaagtaattaacaagtaaaataaataatcgtttaccacgtgcccatccagctgtgattccacttcaacttctgactaaggaacggaaaggcattccaagtttcctcaattaggctcaacttttcagagatgaaaagaattagtatgtgcaaaataacgtatagattcacaggatgatacaaaatctttcaatgacatggttagtcaacgtaaacaaatttgttttggaagggtccatagagatttttactaaagcaacgtggagttttcatgtgtttgcaaccgttaccaaaacccaacagttagttaacaactttattataatgaataaaaataacacacgagaattaatgacatagtgtcaaaaagaagaagaacaagcatgatattttatgccgactaaagtattgtgaccatttgttgttgctgaatcgtcatctccaactcctaacgttaggcacgttcttgaaaaatatcccataacgcaaattctagattaagcccggtaaagtaaacttgaaaaaattataatatacaggttctttatttaaaggaaaatgtgacatggcagtgaggagaaactaacccatcttcctaatggacaaatgtcagcagagccatacatttataaagtattttaatgattaaggggacgatgatgatgtcatcagtagttgagttgggggtagaataggtaattcaagaaatatgtgattgaaagtggaaacgtaagctttctggcttttgtgtcctctctgagtctcagtgtcgggacaagacatgcatcagcatcacacatccgtgaatcggtgctttatcctcttctatcttttttaacttcacgactagaaaattgatttttaaattttgttttacacaaactgatattaactacaaattaagaataacatagaaattaagaataagtttctagaaatgtacatcaagtattggccgttaagtttcaacatatttataccatctggcctcaattacaatcataattcataaataatcttctgacacttaataagataacttttcaccgagtgatatattcctgaaagtaaattcaacgctttagaataatgttcttatatatttaattatttaccaaatacacactatg

SEQ ID NO: 6027 - DNA, 3000 bp, Unknown
  misc_feature (1)..( 3000): cDNA_ID_1807967_gDNA_ID_1620837_Annot_ID_50818 3000 nt of promoter + ATG
ctcttcgtcaaccacaaacgcgtttcactcttcgttcacgtcggggaatttaaaaaaatctccttcgtaacaaaaaagagaaagatcaagaagattgtcgtgatggctgccggatccatggacggaatattccgcaacatctttgaaggttgcatctctagctgtgactcttccatccaacgacgtccataccacaagaactgcggttgtgcccttcacgagagatctcgcggtggaggttcagcgactccttgtcgtcatggaaggtctgaggtcgttatgttccctatccaacgatcttggagtgaaggaaacagtttggctctgcatcttgcctcatcttcttcttcctctaacctccagtcactttcgtcgtcttcgtctatttctacccttgcatcgttatcttcgaccgtgtctgatattgattctcccatttaaggcatgaactattattagttcccattcattaattttttgtcttttatttgtttgtttcgaagagagtcaaattatgtttggtgtgtgattggaaaggtttcatgagtttccttggatatcaaaggaaactaattcaaatgttgtaatataatggtcaattgtagggaggcttttctataaaatttgtacagaatcatgtatttgagcgtaattatagttttttttgtatgatgtaaatttatacataaaccgtttgtaacatcgagagatgaaatttggattggaatgcgagaaaaataattttattttaatttttgtaatatgatcttcaagctatttcttcttattttatgttcttcggttaccactgtcttcatattgttttgattatactacgctatcatttgcccaaatctcttgacattctaatgtagagttgttgagcgacttgctaagattgttttccaagaaaaaaaaaattgtgtattccatacgtctaagagaaaatatttgtttactatgtgacttaaaaaatatataaatttaattattttatagttatatttggtaatgactaatgacattcaatccgaatatctgatcattgacattcaatttgaattttggctcaaatagaggttagcagagataatccgtctactggattagctatactggaggagaatgtttttttttggttattgttctttcattgatcggtatttggagaaaaaatataatttttcaggatattgttcgaaagattaatataacgaaacatcaaatatgagtttgtcttcaacggagcctacttccctgcatacaaatatagaagcattaatttgggcgaagtaatgtctaacggccaagcagaagaatatagtttctttcgtcacgaacttttatgaactcataaaaatggtgacatggtgtacatgtcttcaccaaaagagtggcccatattttcgtcatatctcgaggaaatcgtaaagtgtaagtaaaaattttctcttgtttttctgtttcatttgtttcttatcgagttaatgctagaataggcacatgtacactagcataaaatgtccgcactaatccacaatttgatcatgcacgtaaatattgttttctcaggttgcctacctacttttgtttgttatatccttgataacattatcatgttctaacattttcaaccttgctactattgtaatatggtacaaaagaaattgaaatattttatgcatgagatgagacaaccaaaagaaaataaaaatggttaataaaatatgaaaagaattgttaacaaaaaaaaagtaaaccgcaataccttttttcgtctagtaaaatagtaaaactggagaattctctttctttttctctagtaaaccgtaatagtaaaatccgtcccaccatctaatccagtttggtaaaattaaacattttttttttgttctaataatatttttattaaaagaattataattcaaatcaatttaaaaagttttcttttgaaatggttatttaattttatagatttcatatattatatatattctaaacgtttttcgttaaatattctaaacattttagaaactttaaataactataatatttatctttaataaaatcctaagattttttctttttaaaagtaattaaaattgatggagatatattaaataaggaaatgctaataattaggaatattatttaaatgataataattaatgttaatgacattccttgtaaataagttccaacttgaggatttatttacaaaaatggttgcaaaaatatatatgtagataacatgtagataacatgtatttttatttcagttgtctttgatgtcagattgaataaccagtttgagtttttgtctcaagaacagtggttttgtaagatatttctttcataataaagaaacagtaaaaaagaaaaaccgcaatacttttcaaaaaacaaatatgaaaagaattaaataaagatagtaaactgaaagccttgtccctattgcattttgccatctccgtccgattggtgaggtgtgatggtgtttgtacttgtgtctctggttttagcatcctcttgattttctctctgtcggtttgctactggtttgacttcgatgtaaggtctatccaattttattggtgcttccgacgttcacattaggaaagtttggtgagagtttctgatccttttgctcatttttagtgcttaaatcttgtttttctcatagtttttgaccttcattagaattttgtctcttggtttgatttctttgatttaaattagttttcccatatctgttgggttttttcttccctcttttggattgagtttctggagacaatccattgatccaccgatttatatattttaacttgtatcctactttggtttttaataaaatttagaggacaacaaaaaaatagtaaactgcaagcccgacccagtaacctattaaggtccaaaacgacatcgtagaacatagcaagtaaaagaagaaaagatatagagatagagacaatgatatcatcatcatcatcatccaac

SEQ ID NO: 6028 - DNA, 3000 bp, Unknown
  misc_feature (1)..( 3000): cDNA_ID_1829692_gDNA_ID_1620837_Annot_ID_50819 3000 nt of promoter + ATG
tagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaagatgagaatcacgcagatcttgttatgtctggtaatagtggcattgtcttcaagctcccatgtctggtccgatcagatcttcccagctcatctaggtctatatcatttcctctcttctcataattttccgatcaatttcgagttttgtcttgattcaatgttttatgtatagttggaacattcagcagaaacaatcgtgaaccaaagtacaagattgagttccttcctgaagattcaccttttcacccggtaataacgcaatcttaagatagatttcaaaaagcttaatttttgcactaattgaatattaatagtagagattctctgtgattttggtgtttgatctctaatattgttattagtcacactttagatagatttgaagcttacgttttctctatgacatgatttactatgagtagagatagttgtaacatagagattgtcactaacagggttagaatctggaatctatggttatggtggattagattagcttttttaaatcacaatttagattgatttgaagcttatttttgccatgtgacctgagttacaatgattagtgatagttgtaacatagagatcctccgttgttttggtgttttttattctctaatattgttgtttatatggtggtaatctggaatctgtggttacgatggataagagtatagtagttttgaaacttattttgcactttgatcttaagttacaatgagtagagatagttttaagttagagatcctctgtggttttggtgtttagattctctagtattgttttgtatagggtgagaatctggaatctattgttatggtcgataagtgttggcttttttttttatcacaagctattgatttaaagcttatttttcactttgacatgagttacattgagtagagatagttgtaacatagagatccctctatgattttggcgttttggttcgctaatattggcttttatagggtgataatctggaatca

SEQ ID NO: 6029 - DNA, 3000 bp, Unknown
  misc_feature (1)..( 3000): cDNA_ID_1829684_gDNA_ID_1620837_Annot_ID_50821 3000 nt of promoter + ATG
cgagctcctatctcaaaagatctttttgctctcccacgagcgcacatctccaaaatcgtcaagctctcccacgagcgcctatctccaaaatcgttgagctcttccgtctcttgcgagcacatacatccaaagatcttaaagctcttccacgagcgcctatatccgaaatcatcaacctcccacacgagcgcctatctccgaaattgtcaagctctcacacaagcgcctatctccaaaatcatcaagctctcacactagcgcctatctccaaaatcgtcaagctctcccacgagcgcctatctccaaaatcgtcgagctcttccgtctcctgcgagcacatacatccaaagatcttaaagctcttccacgagcgcctatctccaagatcgtcagacactcttgctagcgcctatctcagaagatcttatagatctcccacgagcgactatctccaaactcatcaagctctcccatgagcacctttcttcaggatcttcaagctctctcgcatgcgcctatcttcaaagatcttccagctctcccacgagcgcctatctccgaagatagtcaagctctcctacaatcatctatcttcgaagatcgtcgagctctcaaacgagcatatatctttccacctattgcgattctccgactcttgcaaaaatccacacttgctcaaacaaagaatttttctttggttcgggccaaattggcatgtttccggtttcagaaaaatattcgccaatcgcaagaaaccttctctcgacgaactcgggggggactaattatgggatacgggctttgccctctatgcccaattcggcccaaacacaaatagaacaagtcaataaggctcctaacaaggaagaacggcccatcagaacaacggcccatcagaatgactgctcggcccatcacggctcggcccagcctgataaattcagaagggcaaaacggagatatcgcaagagagactaagagaaccctagatcagcttcttgcctataaataagaggagatccactactaagaagggattggagaacctaagtcaccacttagagaatttaagagagaattgttgcctagctctttatctcttactttttggttttccgttctgtattttcaggttttccgaccattaatattagttttccgacttgtactttcggttctccgttctgtacttacggttttccgttctgttaattactgtctttccgttcgtcattaataaagaagttactccgttctccccaaaccccttagttatttattgttacaacctcggtacaaacaagaggaaagacaatttagatttaatttcaccttatcattgattatcgtttttattataatcgcttcatatgctccaactttctaatgcattaccttgatgatgagtctttagatttgctgacttctttagcagaattggcagtaaaaccctgaagttgtttggaaagccaacagatagacgaaacagatttttaaacaccgagattacattacggaagacatctgaaaacataagaaaaaatgtaaaactctgaacttaagtaagatgctctctggctttttctgttgatcaaaactcgaccatgggatcattggttcatgggtctattcaagcgtccaggtaattggttcagtttgtaagtgattgaaaaaatctcttaaacaaagaaacctgataataaaatggatgatgagttgaagttgatgttcgaacttttttgacaaattttttccggtgagtttccggccaaattccggccaaacggctgaacggatttgtcgggtgattagtgcattggaaagctggtaaagagttttacaaaatggtatactcatacgtcaaaaacggagttgtattgaatgagaaataagggtgtaaagtgggacacttgggccaaaccggaccgaaccaaacaaaaccaagctgagccgggctgcgggttgtcgggacgtcccgtcatcggctcaagggctgtcgggcttgcggaccgtcatgcttgtgagttattgggcttgctgagttgaatcttatggaaatattttcaggatagtctcaaaatattctcagaataggatagtctcagaatattctcaggataatctcaaaatatatcatgcatatcctgaaaatattctcacaaatcttatccccctctactatataaagagatccagcgtctcattatttctcaagctctcaaacacaaaacactctaaattctaaagtctctcctctctctctcttgcttcttaaaagtaagttcttagtttagtagtttcgagagtatatcgtagatctagttcgcttgagtctaatacttgtgtgctcgggtattagttcgtgatcggttgtatcctgggattcaaaaatcgtgatgtccaaaaagcacgtacggccgatttattgaattaaggaaaaagatatcatatcttgcctccgtgatttactttctgtccttaattactgttactgtaattttattgttattgttatcttaataaaattcgtacttgtttctcaattcggtttttgggctcctacaatcttaattcaataaatccgcttttagcttatcgctctagacggattgagaaattttcgaattttttaaaacgatttcaaaatcttctaaaaattgtttccgctatcatctttgggtgcttacgtagaaggtttatagaagaacgttattacttctttctttctcctctttctaaactgcttcgcaaacgctacgtagcgattgttgtgaacagtttcttatataaacttctctagtttccacgaacactcatacttgaggagtttgggaaacgcgaaacaagtttctgcgaatgcttcttaagcgagtttgcaaaactaattcggtgaacagaatgactgatatcggtgaaatttgcaaaacaagtttctgcgaacgcttcttaagcgaattttttggttaatatactaatcagatctttttttttgtgaaccga

SEQ ID NO: 6030 - DNA, 3000 bp, Unknown
  misc_feature (1)..( 3000): cDNA_ID_2135207_gDNA_ID_1620837_Annot_ID_169928 3000 nt of promoter + ATG
ttgctgcctcgttaaaaaccttttcatggaaaaatcaagtgggataaaaaccatgataaggaaaaaagagtacagccacgctcatcatcatatgtctcctcctggaagcatcttcttcaaaagatgaattttgatatgtgaagaagatttctgaatgttgtagctcgaagcgcttttctgctacattgtgttttgggcgaacgtactggaaatcaatttcttgatttttcttgaggtcttgaatgtaacagaagaatcttggagaaatatttcttgtcatgtcgctcttgacatagcttcctttgaactgggaaacatatgcaacattgtcttgttgttgactcttcattggtgactatattgcttgcttcttatatatgttgatgacgttaatctaagccatacatctttttgacatgcttcatgaagtgcaataattttggcatgacttgagcaagctacgaccaaagtctgctactagaaacaccgcgagcttgttgttttgcgatatatttttatatggtttgatataaatccttcatctataaaacttattaaaccaaaattcgagatttctagaataaaataagtccaactcaatctaaccttgcagattataaaggacatgttcttacttatctcgatgtctagccgagggagatgagttaatcctgcaagtagatcaatagcaaatgctagatacaattcacaaaatatataaatactcgtcagcatttatatatagtgtttcatgaccaaatatatagagtcgacttcctttagaagtgactaatataacatcaattactttagatgtttagttggaatatctggagacacttttgtctttccaagatcttttattccaattaactctttaagagttttgatgatcaaaatcattatgtttataaattccagggaatataattataatatatatctttcaaggattagttctttagacatcccatgaggcgtagttaagttatttatatagcatcaattcaatatcgagtgattttgacaaatcccggcgcgacacaccgttttgtcttaagtatcataacactctttttgatgtttggaccatatgtccagaaattactcgtttcttatacgagattaatatagacttgactctctttatttattggccaatatatctctttacgctcacagagcggagattcatgatcctcattaattacattacacgctagatcattataaatgattttatttaggtacctgattttgttattaaccatgtcaatcggtctctttactcttcttcaggagtctctttactcttctttaagagtctatatgctcctcttttaagagtttaatcctctatataacaatttgctcttttttcttttcgagggttttctttatatttgaaaccaaaaatgtttatcacgttctttaacgtgttatagacaataatatgtcatctgccagagacatattttttttttggagcatttttagctgggatatgagtttttctatgaactctctaagttcatatttatttgtatgaggatcaataattttataaaatctcattcatcagctgtttgcatttgatttgcaatatactctgaatagtgatcattttgaatttttgaactcttaagttcatatttatttgttcaaagatccaaactattcaataaatcttccatagtgatggagaatttttatcatcaacattatgatttgcaaatcttgcaattggcacatctctaaaagatggctcaatattaatagagtgaagatttatctccaacatctctaaatttcatcctctttggatgatatttttatgtggtgcagaagagcatttataatatatatctcacacccataaaatttaaaatgataaatatttgatctctaatcatgtataaataacatgagagaaatatttcttatgaatcgttggccttatatagaatcatcatgttccatataaaaacatggagattaaatcatcataaattgttttgcaatcacttggatttgcattatgaacgatttattaaagctcaatttgagagtaaacatcatttttagatgttccactttatgttaaagtgataacttttaggatatgacttcaccagagttatctcgctctagggcgtcaaattcaccaaagtttatcgacttattatcgatgtgggattcctttaattctccccctcgagataataactcttaaagtttattcatctcgaaatgaatctcactttaggatcaataacatgtatgaacgggatcatatatttaaatttggatcctcttaaaaatgtgggacttgtaattattcctcccaagattatggcttttcaagcctatttctcttgtaccggatctaattttagatcggttatattttagatttaatttggagaatatttaggaaatcgaccatcatatactatgagcttattaaaaaaatggtgatttggccaaaaatcatatgattctggaggcatagcctaccacaaaatgaaggagaaggtatacaaccatcgaatccataatatataaataaatttaccatatattaaattttaccatctttatttttgtatgatataatcatacatgtgtgtgtctccattgtggtcaaacatttgacaccatattaatttatagtctcaatataataataataaatatctttaaaactgtacgagtttccttggagactttggaaaacacaaaacatcgattattatgaatctgatgtatttggaagtcgagagactagctcatctagatcttctcattatttgtgcactttctaaacatacatcgacaagtgcttcatatattctcataagaaaactatatttttaattttaaaaatactttaatgtttttaaatattatgtaacacatattaattttttacgaataaaaccaatataaataattaagcatatatgttcaataacaatttgtagaatagatgaatgaatg

SEQ ID NO: 6031 - DNA, 3000 bp, Unknown
  misc_feature (1)..( 3000): cDNA_ID_2135234_gDNA_ID_1620837_Annot_ID_169937 3000 nt of promoter + ATG
gattcagcttggtaaaaagtgttaggttcgtaacgacagagatagtgtctcatgtagttctagttcgcattttttggactagataggactgggtgggcgcttatactttaggttgggatgtgtttaaaagaaaaaaaaggggttgattcattgatgagaaaaggtaaaagactctaggtgaagtaagctaaagaagcagaaaaagtctagtaaaggttttgggatttgtaaaaaaaagaaagagttcttgttagctattgaagatgggcaaaagccctcggttttaaaatgttaaaaacaggaaccttagttgttaaagaaatccaaatccgctagatgtatcaaagtgttgagaaagcttttcctagagttaagagaaaagaaaagaatgattagaaaaagggcttaaaggattcatgaatgcaaagggtagaggtaagttcttatactgggattggagatgggattaccattaaagcttcatctgatatactctaggtagatgggattttatctctgcatgcatagcttgggacttacctttagcattctactaaagcttaatcattttttgagagatcccctgttactgaagcctattctgtaagggaccatctttgtctcttgaccttttaccttagccaaatgagttcattgatgatgcattgcttgattcacgttccagaactaatgaatgttaaagggattggtagatttgaaaacatgtgtaggtcgagcatatgagtcggattgattgatagtaaggcatggctaaagtttttcagtagaattcgatcatatcgcagcttagaactatcaacttggacattgatttcatttggtttatctagtgctttggctctgagtccccgatttcaaacctcacctctagcttgttcttaattgtttgcttgagggcaagcaaagactaagtttgggggagttgataagtgtgtattttgcatgttttaagcatccatttgtcatcactttagcaccatatcatcactattttataccatttctcatcatttgtcatcactttgcatgtttaggatagttttgcatgcatgtggcatatttgtgttgttttcaagtgattcggagctgttgaagaactaattggaagaagcggacctgatcatgccaaaccactcgacctcaggtcgagtagacgcttcacgacctcaacacaccactcgaccacctggtcgagtataggatttcaccacttcacctcatcactcgaccccctggccgagtaccccacgagagtcactcgatcacttcactcgacccccaggtcgagtgtcttcacctccaccacctgaccatcacttgatcacacgactctacctggaagtcgagtatcaccatcaccaccactcgactacatactcgatgtcgagcttcagagtcttctccattccgcactcaaccagacactcgagcacaaggaaaaaaagaagattctagcttatcactcgacctctcactcgaccacctgggtcgagtacagttcttaatccgtctcaatactgcgtcgttttgagtattagggtttcggaatatttttgctataagtagcacgtactttacattttcgagaacaagttttttctaagttttatttcgcagacactgtgttcttgaccttttgtaatccggatttctctttatctattcagtattaaatattcggtatttgttcttgatttcgtttactgttgttcatcctgttatcaccttgctattacattgttgttatcatgttttcactccattcaacgtttatgttttcttcaatgatgtctcagtagtgaataggtttctgaggatggattagagtagtttagaattctcagtatgctaggtggttgagtttgattgatagatcccttctggattagttgttcttaatgcctattgctttctgatcaaccagaatttgagcccagacatttccgcgcccaaaaggtgttcgatgaaatgtttaaacaactaattccagagattcgtgtccctgtaccaaagtattggttgcagggagcgttttgcctttaacttgttgattcgtaatgcctgttaggttagctctcgtcaatggtgattgagtctgggactaggttaacttgagggtctctgttgcggtggtacttagatttggttaatgaacttgttgtgtagggataatttattgagccatgtcaatcacctgtaaactgaggaaacaaaactactcaattaccccatcctcgagaattctttatctgattaattttattttttactctaccgttgtttactgcatcttgtcatctgttgcttagtccctgcaattctttgctgttactcgacctgatactcgaccacccagttatctggcaacagactctgcagtcaagtatccctgttacattttctgtccgttactcgacctgtcactcgaccacaccctgtgttgagctgcatcgagctgtgttggtcgagtgttttattgtttctacttgattttctgttttctgcatgttcacttaggactgctaggacacaccaaaatctgttattgcttggcttgacttagtgacttctgatcacatcttgattgttagcatcacacccatttggattgatacctaaaatactacaacgacatgattggtgttttaggataattgactaaaaacctattatcaacccagaacatgtgggggaaaactttgcttaccactaactacatccttaataggataccacataaggtgactgcaaagtcaccacattaactttggaaaggtacagtaccctcgtacaaatacctaaaagtgtgggggtgtctaacaaaagtggctgtaccacctcccaaaaaggtcacaattgggcctaagactatagactatatcttcatcggatatgcgcacaacagcagtgcttatcgatttcttgtttataaatcggatattccagatatccatgaaaatacagttatagaatcaaaga

SEQ ID NO: 6032 - DNA, 3000 bp, Unknown
  misc_feature (1)..( 3000): cDNA_ID_2135271_gDNA_ID_1620837_Annot_ID_169951 3000 nt of promoter + ATG
ttatctttgtgtggatggatctattgggggaagtaccttgtatcctaccacagacggtagtgaaggtattagcgaagaatacgattacaacaagtggaatgatgtaatagtagaacaatatgtacaaggaaatcttgaggaagacgtcagtctcactcaacagactgctcaacatccaggggaattcagtcgtttattggaaacgtgtatgtacacgggtgttagtgtacctggcggagatacaggggaattcagtcgtctcttggaaacatgtacgtacactggtcttagtgtacctggcgaagaaacaatttctccattgggtttatggtacacgctgcgaagggcaaagggattccaatcttatttgtatagacgaagtcaccgcggatgaagtgatcgacggtattggagcttcctcaactgggacactgaatgataatggggtagttaccgcagctgaggcttaccaagtgtataatgaatttcctaagttacatggtggcgagttggcgaatctcggtaacgatgctgctcctgtgttcgatgacttactcaattttcgagctgatgagacacaggctgaaatcagcaccacatgcgaaactttgtttgttggaagtgtttttaagaatagaaaagtcctgcaacaaacaatgtctcttcaaccgataaagcaatgcttttgcttcaagcaacctaagtcatgtcctaaaacattgaagatggtgtgcgttgatgagacttgtccatggcatttgactgcctgcgtcgtgaaggattcagaaagtttcaaaatcacttcgtatgctacgacacatacgtgtaacatcgactctcggaagaactacaataaacatgctaattataagctcctcggagaagttgtgaggagcagatacagttctactcagggtgggccgcgagctgtcgatttaccacagctgctcctaaatgatctgaatgtgcggatttcatattctaccgcttggagagcaaaagaggttgcagtggaaaatgtaaggggggatgagatagcaaattacaggtttttgccgacctatctgtatcttctccaattagctaatccgggtacaataacacatctacactatacaccagaagatgatggtaaacagcgcttcaagtatgtctttgtctctcttggcgcttctatcaaaggtttgatatatatgaggaaggtagttgtggtagatggaacgcaactagtcagaccttacaaaggatgtctccttattgcatgtgcccaagatgggaacttccaaatattcccaatagcttttggtgttgttgatggtgagaccgatgcttcttgggcatggttttttgaaaagttatcagagattgttccagacagtgacgatttaatgattgtctcggacagacattcatctatatacaaaggcctaagtgttgtttacccgagagcgcatcatggagcatgtgctgttcaccttgagcgaaacctctccacctattatggtaagtttggtgtgtctgctttatttttcagcgctgccaaagcttatagggtcagggatttcgagaaatattttggactgttaagggaaaagagtgctaaatgcgcaaaatacctagaggacataggatttgagcattggacaagagctcactgtagaggagaacgctacaatatcatgtctagcaacaactctgagtccatgaatcatgtgttaacaaaagcaaaaacttatccgattgtttacatgatcgagttcattcgggatgtcctaatgcgatggttcgcatcgaggaggaagaaagttgctaggtgcaaatcttctgtgacacctgaggttgatgagagatttctacaagagttgcctgcgtcaggtaaatacgctgtgaagatgtctggaccgtggagctatcaagtgacaagtaaatccggtgagcattttcatgtcgttctggaccagtgtacgtgtacgtgtcttaggtacaccaagctaagaatcccatgtgaacacgctctagcagctgcaatcgagcatagaattgatccgaagtcttgtgtcggatggtggtatggccttcaaacgttttctgattctttccaagaaccaattctacctatcgcggatccgaaagatgttgtcatcccacaacatatagtggatttgatactcattcctccatacagtagacggccaccaggaagaccactgtccaaaaggatccaatctagaggtgaaaaccgggtatgtactaacatcgttcattcatctacttgtattttgagtattaccatgcggagatttttaacttcctatgtacgtcacttcagaaaaagagacagaaaagacttttaccaaatcagtgtttcacgctgtcgacaagcaggtcataacaagaagacgtgcaaaaatccaatctagttctggtgacaagtttctgagccggccaatatagtgtacgcttctgtgttttctcggtgtacgtaagtttatatataatccacctaactatgtacgttgtgtacgtacgtttaaactctacgttcgtataactatgtacgtttttgtctgtgtacgtgttaaagttcatgtaataagggtacatagaggtggttgctcaatattttgagtaatttgaaataagttttttgaaaatctaacttattccccctcttaaatgaacggagttggagatatggttgggtatattgtggttatgttggtatttaatggaaaggacgtaactgttgctgtttattgtcaaattaacgttataattaccctatatgacggttaccaagctattaccaaaaatttgaatcaagtgtagttggaaccgcattaataactgtagctgttccagatttcttctatttaagtctcctcccttccttaattttatccacaatcctcattctaaatccatttcttctgccggcagttatatcattcacaaaaattttttttgtctttcgattcgcttgttcttgctatccgtgag

SEQ ID NO: 6033 - DNA, 3000 bp, Unknown
  misc_feature (1)..( 3000): cDNA_ID_3079216_gDNA_ID_1620837_Annot_ID_169950 3000 nt of promoter + ATG
tcagcaactttatagagacgacaagggcttcatatgctgcccgaccccatggataagtcttcatggctttgtcgtcgaaaactcttttggcactctcaaatggtatcctagagttagtatgcaagccaaaaagtctaatggatagaagagtcaataacccaaaccatctacgcttttcagtaggccaagctctgcacgttactaagccctgcctaagttcatctagattaggaccttcaccggttggcacatgcaattcactgaagaacgctttgtagtcagctgcaggcacaaacttttctgtaggcagttcatctatatttaaacccgtgatatgatgaaattcgttcaatccaaaccggatgggtttaccagccacgatacaccaaagctccttcttcagtattctcagttgtctgcatagtagataatgtacggtcttaccagaccatagaaaataactatcaacaagcttagcaattaatctaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtcataacataaaacaaactcatccacagataccataactcaggcaaaacataaatctaactcagccatagataatataactccgtcataacataaacctatctcagccacacataacataactcagccataagataaatctaactcagccatattttaacagaaactcagacatcgatgtaaggttaaaccataactcagtcacagcataaaacaaactcagacacggatgaattgataaatcataaatcagtcggcaaacaaatagtaactcagccgtcaaatcaaatagatctaagaaatcggccaccatatgtcaatcaacgacgacgttaaaacccagctttaaaaaccatcgttacgcatcggaaaacgatttcagtgacgggaatcacttgagattgaacttagatgtcagagtcttacttaatggaaacatactcactggaacttagatgtcagatgtgacttcgcgcttacagaaatgcgactccggcgtctgaatttcggccggaacagacgagaaaagagcaaaacggcgaaagaaatcgattttgttccgtcgagagagaaagaggaagaaagcgacagtttttttttttttgggagatgatgaacagtaaagccaagaaataaaaaacccaaacgttatgcggtttggagatgattaatgacgtggattatcgtaatgacatggaatgatgacatgtataatcactgttttttaatttaatttttagttaaaaacgaattaaataataataattaattaaaactagttagggttgttaattgtaattacacaagaactgaaaacatctgagtaataaaaaaaaaatgtgttctattctaggaataaacatacaaatgtgttctatcttaggaattatttctatataatatgtatatgttcaattgtgatccaaaaataaatgtttcactacatattatggaaacaaattcgaataagtgttgatgcaaaatcacttaataatcagataactgaataaattttagaacaaaaaaaatggatcttataatgtcattgttttctagcaaaataatatgatctaccggggatcccatcctcggtggtgaactctactgaagtgtggttaactctgttgaagtgtgatgaatagtgggggagtagttaggtgacgactctgcttcaaatgtgatgaagtctggtgacgagtaacatgagctatttcacttatccctacaaacccatctacattaataacatcttgagagaaggtcaatctctactcccccactattcttttcggttaacttagatgccaacgcttaaaataaggtggatagttgagtccaatataactctaatatttttgaaagtgctgttacgagtttttttgaatgcttgtttccgagttcatagattgcatggtataggttattaatagcatacatgttcatcctacagtagtaagaaaataatgacagataaaggaaattacgtcacatattattggttcttatttgacttttcagcattttcccgttgttgttttattttagggtaaattgcaggccacacctgttgaccatgttttatttccatggattgtcaaaatcaaatgtggttttcaccatttatcttttcgcctgcaaaatgacgcttctgcccttgcgcttctctcttagtaactgttgaaatgtacggtttagtttagcaggtttagttacgtacactgttccggttcagttgaagattttttgtttcacgttgacgcgattcggttccgttacaagtgagattatttccattattccgaagtgacatcaacatttaatgcccccaaaaagtttagacgtgactattgtcacaattaatgcaaaatcatcattacatcaaataatattaaaaaaattattgataataattaataaaaaaattgttgagataaagaagatgaacccaggaacaaagaattattgagaacgtacattgctgctgaagaagtgttgatcttgtttttgtaccaagtttggagccaaaacaagcattgttcgtgtaagtaatgaagttcttttaagaagttttttgttatgtcatattaggatcttgattgtgttcgaactccatttttttatcagaaaatttgcaaaatctatatttgtttgtttaaaatagtcaaatgataattggtatttaggtttataaatgtgtagtatcgacattccatttgtttttttatatgtatagtatttttcagttgcatttaatgtgtgtctcctgaatttatgatgcaggtgggttatggatattcccgtatttact

SEQ ID NO: 6034 - DNA, 3000 bp, Unknown
  misc_feature (1)..( 3000): cDNA_ID_2135224_gDNA_ID_1620837_Annot_ID_169934 3000 nt of promoter + ATG
aatctcgtccatctcatagcacacatagtcttatgcttgctaattagctcgtcaatccgatatacatgcccgtcaacgctgatctcgtcaatttgacagttcgtgctcaccaactatcaggtcgtcaacccgagaattcctattcgtcaactgtcagctcgtctatccaaaagttcctgctcgtcgaatgttaaatcgtcaaccccgacagttcgtgctcatcaactgtcagctcgttaatccgatagttccagctcatcgactgtcagctcgtcaatccaaaagtttcttctcgtcaacagtcaactactcaatctaccagttcttgctcgtcaaatgccagctcgtccaactaccacatcgggctcgtcttcaagcttttcacatctcctcagcaactatctcctcgtatacatatcggttcgttacttaattgcaaagctcgtccagctcgtctagctcgccgacccagttaagaagcaatgccaaccttagaagaagtcttaccgaccaagtcaagtaacctcatcgaccttttactcggagaacttgcgatcgagtaacttaaagaccacaccaatcaggtgcaagaggccttgccgactcgaccaactagtcgacccgacgacttgaagttgctccaaccttgggaagtaatagcgtaaaaccagtcaaaaggtctcaccgaccagagaagaagtcttgtcgacaaggcgccaaacacaaaaatctttgaagtacaaactcattggagcaacgacaatcggcaatatcacatggccaaacatctcaaaagaaagagggaaagattattcgcaaccaaattgtcaaacccgttccccaccatgagacgatccagtccaccatactcgctgaactctccctcatggtcgctaagatccaatccattgagctccgcattaaatccgcgataactggaggtggaacgaatctctcaacctcgctagaccgcacatcatcttcgccgagctccgcttctggctcctcaagctcgcctctccaacgaatctcgccaactcgtcgagcatcctctaagccgagctccacacttaacagaattgtcgcaaaggatagctcacggtgatcaaagtaatccgcaaaacaaacttcttctatgacgagcttgcttctccctgtgtcgatctctccactatcctcggtgtgttcacctcatttagatctcacgctgaactcatcgcctagcatgaagacaacccacccagtccctaaacccaacttaccaacgtccctaatcctctttggcagatcaacatggctaagcgtgacaagccttgtgttggtttcctgaacctgaatttccgcgacgacggatacgctcagctctaagcgcatacatcaaaattaaaaaaaaaaaaaaaaaaacgctcgcttccgagctcatttgctatatagacaacaattggtttaatcccttctgggtgatacatatgcaacttcttctaaacgttatttttctaacgcgcacacaagttactactacaagtctaacttttacgagtaacacttgtcatccccacatcgtctccctggccaggagttcgattctaaaacgcgttcccacatggatgcagtggtgctcgttagataggtctaaaaaacctgttttcgaagaaataatccacatctttacttaagtaagctaaaacttacacttaaagatttaaagccgacccagattcgaactaaataagctgatagtaaggcagaacaatataagccgagtccgctcgcacgttctcgcttacctagaggcatccacagggtaagccggacaccagcgtcgcacctacaaagtacgacgagtcagtctcgcatacttcatacgtaagccttgtgattcgagttcaacgtatacaggataagtcaagggacgccttgccctataatacgtttcgaaatcaagcttaaacgccaaggaaaacctcgcaaaatataagcttaggataaccttgcacaaaaaactcaagaacaagcttcaagtcatcactaaattctccgtctgtctcatcattgtcacttcgtctctaagacaaactcctaattgcgtatttagataggataagccgagctgcagatcgcaccgaatctaaatttcgcaacataagccaagcccagccttgcattctaatctgaagtcaagcttagtctcgctcccaaataacaaacaatatcatgctgaatcaaactaccagttacggttaagccgagctcgatctcgcacatacaaagatcatttcctttactaaaatgcatgacgaagacatgatccacgacataacttaaagtcgtgccgatctccccatgcctaaaagaagatccgtaaaatcaacatcatcactcagtcttacgtcatctcctcgctcgccaaaacaagtttgccgcactcacggccataacaatccatcgtaatgccaaccaagtttggtaccacgcaaaatcaaccaacattcacactaatcgttttcgacgattgtgctaagcggacctacttccttgctactcgacacggatccacaaaacctaatgccaatccccgtaaatctatatccactaagcaagcgttccctgtcaagcgttccttgtagagcattactcaccaagcgttcttaacaaaactgtcaaacgttcctagctcaaaaacctcgaacgttcaatccttgcctaacaagcgagcgttacttaccaagcgttcatcgcagaaccaacaagcgtttctagctctaaaacacagagcgttcagtcctcaccgaactacaaagcattctcatcgccgaaccaaacgattgagcgttcttcaccaagctacaaagcaatcttcatcaaatcgccaaactaatctccagtcttgctaagcatcaataatcataacgagctacacctttgtcgatgccacactacatttatcacttacaaaacgttcaacctccaccgaaccttctcactatacaaagccatcac

SEQ ID NO: 6035 - DNA, 3000 bp, Unknown
  misc_feature (1)..( 3000): cDNA_ID_2105868_gDNA_ID_1620837_Annot_ID_169927 3000 nt of promoter + ATG
tttcgagatcctctaaaactgacaaaaatgagtttttattgtaaccctctgcctattccatattgctttgtggaaatgcttcattggatttgattctctcgaataccaacatttaagtgcaattttagtggcagtggacatatatgcgcaagtgtgcacatcttctcggcagtggatgttacagtcacttttcgagagattttcagttacatggccttcctcgatcgatgttttctaatcgttattgtgtcttctcataacaattatttcgtctagtattgctttccacctacaagctggtggtttttactcatctatgatcgatttgcttcttttcaacttaacaagtggtctttttggcatgcatgtacagagttttggaataattcatccatccattcttctttacaatatacacatgaccatgaaaaactacattttctatatcgtctattctggttctggtacaagagttcattatgaaacttctacaattctttcatatttctctatgttatgatcaacaaaaaaatttgaaacgacgacattagcattggcatgcacatgtcaaatagtaaacactgtccgatcccaactattattatatcaacaacaagttttttttttttttttttctcaaaacaacttttgtatttacatttgctaaaaacatcagattatttggtagatagaaatgtgtgattcattctttaccgcaaaaggttttgaaccgtatacgaagaatccgcggccttggccgaagaaggcggtgaatgaggcagcctagcggagaagttacgtagcggaaaacggtcgatattgtcatcctcatctcctttatcaaagttaagcgcatagctcgacggatcgtaatgaaagtcagcagtatggcggcgaatatgcttcccgtgaccgccaacgccacctactccaccgcccattcgatggatcagactcttacatttttcatgtgacttggacaacgtcctagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaag

SEQ ID NO: 6036 - DNA, 3000 bp, Unknown
  misc_feature (1)..( 3000): cDNA_ID_1829680_gDNA_ID_1620837_Annot_ID_50823 3000 nt of promoter + ATG
agaaacatagtcaaccttttgccccaacaaccactcgatgactgacgaaaagaatcaacaaaatggccatgtcaacattggtgctggagatgcaccaagggaccatcgttagaagaaaggaattgcacctcctgctatccagaacaacaacttcaagattaagagtggtctcatctcgatgattcagggaaacaaattctctggtttgccaatggaggatccactcgaccaccttgatgaattcgataggctctacaacctaacaaaaatcaatggtgtcagtgaaaacggattcaagctccgtttgtttccattctccttgggcgacaaagcacacatctgggagaagaatctgctccatgactcaatcaccacctgggatgattgcaagaaggcttttctatcaaagttcttctccaacgccagaactgcaagactcagaaatgagatctccggctttttacagaaagctggtgaaagcttctgtgaagcatgagagtgttttaagggttataccaaccaatgccctcatcatggcttcactaatgcctctctgctcagcactcattatagaggagttttacaacgcatcagaatgcttctggataccgccagcaatgggaatttccagaacaaagatgttgaagaaggctgggaattggttgagaaccttgctcaatcagatggtaattacaacgacgactgcgataggaccgtcagaagcacaactgactctgatgacaaacacaggaaggagatcaaagcgctgaatgacaagctagacatgattcttcttagccagcagaagcatgtgcacttccttgttgatgacgagcaatatcaagtctaagatggggaggataaccagttagaagaggtcagctacatcaacaacaaccagagtggctacaaagggtataacaacttcaaaaccaacaaccccaacctctcctaccgcagcaccaacgttgctaatccacaagaccaagtatatcctccacagcaacaacaaggtcagaacaaaccttttgttccctacaaccaaggtttcgttcccaagcaacaatttcaggggaactaccagcaaccaccaccacctgggtttgcacctcagcaaaaccaaggtcctgctgctcctgatgctgaaatgaaacacatggtacaacatctgctacagggacaagcatctaactcgatggaaattgctaagaaattatctgaattgcaccataagctgacctgaatgccaaaatggaggcattgaataccaaagtcagatacttagaaggccaatcagcatctacctctgcacctaaagttacaggacttcctgggaagtcaatacagaatccaaaggagtatgcaactgctcacgccatcaccatctgccatgatcgagagctaccaactcgacatgtccctgatttaatcattggggacaatgatgttcaagaaggggaggcttctactcagattgaagtctctgttgttgaattcaaccattctgatggttttcgccatctcattcaatccacctcggaagagaaggccgccactatcaagagaatagtgaaacgattcaaacctactccattaccctcacgtgctcttccgtggacattcaggaaagcgtggatggagagatacaagtctgctgcaacaaagcagctggacgagattgaagcagtgatgccactgatggaagttctctacctgattcatgatcctcacaaagatgtgagaaatttgatactggaaaggatcaatatgtatcaagatttagatgatgaaagtgatgccactccatctcgagctgctgataagaggattgttcaaaaaaacttagaagatcctggatctttcactctaccatgttccattggggaattagcttttagcgattgtctttgcgatctcggagcctttgtcagcttaatgccactctctgttgcaagaaggttagagtttattcagtataaaccttgtgacctgactttgatccttgcagataggtcttacagaaaacccttcggcatgctgaaagatctaccagtcatgattaatggagtagaagtccctacaaacttcgtggtgctggatatggaagttgagcataaggatcccttaatcctgggaagacccttcttagcttcagtgggagacgtggtagatgtcagggaagggaaaataagtctcaaccttggaaagcacaacaagttgcagtttgacatcaacaaaattccacaagagtcaacagaagatgaaaaaacctctaaagactatagagtgatcccaggagaagggtatgagactgagaaaataaaaaaagcttaaaaagaggtctgataagcaaaaagaaactatagagaggctagctcactctgttgaggaacttaggagtaagctgaatcagatgcagaaggaaactcaacctaaaggcgggattaacactatcccgagaaaaaagttcacttcaagatggtctgaagagacagattaccctccagaagagaaagaagcttattttgaagaaatgagaattaagtattctgctggagacctctctagggaagacgttgagtatgatgatgatatcagagaggattatgcagaccctctctatcattcactttcttcttgataagtgtgaggagtcaagctagagactttaaacaagctcccttgggaggaagtcccatgattatccttgtaaataatttttactttcttgttatttttgatttgttttagttgtgtttgtggttctcaggaaaaaaaaaaaagaataacgtgaaggtagagtaaaaattcaaaacttttactctacttatggcctagagatcgagtacattggtcgagtatgagtgatgtttaaaaactcaaaaaaatttaaatcatcattttactcgaccaacagaagctacagagtcttacagagagttcattaagtttagagatgattgtaggatttcctgagattttcctagtgaagatagagta

SEQ ID NO: 6037 - DNA, 3000 bp, Unknown
  misc_feature (1)..( 3000): cDNA_ID_1829676_gDNA_ID_1620837_Annot_ID_50825 3000 nt of promoter + ATG
attataatgatggttggtttctagtaacaatcgtaggtcaagattcgaacaacagaaataaaaacttaaaagccctactcgatcattgggtcgagtagaaccaacaggcaacaaaattaagaattaaaaatgcaatcaacaggtgacacaaataacaggtaaataaaagtgcaatcaatgggtgaatacaaataaatctaagaagaatagaagtcctaaggatggattcattgataagggcaactttagggttcatcaggtggctaacaggtcaaaggtagataccctagacgatagattcaagaaccgagtcaatccactcccactctcgtgacagagacccccataactctaccacttcctaatctcaactctcgttgatgaaacatagcaaaacatggtttaagcaacaaactaccaaagccaataaacatactagccaatctcttggtctatagcctacaaatttctggaattcatagatcaggcatccatttgaacgtcttttggacgctggacgtctatggtcgaatttccacattagccaccgaaaaccgcataggggccaacgaatccacaagggatctaacctaatcttaaccacctgactaacctaaagattatcctaatctaatccatcctcaagaaccctaatgactactcaagcaacataattaagaacacaaactcagaaattactgaaatcataccaaaatgtagatctaaagaaactaaacaactttactcaaaactaaatacaaaaactaaatagattaagagtaattaaattttgaagattcaagaacataaagaaaaactaaaggataaaagctagatcctttggacaaatcccaaagtgatctatttatagtaaaatgttgaaaaccctagattcactagacgacaagagacttgaggcggtttgggcgagtgctcgatcttggagatcgagtaaagagggtgctgcaaagtctgcgcctttgtgtccatgctccgagtgatcaattggtcgagtagatgtttcttcctctcctatctgtatgctcagatgtctggttgagtggggaatgaggaggatccgaagacgctttgatagatcaaaaagtctagtagatttggtcgcccttggtcgagtagaagatcgagtaagaggggcgagtataccgatctgctgcttcctctatggctgtctggatcgagtaagtgggtcgagtgaattgatttctcctctgtgcctacctggatcgagtgaactagttgagtagattgctctgctgcttccctcctggttggatagagtagagggtcgagtagagtccttgtaagctccttctacacctgaaaacataccaaaacatgcaatatgtatgcaagatgatcctaaatggcgaagtgtgcaaaataagctaaatgtgatgcaaaatgatatgaaacaatgagtgatcactaagctaaatgatgataaacacatgcctaaaataagtaaaataaagtgttatcaatagcgctcgtgagaccctaacggacgcagatgtagagacacagacaaaggatagcgtggatgagatgcagacgctggagaaaaattaaggattggttgaagtatttcaacaactgagttttcaatatgatatatgaaccttctgctagcactacattacttaccacactactcaaaaatctcgatatggaggcatgcttagacaaaacaaaatattctctcccaatggacatgagaagaaatctcaaaggcagtgaaggaaagatcattagaacattataggtggtttatctcctttcaaactcagaactcaaaactcttgtctctagtgggtatgattttggttgttatgtgtccttttgctatgattttgaacacagctagaaatctcatcataaacactcatatatcattattgcttcgttttttcttttcagccattatcttccgtagatgtagagagcgttgaccagaatgaaatttatcaaacagtagtaatgtttccaatgttttttttttgttatataatagggagattaactgtgatgggtaggaaattaggtgttattaccagaacacgacagaactttttttaattactgttatattatcgaattttttttattacccagcgtgcccctactaaacgttatcggaaaaaacgtaattacagggaatgccactgccacatcagaatttgttgacgtggattaaatgaactcagccggctgagttacggtatgttatatatgagtcataacgaaacggcgaagtatgagtataactcagccagacgttacggctgagttgtaaaatgttgcctgagttattgtataactcaggcaacggtatggttgagttaaggatggtcggccgagttataagaagttataagataacccagccaacaatatggctgagttatgagaaaaaggctgacttctttcctcgacgcggccgagttatagttttgattggcttagttatggaaagatgtgacggctgagttatggtcgagtgctataaatcagccgccaatagctggattacgatataactcagccatgttatggctgacttatttttaaaagattaattactataatatcatgcagttatggccgagttgttgaacgttacggttgagttagttgagttacgacatacaacggctgaattaactttgttttttttcctgttttaattactgtaatagtattcatgtcacggctgacttaaagatttgcttcatggctgtgttatgaactgtttgtttggtggctgacttgccacgtcatcacttcaaaacggcgtcggctgtaataatccatgtcatcattccatgtcagcatcctcgacggaaatacgaaacgtcccttgcttctttaaatcgttttcccagactgtgtccaccgcctgaacgttacaacatcaccggaactttcttttcttcattcatcttctcatacatcttcaatttctttcatctttctcttgat

SEQ ID NO: 6038 - DNA, 3000 bp, Unknown
  misc_feature (1)..( 3000): cDNA_ID_1829665_gDNA_ID_1620837_Annot_ID_50829 3000 nt of promoter + ATG
cactctcaaatggtatcctagagttagtatgcaagccaaaaagtctaatggatagaagagtcaataacccaaaccatctacgcttttcagtaggccaagctctgcacgttactaagccctgcctaagttcatctagattaggaccttcaccggttggcacatgcaattcactgaagaacgctttgtagtcagctgcaggcacaaacttttctgtaggcagttcatctatatttaaacccgtgatatgatgaaattcgttcaatccaaaccggatgggtttaccagccacgatacaccaaagctccttcttcagtattctcagttgtctgcatagtagataatgtacggtcttaccagaccatagaaaataactatcaacaagcttagcaattaatctaagctctgtctctttcagttctgcccatatttcttttcctattgattctctaattgcagggaactctcccagctttatattatgattaatgcctttaccctccagattagaatccccctcttggtaaagtcttggagggtactcccttgcttggtcttcagacatctgtataaccataaatcagccgtaagcattccataactcagtcataacataaaacaaactcatccacagataccataactcaggcaaaacataaatctaactcagccatagataatataactccgtcataacataaacctatctcagccacacataacataactcagccataagataaatctaactcagccatattttaacagaaactcagacatcgatgtaaggttaaaccataactcagtcacagcataaaacaaactcagacacggatgaattgataaatcataaatcagtcggcaaacaaatagtaactcagccgtcaaatcaaatagatctaagaaatcggccaccatatgtcaatcaacgacgacgttaaaacccagctttaaaaaccatcgttacgcatcggaaaacgatttcagtgacgggaatcacttgagattgaacttagatgtcagagtcttacttaatggaaacatactcactggaacttagatgtcagatgtgacttcgcgcttacagaaatgcgactccggcgtctgaatttcggccggaacagacgagaaaagagcaaaacggcgaaagaaatcgattttgttccgtcgagagagaaagaggaagaaagcgacagtttttttttttttgggagatgatgaacagtaaagccaagaaataaaaaacccaaacgttatgcggtttggagatgattaatgacgtggattatcgtaatgacatggaatgatgacatgtataatcactgttttttaatttaatttttagttaaaaacgaattaaataataataattaattaaaactagttagggttgttaattgtaattacacaagaactgaaaacatctgagtaataaaaaaaaaatgtgttctattctaggaataaacatacaaatgtgttctatcttaggaattatttctatataatatgtatatgttcaattgtgatccaaaaataaatgtttcactacatattatggaaacaaattcgaataagtgttgatgcaaaatcacttaataatcagataactgaataaattttagaacaaaaaaaatggatcttataatgtcattgttttctagcaaaataatatgatctaccggggatcccatcctcggtggtgaactctactgaagtgtggttaactctgttgaagtgtgatgaatagtgggggagtagttaggtgacgactctgcttcaaatgtgatgaagtctggtgacgagtaacatgagctatttcacttatccctacaaacccatctacattaataacatcttgagagaaggtcaatctctactcccccactattcttttcggttaacttagatgccaacgcttaaaataaggtggatagttgagtccaatataactctaatatttttgaaagtgctgttacgagtttttttgaatgcttgtttccgagttcatagattgcatggtataggttattaatagcatacatgttcatcctacagtagtaagaaaataatgacagataaaggaaattacgtcacatattattggttcttatttgacttttcagcattttcccgttgttgttttattttagggtaaattgcaggccacacctgttgaccatgttttatttccatggattgtcaaaatcaaatgtggttttcaccatttatcttttcgcctgcaaaatgacgcttctgcccttgcgcttctctcttagtaactgttgaaatgtacggtttagtttagcaggtttagttacgtacactgttccggttcagttgaagattttttgtttcacgttgacgcgattcggttccgttacaagtgagattatttccattattccgaagtgacatcaacatttaatgcccccaaaaagtttagacgtgactattgtcacaattaatgcaaaatcatcattacatcaaataatattaaaaaaattattgataataattaataaaaaaattgttgagataaagaagatgaacccaggaacaaagaattattgagaacgtacattgctgctgaagaagtgttgatcttgtttttgtaccaagtttggagccaaaacaagcattgttcgtgtaagtaatgaagttcttttaagaagttttttgttatgtcatattaggatcttgattgtgttcgaactccatttttttatcagaaaatttgcaaaatctatatttgtttgtttaaaatagtcaaatgataattggtatttaggtttataaatgtgtagtatcgacattccatttgtttttttatatgtatagtatttttcagttgcatttaatgtgtgtctcctgaatttatgatgcaggtgggttatggatattcccgtatttactatggtcggtgagtggaaatgcaaagaaggagaatggaaatttgaacctgaggaaggcatctttggtcgttgtgtacgagttcaggaaacc

SEQ ID NO: 6039 - DNA, 3000 bp, Unknown; identical to SEQ ID NO: 2575
  misc_feature (1)..( 3000): cDNA_ID_4254803_gDNA_ID_1620838_Annot_ID_50836 3000 nt of promoter + ATG

SEQ ID NO: 6040 - DNA, 3000 bp, Unknown; identical to SEQ ID NO: 2575
  misc_feature (1)..( 3000): cDNA_ID_4254803_gDNA_ID_1620838_Annot_ID_169983 3000 nt of promoter + ATG

SEQ ID NO: 6041 - DNA, 3000 bp, Unknown
  misc_feature (1)..( 3000): cDNA_ID_3079288_gDNA_ID_1620838_Annot_ID_169978 3000 nt of promoter + ATG
aaagcaaatatcgtcatatttagtttttgaaggaagttttgtcgaagaatattgataactgttaaccaaatctagtagatatttttaaattcacttgccaagaacgtcagaaaaacaacgtggtcattccatcaagtggtttccattagagaaataaattttattaacttaaatttaacaatgcattagttgctaagaagaaaaaataaaaaaatgttctataaatactttcttctatggtatataaacagataaatactagagacaaatttatatccacggatttgttggcggtccgcgggctacgaatatttaacaaaaataaatataaaatatgaataaataaacatttttatataattttaaaaataaaaatgtaaaatatgtgattgtgtaatgaaatttaatgtataaaattataagatttataaaaataataataataaatattttttaaattaaaaattgttaattaacgcattaaatggaaattacaaatggatttacaaaaatttaaaatatccaaccagtctcacatctttaggtgtgagtacaataggtccaaatacatttcttttattgagtgaatcaggttcagcttatattacatctttccattttatctagtcatgtctcttttgacattaatatacatactttggttctcgatcctcattttcctcatcaatttcctttgacaaaaggtatgagaaaacatcatcaacatcatccattttattttgatcctagatctttccattatggataaagttgataaaaatctcataatttccttcagtctcatggtgctcatcattgtcattagactcttgatttgcttcttccaaaatgctttctactattctaggaatatcatgctttccaacttcctttcattttctaggattttatccttagaaccaaatggtgtaccacgtttcaagcgtgttatggactcaattgtagtatctatattccacattcttgtggtatttcaattcgagcagaaacatttgcagctggtatatatgatgttgctaccttttggtatctgcaaaaagcatcaggaagttgatctgaaatactttgcaaatgcataattcgttgaacttctatttctgattgttttataagaggatcaaggtgtaacaaggatgatacacactattagatttcttttcctacttgcttattttcttttctaggaaaagaaaatatgttctcatcaaaatgacaagcggtaaacagtaccgtaaagacatcaccggtctgcagttcaaggtatcttgtaattgatagagaatcacaaccaatatatatctccaaccttctttgtggtctcatctttgtacgttgtagtggtgctatacgcacatacactacacacccaatatttttaaataggatatatatatatttggttctcaaccaaatgctaactagcatttcatcatataatctacatgccaccaacaatgtggtattccttttttatccttaatgaactgatttagataaataaaaaagaatttcgaaatagaaattaaaagaaaattaaaagaaaaaaaaagaaaccagtgttaaaaaaaaagcttcgccatcgttcttcttcctcttctgctttttccttcctccatcaccatcgattccaaacatccaccatcaacccgccgacctggatatccatcgcaacaggcggtcgaattaggtcagtttcttctcctctatcctctgtcgttgctgcattgtgatgttagtttaggtttttgaaattatataagattctcatatttcatatgaatgtttgatgttcgggttgtaaagttaagataaatcgattttaggttgccgaataggtattttcagtgatccttaatctaatgtataggttgaattcgagttgaattccatgatttcatatgaaagtttgggatttgggtttgcaaagtttagattaaccgactgttatgctaaataggtatgtattttcattggtaatcaattgaatggaaggttgaatcgatttagaatcgaggtggaggacagataggtttcatgtatacgtatgataagattacaagtggtataattggtacaatcactacaagaaatatgggcattgatagcacaaaagcatagcaaaattattgtaaatgctttaacagtattttatctggaaatgagactatataatagtagttttaaaacgttaaaccgaaatatatctttgcgggaagctaaaaagacagttttccgttaacacttagaccaaaaattaattaagcgccataacaaaataatatttcccaacacttagacaaaaaagtgatatttgcagaaactcaaaagttggaaggaatttgtatttttcccccatcagtcgttcttcgagctctcgccgacgagtacctgatttcatatattcatcggctttgtcgacttcatttccatcctcgtcgcatcggcatctcacaatcttcagctctgtcacaatatatgtatgaatctatagccgttgttatcctttaattcaattaattttcttctcaattagggttctcccaattttcaatttcatttcctttgatattagggttctttcgagttagtgtacgaattagggatctttactaatttcagttctatgtatttcagatcttgctaagaacttatataattcaacgctttctttcaaaggtttgtccaagtcgatagatttcttatgcctttgatttcttacacaaaaactttattgcgaatgtgattgttttttgtatcatacatcttgtgtgttgctgtctgacttgttttctttcttatacatgttttgtgttgctgtctgattcatgcttgttttgggatactgtctcaacggttcaaaataaggataacagataaaattaggcctcgacataaaaaccgtactcgcatacccgaaccggaaccgaacaaaaaaaaacgattcagggcgggtacgagtataaggattttacactgatg

SEQ ID NO: 6042 - DNA, 3000 bp, Unknown; identical to SEQ ID NO: 2574
  misc_feature (1)..( 3000): cDNA_ID_2113272_gDNA_ID_1620838_Annot_ID_169964 3000 nt of promoter + ATG

SEQ ID NO: 6043 - DNA, 3000 bp, Unknown; identical to SEQ ID NO: 2576
  misc_feature (1)..( 3000): cDNA_ID_1829711_gDNA_ID_1620838_Annot_ID_50837 3000 nt of promoter + ATG

SEQ ID NO: 6044 - DNA, 3000 bp, Unknown
  misc_feature (1)..( 3000): cDNA_ID_1829753_gDNA_ID_1620839_Annot_ID_50847 3000 nt of promoter + ATG
acaaaatgatgctctcttactttagtttcgccctcttttattcgtcctcatttttccctttcattgacgtcgtttgtttgttttttactaactatttttatgagttttcgaaaacaagtaactaattcattgacatgcatgttatttttgaatgttatttactttaatagtagtacattattaacaattaaattaagaaataaggtacaagtcaacatgcattgttaagtaaattattttctccctctctcacttttaaccttaaaactgcaacaatgatttaaacaaagaacataaactttaggacaaacaatcataggtttaaaatacatgaaatatcattgatcgatgaactttcttaaaatctttaaggacgctctaaccctcggaaagaaagggagtttaccaccctttcccaacctccacgtccacttatccaatctggttgatcagcgtgtatccaaacattagatcatacggaacaactcaacactatctagtaatatattttttctaaagtttatgatcaattataacccaaagagttacggatacaaatcctagtattttgatacattattgtcaatgataatttgcatataaatgcattgcattgagtctacaacgtaactactttttcctcctaacaaaatgcatgattaatttacagctcatttctagtaatggcaccaatttgaacgatattagccaaaccattggaccaaattgatggccaagcatttgatctacttttgtctttttcttggtttttatagctattgatctttcaccacttcgttcatttcgaaaaatagtcctctcaacaggaccttggaagaggcaagtcctactctcatgaacatggcttctcgaagataaaaccaaagtcaatgtcaacctctctccaacttgaaaattttaaatgctcaatcatttgaaaggcggcgaattcttttgtatttcccattacaaactatacaaaaacatcaccgtgactatataattttctatgcacataaaaacatttaacttatgccaatatatactttttagtttttacaaccaattttagtccactttcgactacgcaaagatgattttataaaacttgaaaatgacagaattaagaggttggcatcggctaattgattgcatgttataaaaatataactggatgactttctcattacagttttttttatcgacggctaattcgattttatccactgcatttagtttcttataagttctttactgcatatatatatacgtaatatatgtatattataatttttctttcttcctctactcgtcctaataattttgatgaaatggttttgtatttaaaaaatatactaattatattttcaggatacaacgacatttgggtagtgtaaatgcaaaataccaaaacaaatatatactatatgttatacaaaaattgtttaaacatgtaaaaaatgatatgcataagacaaaatcccattttaattgaaaatataatatatcattcgtgacgcagctgacgctattattaaaattgaggtgatgatctatgagattttttcctcttacaacaaatatgtcaaaggagacaagccagttgtatatacaagggattgagtgttttttccgttgtaatgatattcttcaattatgctattgtttgtatgatttcttaagactcgacttaagctagtagctttatataaataaaatagctttgttgtaaactaatcatcatgaaatttcaaataacaaaaaaaaactaatcatcatgattgtatttttaaaaaggaaactctctttcctataatacgataataatgagaacgcatctcctatcataatatacgtttctaaacacttattgttgttctcgtgtagaagcatgctcgaaattaatcaaaattatctttgtttttgttttgtttcacgttagactagcctcatcgatgtaagattaatgaaagattacccgttacaagtcggtaactagtaacattagtgtgtatataaataagaatattagtggttacgcgaccaaattattgcatagtggaaacatttaaggctatttttccaccattactttgcgtacttgaattgaagaactctttacattctcagcacatcaaggtgtctcctttgagatcaaaaaagtaggaaaaataaaacgaaaaagtactataaatattaatttcgtttacgaacaaaaaagtattaaaattccgtagacatttttggggggacaataattttagactcgtacaatgctttcatggaaatgagtttgttgttgaccgatggcttccctttatttttctttccacttttttattactaattaggaaactagtaatatttatactcgatgtataattcactaatcatatactttccaaaacgtagcaaataattcgactagaatatattgtccgtgaattaagtttcctcttttctttttttatgttaaccatcatgtttctgttatttgttgattttaataaccatactattttatacttttttaaaaataattgaaaataaattcagattacaagtctacgataatgattcttcttctttttcattgtagataaatttcttaaaagttgactacttttctgtcagtatatgtcacatttttctatctatcgttcgagaaaaaaaaaagaaaaaaaaaagtttacaagtgttacctctaaagtcttaaccaccatttctttctattttgtaaaggaatcaaatagttatttactatgtttgagttcatctcttgagttttctgaataaggtggtcccataaaaggtatcaattaattcacccaacgattataaaacaaaagtgtttacaccagaatatcgccaatcatagtttctctcattttataataattttctccatcttcttccttcctcttcaagcttatagaacctccaagaaccataaaactctctctgcaacaatctatactttcttcattacttttataaaaa

SEQ ID NO: 6045 - DNA, 3000 bp, Unknown
  misc_feature (1)..( 3000): cDNA_ID_1829749_gDNA_ID_1620839_Annot_ID_50848 3000 nt of promoter + ATG
ggcggttacagagaaagttagcgaatgcgaaggtgttgtctctctctctctctcagggaactttgccaatttggtctcctcacgccggcgatgataattgttttcccgcctcctcaacacgtgtgggcgctagagtctgattaactttatgaggcctttaaacctaatgagcccatcaggttgttaaggcccatcatatagttaaggcccatgagtcatagtccaaagaaatgttagtggaatcgaaactctcttttaagatgcatcttatatgactatatactttttggagctataaagttataagttgagagagagaatgttcaatgtagcccatataaatgttctgagtttcgttatatgtaagggtatgctattcttttggcattttatttccctaccaatacagtgatgtcttttttgctggagacaaatccattctaagatccgatttggatctgaagccttcaaaaaacatatagttctcatcaaacctgactatgggttgataaagaaattcgaaatcagatttcagcaatccgactctcttaggcgacatgcgttataacgatgcttaccaacactagatttactctcgagactagttatcactgattcttagaaagctttaaaattttcagaagtttttagagtttacttttcaaacaaacttagcacaagttgtaaaaacgtattttttcttttaaatctaatttgatattatattaaaaaaaaaaaaaaaactaactatcgtatcgtgatcttgtttttattatttttaccaaaattataatattttaggtaatgttctccgtaatatctttcactttcattttattatttcaatgatattaacattcataacaaaaaaaagaaaacatatagttggcatcgtaatttgttcttggttttctcatcctaccacggtgtgggatggttcattagttaaaaaagaagaaggtagatattgaaatctaaagagaaagtgtgtacttgattataaatcatgtagatctagcaaacgaaactgtacttgagttgccaaaaaatcattttgattttataaatatgggaggtttcattattcgtgcatgggaatcgaatgggtcaaggagtaaaaaacaaagaacgtaatggtggtgaatggtgtgatacgtgggttttattttatttttaaacgtcaacattattgatatctacaacaaatataatcattgtgtaagtataagaaacggtggtggtacgtgatcatttaaatatagttacgctaaaaaaagacgttcaccgacaggattttgtggagaaacgtacatatattcattacgcaccacggaaaaatacaacgatatgtccttagttaacaccttcatcccaagtttacaattaattccccaaaactttcaactttatgtagcatcctattaatgttccaaacattgcaaggattatatgtatatatatatagaaaatagattgtatataataaacaaacaaaactatcgaaggtagttagctcaattggtaaagatcctacgcgaagcttaaaggtcatcggttcgaataacgtttgagacaaaattaatattacatactgtgattttgggcttgggaagattacgagtttcggttctagaaagattataggtttcgctccaaaacctcttaatattaaaaaaaaaaacaaaaaacaatcaaacaaaactttacattttagataaaatgcgaattgtttttggaaatcacctgttcaatggtaaaatagtagtttactagttttttttttttgaattttaatagtttacttagaagtttaaataaaaacttggatgcatcaaattgaatgaagatgtaaatattaaattattaataaatccagtgattaaaagtacatagtttagtggacgatagatagcaccgtaccggtttgggagtgtttattttgtaagagcgtaacatgtgcatcggatttacaaacagccccaccactctctttcttcttcctctctcagccattagtttcaaaccgataaattatgacaattattttggttagtcaaagagttttggatttattggcctaaacttatcctggacaaggaaacgagaataatcctatattttttcttacaacaattactaattttgaaaagaatgattcaaattaagtaagagatctatattccttgtgcaggatctattggtacagaattccttaaatattttaaattttatttgccactctttgacaaactatatggttgtgtattaatttgacatccttgattactttagactcaatccaaacaatgatagtatgtgttgaaatatcttaaaagaatgttttaaatccaaattacatgattaccacttccgtaattatcgctcatgattttattgcatcctggaaaccattagatagattggtaggtgtcggggataaaaaaatcacagataaataatatatattaatattgtttttgataatgattttttccaatgcgtgatttagaaaatatcataaacatcaataatgaaaaatcataggtagatatcacaatttatatagttacctcttgtgtatgttgatgtgtgtttcaagtatgaaaccaaacaaaaagatggtctccttgttttacgacgaatgctaaattagttataattagtagtttagtagtactactactattttctttaattaaagattagtgtaattgtaacttttaagtataattaattaagacaatcgaggtaatgagattccaaacgtgaatccagccataaaatctcttttttaaaacagtcttcttcacttcacttctctgctctgctcttgcctctgtctctttcttcttcttcttcttcttctcattaaaagctgaacacaaagatctattctttcactaacacattaccagtttctgcatttgtattatatccttttctaaaacttttaaccattctttctccattcccagttcttagaaagagtcaagagcaatg

SEQ ID NO: 6046 - DNA, 3000 bp, Unknown
  misc_feature (1)..( 3000): cDNA_ID_1829745_gDNA_ID_1620839_Annot_ID_50849 3000 nt of promoter + ATG
cattgctcttgactctttctaagaactgggaatggagaaagaatggttaaaagttttagaaaaggatataatacaaatgcagaaactggtaatgtgttagtgaaagaatagatctttgtgttcagcttttaatgagaagaagaagaagaagaagaaagagacagaggcaagagcagagcagagaagtgaagtgaagaagactgttttaaaaaagagattttatggctggattcacgtttggaatctcattacctcgattgtcttaattaattatacttaaaagttacaattacactaatctttaattaaagaaaatagtagtagtactactaaactactaattataactaatttagcattcgtcgtaaaacaaggagaccatctttttgtttggtttcatacttgaaacacacatcaacatacacaagaggtaactatataaattgtgatatctacctatgatttttcattattgatgtttatgatattttctaaatcacgcattggaaaaaatcattatcaaaaacaatattaatatatattatttatctgtgatttttttatccccgacacctaccaatctatctaatggtttccaggatgcaataaaatcatgagcgataattacggaagtggtaatcatgtaatttggatttaaaacattcttttaagatatttcaacacatactatcattgtttggattgagtctaaagtaatcaaggatgtcaaattaatacacaaccatatagtttgtcaaagagtggcaaataaaatttaaaatatttaaggaattctgtaccaatagatcctgcacaaggaatatagatctcttacttaatttgaatcattcttttcaaaattagtaattgttgtaagaaaaaatataggattattctcgtttccttgtccaggataagtttaggccaataaatccaaaactctttgactaaccaaaataattgtcataatttatcggtttgaaactaatggctgagagaggaagaagaaagagagtggtggggctgtttgtaaatccgatgcacatgttacgctcttacaaaataaacactcccaaaccggtacggtgctatctatcgtccactaaactatgtacttttaatcactggatttattaataatttaatatttacatcttcattcaatttgatgcatccaagtttttatttaaacttctaagtaaactattaaaattcaaaaaaaaaaaactagtaaactactattttaccattgaacaggtgatttccaaaaacaattcgcattttatctaaaatgtaaagttttgtttgattgttttttgtttttttttttaatattaagaggttttggagcgaaacctataatctttctagaaccgaaactcgtaatcttcccaagcccaaaatcacagtatgtaatattaattttgtctcaaacgttattcgaaccgatgacctttaagcttcgcgtaggatctttaccaattgagctaactaccttcgatagttttgtttgtttattatatacaatctattttctatatatatatacatataatccttgcaatgtttggaacattaataggatgctacataaagttgaaagttttggggaattaattgtaaacttgggatgaaggtgttaactaaggacatatcgttgtatttttccgtggtgcgtaatgaatatatgtacgtttctccacaaaatcctgtcggtgaacgtctttttttagcgtaactatatttaaatgatcacgtaccaccaccgtttcttatacttacacaatgattatatttgttgtagatatcaataatgttgacgtttaaaaataaaataaaacccacgtatcacaccattcaccaccattacgttctttgttttttactccttgacccattcgattcccatgcacgaataatgaaacctcccatatttataaaatcaaaatgattttttggcaactcaagtacagtttcgtttgctagatctacatgatttataatcaagtacacactttctctttagatttcaatatctaccttcttcttttttaactaatgaaccatcccacaccgtggtaggatgagaaaaccaagaacaaattacgatgccaactatatgttttcttttttttgttatgaatgttaatatcattgaaataataaaatgaaagtgaaagatattacggagaacattacctaaaatattataattttggtaaaaataataaaaacaagatcacgatacgatagttagttttttttttttttttaatataatatcaaattagatttaaaagaaaaaatacgtttttacaacttgtgctaagtttgtttgaaaagtaaactctaaaaacttctgaaaattttaaagctttctaagaatcagtgataactagtctcgagagtaaatctagtgttggtaagcatcgttataacgcatgtcgcctaagagagtcggattgctgaaatctgatttcgaatttctttatcaacccatagtcaggtttgatgagaactatatgttttttgaaggcttcagatccaaatcggatcttagaatggatttgtctccagcaaaaaagacatcactgtattggtagggaaataaaatgccaaaagaatagcatacccttacatataacgaaactcagaacatttatatgggctacattgaacattctctctctcaacttataactttatagctccaaaaagtatatagtcatataagatgcatcttaaaagagagtttcgattccactaacatttctttggactatgactcatgggccttaactatatgatgggccttaacaacctgatgggctcattaggtttaaaggcctcataaagttaatcagactctagcgcccacacgtgttgaggaggcgggaaaacaattatcatcgccggcgtgaggagaccaaattggcaaagttccctgagagagagagagagacaacaccttcgcattcgctaactttctctgtaaccgcc

SEQ ID NO: 6047 - DNA, 3000 bp, Unknown
  misc_feature (1)..( 3000): cDNA_ID_1829737_gDNA_ID_1620839_Annot_ID_50851 3000 nt of promoter + ATG
catcggatcgattcgttgtgatagatttaatttagtcttagtaagtatcgaccgattttctgaaatgaagagagaagtttgttagccaaatgaaggaaaaaaaaaatagcaccaaccaatattatggtgacacgttctgtttcttccagtatcagaaaaatgtcttctcacagacatcaaagccacagtgtctctcctgttcagcgcattaattcccatttttctattttttaattttattaaaatttgaagataccctctaaatttgtccgatggggatggtctaatagatttttcgggttttgaattatatttgattaagaagatgtatttatttatttgaagtttcaattcaatcgtctctttatgaagtcatcttttattaaaagatatggacacgccaattttattgtatatagaattttcatttttcttaatttgcgacatcatagtttgcccattctagttgaactaattctcagtaatcatttcaacaacattccctaatattaactcttaattttgcattttattggctctaattagtatattatattagggtaaacaatagaaacaaaagtttttttttgttttgagtccaaaggcgattgcaaattataaaagccgagctaccaacacatagagtagttgaagcttttaacatgaggcccgagattggccgtccgcagcaaagaccgataagccccggatcacatactattcccaagtcatgtgaacacggtttatcggacaattccatgaactatatcactaaatagaatctcacaaaccaaaatatactaaacggtgcaaattcactttattaagaatggctaacactgaaacttagatgccgaagaaatgaagaaactattttctatttttgttttgaagttgaaaaacaaaaaccaaaccgtaaacaagaatgtacacccctctaatagaatattataaaaatgctaaagaatcacaaactgaaaccaaatatagagaataaagccggcgtaactactcctttatcgagatccgtttcaattttggtaacttttgcttgggacaaacaaaacaacaatggcaagtataaaacgtgttcttcatcaaaaccagtaataagattttatttttcagtcaaccaacaataataataagaaaaaaaacagtaataataataataaaatttccatataaaaacagcgatatacccgaatctaataaaataatactaaattaataaaagtcgttaaacacacaattaatttgtgagagccagcgaagattttttctgattggggaaaaacctaagtgaagaagagagacaatacaacaacaacaacaacaacaacaacaacacaaaagcagacctcaatttcttcacaattctgatctgggttttgagaaattcggaatctttctttttctcgtttggttaatgcctgggaatcacagtgagatttcattgaatgaacaaaacagagtcgatgataacgataccaagacgaagacgacgacaaggaagaagaagaagaagaaagatgtaacaatcgttgatgatgacgataatcaattcgataccaccaatcaattggtaaagagtaagaatcgatttttaggtaagtttcgtaagaaacccaaatcgccaaaacgatggtctgggtcgcgtaaaggtgggtgctttcgtgtgatgagacctcgaaggagagaaggaggtgatgatgattcttcggtttcgtctccagtttctgatcctaatgatgaaaggtttagtcatgagatgttgagagttatgttagagactaatgatttctgctctgatgagtgtaatccacatcggtgaatattttgtatgtttcgttattgggatttggggttgcttgattcttatatttatagattttttggttttgggtttctttctttggatcaatctgtatagaatctctccatcaaatggctatgagtgttttgtttcttatgttttagaccagtgatgattctttaaaagggcaattgtgtattgaatcagatttgttatcggtagatttcatttagttgagttagctttgtgggagatgatcaaacttatagtaagttcaatgtatttagattaagattggcttcagtgcagagtaaatttagatgatttttttgtctctctaatgtgccaaatgtgtaagatgatagttcaagacagataatgtgtgtattcgaagaagtttaggtgctcaagacttagtctattggtctactaaaactagcctaggactgaatatagcctgttgtgacttggtttacagagattttagtgatggctaggtttataatgatgtctcggtagattgtttaggatgtgtggtgtgcacatttggttgagagttgattgatagtctttctggtttcgtgaatcgaacaaaaagcaggttaagcaatgaccttgtccaaagaagagggaccatttagcattggatttcagtggtattgctaaatgagtatctggttacttcccattccttagttctattggcacagtgtttatctgtttcgattttttcctatatgagtctatgagagattttagttcaaagatttgtattgccttttagcttttctgaattgcctctgcattggagctcccatgaagtattctctcttgaaaagagaactgcagagacactgatacagaaaccagtcacataactcatataaccaaggatagttttagtatagtatgattctccaaatgatgtgtacataccaatttaactacttattactctaatccaagttgagttaaaaaaaaaaacactatgtaaagattgatactttatggactaaaaattgaaaaagttgacaacttggagccgcccacagttaaaaaagtaaaaacctaatcctaagacccgaaaccactcaaccaaaaaactagggttctgtttctcgtctctctctcaaacccacattgcacaatccatttctcgtttctctgatttagatccaaagatg

SEQ ID NO: 6048 - DNA, 3000 bp, Unknown
  misc_feature (1)..( 3000): cDNA_ID_1829733_gDNA_ID_1620839_Annot_ID_50852 3000 nt of promoter + ATG
ttgtgaaaggcagttgcaccacaagtccacaaccattggttagagataccatactacaacatattgatgccttcatgtagctacatataaaacaatatcatgtcaaagatgatacatcttcaaaaaaaaaaaaaaacgattataatgaatgagaaatatttttttaaatgtaaatagtagattaagaaaaacattatttacaaaagtaaaatgggtgtattttaaaaaactttatgaaactataaaatagtagatgaattttgtcataccaaattaggttgaaacatgttataatatttttcaaactttatgaaaaattatttaatatgtgtcattttttacatctaattggtcacatagattattttttcatgcaagtaatctgttactttaaaacttatctttaacatttaaattgttgttatagacattaagttaatattaaataaaatgttcttaaaatactttaaataatattgtaccaaaaatgttttcaatattcttttttcgttaatttattgctaatacagtcgaccttaaaagcaaaagtagatttatatagctgttgccgacaaaaaacatttccactatattaaaagaaaagtagaatacaagatagaatacgattctaatacacgaaaccgataaaagttgaaacttttttaaaactaagctggtgaaaactaagtcttaaaaagaagcaaagtaagagaaaaatgaagtaaatgacaaaagaatctaataagtaaatcttaaattcaaaaccatcaaaacccgcaaacaatctcagagaaacagttggcgtcgaacctgaacaaaaaaatataagcttaaaagaacaaacaaacagacaatttccaatataccataaccatagaaaacttaaactgaaagctcaactagtcacaaccgagtagaactgagagaatgaataatccaaagacattatcctgcaaagatataaaaaatgactacttctaattagaaaatctcataagaaatttgagtctctttggttgattaaaaaaatcacataatttttttatataatatacctttgtcttagtaatacaacgaacaatatagtatttgaccttcattgagacatagccaacgatttggtcaccaaaacaccatatgaagcaatgacatccctatggaatatggatctgcctctcctttcctcaattacacatgtgataatccccaattgggatctacaaccaaacaaattacccatcttgtttttggcaaatctttaccaaaaatgatcaataactccaaaaccatcctcattctcattcttatggaatacaagtctctcaaaccaagtataggatcttcattctattttctatggaataaaacataaatctttaaaaagggtgaattttttcatagcagaataggttgaaacattttatgactctttatttcagccctaggggtgaacctctttcattcaccttctcttaattaaccaattaaaatttatcatgtcatctaattaaataaattaaaacaattaatattaaataaataaataaatttattaaaacccactaaacttatttaattattaaatctaatctctaaccatttttttataaacccaaaccgatatataatcccgtttaattacaaaatctaaaccataattctcttttgtaaacccaaactaccatttaaactcgtttaatcgtaaaaaatctaaaccttaatcgtattttctaaacccagaccaacatttaactttgtgtaattataaaatttaaatccgtttataaacccaaaccgatatttaacattgttttatcataaaatttaaagtctaaccctttctaataaacccaaaccgatacataatttcgttttaataaaaaattaaaatttttaattaaataaattattatttttattattagatgataaatcctgattggctaaaattaagagggtaaacagttaacccaagtatttttcttttataatcctttttgaactttatgacataaaatatatgtttcaccttttacatctcatttgtcacatagatttatcttacaaacttgcaatctattattttaaaacttttcctttaacattatacatctacaccaacattaaattaaatattcttaaaatacaatcactaatcttataccaaactgtttttcaatattcttttctcctttgatatataacaaaatactaaaattcaacgatatttctttctttatttgctattgcaaaccagaaaaccttatgtatcctttgccgacaattttaacaaactaattaacaattgtaatcattgaattgggtaagacttgtgaataaataataatgttaaacaaaatagattattccaaaaaaataaaataaaataaattatgaaataatttagggtttgaagttcacaggctgtattggatggacgttgaatcgattccacctcatctaaataatctcttcacaaaaccaaaattaaaaatcattcctttttaacaatcttctgcattttcgaacttgctttgctgtgataaagttctctcctttcctttctaaaggaagaagaaaggctttatctctcaaaaccctcatccacaaaatcccctttaatccgctaatcagagggtttttctgtttttgtgttgcttcgttactacggttacattcttctcttccccttttgatttcaaaggtacgaattttatcctcaattgcgtttcgatcgtatctcaaattctcttcgatctctgacagaaagtttccaactttagtgaatcgcgaaattgggttcgtgttcttgctctgatttcggtgtaacccttcaatttcagaaccctcttgataccttaagaagaggcaatttgaagttttcttcacagatccgtcttagctctttctagaggtttgttgtataccaaagatctctttttttttttgcatttgctttgatgagtttggtcatggagatttatgtgtgtttgcagaatg

SEQ ID NO: 6049 - DNA, 3000 bp, Unknown
  misc_feature (1)..( 3000): cDNA_ID_1829731_gDNA_ID_1620839_Annot_ID_50853 3000 nt of promoter + ATG
ccaatacagcctgtgaacttcaaaccctaaattatttcataatttattttattttatttttttggaataatctattttgtttaacattattatttattcacaagtcttacccaattcaatgattacaattgttaattagtttgttaaaattgtcggcaaaggatacataaggttttctggtttgcaatagcaaataaagaaagaaatatcgttgaattttagtattttgttatatatcaaaggagaaaagaatattgaaaaacagtttggtataagattagtgattgtattttaagaatatttaatttaatgttggtgtagatgtataatgttaaaggaaaagttttaaaataatagattgcaagtttgtaagataaatctatgtgacaaatgagatgtaaaaggtgaaacatatattttatgtcataaagttcaaaaaggattataaaagaaaaatacttgggttaactgtttaccctcttaattttagccaatcaggatttatcatctaataataaaaataataatttatttaattaaaaattttaattttttattaaaacgaaattatgtatcggtttgggtttattagaaagggttagactttaaattttatgataaaacaatgttaaatatcggtttgggtttataaacggatttaaattttataattacacaaagttaaatgttggtctgggtttagaaaatacgattaaggtttagattttttacgattaaacgagtttaaatggtagtttgggtttacaaaagagaattatggtttagattttgtaattaaacgggattatatatcggtttgggtttataaaaaaatggttagagattagatttaataattaaataagtttagtgggttttaataaatttatttatttatttaatattaattgttttaatttatttaattagatgacatgataaattttaattggttaattaagagaaggtgaatgaaagaggttcacccctagggctgaaataaagagtcataaaatgtttcaacctattctgctatgaaaaaattcaccctttttaaagatttatgttttattccatagaaaatagaatgaagatcctatacttggtttgagagacttgtattccataagaatgagaatgaggatggttttggagttattgatcatttttggtaaagatttgccaaaaacaagatgggtaatttgtttggttgtagatcccaattggggattatcacatgtgtaattgaggaaaggagaggcagatccatattccatagggatgtcattgcttcatatggtgttttggtgaccaaatcgttggctatgtctcaatgaaggtcaaatactatattgttcgttgtattactaagacaaaggtatattatataaaaaaattatgtgatttttttaatcaaccaaagagactcaaatttcttatgagattttctaattagaagtagtcattttttatatctttgcaggataatgtctttggattattcattctctcagttctactcggttgtgactagttgagctttcagtttaagttttctatggttatggtatattggaaattgtctgtttgtttgttcttttaagcttatatttttttgttcaggttcgacgccaactgtttctctgagattgtttgcgggttttgatggttttgaatttaagatttacttattagattcttttgtcatttacttcatttttctcttactttgcttctttttaagacttagttttcaccagcttagttttaaaaaagtttcaacttttatcggtttcgtgtattagaatcgtattctatcttgtattctacttttcttttaatatagtggaaatgttttttgtcggcaacagctatataaatctacttttgcttttaaggtcgactgtattagcaataaattaacgaaaaaagaatattgaaaacatttttggtacaatattatttaaagtattttaagaacattttatttaatattaacttaatgtctataacaacaatttaaatgttaaagataagttttaaagtaacagattacttgcatgaaaaaataatctatgtgaccaattagatgtaaaaaatgacacatattaaataatttttcataaagtttgaaaaatattataacatgtttcaacctaatttggtatgacaaaattcatctactattttatagtttcataaagttttttaaaatacacccattttacttttgtaaataatgtttttcttaatctactatttacatttaaaaaaatatttctcattcattataatcgtttttttttttttttgaagatgtatcatctttgacatgatattgttttatatgtagctacatgaaggcatcaatatgttgtagtatggtatctctaaccaatggttgtggacttgtggtgcaactgcctttcacaatttcaacaacagaagttaaaatgatttttttttgaaagaaaaagttaaaatgatcttctacttttcattttacctggtggataatttaacactaaagattgaaaaaataaaaatctatttaaattttcggtgatggatttatcgatagatttctaaataacaatgattaacgagatttagttcaataattatcaacaaggtggaagaaaaatagtgtttaaggagggtgagaatgagattgagactagtacatccaaaatatgaaaataaatatctctataactatatccatacctccaatgatccaaacatggccagaagcccagaatcagaataataaaagccatacaatggacctaaataaacatagcccaataacggcccactaaaatctgatattttacatcaacttgagtggtagaaataaataaagatagggcagaagcagagaagcaaaatcgtggaaggttacaaagcctttcaaaaacctcactctctcaactctcaaaccttatctccttccttctcttctcctctcctctccgtcgagcttactatctccacaaa

SEQ ID NO: 6050 - DNA, 3000 bp, Unknown; identical to SEQ ID NO: 6048
  misc_feature (1)..( 3000): cDNA_ID_3079329_gDNA_ID_1620839_Annot_ID_170026 3000 nt of promoter + ATG

SEQ ID NO: 6051 - DNA, 3000 bp, Unknown
  misc_feature (1)..( 3000): cDNA_ID_2105085_gDNA_ID_1620839_Annot_ID_170024 3000 nt of promoter + ATG
gaatgtaaatggatcagcattgtcgtatcaataaaaaaaaaacttaatataatgctacatcaatattgttttagttaaaattttctacttgtctagttttcatatctactttttatttattttaaaatcaatgacttctaataaattaattttctacgacaattttacaatccattaaaatccaataatccatagaaacttagaagatgatagataacaacttaagtaaggcagtatgaaaagttgaaatgcaatataatttttatttttgagttctaacctaaacaagttttcaataactttgaataaaaacaaatttaggttagaactcaaaaacttgttttcaataacaacaatggaaatatgcacaccactaataaactttcttgtatgaaatggctaaagaacgagtagatcgttgttgaccattccaaaatacaactttctacttggcctctaatcgatttgaaattgaaaatgatctagattttttagactattcatatcgagatcagtatcctgatcttgaaaaagcctcttaattatgtttcattcaatcgccaaaaagtaaggtcggtttggttttacagagtttgtctttttcctgcaaggttcatctttccgggaaaaaaaaagtaagttttatatttttcttaacttcttgttagactaagaaaaccaaattttaaactaacgagttaatttacatatacattttttgagccattttagctaataaatcctaaacttgaacttatttacaataatgccattagcattaaatcttttttccaaactaattaattttactttacattcttaatttaaattgtcaatcacattatcaatcaaatttaatccaaacaaacttcacatcaatcccttaaaattagcataaatatatttgttaacaatattttaaaacaaagttttttgtttaaataaatattattcttactaaacgtttttgtttaaataaataaatcatgtatttgaacttatttacaatgtcatgcttaattatttaggaatgaaaatatttaattaaagatctaaatcttctaaatccttgcttttagatttattatgtcattacctaaaaggtaaaaaatattaactttttaaatataattatttctatatttaaacttaataaaacgttatcaatatttaaacttttaaaaagtttaatatatcacaattttttaacatcattatataatatatagagtttaaaaaaaattcaaatttttttccgtcatatcttgtgattcgaaattttaaaaatgaacatattttaaccaattggcgaaaaatgtgtgggttcaacgtcccgcatcgactaaaatatttagacaaatgattcgtaaacatatcataaataagatcagcattaataaaataaatggtgtttttatatatactaactttaaaaataaattgtccccgcggtacacagcgggttaaaatctagtaatagtatataataagatgacttgagacaaagaaaacaagaaaatattcttttcactttatcatgcaacttaaaaaaaaaatacatgaattatcctgatgctgatgtcagtttcactttcaaccatccttttaagcagttttagttccaatttgttttcgggatttaggcggcgccatgactgcgactgcgatttttgcattgtccaaccagaacaaacaaacaacagtgtaattgtaaaatcatgatgtggataataatacatatgttatgtggtttgcagaatgatatcgttgtttgctatgacaacatagatatacattatccacgcatctatggtttctcttgaaattacaaattatttttgtgcgattcacaaatacaaactaaaacatgatgggattaacatctactcttagcgttgagagaattggcgggaaattattgtgatcgatgaatgcaaaaatgttgtacatgatatagaagatacaattgcaactaatcgaaaaatctttgagaaccattcttcaacttttatggaagccattagaattcaacaaagtgactatcaatggtcttgagcttctccaatacctctccatagcaatttaattatcaacgtacaacatatatatgtatatctcatcataatattccccaatcatactcataccgttttctaccgtcggagacgtgaggatatcttctaagttctttctcttatgttctagaccaataatgattcttttaaaagctaggtgtattgaatattgattctgattcacatagcatagttgttatcgttagttttcattgagttgtgttttcttttctttacctttgtaggagatggtcgaactcataataagttcaatgtattagattaagatttgtcttctgtttgtagtaaatttggatgattttttaagattgtaattcaagtcggacattggtgtatttgaagaagtttatgcactcaaactagcctaggactgaatgtagcagattatagatgatagtctgttgtgacttttgtttataagagcagctataatttttattattttattattttatctcagattagtcgttgacaatatgagaaagagattatttatgtaattgctggagattaagcgtgactaataaagcatcaattaaggaacagaaagaaagaaaaaaaaaaagcaagaagagagatagcatgataaaggagatgataactttacagaacataaagactttacaaaacagaatgtgatgatttgtgacaaccacctcgttttttttaaataatatgtgctataatgagaagcaacacatttaaagattgaagcttgtctgtaaagtaacaaacttttttggtcactttgagagaatcaagaggtatcattataaagctgtaaagggttggtgaaagccatcacattttctgccaagcttttaaaagaaactgatgtgacaagtagaaagaattttgaagaagcaagaaaggttatatgaggagtttggtgtataggaagatg

SEQ ID NO: 6052 - DNA, 3000 bp, Unknown
  misc_feature (1)..( 3000): cDNA_ID_2135381_gDNA_ID_1620839_Annot_ID_170020 3000 nt of promoter + ATG
aatctcacattaacagagtttgattatctaatcaccaagaagaaggtaagaatcggttgatgcatctctacatttgattattgttttctctctcaaaatcactgatttgtttgtttttgctgcaacacagctggaagatgatgatgaagttgctgattttgtgaatcctaacacaaagaaggaaacattggcacttggtgattcgaatatgaggaatctgaaatgtggagatgtgattcagcttgagaggaaaggctatttcagatgtgatgtgccttttgtcaaatcttcaaagcccattgtcttattctccattccagatggaagagccgctaagtgatcaatgaactatttttgagtttcccattttatgaacattgtgttgagaaatttgctctttaggttttaaaacaatgaaaacaaagctttttatcagttctttagtttcatctcataatagttttaaagttgcaaactttatattgattcattcttctttgcttagtgtttacaatataaacaaaaacaaactcatttcttgggtgcgtatctcagtttgatcttcttaacctgtttgtgtttgagctggaatgacttggccagaatgtcatcgggaagagctccaaagagagaggcgacaagtgattgtgttccgggcaattggctatcgaaggctgcgagtacagatgctggactgttggcaatgttcttctggaaatggatgagtcccttggggaaggtgaaaacgtctcccttgttaaggttcttggcgatgagttttccagcggttgttacaaagccaacatagagctgaccttcaaggacgaaaatgatctcggaggcacgtgggtggacatggggtgggtttaggccgtttggggcgtagtcgatgcgggacatggagaggccgagagtgttgagtcccggtagcttttctacgttggctccggtcacgactgagccggtagaggtgtttgtggcggcaatgttggctaagcctttgaagtagaagtcttctggtgttatttgtgttgagtccttgcaagtgtatccgttgaccttgaccgcttcatttgtgatcaaaagagagcaaaacacagttagataaattttgacaagaagaaacaaaagacaaactaacttcaaaactctattattatttggtatgatactattgaaaaagaatgttgtccacctactttatattttaacattttgataaatactatatcatttataaatcctgccaaagttcgaggaaactcttgaataatataatacaaaatcgagaaataaagtatagtataaatgagaagatttcgtttcataatatctcaattggtggcaaatttcttaacatgatataattttataactagaagaggacaaaaaaccataatatcatgtggaaattgggatctataagaaaaaacaataaaatgtttttaccaacgatgaacaaaaaaaaagaggtgaaaacatgtcacgggtaaggtaaaattgattgaaacaaaatgtgttagtgaggtaaataccattagacaaatcagcaacacaaacatcttgaagcatctccgcggaggccatggctacaaacaacattgtaacaacaacaacaagatgggttgcaaaagacgccattattgttgttgttgttattttttttctgaaaagagtttgtttttgatgaatttataaattactaataaattcacaataaaaatgccttgaatttggtattcttataaacaccgaggatgctttacaatgtttattattaggccaattgtgagaggtggagtttaattcttaatttagccaaaattaggtttttaaattttaattgttggtgattaacaagagttgtttattggtgaattgagacatctcatctaatctatttggctttagtaccgtacgaggaaactctcctaaattaaacgtggccacaaaaaaatcgttgtatggattaataaaatagaaactagatgttggcttgtaatttcgttataactcagctagctttgttttgtttttggccaaacgactcaaatctaatacaaactctcattttacttgaggcttggataaataaccgaactgagaaaaccaaacaagaccgaaccgagatttcgtgttttggatcggtttcggttctttcggctgaaccgatcgacaggactttaattttggttagggtcaggtcgaacctatctatttctcagatacttaagaaaatggattataccaaaattaaaccggttttcacaaaatttagaccgttttcagcaatagccgaaccaaaccaaactgaatttaacccaaaacccagaatttagtcaaaacataactgaattaacaaattaaccggaaaccggatcgaaccgaatttattttaggttaatatcgacatctgtataattttgttggcgataaccgaactaaccgacccggagaaccgaagtcgcattcctattgaattttacatttgtaaccaaaccggggagatttggtgacttgagatttggtttctgggtcgacagagattgtccgctaaaatgtcactgtcattaacaagtacacaacatataatatgttaaatagatgaacaagtgaacaaatggtttaagacttatgactaacaaataccctcatggataaactcacaaaagtcccaagttcagcttgaatcgatatttagatatatattatcaactatgtaaaaacccaaatataatatgtaactatattaatataagtgtagacaaaatgtatagactacataaaatataactagagtaagctcgttgacgcaacagtttgggagaaagacttaaacgaagtcaagtcgcttttatttaatgaagatgttgagaaatgaagacaataagaaacaactcaagtgcttctttcatcaaatctctcctatttatatgtttctaatttcttctcctctattcatatctaaatcccataatccttgttaatctctccatcatg

SEQ ID NO: 6053 - DNA, 3000 bp, Unknown; identical to SEQ ID NO: 6046
  misc_feature (1)..( 3000): cDNA_ID_3079341_gDNA_ID_1620839_Annot_ID_170019 3000 nt of promoter + ATG

SEQ ID NO: 6054 - DNA, 3000 bp, Unknown
  misc_feature (1)..( 3000): cDNA_ID_3079362_gDNA_ID_1620839_Annot_ID_170009 3000 nt of promoter + ATG
tgccaaaagtagttatcaaatttttttttttctagcgaataagttcttaggtttacatgagctcaattagttcattgatcattgttattcaaacttaatgaagtgtttagtttccaccaaaaaaaataaaatgaagtgttaagtttgactaccgttatgtttaggttagtgacaaaagttatgttattaaaattgattagtgtcaaaagttaaaccatgttaatcttttatttgataaattagacgtacagatagaaaaagtacgcatctcataacagttgaaaaacaataaaatcattgaaaaaagtttatgttcctatttaaataatttttagtttaatttttacaaaatttgttacgttttcttttaaagtgaaaagctttacataaaacacaaggataaaaattaattacaattttaagaagacatagtttttatagatatttttttgaacatgctataattattcgtttgaactttttttttaacgtgctcgaatcaataaccagccaaatcgtaatgtaatttctcgatctatgctattgaccatccattcgaaacacatcacattttataaaccaagaaacataatcatctaagaatagtgctatcccatatttcatgatttggtctaaagattcttcaatagggtttatttatgcttagacctacaagaaataaaagacaagctagagtaaaagtaggctataataattgtatacaaattgttctgaagtaacagattcatgatttaaaaatcaaatcaagcccatcaatttggctttgaaacgctttgtgtcaaaatggacaagacatgacttccttcgtgtctttcgtattagaaccaaccatctaaaagctctcttcctttttctctaccaacttttgtcttctatttaatttaccaaatcatgggaattaaataattagatgaataaaggatcggaataacaagttctatcgtacactgtaagagcaaaaagaagaccgaaatcttggttgaaattgttgtcgaaagatctcattcacgagatcacttattaacttacgtcaaaaaattatatcgaatcgaaagatctttgtgatattgagtaacgtgaggattttattttggttaaagactaacatatgttgatctttgataatcaaacctagtaaaacaaaacatactaaagggaaagagagacgatacatgcaattaatgatttcaatcctccgtttaagaaactctgattttggttagaaactattagctattcattttggatatcgaaaattcgtttagatctcaatgcaactaagaataaatgtgtgtaaaacagaaaacgatgaaatctcaagtgaagtgatatatcaaggttttaatttttaaccgagtttttggtgttttatcattgtgtttttattcgagtttttagtgttttaattagtatattagaatgttttcaggtaaacatatgaaaatgatgcaaaacttgagtcaaatggtaaaaaggattaattttcttgaacaagacattataccggtccatgattaatcaggctaagactgatccactcttcaaaacttcagaccggtctaagcagaccaattccaaaagcatttatgaacagtctatcctttagcaagccttccattcaagccataaggccggtcccaaagattgcttcgtctaataagaacacgtacgggtaaagacacacctttgaagaccggactaagacaccgaaaccagctccgttgcaccagacccgtccagtcctcatgaagtctaatccaaacagtccgaatccaatagacctgtcccaactccttcacgcgggactagttcagtccgagaaagaaagagaaggtattcctaatctgtttgggacttcgccaaactaccgactctaagaagatctaggcctattagacggatttcaaaagagatgatttcatactcttaaatttagagaagagttccataacactcctttttaatattttcgatttatttatgcattattctttatatttattttcatttttttaccaattatgagtatatagtttcattattggattttagggattcaaaaaggattcatgaatcattagtttagaatcattagattaagtaagcatcttaagagttatatgtctactgttattcgtaatgccgtaactagtttgatcacccaactacttatcttatgtgaattaacgcagtaaaagtggtggaattgttggaaaatatcctagccaacaaaagcattgtttacgaagttttgtgaacctatcaaacttaaacgtttataaataaatattttcatgaaatccaaacgaaactttaggcttttaattggttagatatcttgactgaactgtcaaggaaacgctctctgacccgataatcgatatcttgattggttagatggagctcgactgttctctcatctcttcaacctctgttaacgattctcctgctgttttggcaccccgaagagccaatccttaccaattatcccttatccttcgaagctgcaacgtatgggtttgctcttcgcagatctataaagtttggtacgctctcgactccctctgatgcccatccccaacggaaactaccggagcaaaacggcggcggcggcggcggcggttctaacctaatccttctccaagtcccccgcttgggccatttgtcttgccatttgggcttaggcccaaaccgtttatttctacggcccaacttcaaaaggtgctcttcaatttcatttttacaaaagcccaggtattgcgtgaagcgtctgttgtcctctcttagctttaagttgtgtcgattcatggagtcaatggtttgtggacgccacttgatctcatatcatacctctttgctctgtttgctcaacatttatctgaaaacctgccctttagaatcacctagaagttctatcaaagtttcccaaagcttgaagaagactctctcggatagcttacattatcacggccgtttgca

SEQ ID NO: 6055 - DNA, 3000 bp, Unknown
  misc_feature (1)..( 3000): cDNA_ID_1829890_gDNA_ID_1620841_Annot_ID_50886 3000 nt of promoter + ATG
attgaaggaattgagaaagttgcaccgttcttgaaagtcattatcgaaaagtgagttctcttgttctctaaaattgttccattcttcatgacattaaatatgaggaacattttgactaacagtggacctttttgttcacagagatttcataaaatcgctgatacaaggtttgctagccggtattgcgttgaagcttttcctcatctttctgccagccatactgatgaccatgtccaaatttgaaggctttacttcagtttcattcttagaaagacgatccgcgtctagatattacatctttaacttagtgaacgtctttcttggaagtgttatcgctggagctgcgtttgagcagcttaactctttcctcaatcaatcgcctaatcagtacgtgactctctatctctgttaatctttcgttctttttgggttacaggcttttctaaggactcttctttttaaaaatctgtgcagaatccctaagactattggcatggcgataccgatgaaagcaaccttctttatcacatatataatggttgatggttgggcaggagttgcaggagagattcttatgttgaaacctctcattatataccacctcaaaaacgcattcttggtgaaaacagagaaagacagagaggaagcaatgaacccgggaagcatcggtttcaacactggagagcctcagatacagctttacttccttcttggtcttgtctatgctcctgtgacaccaatgcttcttccttttatcttagtctttttcgctcttgcttatgtcgtataccgccatcaggtaaatgtagtttctttctctcctaaatttgatgaaactggctagtttgataacttgaaccttctgtttatttgttttcttattctcagatcataaatgtgtataatcaagagtatgagagcgctgctgcgttttggccggatgttcatggacgggttataacggcattgatcatatctcagttgcttctgatgggtttgttaggtacaaaacatgccgcttcagctgctccgtttctcattgctcttcctgtgattactatcggtttccaccgcttctgtaaaggccgtttcgaacctgcctttgtccgttaccccttacaggtcagtttcttctacgttatctagatttattatttctgtttagttcgatttttgtcactgtttggatcggttttacgagccccagaaatggcaaaatgttgattattttacaggaagctatgatgaaagatacattggaaagagcaagagagccaaatctgaacctgaaaggttacttgcaagacgcttatattcatccggtttttaaaggcggtgataatgatgacgacggtgacatgatcggaaaattggagaatgaagtcatcatagtgccaacaaaacgccaatcgcggaggaacactcctgcaccgagcagaatcagcggtgaatcgtctccatctttggccgttattaacggtaaagaagtctagtttaacggtttcaattcagtaaaagcatctgcatacgatttaagtatgaatatagttcgtgtatgtatgtacttttatgtgtacatagagaggtttgtgtttttgcttagacgttgttgatgggttttaattgttgaagtattgaagtttcagggtatttttagaataatatcattttaattgggtgtttttcaaacaatgaatttgtggcaatcttgccaaacaaaaatatacgaaatggtcgaatagttgaggcggttagggcggacaaattcatttgcgatttaaaccatttttgtgtacctttcataaactatataagccatgctagtgtaggttgaaaaagatagaacaagttgaactacagaccggttttacttaaagttagtccgtggtggtttattgtccgattcaaaaatagagtggtttagtcgattaacggattagtctgttttctcatgtcatccattgaaagccgaagagtttgtagaagtaaacaaaaagatataaacaataataaaacaagaattgcataattttgtattcaacagaaattataaaaaaacttatagaaagccacattacagtacaagaaatcattcttatatctaataataggagaagtacatgatttttcatcccaaaaaaaaaaaagaggtacatgatttacacctcgtcgatatcctaacgattaaaaaactgtaactactgattttactacagtatatatgtatcgacaacataacaatgtcgtgacttatatactgttgagctcctaagaaaaaaataacgctattattgatttcacaatagtagcaatctcaactccatagcgaatgacgtagagaaatgtaaccaagacattttttcagaaactatgatcgatatatttcaagaaaggtagacaaaaagtgagaggctattatgtgaatgaagtaaaaaagtagaactattgaggctaatttatagagaatgaattgtaaataagcaatgcgatgggctgcaaactcttctcgtaaatctgcaaatttattaagacagtgcacctaaatattaatgaagagagttaatgaatcaataaatttgaacatcgtgacttgttaagtttggtgagaggggaataaggaacgttctatatgtaaagcaatgataattaagagttaaggagttcatagttcatgtttttctctagtttggacttgagtccaaaatccaaattaatccaaaacaatgttgagcctaaactgtcccaagactcccaacaactcaggaagctcttgctgttttccttttaatcattgtgatattacattcttgatcgtcccacagggaaaatattttagccgttagaccaaatgataaaaaactgtaactgttgatgggaacggcgtcgtttcgctaaccttcgttttaactgatctcaattctcaaggttcaaaagagtacacacacacttatctcaattatccactgaaacattcgtctccggcgaaacaaaaccagaatg

SEQ ID NO: 6056 - DNA, 3000 bp, Unknown
  misc_feature (1)..( 3000): cDNA_ID_2138640_gDNA_ID_1620841_Annot_ID_170039 3000 nt of promoter + ATG
ttaaaaattagggatttcgcttaagtttggaatgggttttgggtcgttgggcatggatcttaattggatcggatactttgttgggtcgtctgggtttttggtcttttgccaattatttgaattttctctcatttatttttaattcgataaaaaatgggaattagaagagtggcattcctggttactttttcgcagatagtggcattcctgccatttattcgttcaattccgtgattacaccatttctctctaccaacaggtttcaattctacaaatcttcaaacccaattcattcaaacgtctttctttagctaatatagatcagcgatactagatttactcagattcatgattaaagtgaagaaagtgtgaatctttatgtgtgaaattgttgtggttcttacaagttatgatttctagggatttgaattgtgtaaaggtttgaacttcagattcatgtgtttgttttagtctgttagatcattgttacaagttatcatttttagggatttgaattgtgtaaaggtttgaactttagattcatgtgtttgttttagtcgtttagatcattagtttggtttttgtttttgtgaaggggtttttggatgatcagtttactgaattgaagaagcttcaagatgatggaagtcctgattttgtagctgaggttctgtctcttttctttgaagattgtgttaagcttatcagtaacatggctcgagctttgtaatttcgatctttctcttatctcactcataatttttgttagatcatcattgctttgtgttgtcttaaaacttcttaaaactgtgattgtgtctcaatcacaaagtctggctagaatcatcattgcttgtgtatataactcagggataagtcgacgggaactgtagattttggtcaggtaggtgcgagtgtgcattaattgaagggtagtagctcaaggtatgttttgtgtctcgcttatatcctaataacaatcaagaagtatactctgtagtagcagaagttctgtgttgttgatagatgaagctcttctcttgtactcttgtttttgatagatgaagctcttctcttgtactcttgttttcgatacagtgttggtgcgaagagggtcaaagctttgtgtgttagcttcaaggaatattgcgaagctcagaattacgaagggtaagcttgttcaacaccgcttaaggactcatcggttgagatgtttgcagcaagtggatattgagtataagaccttgacgacaaagcttcaagatatgttcaatgtgagtagtgatgacatagaatccaatttttggttcattttatgaatcattttgttgactaatgaacaaatttattgccattgttgttgttattgcagcttgagaaacaaatcattcaagctggtggtagagttcctcaagtggatattaactaaagagagactaatccataagaaacaagatgatgacttcaaatttggattgttcagtttctccttttttaaatttattttggattttggtgttttgcttaaaaactcaatagaatgtgtggaaaaaaagagacaagtgattgttgttgataaattagtagtgtgtattggttctttgatcttattcgagaaaatttaacatctttggaccaaattaatgtgattgatgatatattggttttgcttctggttttagtttgagtaagatatagcaattaccaagtgagtcttttttggctagtggtgcttctaggactctccaaaggttgtggtttttaagatccttagttcgattctctcttggaataggtaggtatgtccatttttttggatcgcaaatccgtcctgactcgtatccgtcccgaatttttcatcccattcaaatgattatttgtttgggacaattaaatatgttctagcggatacatgaacggattagataagagacaaggtatccgaattatctttaaaattttcaaaatatttgtaacaattttaaaattattcaaaagtttcccaaatttgtccatgatttatcatagttttccgaaattatccatttgaaccttactcaaattagtgaaagtttatgtgaagaaaacttaaaagtaacggttgcttgaaaaagaaacaagcacaaagaaatttgatcaccgagttcacgacttagccgctatgttccggggaagatttcttgctccccactttcactatgagaatgaggttactgacaccacttaaagtgtgatgttgtcttttggtttcagatacaagcgatagaagaaccaagatcaaagacacaaagatgataaagaacaacttgctcaagaagctcgcgtttctctcactcttgttctatatacctaaatttctcgaacctatattgttatctgaatttttcgtcccgtattttatgaagaatattttggaaaaatatgattgattatccaaattagctgctctaattacatgttacttcctatctcgatatccaaaatagacaccctagaaaaaatggtgattcattcacgataaatcacaaacctgattctaatcaatgtagattagaagtccaaaggatactctccaaaaaaaaattaaaaaaaaaatagtgattagagggagcacaaagataaatgtaaacgcgagtgtagaagataactatctctttacaaatagtctttataccttccgcaacaagtaattgttctcatcagtctctctatgagtaaaaagctaagcgaaagcgagactccacactctcagcgattcaggcgataatacctaaactcaagtaagggtttttactctggtaagctaatcaacgctctcatctttaacaaattgcgacctttatatttctctcttcttatgattcgtcctctatgttctcaaaatagcttagaactttttacaaatttcagactttcttgtaatgattcttatgggtttaaacgtatttgatgatgaataggatttgctaaggatttggggatctttgttcggtttcaatg

SEQ ID NO: 6057 - DNA, 3000 bp, Unknown
  misc_feature (1)..( 3000): cDNA_ID_3079406_gDNA_ID_1620841_Annot_ID_170055 3000 nt of promoter + ATG
taaagctgtttaagatcaaatgtgggagtgggagtcaccaattttagtaaattacgcttttaagtaaaagtaaaacttggatttggatggatatgaaatttagtggatcagcgatagtttttgagagtggaaacacatttaagatgttgaaaaatcatttttgaaagaaattaagtattttttgggggtttgaattgaatatttacaagaaactagattttaatccgctgaatatcgcgggactattttggttttttacaaataaaaatttaatttgttaagcctgttaacggctgttaacttatatgtccgattcgaccaataattaaaatacagtgttttatttggcaacaatttattaagtgatgtatttttatttcaatccaaaagtattgagtattaaacttccaaattaaaatttgtttgggattttttaagcatttttgcctttaatgttttgtattttctgaatgtataactcttactatgtttgatttttactgtttaaaaatataggaacaataatgtacagttcattaagttaaaatctagattattattaaataatttaaattttaattatgtttattttattaataatatttattttgttaagtttttaagataatataattatattttgattgttatatctaggatttcacccatggtataacgtctcgtattactatcaactcaaactcgtcctaccatgtaatctcgttcactgaaactaaacatatctaatagatttcactcttggtatatcatctcgtattacaatcgacccaaatctgtcctaccatctaaactcgttcactgaaattaaacattttgtttttgttattttattttaataatactttaatttaaaagatatataattcaaattaatttaaaaatcttctttcaaatggttatttaattgttgtaaaagtcatacattataatattctacatccgtctctccatctaatctagttcggtaaattaaacattatttttttttttttgttctaataatatttttattaaaagatttataattcaattcaatttaaagttttcttttgaaatggttatttaatttaatacatttcatatattatatatattctaaacatttttcggtaaatatcctaaatattttataaattttaaataactatattatttatctttaataaattataatgttaataaaatcctaacatttttcctttttaaaagtaattagaattgatggatatatattagataagtaaatgctaataattaagaatattaattatttgataataataaatgtcaataacatttcttgtaaataagttccaacttgaagatttatttgttaaaatggcagcgaaaatgtatatgtagaagatggagatcatatgttggtggttgctattagatgtaaaacataacgttgtactgtgaactatatgccatgtatttctcctccacaaaatctattctctggaaattaacctaaatttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttct

SEQ ID NO: 6058 - DNA, 3000 bp, Unknown
  misc_feature (1)..( 3000): cDNA_ID_1829886_gDNA_ID_1620841_Annot_ID_170053 3000 nt of promoter + ATG
tacaagaaatgttattgacatttattattatcaaataattaatattcttaattattagcatttacttatctaatatatatccatcaattctaattacttttaaaaaggaaaaatgttaggattttattaacattataatttattaaagataaataatatagttatttaaaatttataaaatatttaggatatttaccgaaaaatgtttagaatatatataatatatgaaatgtattaaattaaataaccatttcaaaagaaaactttaaattgaattgaattataaatcttttaataaaaatattattagaacaaaaaaaaaaaaataatgtttaatttaccgaactagattagatggagagacggatgtagaatattataatgtatgacttttacaacaattaaataaccatttgaaagaagatttttaaattaatttgaattatatatcttttaaattaaagtattattaaaataaaataacaaaaacaaaatgtttaatttcagtgaacgagtttagatggtaggacagatttgggtcgattgtaatacgagatgatataccaagagtgaaatctattagatatgtttagtttcagtgaacgagattacatggtaggacgagtttgagttgatagtaatacgagacgttataccatgggtgaaatcctagatataacaatcaaaatataattatattatcttaaaaacttaacaaaataaatattattaataaaataaacataattaaaatttaaattatttaataataatctagattttaacttaatgaactgtacattattgttcctatatttttaaacagtaaaaatcaaacatagtaagagttatacattcagaaaatacaaaacattaaaggcaaaaatgcttaaaaaatcccaaacaaattttaatttggaagtttaatactcaatacttttggattgaaataaaaatacatcacttaataaattgttgccaaataaaacactgtattttaattattggtcgaatcggacatataagttaacagccgttaacaggcttaacaaattaaatttttatttgtaaaaaaccaaaatagtcccgcgatattcagcggattaaaatctagtttcttgtaaatattcaattcaaacccccaaaaaatacttaatttctttcaaaaatgatttttcaacatcttaaatgtgtttccactctcaaaaactatcgctgatccactaaatttcatatccatccaaatccaagttttacttttacttaaaagcgtaatttactaaaattggtgactcccactcccacatttgatcttaaacagctttatattctcaactttcccctttccataatttaaaaatagatcttcttttacattgagaatcagcatgattggagatggctagtgggcataaaatgttaggaatagaccacataaataaagcataaatcatataattataacaataccttttattggtaattggcatacactttcaagtttatatttggattatttcattagcttttttaaaattaaaatgtagaaaaccacttcctacaattagaagaattttattttaaaatctacgacaaaagaaaatatgttccttttcaatcattctacttaaatctttaggaccaggtttaaacaaacttcatgtcggtatgtctctcattgtcaagatctgaagatttgttttttttttttttgaaagaaagaaagaaagagacaaaacttcaataatttacattttttattctagatgaataaggagtgaaaattcgggtaagcgggtcgggttcagataaaatttgatcggatacggattcttcggttaaaaatgtttaggacccaataggataaatctaaaatattggttcgattttggttcaggtccaattggatttgggttggttcgatatagattttcaggtctttttttaaaccgatactcgaattttcgggtaaataccagaactttcggataaaatttcggatttttgattaaatttaaattttcgaataaaaattcgggtatatttggattcggatcggattcgaattcgattttttggataaagaaatttagaagtcaataaaataaaccttccggttgatttaagttcagataattagattttttggataaagaaatttagaagtcaataaaataaaccttccggttgatttaggttcagataatcagttccggttttttttggccaggcctactgatgaactgttattttggtaacttctaaatatcaaaacggtcctgaatcaggactgataaaacgttaaaaaagaaaaaaaaaagatctactcgtcttctttgtttgttcgttacagtttttacaaaaaccgacagacactttatctcaagagactgggtcaggcctctgttcaatctctatcaaaatccctttcgacatcattcataaacactgacgaatcagtgaaacaatatctcaaacccagaaaccaacaataattcatagattactactatacaaaattctatataactataatctgttctcttgtgtgtttctcgcgtggcttgcgtgttacttcattcatcactgctttagcttctcctcatatgaatctcgaggcaatccagtcactgacttttctcactccccatctctagggtttctctctttcccttattttataatttatttcattgaatctctgaatttcattctcttttgtggagtacatttgtgtaaagcttagatttttatttgggtttcaagcaaaccgagaaaagaaacgattagatctcctttttctgggtttgttctcaaagatttgttctgtttcagttcttccaatttggggggattttatgttggatccagtctctaaaggttcgattttgatgtgtttccttgatatgtaatcagatttgaatcttaaagtttctatctttatgactcctttcaggttaaaactgtgagcatttggagtagcaaaagtaacaaagcatg

SEQ ID NO: 6059 - DNA, 3000 bp, Unknown
  misc_feature (1)..( 3000): cDNA_ID_2138720_gDNA_ID_1620841_Annot_ID_170064 3000 nt of promoter + ATG
ttgataaaaagatagatgagttctcataagagattacaaggagtttataaagaaagaagtcttggaacacactcacaagactaccttggaaaatacagactagtttgaaagtttaaaaataacccttccacttcttggctccaaaatgactcttgatatgctattttcgtcacttctcttgaccagcaaattatccacttggtttggggtcttcttgagcttgtgatggtcataaaattggttggacttcatatatattacattgggccaacttctgaatgttataccattgtttggattatcaaatgggtgatttgaatgtgaatcatttgcctcattaaaaaccttgtcaagaaaaaccattgggacaaaacttgacaagggaaaaatagtacaaatgagacatatgcccatttgatgatcatgtatcaaaaccaatgaggttaagataacatctttcccatactctttctccgttataagttcattttctgtttcaaaatgctcctcaggttcaagctgctcctctgcttcaagctcttccgcggctacaagctcttgatcaaattccatgtcctttgtgctttccatgatcacatcacataactccaacgaatccactataatacgaccaacatcttcggtctacatgaagtctttcacgaattcgataaagttcttgtcttgtcagagttttaatataaatttaatagagatggaaattaattgatttcaataatttttgatttgactaaattaattgatttgattaagttttgaaaaaaaattcatataatcatattaccatctaatataaatatactaaactataatttaaaaaaactatagtaattttgtatatcttcaaaagtttcctttctcgttttaataaatgtatataaattttgattagtaaatactatcacaaccatttatttttcactaggttaggcccgcctaaataggcgggtttaaaaaaccaattataaatttttactgatgatatttgaattctaaatagtaaatgatacttcctatttttaaatatttaatttagtaaatttgcttaaaatcaaattttaatcttacaattttgattttgctgtacacttaatgactttaacggtattttattgatgaaaattaaattttaaatagtagtcaacacatatttttctgtattttgtttagtaattttctaaaacccaaaattttaatcttacacattctattttgctatcaatttaactatctatttcatcataatattcccgattttgattatgcacatattattttaatgaataagtgttaaattttatatcaaaataatatgtatatcatatcaaatcaatataattacttcatatgaaaataattaataaataacaaaacataatgaaccaaaaaaaagaaaaccacaaaatattttggaaaagaaaaattgtttaagatatagttttgctatattttataatctcataaattagttttacctaatgtcaaactcatattagatgacttcaaatttatgaataaaacattgaaattttatattaacattttcacaaataataaaatatcaatccctctaaaccctattttcctaatttttggtggtttctctaatgactacatgcattaaaattcttatattaaaaaataaatataactatacaaaaattcccagtgggtattcaaataaaatactatattaattgaaaatacaattttatcgaactaaattaatgttaaataaattattttgttattttatacttcagtgggttcttaattagttattatcattactaatggttttgtttaaattaataaatgctagattaatttaattgaccaatatcgcatgtaaaatcaaagtttttaattttatttttgattaataaaaattattatgtatatatatagagataaaaattagtgtatgtaaatttgtttactttttttaggtttctattttcttagagaataaaattttttaaatctttgatgacacatgtaaacatcttatcgttaaactttccatctatcatgatctcgtgagttagtaatttttgaaaccgtactttatataataagatttgtaaaattttctatgatttgattaaaatttaatactgatgttatgaatataaaaattaaaatttccaaatctccactccctcatcaaatctccctcagccttatcaaatctccactccctcatcttcactcccccatatattcacttccattgacattttaagaaaaaggattgtcaaaaggaaatggtatacattgttatattaccaaaatttgataacaaaatatagtactaaaaaaagaatttgttgtctgccttgttaaattttgtttttttgtatatctagtctatatatacatttttacagcacttttttgaagataatgttgaagatttgaggaataattcaacaattaattcaaatgggtgggttttaaccggtttaactctgtttggatcctagattgcataattttaaggaataatgttatcctgatcttggattgcagaagtttaaggaatatgtttcaatgaatattacctacaagatttcgtaaacataattaatattctcgagtgcaaatatattctcttatataatctttcaaaattcttgcaatctctacaattatgcaaataacaacctttgattcctaatatctcgatacaatatatatctcaatgacatcaatatattctcaaaatcttctgtgtaaactaaccaaggtttaaatccgtagcaaacttttcttttccctcccaaatcatcaaacgatctaatatctaatactcctattacaatattttcaatagatcttctcacacttgcagttacggaaaatctcaacaattattctcattaacataactagatcatgaaaattctgaatttaaaacgcaataagatcattttaatttaaaacttactgaattaaaaacattcagagtggatacaa

SEQ ID NO: 6060 - DNA, 3000 bp, Unknown
  misc_feature (1)..( 3000): cDNA_ID_3079398_gDNA_ID_1620841_Annot_ID_170058 3000 nt of promoter + ATG
agtggctcacctgagagtaacgacatagaatgatcaaagaatgtggtcaacttacaatcaaagagacatgagtccagagaaagtaactaaccaggaacagatggatgaaaatatccaaagcatcgacggcctattcccaatcttcttttaagatccaagaggttgctgattggatgcaccgccttataaataatgcgttattagacaaaacttttaacattctgaaatagctgagattactataatggagactagtactgcatacctcatatgcaacaattttctcaagcaatgaagcaggatcatcccaagtaatttgatgaagctctaaagtggcaggactaagccacataccgagtttctccttcagaaaagaatctaatgttcgcaaagacggcgtgttctcttttctatacattagaaacaaccatcagtgtcagatacaaccggaaatgttttaccaactgattcgaaactatcttcaaatatttgagtttccagtcacataacaagaggacaagaaacattacgagagtatcgacagaagatcagctcggaggatggacaaaaatctcaaccctccaggatgtgtattcaacctctcaaataaaacttcatatgttggcctaagagcatgcctcagattcctctcaatgcgatagaaaacagaagataaagcccccttatcatcatcacctaaagaaaagtactcgcccatcaatggagaatgtaacgaagaatcacacaagaaaaaacaagaatggcacaagaatgactctcactagctggagtttcaagtccaagatattgcttaacaagttctcggacttgctctcggttaacatcatactccttggctaaaacaagcagtaacttctcgcggtcttcaagcgaaaggctaaagtaaccctataagcatttttaaccatatatgtaatcagattgaaaaggttaaacacatcaaagatcagaatcaagaaacaacaatgtgaagatagttttacctcttgaaaatcattaagagtaatgtctaatacaccagttttactagctgagatagctgagtgcattgtctctcgaacaacatcataaaccctaaaacaaaaaccaaactcactactgcaaagatcaatggtgctaaatcaatatctacaatgagaaattaccttccagtggtaccaaaatcattagaattttgcacaatgtgatctctagaatgattctcttgaggattagattgaatttccttctgacaacaaagtcaacaaaccattattatagagtcaaattagccttattatattcttatcttcttaaaaacattcaagctccgattaaagccatagccaatttctcactctctctctctctttttcatcaaaagatgtaaacttttcattgcccatgattacaaattgtgtgaatttggacagaatcgcaaaattatccaaaaaattcaaacagagaaaaagaaaagcttacaggaaattgagagagggaaaatttggagggattgttggatctcattctagcacgcaacagaatcgctagatttttcttgctcatatctgtttcattatgatcatcatcatcacggttaaaatttcatcggagaaaaaaaggaactcaggaagaagaaaaaagcgatttcgcaatcagacatgacaggaaccttaaaatctggccgttcaagtatcggaaaaaaaaatcgagactttgtattcccttttcaacggatagcgtaaaggcactggcttttaaaacggcgtcggttttactttacctgtcgcttcacttgccacaaaaatttgaataaatggcaggaatgtcactttctccaaaataataatcacgaatgccacttattctttataattttatttttttttataattaaaactgatgtaaatatccaaataactttttaaaaaattaaaatatacagatccaactaaaataatccgacccaagtacaataaaataattaacttggcccaaataatactatatttttaatatgtaaagtaacagttttatccaaatttaaaagcattattcttaataaataaaaacaggattcatatttagaagaaaaaaattaaaattaaataaattttgaaatataagtaatagatttttttttaaaaatctctattgataaattcgaaatgtatgtattattcgaaatatgttttagttgttgataacatttttaattatttttgaaataaatatagtttatttatctatttatattaaaatttaacaatttaatatctaaatatattttaaagtttatcacttaataaatatagtttatatatattattttaaagtttatcacttaatacatatagtttgaaataaatatagttttgaaataaatatagtttatatatattattttggacaaaattttgtttaaaatatttaagataagaattatcttttaaattatagttaaatcaaatattaacttatggattttttctgtttaaagttttaattatattaaattataatgaggttattttattaattttatatataaagtaggatatagtatttttcaaataaaaactcataaaaaaggcattttccaaatttactcatatcatacgcccgaaaaatcgattggaacttattcaattgaacaatttgaactatataagttgaactcgttcgattgaaccagatgaactagatcagttgaactatttgaactagatcagttgaaccatttgaactagatcaattgaaccaatttcagttataccattttattatgcaacaatggattggtttggggagcaacgcgattcagttactacattgtactgactaccattgcaaatatctaaacagccatttttgtttcgttcattcactttcttcaatcgagatctatagacagagtagaacaaacaaagcgcttgtaaagaaaagaagacgttgcgacggaagaaaaagcgaccgatgaaatatatgagtcgaccggag

SEQ ID NO: 6061 - DNA, 3000 bp, Unknown
  misc_feature (1)..( 3000): cDNA_ID_3079402_gDNA_ID_1620841_Annot_ID_170057 3000 nt of promoter + ATG
gaggagacgctgcaaaattgctaataagggtttctagtttgcttagtgggggtatatatatatatataggatttgtgaatcatggctcgcaaatttcggagatcgccgctgagtagtggagaaatcgaagaaaggaaagtgaattagggttctaagtctcagaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatg

SEQ ID NO: 6062 - DNA, 3000 bp, Unknown
  misc_feature (1)..( 3000): cDNA_ID_1841673_gDNA_ID_1620841_Annot_ID_170056 3000 nt of promoter + ATG
tttttaaatatctgtattttgcctccttttcattctattttgtttgatacaaacgattgtggtttgtaatgttaaaattaggaatgttattgaatgatatgtatatttcataaaaataataataataaaagtaggatgaatagtaaaattccaaggcatttcataatttacccattacatggtcaaaatttatcaatattttaaaataataataatcatccaatcaagattttgggaatagaatatcttaagaacttagtataattacatatatatatatatattcccttttaaatgtatcaaaaacaaactaagaacatacaaggaatttgatgtagtactatacaatttacatgcaaacagatgtagtactatttgatgacaaaaaaaaaaaaaaagatgtagtactattttatcttttcatcggaataattcggtcatgaagctattaattggttttaatgagaatttattataacagttgttgccacactgtcgaaatactaacgcctaacggctagttaaataattaacacgcggtgagaagtgagtgagttacacgaaccactaagaatctaatataggaagataagataagcatttcacacgtgtggtgtggacaatttaacagtgttaacacgcgcatggcatgtgatctagaaattagaacattaattttagcgttttgactttgacctttgaatcactaggcgtaggtatttacacgtgtaacaatataatttttttcaatatgtgatgatcatgggccaacgtttgtgggtaaaggtgtggtgttcgatcatgatccacttaaatttactgaattttagaattataacagcagaaggatataagtaatataccaaacttaactataatctacctctccttgtctatgtatactaaatgtctaacatgtaacacaaagctgtacaaaatttttaactctcaaattttttgaaataatgcaaagctgtaaaaatagctgtacgagaaaactgtacaataaaactgaaaataaaaaaatttgtaacgtttttgataaaagttttgtaaatgtataaccatcaaaactgtacaacttccagctttgataatgaattaccattcaaagctagagtttcgaattttttcattgtatacaaccatttgaacacaactcttttcaattatgccatacatacatttagttaataaattttaccgattaactagtactgacaaaagaaacaaagagtaattatatttttttgataaattgttttattagaaaaatacttaaaattgataaaaataaataaacccaattgatatatttgatattacaataccagatattgaaacaaataagacatgttttgtctatatacttccaactagaagatatttatttatccatatcctagatattttaatgtgtgaatctaatacattctcttatatacgaccaaatagtaaaacaatatgcctctcctgcaatttttcttcatccaatatttctatggagtcatcttcttcactccttcatcactcttacctctcttaccttaatccaaaatttggaaaaagacctttggtttcttatccattaatgcagagttcgcgaaaatgcaaacaaactcgcatttgttctaacaagatgtatgttcccggtatgtaacaatatgacatattcatcacaaaatgtggtttttattcatacagaattgttctatatagattaatgcctatttttctaatgttttttttgttatataattgaattaggctttggagaagcttcaccggaggctaaggcagcgaagcatcttcatgacttctttacttacgttgcagtgaggatagtgtctgctcagcttgaggttgatttgacgatttatttgattttttaatttaggtgttttgattaataataagtatgatctatatattaattaatgacagagttataatcctgaggcttatatggagttgagagaatttttagatacaaactctgtaagtgacggtgataaattctgcgccactctcatgcgtcgctcttcacgtcacatgaacttaggtaccaaaaataacacctttatatcaataatttggttataaaattctagtatgcgttttctttttgtgaaacttgttagttggaattttaattctaggttcttaaagttatacattatacttttttaacaaatttggttttcttctagtaatttagacgaaatctctttactttttccaaacattcttttcgtacattggaagttgaaacttctcactaaaataactagttatgggagttcggtttatatattcggtttcagttatatccattcgcttatcgtttttttttttgttttaaagtttagtatcccttcggttaatttgaaagttcggttcggtttcgattatttcggttttaaaatttagtatccatccggttattttgctttaaatatttttggatatttcggttattttcggatatttttggatattttcggatattttgagatattttttttattatttttgaatatttttactattttatatatattctcaagtatttttaattatctagtctagaaataactaatacttttgtaaatatatatttatattttagatatttttggttactcaaaatatttcggttggtatccattcggtttcagttatttcgattataaaattttgtatccattcaattagtttctggttatcggttctgtttacttcggttttggtttggtacatctggttcgggtaatttgctcaggcacaaaactaacagtataacacaactaatctgtgcaattcttgtaaagaaaaactacttcaaaaattgcgtgacgaaatacaattccaccaatttgcggattactaacgaaatcactttgtagatccataagtttcgtatatcttttaggtatacatatacttgatatgagataagtaaactaaaaactttgctttttttttttggtatcatggcca

SEQ ID NO: 6063 - DNA, 3000 bp, Unknown; identical to SEQ ID NO: 6058
  misc_feature (1)..( 3000): cDNA_ID_1829886_gDNA_ID_1620841_Annot_ID_50887 3000 nt of promoter + ATG

SEQ ID NO: 6064 - DNA, 3000 bp, Unknown; identical to SEQ ID NO: 6062
  misc_feature (1)..( 3000): cDNA_ID_1841673_gDNA_ID_1620841_Annot_ID_50888 3000 nt of promoter + ATG

SEQ ID NO: 6065 - DNA, 3000 bp, Unknown
  misc_feature (1)..( 3000): cDNA_ID_1829882_gDNA_ID_1620841_Annot_ID_50889 3000 nt of promoter + ATG
agaaatgcttatatatgttcgggttagttcggatggggttcgattatcgggtaataaccgattgggtacgggtaaccaaagacatgaaatctataaaccgatcgggttattaatagaatccatacccgtactgaaccccttaattcgggtcgggttcgggttcggggatcgggtatgggtaatgtgcccagtcctattctcaattatagatgtggagaaaccttattggaattatcctcataatatatttttggagtcccagtcaagaatgtcactgaaccagaaatttgaatccggcatgccactttttgatctgtatgccactttatatgtgttattcctattttacccttaatgaataattttttatttaatttcaaaaataaaataaaaataagaaaaacataaatattctatatataaaccctacaaaaacgttggatttaatttagtgactgtatttactcaacatatggaccccactaaaaaatattttatctttttgcggtagaagatactcgtagttataccgttgtaccatcgtattcatagttgaactttccacaattttcataatttacagttgaattagaaggtaaataattaattataagttgaacgcacactttttctctattattttgtatttccaaagttttcataatatgacatcggtgaaaacttggttttttacctattttacttcatataaggtgctcatagactaaatgtttcttatattagaaggggtgttttatatgaaaacaaaattggattttagaaaatattaaattttattgcattgatctaaaattatttatttataatttgggatattcgtatataattttacatgtataataaattatcaattttacaaatttaatcattttaacgttatttagttgaactagttgaactaattatattaaatgttaccacgaaaaccaaagaaagacatttgaactagctcaactaaataaattaaaaagtaccacgaacacaaatacatatatgtttttaatctaatccaataagttgaactagttgaattgttcatacaaatccgagaaatacaaattcaaaatacatgaattaattttttcatgtgcaacaaattgttcaagtgtatcccaggcatagtcttgttcttcctcttacgacgcttttctctggttgatggaaaccagtttttttttttttttaaccattttttggtgtataaattcaattggctctgtcgactcgggaaaaaccatctctggtcggctcatccatttcggcagccgtcgattctcaggtgatgtgtcttcctccatcgatattgttggatcgaaatctagatcgatatctcgatatttactttgtccactctggaaacgttcctcctttagagataccatctccggtcgactcatatatttcatcggtcgctttttcttccgtcgcaacgtcttcttttctttacaagcgctttgtttgttctactctgtctatagatctcgattgaagaaagtgaatgaacgaaacaaaaatggctgtttagatatttgcaatggtagtcagtacaatgtagtaactgaatcgcgttgctccccaaaccaatccattgttgcataataaaatggtataactgaaattggttcaattgatctagttcaaatggttcaactgatctagttcaaatagttcaactgatctagttcatctggttcaatcgaacgagttcaacttatatagttcaaattgttcaattgaataagttccaatcgatttttcgggcgtatgatatgagtaaatttggaaaatgccttttttatgagtttttatttgaaaaatactatatcctactttatatataaaattaataaaataacctcattataatttaatataattaaaactttaaacagaaaaaatccataagttaatatttgatttaactataatttaaaagataattcttatcttaaatattttaaacaaaattttgtccaaaataatatatataaactatatttatttcaaaactatatttatttcaaactatatgtattaagtgataaactttaaaataatatatataaactatatttattaagtgataaactttaaaatatatttagatattaaattgttaaattttaatataaatagataaataaactatatttatttcaaaaataattaaaaatgttatcaacaactaaaacatatttcgaataatacatacatttcgaatttatcaatagagatttttaaaaaaaaatctattacttatatttcaaaatttatttaattttaatttttttcttctaaatatgaatcctgtttttatttattaagaataatgcttttaaatttggataaaactgttactttacatattaaaaatatagtattatttgggccaagttaattattttattgtacttgggtcggattattttagttggatctgtatattttaattttttaaaaagttatttggatatttacatcagttttaattataaaaaaaaataaaattataaagaataagtggcattcgtgattattattttggagaaagtgacattcctgccatttattcaaatttttgtggcaagtgaagcgacaggtaaagtaaaaccgacgccgttttaaaagccagtgcctttacgctatccgttgaaaagggaatacaaagtctcgatttttttttccgatacttgaacggccagattttaaggttcctgtcatgtctgattgcgaaatcgcttttttcttcttcctgagttcctttttttctccgatgaaattttaaccgtgatgatgatgatcataatgaaacagatatgagcaagaaaaatctagcgattctgttgcgtgctagaatgagatccaacaatccctccaaattttccctctctcaatttcctgtaagcttttctttttctctgtttgaattttttggataattttgcgattctgtccaaattcacacaatttgtaatcatg

SEQ ID NO: 6066 - DNA, 3000 bp, Unknown
  misc_feature (1)..( 3000): cDNA_ID_1829979_gDNA_ID_1620842_Annot_ID_50892 3000 nt of promoter + ATG
ggtatatttgcaagaccattataactacttaactgacagtgtttgaaattggaaataacttttttttttcttttaaaaaacaaaattggaaataacaaaattggagaaggaaatattaaaccatataatatttgctatgtacaaatattatttataaaatattttatgtttttattatctcaatgatggtgaacatatgtcagatttttacattctgtcatatataattgtttttacaaaaccataggttaaaaaaaaccaatttttttcaacttcatgcttcttaggttaggctattaggttcttccttcaaaaatatttgcgggaagttgctctcaaatataggattgaagcatttttcatattcatgagtggatgaatccaaaaggtttcgagcctctagaggttttctgcatgttttcgttgggttgtcccatccgatgttcccattggtttattatactgtttttcttaaagttttgttaaattttattatgttctctccttgatttcttatattattagtgtaagtatcttccatatttagtatcgaggaatatattatctattttttttttggaaaaatttaaactgttttgtagatgaatatatcaaactatgttaaattttatgtattttccatatatgctaaaaaaaaattctcgtgcaaactgaattttatttaagaatttaagtctttacaaaaaaaggttttttagccacattagctgattttctgaatttgcttgaaactacgtgaacattgaagaagctacgtgatgtgctacactattacaattacggtttgtgaatataaagataattgattcaaattttgaaacccaaaaatctatatttagaagtaaactggcaatgttcgaacagaatagtcatgccgttgaccgctataaaaaaattttaaacagaatataattacatgtatattaagaagttcaaaaagaagctatttgattcatcttttttttaatatatttttaaaccaaaatattgatagaacaatagggaaaagctcgagtttaaatatgacctcgtgaatttgttttttgttgtgtttttgaattattgttaaattatattcaaaaaaagaaaaaaatgttttacagcttaatgaatacgatttcaaaaacaaattctaacaacacaattggaacttaagctcgtcttgtagcaaaccaaacttgaagatcctcttcatacttatggattcccctataccccgaattgtacttaaacgatttctcacatttttgtcgatcatcttgatctggtggttatggttgttcaccgtgtcttcttgcattcctctctctccaaattgagtgtaccgtattttgaaagatatataggagaatgtaaacttttgttttctcatgtacattatgttaaacttaaatatatattccatttatttttagtataaagtttttcaacaaaatcttgatgtaacaacatgagtactttagaatagatgaaaataaaactagcttataaaatacaaaatgtaaaaataatctaaaaatgatgtaaaacacaaaatataaaatacaaaacgtaaaaatgagacatcaatatattgttctgtgaactttatatatagattagttacaaataatctattgtaaatattttaagatagacaataaattaatactttttagtaaaacatacaactagttaataatctaacgaccaatataaatcaactgccaaaacaaaatatatgaaattatattttctcaaaagttaattggttgtcttaaaatgaagatgttgactctgagtctatgatattagtcaaaatgcattttaacttttatgtacattccttgtatactaaaatgtctaaaaacacggtattgaatttcatttattccgtattataaaaaattacaaaaaagcccttcaaaatatatggaaacaaaattgtaaaataactgtaaaaagtaaaattatggttttgagataccaatatatttttgtatgaaattttatccaaacaataaataaatattgtatttatttgttttaaaattatatatgatggaaaatgaatcaatatttgttgaaagttggcaaatggtagaaacctaacggctaagagaatacgacgacgcaaatgaactgttttgactaattttaggaaaaagataaaacggttctctttaacaaatttgtcgcgtttgaatacgacatcgttaaaaactatgttaaacattatatatatatactaaaaagttcaaaaaactataaaattttagttttctcatcctttttatctttaaattatcaatgatttgttgttgatagaccaataatagctcacactaaagtaatttaaattttgaacacacttaacctattatctgcacctaaactattttattctataagtagaatgctcgttccaacacctcatattgttcaaaatgctcgttcatttttagatcgtaattgtctaattattaatttataaaaattgacagctttccttttaaaaacaaaacaatacaggtttgactacaaatacacattttcgaacagatagatagagagagaaaaagaaacacaataaaacgcgcgtaaaaaggaaggctaatttagtctttttcgtcgtaactcccataacgagacaaaacaatcttaagtgttccctctcatcgtaaaagcttttctccttccttctatgtacagctgtaatggcaatatcgtaaataactcgtaacagaaagggcaattattgtcaacatttataatttaatttctcccaacttctcaaattccaccatttttcttcatcctctcctccataattgattttccttttttttgtttttccttcttgcaactaaaataaataaatttttagaaaccaaaaaaaaaattgtagagagagaaaaaaaaaactcagaggagagaaagagaagacgacgaagacgaccattttttttttttttgtcaagagagaagacggagacaaca

SEQ ID NO: 6067 - DNA, 3000 bp, Unknown
  misc_feature (1)..( 3000): cDNA_ID_1829975_gDNA_ID_1620842_Annot_ID_50894 3000 nt of promoter + ATG
agcctacacaacaaaagcaagatatcaaattcagtctcctctcaacaaatttctcaacaaaattgattaccaattcccattaccttaagaccttgttgagaatagagtctctcctgcataagtaatagaatcgttgggacactgtttcctttctcatcataagaacattgcatcgattccgccgatacaccaaacacactcacactgcattaatcaaagagaatccaccattaaataagaagctacaatttcagatccagtttcagattctaaagcagtagtgaaattttgagagattaccttgcactagggactcgacatgggatctcaacttgaagctcgtgagggagaccaagaaagccatggaatcgatcgaatgttacatgagtgatgtgtcgaacatttgttggccaaccgatctccatgtgatgaacggcggacgaaatccctccgcctactccgccgtcgtcttgtctgttgtctacacggcaagaaaccacagatttacgcagcgccgttaagagaaactcaacaagagacagttgttgctgattctgctcttcttcttcttcctcctccgccgttgattttctccttcctccttttcctccgccgccgcaacctccgcctttagtcatcatcactagccccgtcattgagaactatgaaagattttcgcagcttctctctctctttctctctggactttgtgcttcttcttctctctctatggaagtgaatttgatttttgaaattctcgaaaaggtttctctttcttttttattcttttatgtgatttaatataatatatgtttggttttgaaatttttgtctttttggttggatttcaaagcaacggtccactcatttcaaaattttctccctctagggatattatttatctaatgtagcttttattggaatcacgttttaccccaaagaacttctctaaatctacgataatgccactcaatttaattggttgttggttgttgacgtggcgtttcatttatggatctacttgattttttgatttttttctttgtcaaattgacattttattttggatatataaatattttcactattaatattgaatccatgttttctctctcttttccctctttaaaatcttcgagagagagagaaagctgaaaatcactatgccgtccggaattcttttcggcttctgcctcttccgataaggattatcgtctagcaactactagttctttccggtgttggccaagttttgtccgacatcatttggctttcatagtgatgatgctcggctatgccgtcagcgctcttttgctgctttttgttttttcataaattagttttgttttcaataattctcatttgagatgtgttggtgataatgatagagcgattttcgcttctgttacttattatccaacctgtttttctttttgagtttagaagtgcaggaatcaaatcagagatttgagttgaagaacaaaagtgatttccgtcgcatattaacattgccttgagctgttgtttctctaattggagctttgattgttttaaccggtgaaaacccataagttttcatgtttgatttgttaatcgacgtcgaatcttcaccagaatcgatgtttgacggcaaaggatgaagtcgggaaaactttggattctcatccaatacgtgtattggtttctctacaatagaagacacgtggctttggatagagacaaaagataatacatttcttcttccatgttggtttctctgatgggctttagttgggcctaatatatttctgtagcttttgtgttatagggcattctatagcccaatgtaatatttatcttgctcaataaaattatccctcttgtgaaaaaaataaaaaaaattcactttttagattatttgtgatctatcattaaagttagtatacagatattttcatttcattttaaaaaatattttcagtttttattttgttaaacatatttgaaatttttattcacaactaaaactaagaaagttttttttttttgttgatactaattctttttattattatactaataaacttatttttctttttcatataaaataataataataaaccaaaatatttgttttttgtaatgtattattgggacaaaatttcatttgcaatgtaaagaccaattagatcacagtacgtgtgtatatttgtttttccttttttaccctttatgagcatagttaaccaaattttgttattaacaaaccggtttagcatacataaaaaaaagtttaagtcctccgccgctagggttcttgtgcgatgaagccgtctccgagaaatttgttacatgtgcgtcaatttcttttcagtttagattgaactaaacctattttactttattagatctagggatacgaaagatatggttttgatttttaacgattttatcattttcttccatgttcggtttctctgatgggctttagttgggcataatatatttctgtagcttttgtgttatggggcattccatagcccaatgtaatatttatcttgctcaattaaattatccctcttgtgaaaagaaaaaaaaaattcactttttaaattatttgtgatctatcattaaggttagtatacagatattttcatttcattttaaaaaatattttcagtttttattttgttaaacatatttgaaatttttattcacaacaaaaactaagaaagttttttttttttgttgatactaattctttttattattataataataaaattatttttctttttcatataaaataataacaataaaccaaaattttattttttttgtaatgtattgttgggataaatttcatttgcaatgtaaagaccaattagattacgatacgtgtgtatatttgttttttccttttttacctttaatgagcatagttaaccaaattttgttattaacaaaccggtttagcatacataaaaaggtgaagtcctccgccgctagggttcttgtgcg

SEQ ID NO: 6068 - DNA, 3000 bp, Unknown
  misc_feature (1)..( 3000): cDNA_ID_1829971_gDNA_ID_1620842_Annot_ID_50895 3000 nt of promoter + ATG
tatcccgagacacatatattatttcttatatacacatgttttgctgatttggttttaatggatatttgtatatgtaggttctctgttgcgccatgcagaatccttgatccctagttccctcaacgaggaagattttctgcttttgaggtaacataaagcctcttcagtcattctacttttcacctatgactacattaaagttttgtagttctcgagctgtactattttatgtagccgttgatattatttttttccggtatattgtcttctgcagggtgttttgtgaccagttacagccgttaatccattccgagtttgaggaaagtcaagtacaggtgaaggtgaaaaagctttttgctctcttatacattggttttacaattctctggcttatctgtttagttacactgatacaagtaggtgtaacaaggttttactcatgtccatcgtatgttaaatttctacgtaagacagatcttttgctaaccttcaaatgttatgttgtactaggatattgaaggtaggggcgggaatttatctggtaagctaaaagagcttctgaatcttaacaatgaggaagcttcagaggattgtgatgtccgagttgaaggtgtgatgacaaagcaaggcgtgaacgaggagatagacacagttgaaaggttgaaagagagcgatgcagatgctagcaatcttgaaaccagtggttcagatacaagctctaacagagggaagggtctggttgaagagggagagttggttcagaatatgagcaagcgatttaaaggcagtgcatcaggagaggtgaaggaggatgagaaatctgaaaccttccttgtctttgagaagcagaagaagaaacggaagcgtagtattatgaatgctgatcaaatggggatgattgagaaggcgcttgctgaagaacctgatttgcagcggaattcagcttcgagacagttatgggctgataaaataagtcaaaaggtgagttcaagaattctactctttttaatttccaaccacgtattacgaacgatgcgctcgttgattacatgattttgcagggttcggaggttattacatcttcgcagctgaaaaactggtacttgcttttatttgttcctcttcgtcagctgcaaagagaatctcgtaatcactattcattatctgacattgaaagtttattatcaggctgaataaccgaaaagcgaaactagctcgagcaaacaagcaaacggggccagctcatgataataacagctcaggggatctaccggagagtcctggagatgaaaacacttggcagcagaaaccatcaacaccaattaaagatcaaactgtaacagaaaccccgaaaacaggagagaatctgatgagaacatcgtcatcatcagaagaagggataaagcaagggcaacaagtgaggcttatggatgagagaggagacgagatcgggaagggaacagtgttgagaacagacggtgaatggaacggtttaagcttggagacaagacagatatgtgtagttgatgtaatggagcttagtgagtcatatgatgggagcaaaaagatgatcccttatggatcagatgatgttgggaggactttcacagaggcgaattcaaggtttggagttatgagagtggcttgggatgtgaataagcttcagtattagactcagttgcattgaatttgaccagtaggtttttgatttttgtttatttttaactgtttagagattctcctctgttttgtgagctttgtctctctctctctgtggttatttacaggcaaaggttgagactttgagaggaaggtaataacagaaggaatagtttgacttttttaatctcagttagttgactttacagctatttaaagaaacaaattttaattgtttcgtgatttaaggagattaactatagtaaatttaagaagaaatcaattccataaagtagctaatgattatatttgaatatttaggtggtgttattcaattatggagttaaagtcaattctttaaactttagatttgttttctatattgtttttaaaaatatgtttgtatgaatttcaaaatctctgcaatatgtcatggatttcgattctaatgatttactcatgaaactccaaagaggtttcatttcaaatgaattaatatacaaggattttacaagatttttagttttgaataacactggattttaatgaaatatttaaaatcttaattgaataacactaaactttaaaatctattaagcatgatttacaaagatgagttccaataacactagattttaaaactggatttagaatcattagttgaataacagtggattagtgttggatttcaattctattaaaatccattaactaataacacccccttagataaattaccaataaggctacagcttatgcattattattaaatttgttgaaaatgtgtatagaattagaatgttcctctaaacgaaaattcaaatttcaaagtttcgataataaagtgttgaaatagaaatgcttttcttagaattgtctacacacagtatttaccagatataaaaaaaaataacaaagggtaatctagacaattcacatacatataaagccgttgactaaagaagaagactaaaagtccagctcagcgaaaacgccttttctatccgaagaaaactgtgtcctccaaaactcggcgaagcaaagatttttattttattttttcttctcttttaattcaaaaacaaaaaatagtctctgaaaaaaaaagaaaggtttttactttgtggagaagacagagtccgtccgtcgtaactcgccaccgttctccgccgtgaattcttcttactccttcgatctgaactttctacctagttctttcgtccagtgccgtagtctttccttctttgattcgctttctaggtttcgtcttctcatttctctgcttctggttcagtattttggctgttgcgggatcgatttatacccgtaaagtggtttcca

SEQ ID NO: 6069 - DNA, 3000 bp, Unknown
  misc_feature (1)..( 3000): cDNA_ID_1829952_gDNA_ID_1620842_Annot_ID_50900 3000 nt of promoter + ATG
tctatgtgtaagctttcatttcctttttactttggcacaaatatattaaccattattcgttcttcgaggttcatgctaatctagtccggtcatgtcatatggcaaacggactcgaaaagtcgagctatgggtatttggcctttataaataacatatgtggatctataacttaattttgattaatagaggcataatataactcaaatattaaataaataatatagacaatccaactcaaatattaaataaataatatagacaatccaatttctctagcaatcactttgtaatgctttttatgattttatttgctcgcatcactttcaatataataatggctttttttattcttctttaaaaaaaaaaaaaatgttggtacactactgtttttattattctctttcagaatcttcttgttgaaaataaagagtaatcaatcatttacttggtgatattgcagacacttaggaaacggtagaactcgtgctccgtatcgccgagtaagagtagcaggaaaaagatgataagatacacagcagcaatatgagataatctggttttggacacgtgaaaattaacttttcacagcagcaatatgatatgattttcacgtatccaaaaccggactatatcatagaggcaccaaagaacttgtggacgagaagcatccacgtctcttcagacgacccgtagattaccgcgacttgtttaccttctatcactcagaagctggtcgtaaagttcaatctactcttcaagcttacatgtgtgcgcttgattccaagttttaacagagttaggtgattttaagtttgtcaaaaaccatgtagtaagaaaaaagggtttttgattagttgagtcatgtctgtttctgtgtgattcgtctttatatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacata

SEQ ID NO: 6070 - DNA, 3000 bp, Unknown
  misc_feature (1)..( 3000): cDNA_ID_4257535_gDNA_ID_1620842_Annot_ID_170091 3000 nt of promoter + ATG
ttttcgtaaatggcaaagaataatttatctcgagaatgaggaatataaacaatgactttataatataagtattatactatattatgtataatttaatattgtgtaaactatatataaagtccttttacagcatttaaatatagatatttattgacacactagtgcaacaatggaaatatcttgaattgattaaaaaaagttgttatctatacaatatgaaactctttgtatatcttaggtgcaaaactatttgataatataccgatacatagtataacgatattattggataatcctccaaaactcagctttttgtctcgaaacttaagttataacaaagttaattgaaaataatgagacagtactagagatgtatgataaaccaattaaagttgaaaaagttatattcttatttagctttgccgtcaaaaggtacgataaatggaaaatatgctcttgtcttctgagcctcaaaaccttaagaagattcttacatatcttacatgtcaaagtaaagagatagttggtaacacattcccatgtggtccggaaaacaaaagcttcctttattgttttggaatattaatcagcaactgtgtagtagtattctatgttgcatacgtaaaacatataaataacattataatcatattagtttgaataatagattctaataaaagatgatgtatctttagcctagtgatacgtctaatgatcttaattaaacttgtttaatgtaatgagttaacactcaatattaacaaacaaaaacttcatattctggactacgtatgttatacatatttcaaatatacatcaattgtctattctcaacttattatttatagtctctttgttttcttgacaaattattggtcatatttttctttcacatggttccgaaggttacgttttcatgtatatatacatttgtaaaaaaagtatatatataacatttgtacaaaaagcataaaaaaattaaaatgtttatcccgattgctttttgtttgtcacatcaatatttagtgctctaaatattttggttgagtcacgaaactgtaaattaaaatcgttgaagttgctcaattatatatacgtcaccgaagttgttgtatattaacattgcatgctaaaatatatttcagatgtttaggacacataatgcattttccgtaaaataaagcttaaaaataaattaaaatatggttttataagacactattttatcttcttttttttttttttttttttttttttttttttttgccaaacccctattttatctttttatcttttgaaattttttatgatgtatctatgaaaatgatttgtgactaatgcaccgaggcttcatatgatttcattaatcacatcccatataaaatcacgggttatgttcataatttgtttattcaatattagactactatgtgaacttttagtgaattcacttttttttttatccaatcaaacctctggtttcagaatttagtttccagttttaaacttttttcttgagacgtaaaagctctcatgctttgttgatgatgtagtggtggagaatcgtgatcttcaacactttcatgtaaaaaggcttcatcatcgttaatggcatcttgggtttactcttggctgaatataaaaaagaaataataggattgatatagactctatatattaagaaataaagtaagacagtccacggcaacgcatgtgattataggaaccactatcatgcaacgacgtggatcagtgggaaccgttgctttcgaaagcataagagagacatcaattaattacaaagaaattgtgtaaacacatttatatatatcagtgacatttgagattggttttgacaaagatatacaacttctctcccgacataaatgtctacaagaatacgcaagttaatcatatttggagctctttcatctatagttgtagacaatttgtacactctattagggagttctagacttttgatgaatagaaacattttcagaatttgctttatttttttaatataggaatgtgaatattattttaaatgattcgtttcaaactttggatatatagtcatgtattcttataactagaaacttcgggtatttgggtaaaattttcgattatttggatacaaattcgggtattgggtaaaatttcgggtatttggatataaaccgatctgaaaccgattggatccgaaccgaatccgaaccgagattttctatttaccctattgggtcctagaatagcatatccgacatatccgtattcgaccgattattacccaaacccgaccagcatacctgaataccaagccgtaatttagatatgcaatttataaaggctaaaaaatcgtgaaaaaccattgtgatatattataaattattttttgggagccctaaaaacattacatattttggaagctcgagacaaaagcctttcttttttttaaccctttaggcacggttatatgaatcatatgacatgtaatatagcagtttgtaatagtaccgtcatattgtttaaccttcaaattcaaatatgcatgatttatgttcttgacaaaaatatgtatatttatgcaaaattaaatattcatctataacgatcatattatctatactgttaattttaaaaggatcatatcatctatactgttaatttttaagtgatttttttttataatttggatcccattttatttgctcttaaaaactttggatatacttgatagctttttaacaaacaaaaataaaataaaaagtacttcgagcccacgtaaaatcgaataaacaaaaatttaatttgttgaacaagttggtgttttgaactaaggcccaataatagtaagaatactaaaatgggcttaagccgggtcgtcggatcgggtttaagaaaaaacagggtcgaggtttcaagagaaacccttgttactcaggcgactaaaaccccaaatctcatttgtgtgttcgcctttctctcgtacaagtcaaa

SEQ ID NO: 6071 - DNA, 3000 bp, Unknown
  misc_feature (1)..( 3000): cDNA_ID_2999710_gDNA_ID_1620842_Annot_ID_170085 3000 nt of promoter + ATG
attccagaaactaattaaattcccagaacaaatcaacacaattccacacacgatttctcaaacatagcagctcaatcagaatgcaatcgaatcaggataaaaaaccaaatcgtttgatcattcaaccaaataacaaaacacggtgccgcaaactgaccggaaacgcaagaaaccgcgggaagaaaaaaagacgatcggaagagaattcgatgagagatagggattgatgaatatatatatatatatattaagagtgttgttgcagagagcgagagggcactgtgataaagagaacaagtgcgtggctacaagacgaagaaggagcccaacaaaattgatcgtgagcttttattttctttctttgggtaacacaaaagagggttggtgcttaggaaaaaaaaaatcataattactgatttgcccctgagggtattttagtcattacaatttctggtccatattgttctgatttcaacaacatgatgaacaaaagaatcgatgacaaggatggataagagagaatgctaatctgatcaacaaagaatctgttcgaaaattcaaagtaaatcattcattctcctctcatgatgatgatacatcaagacatgaagcttgttcttcgattcattgtctgtatttggaccttttctttgttgaactccgggtttatgcaaactcctcgtcgtcatcatcttcttcttcctcgtactcggaatcagattcctcctctctttcaggttgcatcaatgtattcatgtcaaaagaagatggatcagtttctacctcttctatatctattgtgtcgtagctcattctctgttcgaacttctcatctgaacagtttagcatccaagccaatgaacatttgattcccttcttgattatcttcttgtgtctcggctttaccgtggactcaagcccatacgtaaagaatgcggggaaatccacaaggtcttgaagaggtcttttcatttccttttggaagtactcaaagctgagtttcattattccgaggttcaaagccagaacctgaggacacccgattaccatttcccttgtttggtctatcgaaaatccacacttggtaaggaaatcaatgtgctttaacataggagactcgctgagactaacaaactgcggcattctctcgatcaaagagccaagatcctctggatttagatgaatggctgaacaaagtagcttcctctgtgtgtcgagcttaggtttaaggtcgattccgatgatttcaggatactgcgcaattatagaaggaagagatgtttctctgacattgaaatcttgcaggatttgcacgtttggtttcaccgtatcatccaattcaaacccgagtatgtgaggccgcttctctatcaacctagctgcagccagtctcggaataccaagaacctcgagatactccacgagaggcttaattatccgagctacccgcattcccaaaatctcagggtaccgtgttaaaatacccccaatctccctcctagctacacctataccaaccaaataagcgactgatgtgctcatagtcccttccagcttaaaccccaaaacttctggatacctctcaagcacccgaggtacatcactcggtttaatatccagtccttgaagatacttaaccaccggtgcaagatctataacaacgctagagtgaagaacctgcgggtatcttctaagaaactcagtgaaagtcgatttcctgacgcctagtttcccgagataatcaagaaccggaaccatgttcttcttcacgctacaaccaagaacaagagggtaattgttgatatcttcaatggtaagccctaacttgtgaagaaactcgacacgctctttcatcacatcagctgttacagggagttcaaggccatcaagctcatcaggaacaatcccaatcccacgcaagaactcataaaccttagcacgattagcagctttctccttattcatatctaacaaactaggacgactatacaaagacttagaatctcttcccttatccttatctctatccctatcccttcccgaagaagaagaagaacgagaagacctttctcttctcggtgaatccaaagaacgtgaagaaaatctccgatttgcaatagcgcattgaacagttagaccaattccagtcccaggtctcttcttgtggttgcataagttgccataagtggaatcagagagtgaacgagatctaacggcaaaaaaagatggtggctcaaagtgaactagcaaaaacccaggctttgtgaagccattacagaacctaatcttcattctttacctgcacaaaaacggaacaacactaaaatcgacgattatcaacgagaaaatcataccaattcggactaacccagacaattttacagtacaattagctcagaaaactccgaaaaaataccatcattcatgttcatgttaacatcaacgaaccaaaaaaccataacctaactagaagcaaaccacagaaactatggaataaggagaattggaccagcgtgtgattgaaatctcaccggagctgaggaaagatatcggagaagacgagggttttagaggagcgggtaaggttttttcctcatcacacaacaaagtcactctctttctccattgaaatgatttatccgaattattgacgttctcccccttatttcttatatttcccattattgccctatactatctgaaattatcacattaaaccaatacgtatatgattactttggatgtgatataaattaataaaaaaactatatatcatcaaaactttctcttaatatttctaaaattaattaattccctccttttatcttcaacattggattatcgaaaatgaaaaatagtattttctgactcttttttatagtatcgggtttaattcagaaatatataaagctttggggtctgtttcgaagtatctttactcttttaacagttctgagacttctaaagagaggaaaattagttcgtcgaagcatcgagaaa

SEQ ID NO: 6072 - DNA, 3000 bp, Unknown
  misc_feature (1)..( 3000): cDNA_ID_1829948_gDNA_ID_1620842_Annot_ID_170081 3000 nt of promoter + ATG
taaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagcaatgacttggagtgatgaccagagttacttactcattgtagaaagtcaaacgtggcaacacagctttgcacgcttcattgacatacacgtcgacgaaaaaaccatatccgctcatcgagaaagtcggaatttttccgagaaaattcaaaagggcgaaaaaaagagcttttgcgtacagttttcgaattggtctccttcgtacgggtaaaatcagctcaaaaacctgacctttatttttctggttcttcacatttcccgatctgattttagagtcatagcttttctaaagttctcaatttgaactcatactgtttctgggttcttctttcgatgtctctggtgattttaacttttgtgctatttttaattcgatgctgaactgattagggttgatactgtttctggtcattattcactacgcagataaagacgacggctttgattttttttgtttggatttagggttttgtgatttctaatctctccttgtttattaaatctctcagtagattgattgtcaaattgaagattgatgaaactctgatatgatcgtaatcgtcgactgttttctttgattttagctcttcataattgggtttaaatggcaagagggttttaatagttttgacttacattgattgttaaacttaaattgatgattgatgaaactgaggtttggtcgtaatcgtcgattgttttctttgattttagctcttcatagtttggtttaagtgacaataaaggttttagcttcagagtgtggaatgtgttattgatgaaagttggaacatttttactggcttttacaggcaagctatggttcaagagaactatgaatgaaactgtggtgtaagagaatatcaatggttgttatctgctataatgttttttggaccaagtgagtttgatgctgatgaa

SEQ ID NO: 6073 - DNA, 3000 bp, Unknown
  misc_feature (1)..( 3000): cDNA_ID_3079472_gDNA_ID_1620842_Annot_ID_170079 3000 nt of promoter + ATG
ttatatggatttttttggaggtctaagtctttgtgttgtatgaaaatcaatagagtatgtgtgcatgcatgcacatgcacatgtacaataatgtaataaattattgtatttgtatttgtatttgttgatggctccaaataataatagtgtttatggaatattctacacaggttggcgttccacgcaatcaagtgaacccatactttagggtatcaaaataaagaaaatgtacattttataaatttttcaaggctttttatgttttaagaaaaatattatacgcatttttttaataaattcatttttgttgagctttcttttcatgtttcgtgggatttaaacttgatgaaaacttatatttgttgtcaatgaatctaatttggtaacaattgggttttaaaaaatttaaaccttaaattgcttgcaaaatggaagacatcctaagactatattcatcagcgatatctagtacaatatatcaatattaaataaaagaaaaaatagaaaaagaggagagtgggagagagtcgtctctcgtttgagagactacgagaaaaacgtttcttacatgtggttttttataattagtcaagctgaaatacttattaatatgtttacacttaaaatttgtgttcacacataaatgagaaactaaaatcaagagaccatagatggtgatgctctaagatacggtgattttagttgcaaaattataaaaaaaaatctttaattaatcaagtaaatgtgttagctttgctatccattgaaataatttctggttgaaaaactcgattacgtgagtttgataaatgatattgaaggcaaaaatctaaacaatatatttacagaatgtttttttacttacaaactttttatgaaactaaaatatgttctataaaatttagtataaccgatcatatattactacattatttgtgattttataaaaaaaaatattataaggaaaagattttttatttgcgtagcacatttaaatatgccggaccggtcctgattcgaacttacgaaattaaatcggctgcacaactataagtgaattaactttttgtttttcaatttttcataatttatactaataaaaacgttgaaggataacacatacttctttaaataattttttgactagaagtaatctaaactacaaaatacactcattaaacagttattaggtttatgctgtatgacaaacttagagtaagatacttcactaatcatttaatttatatcaacgatacgacgctataagtcaataaaagaattaacttttttttctttttttttggaaatttttttagttgaaagataattcctagaaaataagttatatatttgagttttcatacaacttaaaaacagttaatgattagctatatacctatacttaatgctttctcatatctaattttgacaatctctctttttttttaatttttaatttaattttttcaccaaatactaccgtaccgtgctatatatcttggttgcttaattttgacaacctctctttttatgtatggtaatggaccacacatatccgctttgaaaagtggtccgaaggggaagacgtacggggctctcgacagctagcgaaggaaatgtagtttcttgccgtgattaaccttctttttaaggttttgtcgagaaatcataatcccgttatcgttaataaagttgttaatacccaaagataatttaagattaaaagcatgtctttgacacccaaaaaaaaaaaacacatagaagataaaaagcatgtcccgcaaaaatacaaatagaatattccttctttttaaggttgtcgagaaatcataatcactttatcgttaataaagctggtaatacgattaaaaagcatgtctcacaaaaatacaaatagaatattccttcttcttttttatttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatc

SEQ ID NO: 6074 - DNA, 3000 bp, Unknown; identical to SEQ ID NO: 6066
  misc_feature (1)..( 3000): cDNA_ID_2025218_gDNA_ID_1620842_Annot_ID_170070 3000 nt of promoter + ATG

SEQ ID NO: 6075 - DNA, 3000 bp, Unknown
  misc_feature (1)..( 3000): cDNA_ID_1829948_gDNA_ID_1620842_Annot_ID_50901 3000 nt of promoter + ATG
atttttgttgtcgagaaatcataatcactatcgttgtgatcaactaactgttttatatcgatcgacgatcgctcattacaaaaaaaaaaaaaaagtgaatgtttgtaccgaagttgtaacaataaataactaaggagtttggagagaacggagtagcttctttattaatgacgaacagaaaggcagtaattaacataatggaaaaccgtaagtacagaaacttagaaccgaaagtacaggttgaaaaactgatattaatggtcggaaaacctgaaaatacagaacggaaaaccagaaagtaagagataaagagataggcagcaattctctcttaaattctctgagtggtgacttaggttctggatcccccttcttagtagtatctcttcctattggcaaggagctgatctagggttctcttagtctctcttgcgatttctcctttttgcccttctgaatttatcgggctgggccgagccgtgatgggcagagctgtgatgggccgagtagtcattctgatgggccgttgttctgatgggccgttcttctttgttatgagctttcttgacttggtctatttgtgtttaggccgaattgggcatggagggcaaagcccgtatcccacaccgaatctaaataagaggaaacaaagaaaaaggagaaaaagaagaagaagatatgcagccaaatgggcttaaaccattaacataatgggaaagcctaacttaagcccaatacttcagctgtcaaataagaagagaaagcccaatactccaaattcggatcatatcacattatacatctaaatctgtttcacaattcaaaacatacatttggattttgactagtcgaagcctagtaattagtaattaaccatatccatgtctcagccaatcataaactaccacgtgggtgattaaattaattacagagccaaaacaaaattgtcgtttcttcaaatttcaaaaccagattgttctgtctcagaattcagaatcagtctctgatcttctccatgacgattccgtttcattgatcgatcaatcaaaatctcgccggagtttcttcccgccggcctgaatcatgcctctgcctatattcccgtcgcggttacagtgttcgtcttcatcgtcttcgtcgtcgtcgcgatcttcgttttttaggcctaagcttcgaatcgatccaagcttgaccttaattccaggcttatccaacgacgtcgggagactgattctctccttcgtcccttaccctcacatctctcgtatcaaatcaacctgtaaatcatggtacgctttcctctcttccaaaaccctaatttcactccgccatagcagagacaacagcaacaccaacaatctctcgcatctcctttgtatcttccctcaggatccttcgatttcgcctccttttctcttcgatcccgtgactctctcttggagatcgcttcctcttatgccttgtaaccctcacgtttacggtctctgcaatttcgtagctgtagctcttggtccttacgtttatgtcctcggtggctctgcttttgatactaggtcttatcctcttgatgttcctttgcctacttcttctgtgtttcgttacagcttcgtgaaatcggtttgggaacggttatctccgatgatgtctccgcgtggtagctttgcttgcgctgcgatgcctggttcttgtggtcggattattgtggcgggaggaggatcacggcacactctgtttggtgctgctggaagtagaatgagttctgtggagatgtatgatgttgagaaagatgagtggagagtaatgaatgaattgcctaggtttagagcaggatgtgttggtttcttggtggagaatgagaaggagaaggagaaggaggaggaagggagagagttttgggttatgggtggctatggcggatcgaggacggtttcggggattcttcctgttgatgagtactataaagacgcggtagtgatggatttgagagtagatggtggtgagaaatggagggtagttggagatatgtggggagaagaagagagacctaagctagggaagattgttgctgttgattgtgggaagcctgtgtttttcatgttggataaggattggattcttaggtatgagatgggtttgaatcgttggagaaaggagtcaagcgtgcctaagaaagctcattacgacaaaccggttggtttcgttgcactgaatggggaattacatgttatgattcttttggatggttataatctgatggatacaaggcatactagacaacagaggaaagctggatctttgatgattcatatgtatgatccaaagaagaagacttggagatcggttgtctcaaagccaccgttcaatcatcaacttgatttcaggaccacggttatgtgcaccatccgattgtagtaggtgtaaaaaactctcatcacacatcatctagaataaaatttggtgttcatgttgtgtgagctctgatgatgtttaggtattggttcgtttcttataccacttacatatgttaccacactgtctgtacaagttgaaaaacaaaaacaaaaaagaactgagtattctgtttatattgctaaagggtattctataaaaatgctctagcttgcgaacaatgcaacatttgcttcttctactctcgtttcaagttaatttcttcataacactaatcaaatccaagactttctgaatctctttttgactgtctatcacaattcagtttcgtggaaaaggtttttgtctcaagaaagaagacagtttcctaccataagcaagagtggttggtcactgaagaagacaagacagtctcttaccattagattattgtagcgtgatgtgttttgtttgtgctaccaaccagaaatactagcaactatcatactccacagaattgagattggttcaagtgtattatacattgatgatgaggttttgaattttgatcaaacaacacacaaaaatagtattgtagttggtttaagagca

SEQ ID NO: 6076 - DNA, 3000 bp, Unknown; identical to SEQ ID NO: 6071
  misc_feature (1)..( 3000): cDNA_ID_2999710_gDNA_ID_1620842_Annot_ID_50905 3000 nt of promoter + ATG

SEQ ID NO: 6077 - DNA, 3000 bp, Unknown
  misc_feature (1)..( 3000): cDNA_ID_1829921_gDNA_ID_1620842_Annot_ID_50909 3000 nt of promoter + ATG
tggagtagcatgctagtttagacaaatataaaatggtggaagagtaaatattcaattttgagagggtaataatgtaatcaataacatgctagtttagacaaatactcccaaaagaatgtctcaaactcaaagagttggttagaatttaaagtgtccaaatacacaaataccccaaattttatactatttatgtggctagtggctacatacaaatttatccagtgaacttgtgtgataatttactgtcttaaaagtttatctgtatctagaaatagaagatccgatcaacaaaatacgagtgagcatttcttcatggatcatgatcagaaactttcttatgaaaaacaatgagcaccacttttatgggtcactaagggttcgtgagttaaccccatacctcttttgtgtgtgtgccataggtagtggaaaagggaatctactgatgttagagggtggtgctgtttcggcgacccacaaatctggacgatgtaggcccaaattttacctcaccccaccattttcgtagacttttcattccggtcccataattttacatttcgttggtctaacccatcattcattgattctttacctttttgccaagaggctacttaacctttttgctctttatggattggtgataataatttagtctcaccataaaattcaatgtttttctagtcaacaccatctaaattctaattcaacatttttttcaacgctaattaaaacgaaattcacatatttttagatttatgactactagataaacaagttttatcgaaacttttttcaacaaaaatttcatgcgaaacaacaaaccacggatcaatacttactaatcacggatcggaatcttctatttttttttttttctattttgtaactatcatatttaatgttttcaactaatcacgtagaagggagctttttcaactattagtgaattgacttgtaaacaaaaggagaagtcaaataagaacaacgataatagtagaagaagctcttagactaattaattaatatcttagaggtacaaaaacaatttgattattattactttatgcgtcatctcttagatcatcttccacgggcctcatggacatggacattgacatcatgactcatgagtttggttggtgtaaagttcaaaaatattaacacataacaccaaacgatcaatgtcttatacatatttctatgtttaaaattcactaaaatatgttgcaaacagaataaaaaatattagctgcttataccaattgtagaagaataatatatagcaacaaaaataatatagaatgagtacaaaatggaaaataatctggtgtgtatataagttgattttcataaaattctgatagtaatatttgacacaaatcattcataaattaaaattttctatttaatagcattttgaaaaaaaattatttaaattataaattaacattttctatttaatagcattttgaaaaaattatattattcataaatgatgcattgaaatgttagatttatggtaaacatcaatctttatacattattaaaactcgttgaaaagtttaagtatcaactaaatttataggcgtttattgttttaaaagtttagaaccataaagttcaaatcattccaccacaattttgatcaaagttaaccacaacaaatgacaaggattagatgttacttggaatcgtttgattatagataaagaaaacgatattagtacttttatagttcagaataaatacataattggaagtcattttatgtgatacggcaagataactcttttgttcagcgccgttcttttgttgtcccaaggaactattgtgcgtaaacatcaaccccaaaaatgcataccatgtcacaactttttgaaagaacttaaattaacttaccaattttacaagaagtgaatacaactaatacagctttttaacctaggcttaattgcacgctaatgcttacaacatattccatcagattctgtcttttctttataaaaagttttagagatttctttctatttcaaattatttggtgttttacatctaaagtgtaagaaaccaattttcttttttttcaaaacgcaactaaaaaaaatcctttacatattatacattttattcttatttcattaataataaaatataatttattttataattttctctatcatgtattcttcaataatataacatcatattttgaccccacaaaaaaacttatataaagagtacaagaaaaacaaaactaatgtttgatagcttttacatttttaaaatctgagaaaattgaagttttaactccatcaaataacattgcaaaatcacataaaaattatgatttgtgatttcacgtttaaattttgttttgttagaaatctatttgataaagtagacgtttatataccaacataatcgtctaggtaattaaattagacatccacataacaaaatagcatgttatatatatttttaaaaatcacatattcgataataattaaataaaagttattaaaaaattaaaaatcaatatactatttaatggcgatcaaaaacatcattatttgtttttaaatttcatcgtcaaatcttgccatctacctaatttaaccacacaaaaacatcatcaaattattcctgtataataccaaattaaactcttttgtccaaaacaatttcaaaaaagaaaactctgtggaataagaaacgggcaaagaggggccagaagtttagccacgtcagctacaagagagtgccacatcatcaccataagcctctcccacctgtacggatccctcccaatataaattggaaccaaactctctcctcagaaaaaaccttctcattacacttgcatgtgcaacgacccgaccctatacccgacccggcccacattttaaacccattttagccttttctgtttccgccgccgactgatcggaataatcgatcaaagagagaacaactgaatcttcgccggatactacgccgatg

SEQ ID NO: 6078 - DNA, 3000 bp, Unknown; identical to SEQ ID NO: 6070
  misc_feature (1)..( 3000): cDNA_ID_4257535_gDNA_ID_1620842_Annot_ID_50910 3000 nt of promoter + ATG

SEQ ID NO: 6079 - DNA, 3000 bp, Unknown
  misc_feature (1)..( 3000): cDNA_ID_3076928_gDNA_ID_1620843_Annot_ID_170107 3000 nt of promoter + ATG
cggctgcatttctcgagactatctcaccggactgcattgtcaggtactaacttagttttgggtggaatcatattgaaagtgactttatggatggaattattcggaccgttgtagaattagggctaaatacctctatgacggattcaagggataataaatgttaaggaaagtgatttgcactacatgattttccaaacctatgagattcatatgagatgagagatgcgagaaataatggagagatgtgttgagtcatatattttatttcatctgttaagaaaaattgaaaaaagttttaaaaaaaactaaaactttatgttctatttctaaaatcaaaaaaattgaaccgttatccggcatcacgggtcaaagaaaagtttttatggacgtgaaaacactgactaacacaaaacaatcgtaggttgtgttggggtacaatgggttttaccactagtagctaattactacccatgttggttctcttgattcgaaatgttttttcctgttgtggatctgttgggctctttgcggctttgcctattagatttagacgtttcggctttgtaaaattttctttcttatgcaaccaatagcaaatcttttaagaaaaaaaaaaaaaaaaaaacccgtaattaatatcgtaagtttgactttatttgcttatatgccagcgtcaaatccgattgagcacgtataacaatatccaaacaaaaactaataccattatttatacatacatgttgcatcacgatgaaataaacaccttaatggcagtttaaaagtttgtgtgtatcaccagatctgttaccaacacgtaaatctattacgagatctattacgacttacaagagagaaacaaattgtttaataattcaagttggattgctttcaagtagttaaagtgagttgtggaaataaaagaggattgtttaatggttcctcggtaggaggcaacacataaatatatatcacgagtgagagaaactggatttttttatgttcaaagaaagaaatggaaatgataatcatctctctctgcctagcaacaatcctagcccttcttctcctaaaacaatttctgaatcgaacgtacactgccaaagtcaacctaccaccgtctccgtggcgagttccggtaatcggaaacctccatcagctaagcctccaccctcaccgctcccttcgttcccttagccaccgctacggtccactcatgctccttcattttggccgtgtcccggtcctcgtagtctcttcctctgacgtagctcatgacctcatgaaaacacacgaccttaaggttgcgaaccgcccgcaattaaaagtggtggagaaaattttcaacggtgggcgagaaatggttttctccccttacggagaatattggaggcagattaaggtattattttttttgttttgaaaagtcatttattttttatacaataatactttcctatatatatatatattttttttttcgaaatttaggaagggttattggtttatagatttatctatatatacattttttcagccattttagcaaataaatcctaaaatttgacttatttacaactcaatgctattagcattaaatctttttctaaaataattatattttttaaaattcttaatttaaattgtcaatcacattatcaatcaaatttaatccaaacaaacttcacatcaatcccttaaaattagcataaacgtattttgttaacaatattttaaaacaaagttttttgtttaaataaatattgttcttactaaatgttttttgtttaaataaataaatcatgtatttgaacttatttacaaagtcatgctactgaaattaattatttaggaatgaaaatatttaattaaagatttaaatcgtctaaattctttgcttttagagttattatgtcattacctaaaaaataaaaaatattataatttttaaatgttataatttatatatttcaactttataaaactttattaatatttaaacttataaaaagtttaatatatcaaaaaaatttaacatcattatataatatatagagttgtttttttacgtcatattttacggttcgaaattttaaaaatgaacatatattaaccacttggcgaaaaatatgtgggttcaacgtcccgcatcgattaaaatatttagacaatgattcataaacatatcataaataagattaacattaataaaataaatagttttttttgtggacgggtttggcgggacgggtttgacaagacgttacttaataacaattgtaaactataaagtaaaaatattttatagataaatacaatttgcaagtttttatatatactaactttaaaaaatgaattgtccctgcggtgtaccgcgggttaaaatctagtaaggaattgaaaatccaaacaaaaatcatttgttatttaatcattgattttaaaattctaattaaaaccatgtgttattgattcgatgatttataaatactagttaaaatcctttgttattcgtgtagtcatttgtttttggatttgggaatccaaattatgttttaaatggaattgaatggatttgaaagagaaaaatagaaggattcaaatccatgagtaaacacatgttatttcaaaatcaatatatcttgatttcataattaatagagattttcaaattctatatagatttacaaatcaataaaccaataacaccttagtttctgtttagctctcttgatttgctatatgtgcctacaacataaatatgaaagttcagatttgatttagtttacatgagcttgatagttacttggtgaagaaaaagaaaaatatctatttaatatttgagtcatgtgatctatataaattgaaactagaatatgattaattaactgatgaaaatatcaactctgtcttgtgaggaagagtgtatgcatcgtcaatctactcaataaaaaaaaggtacaatcctttgaaaaggtaagagaagaggagataagtgaaatg

SEQ ID NO: 6080 - DNA, 3000 bp, Unknown
  misc_feature (1)..( 3000): cDNA_ID_3079516_gDNA_ID_1620843_Annot_ID_170109 3000 nt of promoter + ATG
tctaaatatagatttctttataaatagagaagatctttgctccaataattgttgttttgttcctctaaacaaaatgttccaaataaattttattttaatttctaacataatcctcctttatttttaaagtttataaattctatccacttaggttatttttaaacaaaacaaaataaattttcattataacacataaatagacaatcgaatgattaagacattatttttaagcatcatcattagtactatttttatattttaaaatttcaattaatttagtaaatatatctaatacaaatttatatttttaggtattaaatgataacttattaaaattggaagagttttttgtaaataaaaaaattatgctttaaaaatagagaaatgattagtattgctccaaatttggagcaatactatctttatttttggcgcaagatattgagtaccattgatgatgattttatatcaaatatagagcttgtagcaagaagaagggtgacttacattatccttgtggtaaggtttgtagtacgaaactatttttaaccattatccttcaaacaaacaatgttaataattctatgtcaagtttctagatcttaatctccgataacaaactaataattaacaattgttagaacatccaacaataaagcataaagagtgaaaaaaaaaaaaaaatccaattaaaacctgcaatttttctcgttctcaaataaaacttctaactaattaattttcttaaaaaatcttcaagtcgtcaaaattcaaacttttcctatttaaaacttatcttgaaaacctccaaattgaaatattttcccaattaaaacctcaaactttttttcgtttctaaataaaatttctaacataactaattaatttttcctaaagaaacgtttaagtcatcaaattttgagtctgatcaatgatttactaacgataaacggcttttaacaacatattttccatttatttagtttttgaaattcacatgttttagttacagtagaaaatataaaatcaaaattgaggattgaataaatttatacttgaatgattgttaaaatttatactttaatgattatggttaaaattttaaatcaatcgaagtaaataacccaattggtaagtaactaagtattaaaagattccaaaataggaaatatacaataatgttttgcttgtgcatcggtggtcattaagtaaagggcaccattcaattcttagagtggtaggaagcgagaaaccaagccaatatggtatcccatatggctaagcttatgagagagttagagacaagtgtcgcattaggtgtcgtatgaaagatgcatacgatgtatatacagtttttttaacaacgtgtctatttgtaattatcactcattgtcttacttgatagcttttgtttgcttcttcttaataggatgcattttattgcatgtgtatgcatttctccaaatgaaatcttgtgaaacacttgtctctaagagtctaactctcacacaagctaaaaacacgtcagcttgaggtccacttagcttattgatgagtagttttaaagtttgtgtgtttccaactaatcagtaactagtaatcacccaacacataaataaatatattacgagtgagagaattgtttcaaagttagaaatggaaatcataatcatctctctctgcctagcaacaatcctagcctttcttctcctaaaaccacttctgaatcgaaccgttgccaaagacaacctaccaccgtctccgtggcgagttccggtaatcggaaacctccaccagctaagcctccaccctcaccgctcccttcgttccctcagccaccgctacgggccactcatgctccttcattttggccgtgtcccgatcctcgtagtctcttcctctgacgtagctcatgacctcatgaaaacacacgaccttaaggttgcgaaccgcccgcgattaaaagtgattgaaacaatcctcaacggtgggagagaagtggttttttccccttacggagactattggaggcagattaaggtgtttttgctaagtcattaatttatatatacagttaacaattagttgtggttagctctctggatttgctatctgtggcctattatataatttccaaagtctatatttgattaagttttaccagttagattgatagttacatgttgtagtgaatacatgcaccgtgcgtttgattaattttgatcccccttccgttttattttaatttgagtatcgtcttgtaaacaaaaaatgtcgtttaaaaaaaaattcaattttattttatagttttaatttcttgaccaataaaaaatttacataacatattaataaaaggtaaaaatagtattgtttcgttaatttgtgagtaaaaaactaaaagacatataatacgaaatgaattgtatactatttacttcttgaagtacgtttgttttaaaagtcagaaggtatttacttgttgaaatacatatacagttctataatgtttaatcttccaattgaaaaatacaatacatttaaataaaaccattaaatatttttatacaaactttcttattagatatttgattttcgtaagtttagttaataagaataacttgtatatgaaattaacattgtttggcaagaataatagcagaaataaataaataaataaaaaatgagaagaattgtggacttcatacataagaattagtgtttcttttctaatatatagaggatgtaataaaggcatgagttgagctttaaaagaaaaaaaaacatttgctttgtgcgtagagaaagaacagaacacatttttttgcaaaagataaacaacggaagtttgagagaaagtagtatttttgtttgttaaaaactttgatatattaatgctcttgatacttagatatattaattttctcattaagaaactgatgaaagtattacgtctgttttgtgaggaagactgtatgcgtcgtccatctactcaataagaaa

SEQ ID NO: 6081 - DNA, 3000 bp, Unknown
  misc_feature (1)..( 3000): cDNA_ID_2054365_gDNA_ID_1620843_Annot_ID_170115 3000 nt of promoter + ATG
ctgccttctagccgcactctcagtagggtcagcacaggtaacatactgcactgtaacttctcttagctctcccagaacttgatctctagaaggaatgaccactggtggggaagtagcctccagcgatccatgccgccagatgggtgggggtcccacacttggagggggaggggttactggatctggatcaaccacatctctctcaagaggaggtcgtctggttctagaggagtcagaaacagcctggtgttgctcagagggggtgggggccttttccctccaacggagactgtctcggagatcaatttttcgagaagtgttatggggatgggaatgtgacgtggtaagcggtctgtaatggttacggccttgatggtccgtgtatctactatgagagtttcttggtcccgcagcccctgaggatctctctgctgatctaaacccacgtctctcatggcgatggtcagaagatctcttatgtgggtttgaaacttcttcagagaaggtaggttttgtagaggatctttggtggctcactggtgccttgaaattatcccgaggagtgtagtagttcctagagtcccctttagagccaagagacagggccggaggagtagggattgcagacttcattttagaagtagtcaaaccaggacagagctttgtctcatgggagagtctgaggcagtggtgacaatggttcttgaggttcttataatccagatacacaagtgcttcactcccatcaggaaagtccacaatggtctctttgactaaaggttgtaagccattgatgagcagcttgaacttaactgtggccgaagttatttccatttccaagatctcccccaattcttctccaatggtttttagcatttctggttgccaatagtgcttaggtaggccctggatttctatccaaaagggaatgagggacgggaaggagtcagatataacaggctcccacttctgtagtatcaccatccattggtcatagtgatatgacctgttctccaggactttttgcatatcctcctcaaaatcaaacttaaactggaagcaacctttgcctagatctgaccctatggctttacctcgcaggttccacctattagagaggaaagggaatagagaccagaggcgttgcacagatgggttagtgagtcggcccatgagagttagagaattggcttctataagctccgaggtatccagatctggggctctaattctcttacggggagggggagagtaacctctctccaactctttcccttttaaatggaatgggattctcttatccatagaaacagcaagagcttttataaggttagggagtggttgaggttagttcttcgggtcgcaataaatgttcttgacaaggttaaaaggcttaaaaaggttttgaagaggtgtacaaaggttatagaagtatcgacagaagaagagactacctgaaggatgtcgaaacctcaaacaacctggtggagaggagtagagagcaggggaagagcggtggaagagtagaaccagtcgccggaaaatgcaattttgaaacaaagtttgccattgcaggtgtcggaccgctgaatattactccttttgggtgggaaatttgaaattagatctggttaaaagggtgcatcatactccttaaacacaatctcgacaaaagtgcttgggagcgttttttagaaaaaaaaaaacccctagtaattgttgtattaaacgcataagaccccaagtaaagtatcattggaccagcccttctgcgtcaaaatacttcagtaatacatacaaatcaaacaactcctgcgaaaacaaattgcaattacgatcacgttcgtcacccaagaagttgtcataaatttgagtttgtactttccgatatttacataaagttccaaatacgtgacgctggaccgtccctagttgctatcgtcgattagtgtaatctgtatctagtcgcatctcccacgttacatataatttacataattattcgaaagatcccaaataatatacttcaaatagcaattaaagaagcattattgtgtacataatgcatacacataattaaacgcatccttctttttttagttgaaatttaagtcttagtaaatcaaaatgaaaaatactataaaatgtgtctgtttgaatctgatatgcataatgctttttatggctatcataatcaaatacagaaattatacatgtaaaacgtaattgacaaaaaatgtgattatcttagtaaaatattataaaaataatgttgatgaagttaaatatatggttcttaattagtataatataattgtgattctcttagtaaactagtacaaaaagagtattgatgaagtattcaattaatagttaatacaaatcatgttcttcacttagacatagtcacaaattaaaacaaatacataaaattatttttctcgagatatccgaagtccgaacctataaattcgatcattatcccaaactcttatttcttttttcttttgcaagaaaacaattgtactcctccgcattgattacaagagacacacaataagagggaccgaaagatagaaaaagagtacattacacgagattccatatttttcatgtttttattacgtacgtaactgtatgtatatgtaccatatatagataacggaccattaattatttgaacatttacctcaaaaagcaaagtactctctctacttcattccaaccctatgcgtatgtatcttagtgtatggaccgatagacaaattaaatgtataggtagacacatgggctacagttatgaatgttacaattatttcatcaaaagcaaagtactctccatcgttacatgtacatatatacatttcttataattatttaaaacctgtttggtcaaaaggatagtgctcgactatacatatagccaaagaagagcagaaaaatcaaagtcgtgagttcagaagctataacaaaatttctaagaaaaagaaagataagaaa

SEQ ID NO: 6082 - DNA, 3000 bp, Unknown
  misc_feature (1)..( 3000): cDNA_ID_3079496_gDNA_ID_1620843_Annot_ID_170120 3000 nt of promoter + ATG
ctatcacgagcgtgaattaatttgttgttgaacttgttgtctagggatagcttctgtgaagttttgtcaaccgcctgaatagattaagaagaccacactgttcgattaccctatccttaggaatcatttatccatttgattgcctgttatcatttctgctttgtcattcacttgcctgctattgccatttctgcttttagtttcatttcatttctgttattgcatactaggactgttagaaccaaccaactttctacttggcttgacttagagctttctgatcatatctcatctgtttgcatcacattggattgacatcctaaaatactacaacgacaagatagtgttttaggattaattgagtaaaatcctactatcatatagataaaagcatttttatttggatcaagagcgatctagacgggaatgcgaaacttagattcaaccatgattttgattgctaaaaaaatgttagagatttaggtttgaattagtgttcttatactatatatgtaaatatttttaatgtattttttttgttattattgattctcttttgttagagatttaggtttgaactagcaatgatgatttacaaatatttaccaaattaataatttatgatttctgtgtactgagttgattaagactagaaaatgcaattatgctttcatataatagattaacaattttatccaaaaaaaagctagctagtttttttttttttttttttttggtcgtagctaactagattaactaaaaaaaactatagttcataactttgaaagagaaaaaaattctcttttatgattctaataaattttcaaaaaaaagaagttaaaaagtgcatttaaagtaacatatgaatatgactatataactcaaaagagttcgtgggaaacatctcttcacatgcagttgtattatattaattaattttgtaacaaaagagtggcatatgaccccatggaattgttcgtaacgtatctttacaaaatcaaactatattgtttgtagcgaaaccatgttttttctgtaaaccctaccaacattttatattttaaatttttatgattatgtgttgcttgcttgcatgcttctctctctcgatgttaggtactagactacgagagaacaagaagtataataatatgtatgcaagcaaatgcaacacatacagatagaaaaagacgtatgacgtagaaaagcagctttaggatgattccaaaacttgtttcttcaagttgacatttttgcagataagtgttaagttaaccctatcacgtctggtcgtgctggtgcgtggtcctcacgctccctcaatctcctgtgttttctgaaaatgtaggcccattttgctttgacttgggcccatttaaccctctcctcatctttcaatcttccaataaacaagtttttttaattaaggaagcaatgacttttgatgtctttaattagtattttattctgttttttgaagtttattattataattggtttcgtttctatcatggatgtggatcttctttgtttcttctcttcacgtcgtctttcctttaatagttacatattattttaagttatataagaaatatgaacccctttaaacatggagaccaaatagaaattatttgattattattacctcaacaaataattttgtcaatttttttggttgagaacgacgtttttataacaaaaagacaaaaaaaaaaaattgttcatattacactcttcttatcatctttattcttcgtattttccatacagttttattttattttattacatatatatttttaaaatgaaaaataatttatatgattttcttaaaaattgttttaatatgtgtattgtttgattatgtatgctaaaaaatggtacgtttctatatcatcttaggcgtattagttagtgtttagaagaattttcttacaagaatcgtgatcgtttaacgcttaacgagttcttgaaattactattactaattttgataatatgagtgctatttatcaattaatcttatgtttccttaaactccctttttaacttttttcacgtagttacaaaaagaaataaatatatattagtataaattaaaacatatcattccgcgataactagcaacggtgccgtttcaataacctctctcatgtcctttcgtaactcaacgaaacccaaaatcaacggctcagatcattccgacttctgtttcgcctttgctacgccacttcttcttcttcttctccggttttaaattaaaacctctcacaaaattattcggaatattatttcttcttcttcttcttcttcttcttcatcatcgcatctctctcacttcacgttttcttcggtgaagagatagccgccggaaaaagttatcatctccggaaatttcgctctttctttacggtaattacgagaaaaacaaaatccaaaaatcgtttttttctatttgatgattttgccttcgtattcaatattgtaaagttttgttttttccgttgtttaattacgtaaattcgataaaagtttcttcctttagattgaatttttctgtttctatggcttgagaactagtttcgtgtggttgtttcttctgattcttgaatttgattgagaaagtttatatctttggttaagagtttttttgtttgtgtacgttttaaaatccatggagaagcttgaatcacggagaagactagtcgtattaatggaaactccgtgtaaatcgaatgagcttcttcttttggatggttcttcttctctttagctttcctcttttctctctttttggtttctttaacaatctctgacttatagcttttgaagcctctgtttgtttatggttatatcctctctgttcttctcatttctaaagactgaattttgaatggtaaaagatcgtgtgtgtgtgtctgtatccttaggctttgatgcagttttctgaaaatttgaactttgtttatatgttgcagtgtttgagggtgtgttttatgt

SEQ ID NO: 6083 - DNA, 3000 bp, Unknown
  misc_feature (1)..( 3000): cDNA_ID_2054341_gDNA_ID_1620843_Annot_ID_170124 3000 nt of promoter + ATG
ctcattgacccactcgtaggttgttttcttagtgatcaactcatatgtaattttacgtaacaatcaaggaaaaatatgtaaaagctatgaagaaaagagaaaagaagccgaaatttctggaagtatgttgaaatgtgcgttgtcggttttgggaatctaaggtactgtgagccgacaaaagtagagatgtaataaagattttggtcaggcaatcataaatccaaatctttctgcattttataacaatgacgctcatcatcactttcctcttcaatatgtctcagcttttacttacgtgcgttatcatcatgttcctataacgtatcatctctaactttttatttaaacaatctgcggagcatatataaagaaccggataggacaagaacaaaacgtcaccgtttatatgagaaagcaaagcccactcactctcagttttgatatgtttttatgaatagtatcaccagccgcatctattcattcacactaataacgatatttataagctaattatggattttaaatttacgtacattgtgaatttctatgttaggtaacataagtataattcattataaggaacaatgcattttcacatactgcagtgcacattattaataaacaatagtgtctaacatattgcaatgcacgttacttgatccaactctctatcctattttgggttgagaggaagaacattttttgaattggccgtcatttggtacgtacaaatggttgaacatgattgcgactaattttattttttatatatcgttaaaaaaatttctgaatagaatcttcaagtaatttgagacgtctctagtatagtgcctaatatttcgtctctactaatgtctaatacgggttcaatcacaaggactcatccatgtagtgagtaagataccaaagtactcttcagtaattttagtcgacaatattttgtttttagcgtgtgaattaagtttccatatatgatacgtacccaatttttgacctttgtacttatgatacataaaatatttacgcgtcgaacgttatgtatatacgtatgatataatttatttttattttgtgtgggggaaaatgacagttgagcttcaagttgattgagagaccaggcctactatacaaagagaagcgattagcaccaaaaaacaatagtagtacggttgtatttgtcggatctatcatggtctccattaagtaaaatatattcatttaatattcatgaagtagtggtcgatataaaatccaaagattctgattaggaaagtgggaaattgaggaaatatatgagaacgtgaaggtggcggtcttacctaaaatggataaggccattaaaagattcgagcctacgaatacgaaggataaatatgaatatgtatagtgtattattttgatttagtataagaaaagctgtgattggttgattcttccctcgcgttacctttttgttttgcaagttgactacttgacacacactttataagacatatgtgaatatgtattgtaatacaccatagtaatataagtaggtcggtcatacatttgtatcaatatgaataattaatccacaaatcttttagccatagataacacagagatggctcttgattttatttcctgttttgggggttatgacatgagttcatttcacatgatgtcgttattttgaagcaaattatatttgaaatcgttgtgaaaatactcgaactattaactatgtttgatctttcaattgcagatgaaacttttaaacactagaccaccataaactacatatgagtggattgttgtaatcttgtaaaatcttgatcttaagggattgttctacgtctatttattttttggatattgtagaccttaactatgtaacgaaactttccccactactccccactatcaactgtatgaaattgataattaatcacctaaacttttgtttccactccgaaaacacctttaaaagaaaaaacacctaaaattgcatctcacatatataaattttataaaaacttccaacaagaaaaagtaattatttttatagtttggaaatttgttgtttaggtttttcttttttccccgtttttcgatttaaaagccttagggattgttattaatatcaatctggttttagattttctaattttttttttaaatgactttaataattaaaaaaaaaaacattataacctattgctagagagttttctataattattttgattagtttttcacaatctttaaaaatttctcaaacaatatctctattttaataatattttcatgattttattttgtaaagaaaagtataaaaagtcataaatcaataacataataatttaattcattaaaaatcatagattcttttgttttaattgaataacacaaaaaaattaatgacatttataaaaatatgaatccaaaacttcagatttataaagattctatattacttttatagtgtttaaaataataacaccaaattttaacaaacttattaaataataacagattctacgtaatgtattaatattttaagtgatgaaaactctatttaaatcataaaccaataacactgtttttaaagtgattatgaaactagtccaaaaataaagaaaaatcatgaaactaagccccgtattaaacctattaaggatagttaatgggccatagcccaaaacaagcaagaaccctaaattttcgtcatcttcatcacacgtgcccagaaccaagagcttacctcggcatctgatttagcaatctggatcaggtctgcaatttctgatgattcactctccattgttgtaaatctatgtttcagcttatgatcaaaaaccaatgcgtatgaatcgtctatgttcaccaaatcagtacacgtaaaagcgaatgtgatttctctaattctaccggagagcttattcaaacctgtaattcgcttcgtgttttgcgtatacgtctgctcaatcttcaagatcataactttttgattaacctatg

SEQ ID NO: 6084 - DNA, 617 bp, Unknown
  misc_feature (1)..( 617): cDNA_ID_2054329_gDNA_ID_1620843_Annot_ID_170127 3000 nt of promoter + ATG
acaggttatgtagtagagtaatttatgtaagtgtaaggttcttgacatgtgccaagaatacaaatgtacatgagtgacaatattattatctaaatattttcaaatatttaaaagcttatttcgaaatattttaggatccttttatgaatataagctgcttatatatatgcctataacattcattttcaaatcaaaagctccaacatattaatgagctgacaaacaacttaatgtttgaattcagatatgatttatattgaaagagtctccagctatcttagatagtctccctagttaagggattaaaggttatcattagcatataattggtaccataatattcaccaatactacagagcctaatatacatctctgtggctttgcttttctattctcttttgttattgttgtcattaaagaaaaaaaaagttggaaatgaggacgttgcattgacaatgcaaattcaattttgcttagccattaagaagctttttcacaactttagtaaagaagagagacttatataaagaagatgtctatcaccacttactcttcccctctcctctcttttccaaccaattctcttctttcttgtgtgttcacattcaaagaaaatg

SEQ ID NO: 6085 - DNA, 3000 bp, Unknown
  misc_feature (1)..( 3000): cDNA_ID_2054333_gDNA_ID_1620843_Annot_ID_170126 3000 nt of promoter + ATG
gtgacttagtgataattggcaaattgaccattataaatgttttaatggtaagaatacaacttctgatctcgggtaagacacaagtcgagatccatggttatattgtttacttgtccggtaaatatttctgaaaagtgtcaacttcgaatttttgaaaatttgctattttaatttgtgccagtttattaagttgcaatgctctacgtcgcaagttggaataacaaaataaacatgaacattatcatgtatgataatgtctacaaatatttataacaattatttggataataaaaagactaattaaaactcaaaaagtttactacataccatctacgaaatcggccaaacaatccctttgttgaaaggcaagcatcctctgtgaagtgtcatacccaactgcatgatcaacaaaagctgatgctccaagcacattaatcctttcctcatctttcatcgatgatctgaccaaagccgtgcagagagaagatgggctgtcttggagataaagtcctttgtttgagatagtgtaatctaatccttggaaatgaagagtgagtttaggcaatgaatctatctctaacccaacctcggttgtgaaacacattagttcgttcacttcgtatgcgaccgctggtccaatctgcgccgttagctcttccttcacctcctcgtagagtgatggctctagactcgtgtagtaagtcccaacgtctattgctattccactactctcattgcttctcattctaataaaaaaaaagatcatgagaaacaatataatggatatttacatttagagaaaaaagagcttgattgttttaaatactaacttgcacgtttgtggttttatcttttatgtgaaacgttagaaaaccattttcttaaaatacaaaatatttttcttgtttaaaagtattattcaaataattaataaaatggtgttcaatatgtaggttttatttggaaaaaaaaaaacaccttttaacgcaaactattaatcgaaatccaaatatcaaatgtttgagtctatgaaatttgttgttaaaacgtatattatatcaaatgtttacgtagctatgttagctagggtttaaagtttaaacaaattaaccccaacaaaatgttagagcatctacattgcataacctctcattgatgtctccaagatcaaccatggtaaaaatagactaatcaagattaaaattaaagacattttcctttttaagtgtctaaattgtcttaatgtcttagagaagatatttttgacatccaaaaaggaaaatgtctttaattataactatggttagtttttaagacactcatgagagattatgcaaaggggatagtcgtagctaggtttaatggagtaaattaaaaatataatcaaaacatcaaacgagtgatatgtttatacctctgttggccaagactgatcccgaagagagcaacgtgatacgagtaagcttccgtccccgtcatgtttaacatcggaaccaacaccatatcgccgccgtacgaagccgctgatccgagacggatgtagttacgcgacccggctgcggaaggccaaagacagtgtgaaaatcttgtgagacgtagctgagagaggagcgagaaacggtgagtcgttagactaagtctcccgtcgacgccaccaccgtcttcctccggcgtcgcacggtttctagccccgcagccaaagacaaaccctcgcactatagagagagagttttcttggtcggtgattgaggaagttaactgaagtgtgtcggagacaaggtagccggagctagagggagaggcctcgtagcggcagaaatcggaaggagtgcagagaagagagacagaagttgttgtgtttgttgttgttgcgttgaaatagttagtgtaattggtggagacatgaggacaaagagaagagttattgcaagagattgtagagaaagtgttggaagatttgtctgagagggagcattggtggtcatcatcattatcgaggcatgtgagatgtgtagaagagtctagcttgaggttaaaggttcgtgttggggttccaatggtgatctcaacgtaaagattagattcgaaaggtaagaaaaagccgttcggtatatcattcgggagatcatcttcaaggctagagttatgagttagtacagtgaagaggagcagaagaagaacaagaagaaagagtgagtttgatgaaaccatgtttctttggttttgtatagcttaatgctcccaaaacattcttaagttattagctactttttatatgaggtattgtatttaaattatccttgttttttacgatagtgttgcaccttggcttgcatgaaataatgttttacgctgtcagaaaaaataaaacaataataataacgttttaaatgtttattagtatgaaaattgcctaacatttttataagttataacatttttataagttataacgtatataatcgacactaatttttatatgtatgactaatactatatcttagaactaaatataaagtagtttgtacttacacgttacaactataatttttaaataatttagttacagtagtatatgtttttgttatttctacatgtggcatgtgtggtttatatatgcaggtgggttggttactaaacgcatctaccgtgacaactgacaagcatatattagatgacgtggcccattgacgatcacagtaacttgggcttattgggcccataacgcgtaaaataaaaagcccaacagaatcagaaaaagagatgtgtgggtcccataggaatctgcggtatagaatcaattgcttcgcgggggttttacttttcgtctcatcgcaaaaacgcatgacgcgttttttctccgtagatctttgtcttcgtcttcgtctttgtctttgtaattcttacgttaagctctctcacctacccgaaagctgcgaacttttcctagaaagctaattcaaacgtagaatattctaatcccaccacttaattttataa

SEQ ID NO: 6086 - DNA, 3000 bp, Unknown
  misc_feature (1)..( 3000): cDNA_ID_4270016_gDNA_ID_1620843_Annot_ID_170123 3000 nt of promoter + ATG
ctaagggataatttgtttatctcaaaaaatttcgtggagtaatgtgataagatttatgattaatttcgtggagtttagaattcgtggagtaaaaattaatttcgtggagtattcgataatatgatactacattatattattcgtttctgtctaggaaacttgcaagtttggttgtaacatttcacgcatgtggtaaacacattttgaatatttggagaaattaggagcagtaacaatatgtaaaacataaaataagtcttaaccacaaatttatacgatcacaatcttccataacactaccccaaaatttaatgacagaaaagcgatctcatataccattttcaccttctactccccccttcttcttttttcggtttcatttaaaaaattgatgtatttttgtataaatctcttcatataacttgatataatcttctgatcctacaaaacaaccactatattttttctcaaccaagtaaactatatttgtctaggtattacaatcgaacaattcattgttcaattaatgtataattccgtaatttcgtcatctcattatgcgtacaatttttttctttctatcttaaatctgactgttaaatttcctttagcatcctttccgattcgagcagttataagcacacttttttgtgattaaacattgtcatccttcacgctagcttaccttttaaacgacaaatcagcaataaataaaaaacatggacaatgactctaatggtggagctacatatatcgtgacgaatcacacatgtaagagaatcatgtgaacaatagtggtaggcgaatctctatctcttaatttgattcttcaaaataataattaatgattcgatattaagccactttatcaacatttacttccctaacatagatatatgattctagcacagccaatcgatcattgtattagtgcacgcacacaataatcttatgcgtcatcggtcggaatgcattttttatgttgcacaagattaattttcttcgatgcgtagaattttagtaacattgtttatatgtttaatttacaatattactttttttgtagattaaaaatacaatcacaagatttaatggaagtaataactaattgaaagtttagagatgcgggaacatttatacaaaggagcgcatatagatgctccaagttataaaattctttaatattttggattagatgaaagaataaaagaagcatgtaaaattgtgtctaggtacatttggtttagtagtaattagatttgggacaagatgtataatcgttttttaattagtttgatctttctaattaataaaatcggatgtccattgagaaatacggattgagaccatttgtattgccgatggtggtgttacatagtttttgcagaacaagctcatccatgtctctccaatccggtgccaagatctagttggaatccatgaaccaaatcttttttgttggactgattcactcttagaattaatcaaacaaattaaattggttataattttcgaaattctagtcctcggtaaatcccatttcgttgctaacctagaatttccaaagttattaagaagcatgtaatagtcggtttatatatataaaggatttgttttaaatataggtctaagccataaaaacaaacccaaaattctggaatcgaatcaacctaaaataaaagtctagtttggtattctaaaacatttgttttgcggttgggttggatacgaaatctgaaatccgatacccgaacaaatatccttaaattattatttattattgctactttttatcatgaaacaaatgaatttatgttactagaacaatgaacttttttgtgtaattcggtccaaaaacctaaccaaaataggtttcaattctatgtcggaatgaaattaaatttcgaaaaccgattcgaacctgacaaaacccaaatcgacctatatagatcataaatctccctatttgaattattccaaatccgaaaaaaccgatttgaaaacctgaatgcctaaacctactttaaagttaaagaagcaacagtagccataagaagacccacaatataaagattgaaagaacccaactcgaaccaacaatgttcctaaaaatagaagcccataacctagatagagcccaaacccctaattcttcttcatcgacaacatgcaataaactttgctcttgctcgttagatctctcgctccaagtccaaatttctccataaagatgaagactattagagcatcattattgatgatctcttaaaacaattcttatgttaagaaacatgtcttataactaacaaaaggctcttatataagagacattaagtcacttttgttagttataagacatatctcttaacataagagttatgttaagagaccatcaataactatggtcttagtgacatttgagaagaggagcagccaaagaaatttcagatcacatgttcgattaccaaactactaaaaatagagactgtagagtatagacttattcacaaacttggaaaaaagattaagtttgttttatattaaaggtgaaaacttttgccaaataaaagcaataataatgtgtctcaaaaaaaaaaatcctttttttttttttttgtgcacccaaaaaaaaaaaaaaaaagaataatccttaacattctctctcacataagctttttgaattagacaaaaaaaaaaaaaggcactagtcaagtttttttttttttgtataacaaaaacagagacagatccagacaaaaggctagacatccaccacgtcacgcttcccaaccaagtgacacgtgtcgcatccacaactcgtcaaaacacaaacaccaaaaagtagatgacgttacaaagcatcatccgtaaatggcggcttcctctctctcgctctcttctcctctctcaaacccacttcgcagattcactcttcaccatcttcacctctcaaagaaacccctttcttcctcttctctgttcctctgctccgccgcaaaa

SEQ ID NO: 6087 - DNA, 3000 bp, Unknown
  misc_feature (1)..( 3000): cDNA_ID_1011596_gDNA_ID_1620843_Annot_ID_170117 3000 nt of promoter + ATG
aaataacatttaaaggttaatatttatgtatgaaagatgccaagaaacttgtgtcttgatgatttgtttcgtatttgtcttgagattgtgggtggaagcattataattaacctttctataaagttttagccaaccaaaccaacattaccttttctttttctctctttaataatcaataacaacaataaaattgattactaaaatttaaagttttacatatataaaaatgaacaactaaattgaaaggagacgataataagagagggagaggtgtggacatctgaggatgattctctgccaccaagaagagcaaatgttatgattttaatttctaaattaagtaaatatgttgcacaaaaaaaaaaaaaagtatatataagaagacctcaacatcatcccattggccactttgctttgacctttataattctgacttttaactaatattaatcacgtttttttgttctaggtaaccttttacgtaattaatcatttgttaatcgtcctttctactcctctacctacctacaacttacaaattcgatgaatatttgcaaaataccatttcgtcacgatctttttttttgtaacaaaatagtttaatacaatctattaaattactttttctgactgtcttagaaacatttctatttcattattgggttttaaggaaaaataaaaagaacttatcgttgaagtttattattagtctttttggttaaaatgttgaaaaaattttttatataaaaaggagggtaaagaatgaatattcaaggatggcacgaaacttgtaatgcctcttattggcattataccataaatagatctaagacttgtgtagggtcagaagttaagtatagatttggtcatttataaaaagattctgtatcttttcatgtaagcgaggatatatattatctggactttcgagtaagaaaattgcaagttagatttataaatatccaaaatgaattatcaattggcaaattgtagcaaaagaaatgacattttaatcttgcataaagagaacggtatgaaaacaaaagattagttcaaaatatgatgtaatagctcccattgcccattggatttgatatgatatgtatataattaaattcaatatatttttttttttgctatctattaatatttaaatagaatattcctttcttttatcttaattgagttgtgtgacccactcacccactctatagatcgtcttctcaaataccgaagtatcgaaccaaaccgaattagctaaaccaaaatttatttataaacagtttgatttaattatataaacttgaaaccaaactaaaaccttttctataacctaacggaatatatgtaaatttaattaaatttattttaatttagaaaagactacgaatttaaccatatacatgcatatatttttatttattttaatttagaaaagactacgaatttaaccatatacatgcataaatttattttaatttagaaaagactacgaatttaaccatatacatgcataaatttttatttattcatatattgaggcttgagggtatcacctataagaggttttttaaaaaggagtaaatgtgctaaaggaaaatagaagaaaacagggcaaaaatccgaatttaatcgtttctactttttgtagtggggagttttcaacattttacttaattgaaaaccggacacattcttaagttatttaataactaaaaccggacaaaattcaaatagtatcaaataaacggaaaccaaactgagttaagaaaaaacgatctcgaattacaatttacaaacatgattttccatcacttgagtcttttgaataacagtcaataacaaattctaaatttttttttttaatattcattgttaacagtaacattagtaatgcaatcaaataagtacatgattggttgggcggtaagttatacctgacttacattcttaatttttcttaaaatcttaattacgtaccaatagtgttgtaactttacctttaaacttacagcctattttttttttctttttttttttaagcggttagaaaataaattctcaaacctatattttattagttatagaaattttaattcattaaataaatacaaaaaattaaaattattaacataaatatataaccaaaaaaaatatttactatattttatttttctatcatcataatatatttatttaaattagtaatacaaactattttatttactataaaaaattattacaactattatattttactaatccattttttataaattatttaaagtcgaaaacttacaacaataattctacaataataactatttttccttgacatctaatcaagtttgtacagcatatattaaaacatttgttaataaaatgaccaaaaaagaaaaactctcttagagataatcttatttacttacaaaaaatatatccctcatgcaaagaatatacgaatagatttttacacatctaccaatggtagtttttagtattgactttgtcaagtgtatcattaccacaaccctaaaagataccacttctttgcttttgggacaaatgtttctaaattctaatcctgtaaataaactttccaaattaaaaaaaaaaagaaaaatacagaaatgagaagcaaaggactagaacaagcattaatttaaagatattaattaccaaaatcacgcatacacatacacacacatatatatattaatctcccaaaagccaagagtatatattttatccaattatcgtccttatcatcttcttccttcaattttagttttatattaccaaaagaaaaaaaccttatcccttctctctctctttcttctttcctctattgtctgccatggcgatttctactattctctgagtctgtgatcttaaagatttgatgagacagaaacccagaaactgaaaaacaaaaacccaactcgtgatatttcgttccgaccaaatctgtctgatttgtgatctgaacaaagtacggta

SEQ ID NO: 6088 - DNA, 3000 bp, Unknown
  misc_feature (1)..( 3000): cDNA_ID_2054379_gDNA_ID_1620843_Annot_ID_170111 3000 nt of promoter + ATG
attttactttacatgatacctaccacacatgtaatctgaacgaaaaaacctatacgctaacatagccatacataagcgtttttactatcatgtcattttttgcaaaattaatcataattttaactcaggtcctgaatgttttatagtttttaattggtttttagttttcggtttttgaattttggtttttgatttttgaagtttttgatttttgttgtggattttagtttttgcaaaatcaagaatggaaatttttttatattttttttaactcgaatggaaatttatataatttttaatttttttacttaatcttaatgtttaaacatttttaaattgtgtattttatctttggatgaattgataaatggtaaaaatagcataattaaataataatagtaaattaaaaaaaaagggttacgtaaattgttttaaaaacccacaaaacttagtttttagattctatgaagaaatagctaaaaactcctaaaatctagttttcctattttttaaaaaatctactttttgtagaagaatgaatgagtaattatttagtttttgcaaaatcaaaataaaaaaactacttcaaaaattggaaccattcaaggcctcaatcatttgtccatttttaatctaaacgaaaaaacccactcctttcatttgtttctttaaatttctgcaatgtttaatttttattaaaacttatgttcgtttctttcaagtcatctagtttaagaatagtacaagagcacagtacgagtgtacgacacgatcaatttatgttttttcactttatagttttgctcgtaactcatatttattgatgatgactcgactcccatggtttttgccgccggcatgcttttatgggttgggaaaaaataagtaatttgagaaagatgatgtcataatatggacatgtgtccgttcacagattggcttcaaagagtttcaatatgtttgactttggaacagttgtatgaatttgctctatttgctgcaactacctgacgcggcgatgcgactctgcctacatcataactcataattaatgcaacgctcatttgaatcaaactttcacaaatcaatacggttacacatttttcatgatgtatgattctgacactttcaatattgtttttttttctttttctaattaagagttttgataatcactcctaatttttattttcattttaattatttaagtttcaattattatcatgcttatatatttctatttttttttaatttaataatgtcaaatcaaatttacttttgaagttttaaattttattagttggtcagacacaacacaacataaaatttattttgagaaaaccaagagtacaagatgtaatgtttaaaatcgtggtagaagtttgatttatggagaaaagaaaaagagttttcataagaaagtgaaatttttcattttatttcattatcaaagcctaaaataaatgacgattctcttcactttctcataaatactctttttttcttttttctttttgcagaaatcagtccaccgcgattttcaaaatcttcatcttgtactctcaattcttttattgcctgttgtgttctgtctagttctgatttatgcttaactaataaaatttccaaaaaaattgatttgacacaattaaatcagaataatagagaaatgagaagcatgataaatgaatcttagataattcaaaataaataaaaaaaaaataaataaataatctaaaatactaaaattacaacaaattattagtaaaaaaagaagcatatattggttttacatatatatatattttatacatgtcaaaatctgatcaatagatataatatgcgagttactaattttgaaataagtctttatttatattgtaataaggatagtaaaaatttataaggtcttatcctggagttatgtgtggaatagttacggtgcagttaaccatgaaattttgaagaggtatttttgatgactatctagagggcgttgatttctttgttgataaaaaaagaaataagtttatgtgaaaccagtgagtttgtgttgtgacttttagcaaattgagaaataaagttattgggctgaaataagcattttagtgaacaacaaaacacatacatgcagaatatatcagtaataactagaaaccaatggtccacataaggcccatattcagcccactagtgaccgacctacccaccggccatttactttatcctcgctagtcacagtatcgtttccatttaagtttgctcctcatggtggtggtcctaaaactcatctacccatacttcttcaccacttttttcattttattttgcaatagaaccactctctgtgtcagcttatggatttgaatggttacgacggttggggcgaacaaaaccgtcaatggatcagatcgttttttgttttatcattcatcaaaaatagtccgcagtggtccggaccaaaaaaaatagaagaaaaccgctgcggaccatctgcagaccgtttttacatacaaataaacttggtttacagcgatttatagtccgccccaaaaatgagatggagtaaaccgcagacaaattagaccgctttgtccgctgcctccattcataacctataaatcatataaaaaagttcgtagacaaatttgctacgcatcatttgctaaaataaaacacctgttgccaaatgtcgacgatccagaattatgattacaagtatcatcatcatacgattacaattatataaagaaataaagaacacacagaactataatgccaagtaatttcatcagaaataaaattacgttgtttggctaagattttaccacgtgtcaacttttcattcgatctagatggatacccatggaccccacatggatagactcattgacacgctcatgtgaagccaatagtaacaccaaccacaaaagaaagagagagagagagacactgaaacatagagagaagaaaaagaagaggtttagagagagaaaaatg

SEQ ID NO: 6089 - DNA, 3000 bp, Unknown
  misc_feature (1)..( 3000): cDNA_ID_1830037_gDNA_ID_1620844_Annot_ID_50914 3000 nt of promoter + ATG
attatcatggtatcagaaaaccaactattcttggtgtcagggagcatatcttcacgggatcagtctcgtcactggcgtggttcatgtctgctcaggagacaagttttgtcactcttggtcagcgtgttcttgcaaacccactgaaggtcagaatgcattatggccaccctgatgtatttgacagattctggttcttgagtcgaggcggcatcagtaaggcttccagagttataaatatcagtgaggacatctttgccgggtttaactgcacgttaagggggggaaacgtcacccaccacgagtacattcaggttgggaagggtccacaatttggattatttctaactaactatactgctacaacgtttttttaacgtttttaacgtttattaattatgcaatctacttttgttataattatgtaatttaacgttttttaatcttctaaattcaaaaaatttgagtaacctttgtctttatgcatttttcaggtcgggaagggacgggatgttggattgaatcagatatcaatgtttgaggctaaggtagccagtgggaacggagagcaggttctcagccgagatgtgtaccggctcgggcacaggcttgatttcttcagaatgttatcatttttctacacaactgtagggtttttcttcaacacaatgatggtcattcttactgtttacgctttcctctggggacgggtttatctggctctcagcggggttgagaagtccgctctagcagacagtacggacaccaacgccgcgcttggggtgatcctgaaccagcagttcatcattcagctcggtctgttcactgccctgccaatgattgttgaatggtctctcgaggagggtttccttctagcgatatggaatttcattcgaatgcagattcagctttcagctgtcttctacacattctcaatggggaccagagctcactatttcggtcgaactattctccatggtggggccaagtatagagccactggacgtggatttgttgtcgagcacaagggattcactgagaactaccgactgtatgcacgcagtcactttgtgaaggccatcgagcttgggctgatcctcatagtctacgcttcgcacagtccgattgccaaagactcgttgatttacatagccatgactatcaccagctggtttcttgtgatttcatggataatggccccatttgtgtttaacccatcaggattcgactggcttaagacagtctatgactttgaagacttcatgaactggatctggtaccaaggcagaatctcaacgaaatctgaacaaagctgggaaaaatggtggtacgaggaacaggaccacctgagaaacaccgggaaggcaggattatttgtggagatcatcttggtcctccggtttttcttcttccagtatgggattgtataccagcttaaaattgcaaacggatccaccagcctttttgtctacttgttctcatggatatacatctttgctatatttgtgctcttcctagtcatccaatacgcccgtgacaagtactcggcaaaagctcacatacggtacaggcttgtccaattcctcctgatcgtgcttgctatactggtgattgttgctttgctcgagttcacgcatttcagcttcatcgatatcttcacaagccttcttgcattcatcccaactggctggggaattctgctgatcgcacagactcaaaggaagtggctgaagaattacactattttctggaatgctgttgtctctgttgctcgcatgtatgacatattgtttgggatactcataatggttccagtagcgttcttgtcatggatgcctggattccagtcaatgcaaacgaggatattattcaatgaagcttttagcagaggacttcgcatcatgcagattgtcactgggaagaaatcaaaaggcgatgtctaagtttaaaaaacggtaaagctccttgttctcaacaccttatgttatgatcgtttaaatcctggatttcacaccaatgcgggctttaaatttgtgtaggtcttaagaagtaaatggtagttcaaatcctattggtatgtggcgaaggaatcagttggaggttagttttcccgaaacaaccgaattcgaagttttgtttcgtctaaagaaaaactcagatgctgatgatttatctttgtattttaaacaggtttttggagagtttggttggatgaggaatcgggaagttggtttgattcggttagatgggtttagggagatatttgattgtcagtgtgtgtggagggaactctgattcttgtatggtttttgttctaaaggtacagcaatttgtgtagtgaggctttgtgtatttgttctccttctctcattatagagctttagagcatttttagtttatattcagattgttatctaatgtcatctcgcagagcttttgttcacatttcacatcttttcttctccttcttagtagagatcagtttcagattagatacttgtccatattccactactctcgtctattatcggtttctgcttgtcaatttctgggtccaaaattgaaataaatttatataattggaccacaacaccactttgtcggttttgacttttctacttggatgctcctgaacttcttgctcccttttctattacaaattgggaaacaatcagtgtgaattggggaataaaaaaaaacagaattgagcaattaaagccacgtggcaagaaatcgacgagggaccaacgtgtttgtctgcaagatctaatccttttattaacaaaacggcgactgatctaacgggaaacttttaaaatcgagaaattgttaataataaattcaactacttctgggccatcatcatcaatcttgttcgtcttccttttgatcttatcaaactacagtcaaatcactcagagaaagctactaggtctctcctcgacatttgctttcaattcgatccagtaattttcttctcatcggagagagaaaaaaaaaatg

SEQ ID NO: 6090 - DNA, 3000 bp, Unknown
  misc_feature (1)..( 3000): cDNA_ID_1830033_gDNA_ID_1620844_Annot_ID_50915 3000 nt of promoter + ATG
actgatcctaaatattatttaaaaagattttttgtttttcatcgcatattaacaacattatttattggcaacaaaaatgcaatgaaattagtattttgtagcaacattttcacaactattttgcagcatgtagattgtgattttctcgttatactaagttttaagtggtgtaatataagaattgaaaattatgatgttactaatttgtgttattcttataatgatcattagctcaatttgtgttaaatatccacctgactttttattcgagtgtactgttttttttttttttctgttacaatttgagtgtagtgacgattttatatatatttttgttaaagactatctctctagattaattaaaaacttatctatactcgaagttgatatattggttctaaaacgaaaacgctcgatgtattttaagaaagtgttatgaaaaaatgatagcaacttgaacacaaaacgactgcatacatagtagatgattgattgtctaaattaatttatttccattcgaatataatttgatggtgatttgtgtgtaagaaggataggtgaatcgttgggtggaaagttaaaacgtttgaatgcatatctaattactaactagtattcgtgtcttaatacaaagatttcttatcgtttcgtttgttaggtgaagattagctaaaataattaatatgtttaatttgaattggtgtatcatttttttgtcattaaccgtgatgaaggtgatgacaatgctgcttacgtcaagcttatcggcggctctagcggtggcacaagtgggaaagaagggaaacgcaaacgcaggttggcttccgatttgcgggcaagttccaaagttttgcgatcagatcactggagctttaattgccggtttcgttgcactcgtcctctatgtactcttactcttatattctctccacgccgtcgtcgacccttttctccttcaaaaatcttgaatctacctttttttttttgagtatcgatctaattttatgtctctcatacatatatagatagtagacacataaacataaatttgctcgatgtcgatttgagacgtagttcgtgtgttgtgcttgtataatttccactgaaaagaacgttttctaaaagttcatgaccataacacgtaaagaggcgaatgaaggtaatattaatgtgggacatagtgttttgcgtgatccaaattattttagtatcgcaaaccggcctgtcttaaatggacatttgtagtaacaaaaccgaccatcagcaaattaacgttaacgttgctctaatcgtgtgtatttttctaatgcttggtgaagcacatgcgaccatttgttgtgtcagaacaaaaggaagattccacatttagaatttagattataatcccacatgcctattatttaaacatatgtatactgtaataaattagtcccagaagagcatttcatcatactgtataattaatcaaatttaaaaaacatttgtgttgaagagaagatgactagattcacttgattttttttaatactgattggtcgtttgaccagtcaggatccagactgaaatattctcaaaaggtatgaactattttaatgaaatatttgagctgagaatttgcttatgggacattctatccttctaaagaaatcattagaaaatggagaaaaagttactagaaaaagagagggaaatggggcgagagtatgaagaaagggtcccatgtgaatctaataattgaaaagcaaatatgagatttattttagggttcttgttttagcgtccaaagcggtcgcagttgccgttcagcgacttttctctgtttatgaaataaaaacgctccacttgttcttttcttctttcaacccactttgttataactattaacaaatattgcttggtccaaattttattatactgaattattttagtttttttgtatcatcatcctcaatgttagttttgaaatcctaggtcagtaagtcaataacgaaaatgacaagtttaattttgtaattggaacttacatgtcacggtctttgtttacgatcattgccacgaattgtttagatacgggctttttttttctttccgtgttgatgattatcgtttcttcttacatatcttgatcaatcactaacatttacataacctacaattttgtaatataattgcaatactcgagatcttcaaatggtgatactgttaataaaattacgaacttttaatcatcatcaaaatctatagaaaaagatacataggaccaaaacaagcctaaaacaaagagttataatttacaaataaatgcatgtattttgttacttttgttaaggattttcatatcaatgcatgcataatgcattctctttttattttatttataatgcattcttttataatattcggatccaaaattatgaattaattccagattgccataaatgtctttctttgtttatgctgacttttttcttttcttaacttatatagtaagtaaaccagaaaggtggaagatacaaagcaatttcattgcattaataaacttcaaatgtattatccaataatcaaaatttatctagtaattcacaaaaaaaaaaaaatctgtctatcattcaaaatttcaccaatttggataaatatctagaaaattttaaaatacaattcaataacactattaacatatcaatcaatatataacattgcaaaagtttacttgatcattagtatattcattttaaggttaaaagatctttaagaaaaggaaattcaaattatattgttggaaaaaaatacaaatcaaagacagcaaaaaaagtaacaaaaaaaaaaggtagaagaaactgaaacgcggaaaggaggcaaaatcttctcgtcgtcgttgtcgccgtcttcagagctacaaacgaaaaaactcgcttccgtttcgatttctccattgttattgtttcttcagtgaagcttttttcttcgagaaatttctaagatctaccacatgctactatg

SEQ ID NO: 6091 - DNA, 3000 bp, Unknown
  misc_feature (1)..( 3000): cDNA_ID_2991244_gDNA_ID_1620844_Annot_ID_50918 3000 nt of promoter + ATG
gataaccatgtttcttgtaacaagtgtcttcaacatgaccagggcgactacagtaagtacaaactggcctctcctttttctgataggtgtctccattaagaacagattgtgaagactgattggagactgcaaacactgatgaagtcattcctggagtagtagaaatccttgcagaacgttgaatttcatcctgatcaatcatgttgaatacctcagacaaagaaggcaaagttttcttcatgagaatctgacttctaacagcatcataacaatcattgagtcccataagaaaatcaatgactctattagtctctctttcaatcagaagatcttctacagtccgtggaatagcctgaagactcgtcaattcttcccaaagagtttgtttacgagtatgatacgatgacaaatccagattgccttgacgaagagagtgaatctgttgacgcagcttgtaaagtcgagggaggctagatttgtgaaatcgagtatagagatctttccagattgcagcggctgtgggaaaatacaagatgcttgtatagatctccttcgatacactattcagaagccaagacttaaccatactgttacaacgacgccagattttgcaataaggatcatcatcatcaggttttggaatagatccatccacaaatccaagcttattcttagcttcaatgctagtagtcatggctataatccaggtaccatagctgtttccatctaacagttctggagctaagactaaaccaggatgatcggagctaacaagatgataaggactgtgactattatcaggagaatccgatacctcaaagtgacgcgatgagctgtattgagctggttgatgaatcgcagcatgaatcgaggatcctggagctcttgctgatgaaccagaagactgctcatgaatcttcgatgaagcaatgacaagtagatccggtgaactactccgacgaacactctttccatttcgtttacccatggagaatcgaaacagctaacaaatgagactggatcgcaaaggaaacgaagagaaaacgtgtagaagttcaagagaagaaaaaaaatgagaagatgaacaaactccggtgagattccagtgaaatcaaatcggaaaagtttgttacgagactgagatcgagatattttgctctgataccatattagtaaaacaatctcattctcattaattagcaaaagagtacaattgggggtttatatacaaactgatattggcctaaaccataagcctctaaaccaaaattaagattggtttatagaataccaacctgtacagactctatatgaaatctatactaaccaaactaagcttatatacaacaatctaagctatatacattaatagacgaaatttttaaacaaaacccaggattcgaacatcaaataacccatccccaacgcaacaaatattatcaaccaacttttcatttcatcaatgacactgtgaatcatataaaagagatatgatgtcggtgttgaagataacttctttattgtaagattattttgatcgaataagctgcctcaaatcttctaatttcgacaactctttatctgtgaggacactatgaacacgtttgtaaaaatccatcacttggtctctagctaccaccattttctttcttcgcatagggctggggaataatgagttcttacagtgaaaacataagtggtgaccggacgcattgaacctaacatcgtagaaaacattgaggaaatttttgtaacataataaaaagagacatgtggaaagagaaaacaaaaataaaacaaaatattgagaagaaaccaagaaaggaggaatttctttagtagagagatctaccgagattataaagaaattgaggagtagaagagatgtcagcgagctaaagtgacatcagaggaaagactttgaagtggttcctcaatactagaggtatataagaaaaagaaaaagaggcagatccaaaatgttggttttgaaagttttatagatttttaagattttgtttttgttttcatttttcaagagctaattgtcataccattaccaatcaagttttaaaatgttggttttccaagaaaatacttttgctataatctttttttttgtcatcagatattatttaggattcaacgaaccaattttgaagaaaattgttaacaaaagcgaatttttcatgccaaatagttttttattcaaaattttagacttttagttatcttataagcaagcgttataatttatttatttttttaaagaaaattttgagaaaaacaattgcgaaaaaatgtcaggagatcttcaaatgttcaaaaatacaaaaaaaaaaaaaaaaaaaaaaaaattagtgtggggtaaaataatacgtttaaattttattgacttttcatttcaatagtcaacttttagtgacttcttatttcagtcgctaactttttgttgatgttgccaaaatagtcattaaattgacccgagatcacaaattgcgggtaacggaactttgttaaaatttctgttaaatccacaagtgactggattaaaaaaaaaaagtgcaactggcctaatatgagcccaataaaaaatatctcaaaagttttatgggcttattacagatgggcttagtcagagcactatcttacccaaacaattaaaaaaacaatttacaatatgttttcgttttctacttttttcggttattttgggcaaatgatatctacagctcaacaaatcaaaaaaattcaaaaatatttcaatttattatttctcgatttttttcacaactgtattttaattgtatttttagtagaaatacttatttttccaaaaatatttgtttgtgttgatgtatatataaaaaatctgcatcagtgttttgtctacattttctcttccattagtttcgttatctttttattttctctatctatctggatattattttttcacttggggatttggagaaacctctcctctctctatctatagcc

SEQ ID NO: 6092 - DNA, 3000 bp, Unknown
  misc_feature (1)..( 3000): cDNA_ID_2137741_gDNA_ID_1620844_Annot_ID_170158 3000 nt of promoter + ATG
atggttcttgtgattgggaggtgtgacacccaaattagatttatcaaactcaatttatatatgtatgtaataattttacaataatccggataatatatcagaatttaaatctatataacaatcaccaaaataaattaaattacactgacaatatgaataaattcaaaaaagtacatactattgtactacaatctattgtcggcagtacataataaatcttaacgttagttctatgggattttgtgttttgtaaaagccaaaagaaccttacaagacttttgcaaataataatatggatacatttgaatctcaatcgttaaacaatttgtaagctttaattcaaaaaacaacagaaaagagtttaacaaaacaaaacatatgaaaggaaaaagagaaatggatttggatgtgaagaaaaaagtggaagaaacatattggctttgtactttaacaaaaagaaaaaaacatattggttttgcttccaaatagtgactgcgttttgcggtacgggaaaagtgcggtgcagttcaaatagtaacgaaaatacatagatatatatatatgtagagattttgatattgttacaacactgttgcgatgcgattttgggtatggtttcggttaccattcatagcctttgtagtagtggctatacaaatctaatcttgatcgttgtgttgctttaattaggaaatacaagggagggaagatataaaaatatatctaaaaggttatttgattgatatcgacatatgaaatttcgaagtatgaacacatgaaagagtgtttacacatttacatatgtatttttcaacacaactagaaaagtttacaagataagatgaatccaagtggatgaaattatctgtcacttgcatatacatacactcaaaatctgaaaagtcagaacttgtgaaatgattaaataaaataaagttcgacacaaaaaagggatgaatcatgtaggtgacgagagacaggtattactgttagtgatgcaatataatcaaagcttagattcaggcccatcctcatcatcatagcctgcggcaacaatcaagaaaacatgttttagattcaaatgcaattttttatttttattttattttcatttccgatgaacaaaaaaatacttaaaagcaactaacttagttacatgctaattttatattgtaaacattttttttatataattaatatgggattaaagaaaattttaaaatagacaaatctagtactcttgtctttgtgcgcaagatattaaggttttgaatggatattgtggttagtgctgactgatccgtcagcggttcaattcatattatttttggggcggacaataaaccgctacaaacttagtttaaagatggtctgcagttagtacacagcgcttttcttttattttcttgaattcgcactattacagagtatagttttgtgagtatagtttgtgaacgataaataaaaagcggtccgatatataaacggttttgtgcgcttggacatgtgtcaccattcaaagcctaagatcattaagtccatgacatgtagacatgtttttttctgcaatatacggcaaacatatttgcttgcgacattctaaacctttgttaagttttgcaccattagatacgataaactcaattctcttggaattaaaccatatatacatggtataaaaacctttagaagagacttctactatacattaagtttttttgtttttattattatagaaagtaatcatttgtgatggagagtgtatggacttgattagtttgggaaaattattcaaaatttcatttcatacaaaatgtggtttagaatttagaaaggtaatttgcaaagcactaaagcagctttaatatatctctttcatgaatttttaaaaaataaaaagatacgattttttttggggaaactaaaatctttgtttttctctcttatctctctttgtgtgtttcaattagtgagaaattagtaactctctttctcactctctctctctctctgtttcaactgtctgtgaatcaactgttcttgatctccagaaacctctacacaaacaaaaggtgcgttcttttgcgttgaaatggctcatatctcaaatcgtttgtttctctttgtgggtttcttgttgttaccatgtttaaggcaaactgtctgatctgctcagacatttagttgtttttcctcttcatcactctgcgctagttttgtttccgaattcttttgagacaatattggtttagtttcttcttactcgattcacactttacgacattggattcctataaagtgatttacttttctctaaaaacggcaactttgttgcttaagaatctctctgttcttcaggatttgcattaacgtctctcgtttcctgaaaggaattgatgatttacgccagtagaatttgaatattgtctatgtggcagatgtaaagaacaagttacaaagagatattcacaagaatccgtctggattcatgtgtgaatagaaatatgagcaaactctgttcttgatctttgtgctttcttttcataaggattcatgttttgtgattcttgtaggtcctactttgattaatttaatcacagggattagtaaacaagtctcagaacatagattaataagatccccaatggtgataaacaatctcaagacagtctttttggtaatacatacctttattctattgctaagatcacatgctagaatttggtctttactacttcttgaggtttatttatctctgtgatcttattgaaactgctgttaaactatctacttaatcatttgtctctattgcttttaggtcatagtccatcgttgaccaagatttgaatccaaggctttcccggagagtatatactagttaacaaaacactcataaaaagctctggcttgaccaaattttctacttaagcataacggtggagatctgtttttttgtgtgtggctatataacaaccttattgtctaggctgggattaaaca

SEQ ID NO: 6093 - DNA, 3000 bp, Unknown
  misc_feature (1)..( 3000): cDNA_ID_3079534_gDNA_ID_1620844_Annot_ID_170155 3000 nt of promoter + ATG
tcttaatatacaatacttctttttcatgcattaagccccttacaatgtcgagtaaacaaagcatgtgtccgctaatattgtcttcgagcttggtatttttgtattctgatacggtatttggggacgacatcttttgttgactcgatataagaagggggtttgtggaagaaattgtagtattatatatcaagaatggctctccaaaccatgttgctggccacttagctattatcgaagcgtttgttgcaacatcaatatcatatcttcagctattctgttttagagaggttgagactgaatctatatgatctgaaggacggagatactgctatgcatttggccttgacaggtcgccatgtggagatagctgcatgtctggtaaatgtgaaccaatgtgcttcatttcttgcgagtaaagttggaatatctcccttgtatttggcagtggaagctggcaatgtcccactcgtggtatcaaagttgagaactacaagcaatgaaggaagaaagacgaactttgattttgtacacgtggctttgaaggccaagagtagaagtttgttttgcttcttaccaattagtagctctgtttagtttgtttgactagtttgggacagaagactaaatatttgcatgtgggctaatttatacagatccaagtcttggggatgagtgatgtgaagaagggataaattctctttcaattggagcatccatagggttttataaaggagtatgtaacctgttagtacgattaacgaagagtgtttacgtgtgaaacaatgatggaccctttccactcatttggcagcaacgaatggccatatcagaattgtcaaagagactctaaaacattgtccagattcaaaacacctgcttaacaagcttggttagaacgttctttgcattgcaacaaatagtgggaaatgtaagtgtttgattccgttgttgttatatatgcaattctgtttcattttatttccgcactttgggttgaattgtcctgtttctctatttaaagaaaaaagtgcttcattttgatgctttgtcgatcaaactgaggtttgattcccaagagacacatacagattgtatcataattagctaggtccagtttgatcactgtgattgtagttgacagatagtcaaaatgacctcttgttgttttgctggtgatcattatttcagtacctaagttttttttacccaaccctcacttcaacacatcttttgctgccaccatttcctttcgctttcggccgctggtcacaactcacaacagcaacaatgactaaaagaatctgcactaagtcaatttccagcttcttgttttattaaggaaaatctcgtgccatgtaaattgtcagacttttggtttgtttccagctcatacctggttttgaggtagtctatgttcttggcttgccatttctttttaatcttgagctatgttcttagaggcggctaagcagttcaggacttggttgttggttaacttattgtagcaatacttgttcttatttgggctttgctgggtgatccagaactcggccacaaagcctttcagtttgcctttccatttctgtctttggctctaaactccatgtaggtcgcattctattttggcgtgctcgctacaacaagtgatatactagttattttttttcgttcttcactaaatactagattttaacccgcggtacaccgcggaaacaatttattttttaaagttagtatacataaaagtttgcaaattgtatctatctataaatatttttattttatagtttacaattgttattaagtaacgtcctgccaaacccgtcccgccaacccgtcccataaaaaaaacatttattttattaatgttaatcttatttatgatatgtttatgaattattgtctaaatattttgtaattttgtaataattaaatgctatcaaatatctctgcgatttgacgattataattaaattgttatagtcatggagaaaaacaatatcaaaaatgataattttgtagtaaataaatgatattaaatattttgaaagttttattttagtaactaatcgtgtagttaatgtggagagatttagggaagattgttaaatgtcaaatatttaatttgaagattttttttctaattatcaaaaacaaacattaaaatccagtggcagctattgtaaataagtcccaactataagatttatttcacaaaattgctgcaaaaatgtatatatagatattcagcgcgtattttattttgtgctctattttcttcttgcctattacactgtcccatatattcctggctttggtcgttgtcactgggcaacggatatcctctccgaatgctattatggtttgttgatgaagaagatgctgaaacatatcacacctctggctctggtccgtgtgattgaaacaaaaaagacgaaaggatgtcttcttatctatttgattcagttgttgttttcataactagtaatttattacgttggtttggaaagagtcagtaagcggggatagctcagttgggagagcgtcagactgaagatctcgatccacgctcaccgcattacgttgtcttttcgtttttattttctttctatatatcttttactcattgattgtgttacatgaagcggggatagctcagttgggagagcgtcagactgaagatctgaaggtcgcgtgttcgatccacgctcaccgcaatatttagtcatttaatttttttcccaaagccatgcaaacgacgtcgtttaaaaccaaaacacacagagatagtcatatacggtgtcgctttatgaaaagctcgaattatactaacggtggttttacaatatgaagttcaaaaagcccattaaaaagcccactacatatcccaccgcctttacctctgaaccgactattttttttccaccctttatattcgttgtaacagcagagatttttatagtttggtttctttgaccggagaatctcgattaggttacg

SEQ ID NO: 6094 - DNA, 3000 bp, Unknown
  misc_feature (1)..( 3000): cDNA_ID_1830001_gDNA_ID_1620844_Annot_ID_170151 3000 nt of promoter + ATG
accaatacatgtttctcacggatatgtggaaaaactttgttgaaagactctaacttggtgtggcacttggttagtatacgacatgttgttcattcaatggttgtttgacataattcgctttcctttttgttcatgcctcagtctctgtgttgactttttttctataatcatttgggtttagagccagactttccaattctttatgtaaaaggtggcattcacactcatagctacttctccgggtgctgccacattgcttgaaagtttggaacactaaagggattatagtaataaacgaagatctatatgatcgaaaggaaagagatggatatactgctatgcatttgaccttcacaggtcgccatgtggagctagctgatgtcttgtcaatatgaaccaatgtcttcattttttgcgaataaagatggaaaatctcccttgtatttggcagtagaagcttgtaacgtttcacttatgacagaaatgttgagaactagaggcaatgatggacttggagggagaaagtctaactttaattcagttggaagggtagaaaatttcttctatacatggatttttaggcgaagaatacaggtttgtttttgatgcttcttacccattagtagctatgtttagtttgttcaaatttctatattcagctagtattgagacggaagactaaatctttgcatgtgggctaatttatacagatgaccttaatgcttttcttaaagaagatccaagtcttggaaatgaacgagatgaagaaggaataacttgtctttcatctagagcatccatagcgtttcataaaggagtaatgcaacctgttagatcgatcaacaaaggttgtttacgtgtaaacgatgataaatgttttccaacccatatcgcagcaaagagtggccacgtcaaggttgtcaaaagagattctaaaacgttttccagactcaaaacacctgattaacatgcatggtcagaacgttgttcacattgcagcaaatactgggaaattacatctatatcatttcacaaactgtgataaaaccaaatatttacctctactggtggtatgtcttgtaggcttgtagttgtagccacagtaactttttctgtaggttttacaatggcaggaggctttgacaactcttctccaaacttgggaatggcaacattagccaatgcccccaacctcttctattttcttatcttgtatttgacacccttgcaatgcaaatctctgttatgacaatacttaactcggatttatgtgcagttgagggatcctacactcgctcacagatccttttaagtggcgtcaccattactgttttttgctatattctgcatgccctgcgttctatttttgggtggttattacagtaggaaattgtagaggacttgtcatagtcttttccattacatctataatcttcttgggttatattaatttatatacccagaaaacataaaaattaagaatatacctataatttttgtataattagttctctttcctcaacttatataagttggacaaaaatacccttccgctcatcttaaattatttaacaacataagaaaattattacagacgtcttttatctgattcaaatgatattgtttatcaaatatataaataaaagtatattatgaattaactgataactattatgttaacatgataacaaaatatagatcaataagtttataaatatattatgttaaattatattatatcgcgataagattataaatataccgtattaaatcatattatatcgcgataaatttataatttatgtgatatattatgttaacagtgatattttgttaactatactttttatgtatttgaattttagtttttatgttttctaggtatataaattaactattttgttatcttgttaacatagttattagtttattgtaaaaaataaaagaaattgtaaaaggtaaaatcgtctaaaataagttaacagtaacatttgtacagttaacaactagtcaaactaattataaggtcttccatgtgtacagagtgatattacccgatcttcttctctcttgccatgtctttttttttttttgctaagagagtaaatatcaatatatgaaaatgtagttgtcacaaacttacaatagtagaagacctaaagagtttgatccatgccaaaaaaagagagcttaaaaacagggatcaatttacaatatgcatctatccttagtggagccacaagctcatgaggtttctcaatttcttcatcttccttctcctggctgtgatagaaatttataaactgatcacggtcatgttcttttgtaatcgctgcgtcagcaatcagcgacacaaagttataacttacttgcatgtaaagtatgtggagagtattttaccacgacatgatccacgacatactaagttataacttacttgcatgtaaagtatgtggagagtattaaatagcacgaatattctctaaataaagattgaaacttggaagatgtctgtacaagacaaattttattctaaataattctaccgaatatttttctcttaaattttagttttaagtatatttgattttttttgtatttgttttgattttccaggaaatgagtaaatttcgtcgagtccctctaatattgaatctagtgttttttataattattttagtaatgcatttatgatgttttatttttgtggctacgagaagaaaggccttgaaatcttcgatagaattttgtcttgttcagacatcttccaggtttctattttgttttttgtaaggaatcttccaagtcttcatgcgggcggacaaagctactatcggtctaagtctccgcctatgagtctcctgctatcttcctttttaatcttcttggtgatagttacgttgagatatgcggttgcctttttaagcttaaaacttaagcttctttaattttataattccaacgacagctttacacgaaacaaacaaggcacagagatta

SEQ ID NO: 6095 - DNA, 3000 bp, Unknown; identical to SEQ ID NO: 6091
  misc_feature (1)..( 3000): cDNA_ID_2991244_gDNA_ID_1620844_Annot_ID_170140 3000 nt of promoter + ATG

SEQ ID NO: 6096 - DNA, 3000 bp, Unknown; identical to SEQ ID NO: 6090
  misc_feature (1)..( 3000): cDNA_ID_3076251_gDNA_ID_1620844_Annot_ID_170136 3000 nt of promoter + ATG

SEQ ID NO: 6097 - DNA, 3000 bp, Unknown; identical to SEQ ID NO: 6089
  misc_feature (1)..( 3000): cDNA_ID_3079550_gDNA_ID_1620844_Annot_ID_170135 3000 nt of promoter + ATG

SEQ ID NO: 6098 - DNA, 3000 bp, Unknown
  misc_feature (1)..( 3000): cDNA_ID_1830013_gDNA_ID_1620844_Annot_ID_50922 3000 nt of promoter + ATG
ccactcagcctgcagtgctaggtgcacctcagctctcaaggtgatcttaaaacaccacccagacacaatagaaatgcttaactcacagggtcaaaacgttcttcatgtcgctgctaaaagcgggaatgcacgagctgttggctatctgctcagaaaatctgacgtcaaaaggttaatcaatgaacaagacatagaaggaaacacaccgttacatttagccagcagtaattctcatcccaaggttgtaagtctcttcatacatgatagaagagttgacttaaaaatactgaattacaaagggttcaccgctttagatgcagctgaggatcatatggcgacgattccttcactccaagaggtttggcctgcttttgtacggcattggatatatttgtactcatttatatgaagctgttgacatcactgaacatattctatgttatacccatttacagtggttgatatggatggcattggtggctgctggtaccactagagctccacgagttcatctgagagcagacatccctggtctgacaacagatgaggacttaatcctaaaaattcacaaggatagagtaaacactctccttgtggtggcaacactagtggctacaatggcttttgctgcaggcttgagtgtgccactaggttacaacagcacagagttcaagtcaaatgtcaaacattcttacgaagaatctgcatttcatgcttttgtcatctgcaatagcattgccgtatatactgctgttatatcgacagttgctcttatagggacacaattggctgacctaaaatgcatgctgaccaccttcaagtttattgtgccactcctggggttttctattatcgccatgtctttggcttttgttgcaggcttatacctggtcttgggacatcattattggcttgccatatttgtcttggcctcaggcggtttctatctcatggctctacttctgctcatcatcccttacgcttcgccttatacttttagtccgctattttttcgctactttttgcggtttcccttttcaatgttggtttcctttgcatactggagggatggcactgatggggaatgctcgtcacgagtttttcgttggtcatttcttggttaagaagatcaagacttgaaaattcctgaattcccttgtctcatgatgttttagcttgagtttgaattatgcggtgctggtagtagttaaattggtttcgggaagtttgccttaaaaaccacattgtatcttgcttcctaacatgtctcccatgagttgcaaagtgtattcttatgttgactaataaatactttcaactttttgttacagtggtgttattctcttactttctattgtggtaatcaatgaagctatgtagagaactcaattttcctttaacggcgaagaaagatatttaattagccattatggtctgaagcctctatgactagctctgatgtgtcttcattcatctgttgctgcattgacataattgttgctctttgcagcactatcaagaagcctgaattctttagtacagaatatgtcgaaggaagatgttgattccgtaaatcaactagttcctgcaccaacagaagagttgggtatgacttatatggagacgaatagggaacaaggagcagcatcaaaaccaacaggaagatgtcaccattaaccacgcaaagggaggtcgcttactgcaagatacattgccataaacgctattgacattgatgtaagcgaaaagaactggaagtgcgatgttgaaggcttttgagttgagagaaagatactattgtcatgatagaggaatacatcgccaatatgtcacatacaagaaagaattggaaagctgttttctgagccaaagtggccattcccaagttgggaacagagcctttgtgaccacctggtaatgtgaatcctgcagtaaaagtcatggtggttacaagagttgcaaccaataaacggaagaattgacatgatctttgtactttccaccttctggcttgaatgatctaagactttctgaaactggactggaacttcttggtgcaccagcattgatcaaagccatccaagtcaatcgctgtatacaaggtaatattggggtaacatctttgtcatattacctgttgaaacacgtagctccaatcaatgttctactacatctaaagctgtggaaccattatagtttggttttttcaggtcacctctatgatggtcccaagaaaacatactcacaactttagggtgccagttttggtggctagacagcaaaataatagcggcttgacagctctggatatcgccgaactaaatcccaaccccactacatcttttgagaggtatttctaatttcccactacaacattaccttttctcgatcagtttgtcggtttgacctttgaatcttggttgatagaaaccgactaagagtttggctctgtgtcttctcttgttttgggatttcttatcgccagcttggtgctactgttcagtttttcatatgtgagaaaacataaacaaagaaacatacattttgtgttagaaacaaatcggagttgcttaacgttcatgagtttgtatatagattcggtagatggtggcttgatttttgaggttttgttgttctgttttgtttcttgactttcagagttcagacattggttttaatacaaataaaattagacggcaaaacaaaaagatggtggcttgatttacataagtcaatgcaatttcaataaatttttatttttttcataatataataaacaaattaccttcactctgtttctacactgactttggttttataaaatggacgaaaagagtatactaactcagatcctaagtatgaatctgaatcgactcttttgctgggagggaaggatttcaatggtaataccatgctgatcgaatgtgaaccctaaaccaccatcttgcaacaaatagtctaccaacgatgccactcgctcctatcttttcttccaaagga

SEQ ID NO: 6099 - DNA, 3000 bp, Unknown; identical to SEQ ID NO: 6094
  misc_feature (1)..( 3000): cDNA_ID_1830001_gDNA_ID_1620844_Annot_ID_50925 3000 nt of promoter + ATG

SEQ ID NO: 6100 - DNA, 3000 bp, Unknown
  misc_feature (1)..( 3000): cDNA_ID_1829990_gDNA_ID_1620844_Annot_ID_50928 3000 nt of promoter + ATG
atttatacataaatatataaaaatttatatgaaaatttataatttttcattctgactactttcatttgatttagatacaagataaaaaaccatttttagacccaaaaaaaaaaataggttaaaatataaaataaaaatggtggagtaagatattgtaattttattaaacaaaactgttgtaatgttaaaaattatgtaggtgttgaataatgatgtggtagaaagaaaagatgatgtggagtgttaaaagtgaaaaagtgggtgttgtaaatgagtaaccattgtagataaatagtctaatgattaattttgccaacaatgattatctcaacttcagggataaaccggcctaaattttagatttgagtttgatcacttatgtgtgttatgtctgcatgcctaataagaagtattatgaccaacaaatattcaatgtcagtgtaatccaaatttagcaaagcaatgtaaatgagctgcatattatatgttaaatattgtgtgtactcgtgttcttgtttttacatcatcagttactaattctaaatccgaaattccatctacatacgtagatcaatcaaagttgtcctaagaggaggccttgtgagtctcattgggttttacagaaatcgtcggacctatttgggctcaaacatataaaagatccaagatactggatttaggcccaaactcttttctcaatacgataggatccaaatctttttgtagctgtggaatgtggtggataacaaataacgtcacttggtaaaaatccaacattttagattcagccatcggtcgtacaacgtcactctcatcaacttctttttcagttccccaaatcacgatgatcgcttagtcatcacacccatctagcatcccgccgtcagataaaccggtcatttacccttaccaacataccggttttctcaatttacaaattcggtttgataaatatcaatagattaggtaaatagaaattaagttaattcggcacgtgtcacgaaaactaccacatggcgcaaaggccaaaaccacaaaattcagaaaagttggtatgcttccacgtaattgacatttttcacgtgatttgcttgtgactactgatgttacaattagtagacgtaccgttcaataacgtgatatttattagagattattgatttgcataattagttacaaaatcacacgtcacaaccatttttccccaatattacgtccaaaactgttgattcgtttgatttttattgtccgtccaatgactatttcgatttattataacttcttgtgttagtaaatagtaattcaagtctatatatactcttatatcataaattaggaaaagtaagtactgtatacgatcattgtatctaataaaatatgaaatatgcgagcaataacggccaaatagagcgtaacttcagttttttttgtgatacctagttttaaataccctaaacatcaagttacctcaaattggcaaaacctaattttgctgaaattgaaagaaaaataatatatttttatttctatatttgacttcatttaaatattattttcgaaataaatatttacctacgattgattttatcaaccagttgaacgaataatcttcttttttgtatgttaaggtgcacttataatatatatttctatatatatcacatgaaagaaaaataaaataatttaaataataacaactttcagaactaagtttttttcatattaattataaaaaatttgtatagtatactatagactcaataatagtaagtactaagcagtaaccatcaataacaatattttctaggactaacattttatttctcttcctacgaacgtaccacattgtatcatgatagccaatcaaaatacacagtactgaaactagtaatgataataagttaggcagcctaattatatacaacttttcaaatacgtcatatgaacaaataacattttccgtaatatgtactgaaaatttccacgataaaaaacaataaaaatgctcgattaatgttcttatacactggcattaacaattctcacagcaaaactaccacactaatcacaatcttatgctcatgtagtatttttagacaacattgtacatgtagaaagttctttaactcttaagtattatcgactagttttttttctagaatgaatttttctaatcgaatactttaaaaatagagtcgacgaaagagattaaatataacaaaaccaaaccacgtgaggatcataagctatggacgaggaaaatcgtcaaactttgagataaatttttgattgattaggtgtttgttgtactttttcttattaatatccagaattcagaaccttctcttcctcaaatctgtctttatcctttttaattcaattttaatctcaacttttctatattttatcgtctaaatttaaagaaaagaaaaaacccaaaaacagaggattttgatcaagtaaaagaaagaatattttctagagaaagcaaatcgattctctcacctttatatatataacctctccacctctgtttcgtctctcaatatatatccactggtctttcctttttccggcaaaattgtaacagaaccaaaaattactctgtttttttttattttcttgacaagtctgcatttttctcctctgttttggaattttctcgtttctggttttccgatcataaaaaacaaacaaaactaccgtaaaataggctctctccacagaaaaaaaagaagacttttctttcattcttctgcaagtaactgagcagatttcggttttttcttcttcaaattgatatttttaaagttataaaaatttcttgtccataatttccgttttccttaaattcagctgtcctaacgtcaaatctcagacactcgcttgcgtgtctccctctcttaaactctctctttctctttctcttttggtttctgggttatttcaaagaaaagaatcaagaaacccctctttctctcttacaagaatcccatcatg

SEQ ID NO: 6101 - DNA, 3000 bp, Unknown
  misc_feature (1)..( 3000): cDNA_ID_2992383_gDNA_ID_1620844_Annot_ID_50930 3000 nt of promoter + ATG
tacaacatatcttgacagagcaaagattgatttttacctcacagaattggtagtaatagtgagacagtgaaccatggagtgtgaatccaacaagacctgatctaagaacacgagttcgatcaaactcaaacagcggttttccttcgtaacactgcataaagttacagccaaaatggtcagagagaactcaaattaagaagctttttagagtatttttagtttcttacttgtgcaatccaatctcctaaagaatacacaattccactaatcgccattttcgccaaaacagggtttgttttgagaatttgttcatacgcaaaccaattatgttcaggtgcatacctaagtatctcgtagagagtccaaccctaagaagaacaacaacaatcgtgatatcaatttcagtataatcccataaaggagcaagctttgcagagatagaagaaccaatcaatcacaagagagataaagaaaaccctaagcttacttgccaatagtcatgatcaatggttaaaagcttagtaaccgcaacggtaccggcggcgagaactatagctgcgttgatacctcgactcatcagccgatctgtatcttctactttatcttctgatagttcttcctctgccttgaaattgtcatttttaacatcgattgcttctctgtcttcaatgatcgatttaacgatcaagtttcttctctctgtaatcaatcgtttctgattcttaaaagggttgattcggggtaatgggcctgcggttttaatccgtgaagaaaccttcccggagacgatgatggtggtgggacaacaacagagagctgccatggacttgcacttctcaaaggaagatactttttctcttctcgttggctctctcacagccaaaggagaggtttttagacttagagaacaaaaaagaagcagcagactttggtgaccaaacggtaggaactgagccgaaccgagtttcggttaaattaaaaccaataaccggtgggttttaatttggttaaaaaccggtttgcacaatctcaaaaccgaagccgaaaacaaaggtcctaccgagatttgaactcgggttactggattcagagtccaatgtcctgaccactagaccataggaccagttgcttcgagtcctaccgttttggtttaagatctagacatgttcaaggactacaccatcgtggtctccgccgatacggcagtctgatcaaaacgattcaagagaatcaggcggaaggttttttctgaaattcataaaatcgggtgatctttgcaatatgcatacgtatatccttggtaaatgtattggctttgtttggttaacgatgttgataggattaggttgtgatcaaattagaaaaaaattgggtcttttctgattttttttggccaattctctgattatgagttttggaatggttggaatggtagaggagggtttaggcgtaaggtaagagaaaatgggattgaacccaatttgcatacttcaaattctctggtgagcttgatgtttcattgatttgacaaagcatgtatttgagattgtgggcagttgcaggatcagactacatgttacttacaacaggcatgatcaaggagtattgtaaggtagggtagagaaatgatatgacaatgatgcaggttttgagtattgcctagctttgtatcaagatttggatgagaagtgactttcaggcttgtagtttagtgattggagattctgcaagaagggaaaattacatgaaggttatgtggtttttctgcaatatgattcgttaaggaggccaagccaaatgtagtcaaatacaccacgttaatgattcatccgtatggggacagcttagatttttctgtgtgttgcatccaaagatgtactgtgtacccaaattccgagttcaccaaccagggatgaatgatactgtgtacctaaattccaaagatgtactgtgtaccctaacagttttcgtctggttaggagataatcacttcttgaaagcagtttgaatgtttctcaaagaatggtcatgtactacccacgttttttgtttggttatcttggaggtaagatgagctggtgacaattctgtttttggcttatactaagattaacgtggagctagtcctttgctttacggagctttgataagatgttttaggatttaattacccatcaagaagataatgagggagaaaaaggctaaagagattcattcgacttgcaaaaccatggttggaattttgtgcacatagtgattgaggagagagatagaaagtgaagggactttaaatgttagacccgttgaaactagtggtgggcctgtgaaggttgaggttgagggaagagccagcctgcccaaaagaaaaaatatcttgtgcaacttgtgatgcttggtagctttggtcctacatgcttatccagatatttgcagagaaagaaacatcaaaaggttagccacattataggaagaactaaaattttctaatgctattttgctcaaataggtgtttgagagctctgttcatttaataatgtccatatttgtggctatgttcactgaattattaacagggaaagcagttgaaagatagctaacatgatgtaggggttttggtttttaggaggcaaagaggctttcatgggaccacactggatgatagttgcaaaatacattgtggttaaggtttgtctcttgagcacatgttgagactgggatactcttctgtgagaacgcattaatagctgtattaagtgttgatagaatttgtggacggtaattcccgtgacatttatggaggtatctgtgatgtttttcctattaaaaagacaaataaggagacccaaaaaaggtgagaacaactatacacacaaagaaatttcttttgtctgaagacaaagggagtggtcaatgaccagtactcccctatatgttgggttaggacttctactcattttgcatcgttgagatactatactgccttgaaagacttggtattgg

SEQ ID NO: 6102 - DNA, 3000 bp, Unknown
  misc_feature (1)..( 3000): cDNA_ID_2138868_gDNA_ID_1620845_Annot_ID_170167 3000 nt of promoter + ATG
tattgatacgcggtgtctttgaaaaaaaaactcttctgttagatcttgaactgattgtaatctgtaacctaataaatcgtgaaccacgggtctagaattatgacgcgttcgttgtggtatgggcagggatctcgctggagcctccgggcgaggactttcatatacgcagcaatatgctgtacaaaaataaaaccaacccagacaaaaaaaacaacaacattaactcaccattatctactttaactcaggcagaacaataccataacttagacataaccaactacaactcagtctgcacaccagaataaaccagctataatttatttaactcagcctaaacaacacgataactcagccataaaatagacaacctcagacagaatataacaataacttacttcatcacccaaccatccataatttgaatctggccataactttctttcggtcatgaaaactccgtagaaatcaacctcgtctattccattttccaacgattttttgctaacaaataataaaagaaagttaatatacacaaatagtgtaagcatgtcgtacttaacaacttattaaggtataaagggtcatacatgtcgagacttgacaaataatccttaagtttctgcatgcaatttggactcagaatcaactggatgaaaaaacagtctatgtgtatccacgcatgaatgatttttccactggccagctcatataccgaccagaatgattcttcttccctttcagcaactaacggctctgcaaaagggaacatatatagtgatatataactgatctgtcgcaagaacatgatgaccatttcttcctagtgagtattttgagtgaggggggagtttttagccttgctcttatgatttagggattttcttattcatgacaatattggacccctaggtagtactaataacaagagagggtttttgttttcaaatgttggtttactggttaggcttttattctccaccatggtatggttcctataaagctacataagaattcattttgaagtttgtttggtgtgtgaccgaagaaccaaaaaaaaaaaaaacagttgctcattctttgtctacttatctcactattcggcaatgcatatacgtcctaatctttgttttgcttatcttagttattctatctctctcccttacctaaaaagctggcttcaaaggacttgacggatcgtttataaaacagactagtcataaacatagatttatattcgagatggcttcaaatacgaatcttaaactgtttatagtatatatagtatctaatagctgcgggtgttgtgaaagggaacttagtgttgaccatggtcatggagtttaaccaagaagtttgttgaaccaaggattcacacaatagatttgtttagagagggaaaacaaatctagtaatttctcttcattaggtattctatccaagactcgattacaagaggggttctaatctcttatgaaatacattagggttttgctcaagaacagaaaaagaattagagttttaaaaaggtatagctgcatccatgatggattgcctacgtaccctgtgaagggatcaagccattcgtagttttcaataggtataaagttctatgtttcttgtgaatatcccaagatctccccctttttgtgaagtccctaaggcactttatataggatccttaaaccgcctccctagcgatattcttcggaagattcttatttatccttaggtcggttctagaggataatcgtcctaaggatattctccttattcttcggaggttttggggagatttcctgatttcgacattatcttcaaagattctcctttatcatttctgaaagtcccataaaagatcccattttaccggaaatgatccttggagaatgaatggtttttacaagtctttgcctcgcgtgttcttcacggctcggtggtcgtttgagaggtggcttcggggcaaacggtatgtaccggctcggggcgcgcttgatgactgtccattaagctcagttggctgtctcccgagccgatatagatgtttcccgcagcgttctcacgattggttcgggctgtgttcatatgattaacacccgagccattttacaaactctcttcgggacggtcgatcgaataaggtcccgaggtgctttgttctaggctaggggccaatcatatgtttaaccatgaggtgattgttattcttagactgtttggctcggtcttgcttgtgggggaatccgaccccaacaaagttgtaccttgacggaagagagcacgaatgggatcggtgcgggtgtctggaaagtgcctgaagaaggttcatgtgatgatcaaactctggaatgctactgggagtactgactgtaccaaaacctcctccaacagtgccacagggaacaagcaagccccatatcaatgtgtgatgaagttgaaggagcagggtcgtaaggtggacttccacagttagaaggaggcttgtgtgatggaggagctccatatccttcgtcatagtactgatttccggatctgaataaagaagcatggcatcatttggaagtaagagatcacatgagaataccatccctagaaccgagagagaaaagtttatgttaataaatttttattgtataattgatattgaaaaacattaataaacattaataaacagtgttcacataaggtgtaaattcaccccaaaagcactctaaaaagtaaaaaccaaaagagaaaaaaacatagaaatggttacttaataatataccgagtttcatctatttacttaataatatacggttatttgatttaccggttaactaaaaaatatctggtttaatcgtatttattgttggcaaacacaacattgggcgcgaagtggtttttgatgcccttcaacaacatttgggggtttcatttcaatcgcatttctagggtttctttctctacgattcaatagattcggacgaattgggggattctgaccagagagaagctatg

SEQ ID NO: 6103 - DNA, 3000 bp, Unknown
  misc_feature (1)..( 3000): cDNA_ID_2138868_gDNA_ID_1620845_Annot_ID_170173 3000 nt of promoter + ATG
aaagtactatgcatacttaaagaacgaaacaagattggaattcttacattgggagctcaagaatcatggagaatattatctaaaggtttccttagtcattacaaagtgacaggttatgcaaaatgcattgatggagtcatctactatgaaggttcttttggtgatggtttaagacaagagcttgccataatgagttttgatttaagatctgaaaagttcagtttgattaaacatccgaagaaaagtagcatagctacatgttggtcatcttatgagggaagattagctttggtaagttccattgcttctggagttagcttatggattttggaggatgctgataatcacaaacaatggatatataaacattttccttcacatcgagaattcatcaaagagagatggaagttgaagggtgttactcgtactggtgaatttatttacacatcttacagagcttatgtacttaatgttgaaggaagggttttatatcaatggttccgtattttgtatgttgatcccaagagaaacagtatgagggtagttatgcatggaggaattgcagttgacgatattaggcgacttgatgaagttggatatgatcttatgaaagacttgactgtcataccaaatcacattcagatttgaagctgatcttaccatgtcgttgtaagagttttcttcatttttcttttcttaagttctgcaaattttgtgatgatttttgaatcattgaatcccattgaggggtttttgtcttgatttaagaaattccttataaaatcgtggtagtgaagtaacacctgactctaacgcaagaacatcactgaaatgtgtagcttagtcttctatattggttacatatatagtcatctaatgttcttgaataaaaatacctcatgagcagaactccaggtcatatttttcttaatcaagagaaatacattttgttatgatttgataagttccttaatcccaacatgtttttattgtgtttggaagacagtttgattacctaagtttgtaggaggtctaggcctgaaatatcactttcatgtaataaactagaacaaactattttatcaagatggaactaatatgcactttaatattaatacataatacttttaaaaatggtgaaaaataatgagcttatctaccaaaaaacagaaccagttgtttatgatggccaaaagtgtcataattacagtccctagttgctctcatgtgtctttcagatttccagctcttgaaactttgtcaatgtaccaagtgagatgatgatgatgttatgttttgtgaattgtcaacaggtcctgaattggagcgcttgttgaaggagctgatttggactcagaatcaactggatgaaaaaacagtctatgtgtatccacgcatgaatgatttttccactggccagctcatataccgaccagaatgattcttcttccctttcagcaactaacggctctgcaaaagggaacatatatagtgatatataactgatctgtcgcaagaacatgatgaccatttcttcctagtgagtattttgagtgaggggggagtttttagccttgctcttatgatttagggattttcttattcatgacaatattggacccctaggtagtactaataacaagagagggtttttgttttcaaatgttggtttactggttaggcttttattctccaccatggtatggttcctataaagctacataagaattcattttgaagtttgtttggtgtgtgaccgaagaaccaaaaaaaaaaaaacagttgctcattctttgtctacttatctcactattcggcaatgcatatacgtcctaatctttgttttgcttatcttagttattctatctctctcccttacctaaaaagctggcttcaaaggacttgacggatcgtttataaaacagactagtcataaacatagatttatattcgagatggcttcaaatacgaatcttaaactgtttatagtatatatagtatctaatagctgcgggtgttgtgaaagggaacttagtgttgaccatggtcatggagtttaaccaagaagtttgttgaaccaaggattcacacaatagatttgtttagagagggaaaacaaatctagtaatttctcttcattaggtattctatccaagactcgattataagaggggttctaatctcttatgaaatacattagggttttgctcaagaacagaaaaagaattagagttttaaaaaggtatagctgcatccatgatggattgcctacgtaccctgtgaagggatcaagccattcgtagttttcaataggtataaagttctatgtttcttgtgaatatcccaagatctccccctttttgtgaagtccctaaggcactttatataggatccttaaaccgcctccctagcgatattcttcggaagattcttatttatccttaggtcggttctagaggataatcgtcctaaggatattctccttattcttcggaggttttggggagatttcctgatttcgacattatcttcaaagattctcctttatcatttctgaaagtcccataaaagatcccattttaccggaaatgatccttggagaatgaatggtttttacaagtctttgcctcgcgtgttcttcacggctcggtggtcgtttgagaggtggcttcggggcaaacggtatgtaccggctcggggcgcgcttgatgactgtccattaagctcagttggctgtctcccgagccgatatagatgtttcccgcagcgttctcacgattggttcgggctgtgttcatatgattaacacccgagccattttacaaactctcttcgggacggtcgatcgaataaggtcccgaggtgctttgttctaggctaggggccaatcatatgtttaaccatgaggtgattgttattcttagactgtttggctcggtcttgcttgtgggggaatccgaccccaacaaagttgtaccttgacggaagagagcacgaatg

SEQ ID NO: 6104 - DNA, 3000 bp, Unknown
  misc_feature (1)..( 3000): cDNA_ID_2138885_gDNA_ID_1620845_Annot_ID_170179 3000 nt of promoter + ATG
tcttacgtattagttataaggatagctcctcaaacatctttcaaattacttgttttcttatcataaatttcgaaaaacttagatatatttaatctgcatattcatttagtttatttcataataaacgtctaatttttaggtaaggaatatgtgtagcatgtttggattttatgatcactttagccactaagtggatctcaaaattaaaaagaatatattgaattaaaaagatatagaaagaatgatggttcaagttctgactaattatactctcatattttagttgttatgttgaattaattactaattatgtattagttattttatgaagtctaggtggcaagctctcatgtgctgatgtgtcaagttgtgggagagagttaaccttctttcatatatatgattaaaacatcaaccactagatttttatatgattgtgatgccccttaaaactttgatatatttagcgccttggatttatagatcacatgtaactggattctgaaagctaaagtcgtgagtttttgtgtagaatttttataaaaaacaactttaagaactttaccccacacacaagctttagaaatcattacaacgcttgattagtgttgttgtagtcaacatatgtcattatatgattaagtataagaactagatatgcaacgagattcagaaagttaagtcgtatatgtatttgtgtagaagctccaaaaaaacttctataacatcacccccatccacaaagctaagtaatcatacaacaattcaatcattaagcatcaattcaatccatatcatatatatttatgcataagtctacacttagctaatatctcatctagaagctaacatttaggcaaccaaatcaatcaaaaactctagatctacaaacgaaagaaaataaacaacaatcaatcttgtttagatgagttccatgaactacatgtaaccacatgaaacacataaccctaattcacattggtctggatgaacgagaaatcgctacccttgaccaacccgatctcgatctgcctaagctttctctgactcgtactaatgatggatataagcttcagaccaaaaaaaaattagaaaaatattctaaaaatattctaaaaataataaaagactaagggcgggtaacacataccgattatccgactaacttgactcttagctatccgactaatgataccgaccaccacagtttctctgacgaagcttaacgacctaattagtttgcttatacgtttaagttataataaaatgatgcatgaaaaacagtattgtttgtataaaaatcaaataatataaaaaatcatataaaagacaaaaaaaaaaatagactaagaatatcaaaaacttacaccttattacaaactgtacacaatcaatcataattttataactaaaaaacaacaaaaagtattatatacaacaaattcatcggtttatacaaaaagaacaaattattaatcttgcagtatatattgaattatacgtcttttaaataaaagtattataaaaaagaaaaataacaaaatgatatttagttttacaggatgggttatatggtaggacagattttgggtcgaaattagtttgagactgtataccatgggtaaattcttaaaattaacaatcaaaatacaatttatacaatcttaaacactagacaaaacaactataatttaaaattttgattataaaagatcgacccccagtgtatccacaatcaaacataagtttataccaattaaattaaaatacaacaatatcataagtttataacaaaaaagatatatatatatcatccggtgtacctttggtcaaatcctgttattatgtaagtaagctaaacttttgatattattaatttgtcttaaacgtcatactcaaacacgacgattacacttaaatcccccattaatctttgatattaatatatatatatatatatatatatatatatatatatataattacatattgttatttacgttattatttgttttacgattatatttattttgggtttttatgcaaataaaagggtactacccatatttaagttccaaaattgaaaaatattatcaattaattgaaatttgccactattttgcaaatcacaattatacaatatgtcaagctctattaataattttttttttttcagtcgaatacggataaagaatttagaaaatattttaatatattaacaaaaataatcaatagaattaagattaatagtttaatatattgaaatttccgttataggaaaaggaattctcaccttttttatataattttttttaacttatgcatatatttttttctgatagagttatacagcttttcttatatttatctttaaatatattaataaatttagatttgagacatgatgatatcgtgatcacatgagttagcaacttgtaaaattcaacttataataagatggtcacattaaataaaaacacatgtatgattagaaatttccattttacaacctaaattatatgtctcttttataacaataataataatgcgtctgttaaaaaaaaaagcgtcttttacattttataacccttggtcttctctaacttgctaaattgagtgctaaaacaatattcgagaagcattcttgtactcaccaaaatcttcacatttcttttgtttacaaataaacgtactaacaattcaacctggaaatgttctgaaagaccattagctaaacccaaaaatatatgcacgaacatagatcattactttggtagttacaacttacaacttagtagcataataatttaataaagtactactggttacaactttaaaaaggaaaaggacatcttttactttattaggacagctttttgagttgtaaatttagagcccaacattggattcctcttctttgaccattcctctctacctgaataacccgttaatctctctctgtccctttcttcttcttttttcaagaacaataaaaaaatg

SEQ ID NO: 6105 - DNA, 3000 bp, Unknown
  misc_feature (1)..( 3000): cDNA_ID_3076533_gDNA_ID_1620845_Annot_ID_170185 3000 nt of promoter + ATG
aacaaacagaacatcttgaagatctaaagaagagcctaactgaacactgccttgttttgtagcggttgtaaaacgtccatcaggaagtttaatcaaaacaggaggcatatcacaaacattacggagaaatgcaagagaaccagtcatatgatttgtggctccagaatcaattatccaagattcaagaaaatacttaccagactgatgatcatttaaggtagatttccgttcctcaagaatcgtttgtaaaattttccattgtgaatcattcagcccactaagtcctatgcgatcatctgatgtcaatggagaagtgagcgatgaattcgtaacaacattggcagccattccagaagaagcgacatgattaatagaagatccacgaccatgactctgttttcctttgaacgaacttaaaccaccacgtgaagaagatgcagtgtttttaagacgcaatttttcttcgagccaaggaggatacccgattaatttgaaacattgttcggcgagatgaccaacacggccacaattactacagactctgttttctgaagaatctcgaggtcgtgaagtagtttggaccgcgaagctaacaccgtcaaccctctcgttatgtaagcgactcaaggatttggattcttcgtcttgtgtcaaagcattgtaagcttcctcgagagaaggtagtggcactcgagagagaagagccgacttgacagctccgtacacagattcatcaagtcccataagaaactgatgcaatttgtcttcttcacgttcttttctgacgtcgtccatggttttagcttgttggtaatccgccaagctacaccacagttgagagagacagccgtagtaagtttcaatggccactcctttttgacgacaggttgctaactctgttttgagtcgctgaacatgttgtccattcttgacaccaaagcgtttctgaatgtgtgtccagagctcatgagaatcgtcgagatgagacatagatgtggaaacagtttcatcgatggtgagcttcatccatgaaaccacaagagcattgttggcagtccaatcttcgaaatcgggatctgtctcaactggttgtggaatagatccatcagcaaacccaaatttctttctagcttttaacgccaaacgaagatttgtggcccattcgtcgtagttgggtccacgaagcaacggtttggagatgagagttccgggattatcaccggatgtgagatcatatggcgagattgtacgccttgtttcagtcctagctggtgtggtggagctagcgagagccaattcagtactcatgatgaacggagagtttgatgcaagtattaagtagagaagttagaaggaataagaaagcgatctcttatagcggaaggagagatcacagaatcgatcacaaaaaccttttagtagttaggtattgtgctctgataccatgtcaagaatcaatcgaggttgtgaaaagaagattcttattgattacggcaagaggcaatgcctttatatacacgataagtttagacctagttaatctatacaatataaatgggctaaggccacacagcccaacatatattgctcataaacaaacttttcaattgaggcaagtctcaacatgttttgatcaaatcgacgcttttctaaaccactttgttttctctttttgcatcgtgaaccttccttgatttggaccaaacttggaatataagagataacatattgtttacagtttccgtctacaagattcagtttttctaagtatccatcctctccgacgatgctaataaatgttttgagacaattagagtcggggtcaaggtttctaccgaaacccatgaagactttcttctcttcgtctacgaagaaactatgtgatatctttatcttaggtctcgtatcaattctaaataacttgctccacgacaccgtttcggcatcaatcttagtcgtaatccatatctccaactcagataacgctgaaataaagctgcaagcttctcttctttaacacaagataaagtcacatctacagcgctgcacggtagagggagaagcggcccgaatctctctcttgtaaaatcaaaacagataatgtgatctttgtgaccctgtgacctcctttctttagcacaccagtaagtgtttcccttaatagaaacgccactggaagaacaatgtacaccccagtgtggagtgacatcaagagttgtctataaacccgagtcaaaatcatagatttcataccaaaaagattgtgtttcgggtgtattgtagaaataatctagaaacctcaggaacttaaaggtacgacaagattccttatcttcgtatccaagagcataactaaacctatcaaatccattcggaggttgagaatatcggaggttgatccaccttgtatgcccccaatacggattccaaaccaaaaccctagtaacgtcgtctttcaagatgcataacaacaaaccctcaaagtggaaaatattagatatactcacttgattgtgaatgaaaagttgacctttaacctctatagatggatcaaagtcgacgacaccgctcattaaacaaagtttgtgaggcatcatcatgatcatcatagtctctccatctcttgttggtgttgtcactttaccaatgtgcatcttcgtaaaaccctcacttttggataaattgttccaagttttgcaagttaatctcaccgctttcatagatttcaaaggaaccctagaaatgatctcctcgatcaaatcccttggaagattgtagatcatcgtcgtcattgtttcaactttcacaacgaatgatttcttgcagcttagggaaaggaaaaaggtatacacgacgacaaattataaccctaaataaatttgggccactagtgggctttcagaatctaattgggcttaagcagacccaatttgtatctggcgcgaggttttagtttctgcggaggaggagatgatcgacgattcgtctcttacggcggag

SEQ ID NO: 6106 - DNA, 3000 bp, Unknown
  misc_feature (1)..( 3000): cDNA_ID_2138932_gDNA_ID_1620845_Annot_ID_170191 3000 nt of promoter + ATG
cttttgcgttgaaggctttaagtgatcccacttgctcagcaaggcttggcacgattggtcgtggatgtttgcctccaagaagagacgccccattatagtttcatctttgcttatgagtgatcccaaaactgaatcaagcaaatcttcttctaacggtgtagtacagttttcaacctttagagagaaatgaaaatacagacttctgtcagaacacaaagatactatgtttccagctgaaatgatgaaaagtagcaactaatagatacatcttctgactaatgttgacactaacagatctttctaatcttcatttgtttgataaaatatgctacatctcaaggatacagaaagataaatcatggatggaacaagcaatctctcaagcatcatagacaatcaaacacttatcaacagcctttatccacctcaagctatcaaaaacgcctaacaatactgtatatatgaataatatgaaaaacccatttgatatatcagaagaatccaaagttttattaccctcagaaagcaaaacgatatggactgacaattataaaaaccagaaacataatgtggactaccattagagtctctctattaagtgcatctactggataatatcaacaattgtaagactttctgcaaaggaacacaacatggatacttatgaaatgataatacagagttctgtcagaccacaaagaaactatattgaaatgattataagtagcagctaatagatacattttcttactaatgttgactctaacagatctttctaatttctatttgtttgataaatatgcacctcgtattagtaccattaaacattggatggaacaagcaatctctgaagcacatagacaaccaaaaacttatcaactacctttatccacctcaggctattgaaaacaactaacaatagaggatatatgacaaacccatttgatatccacctcaagttatcaccttcagcgagaaaagcgatatggaaggacattttatatttcatagtactaagagaaacttaatgtggactagcatagtctctctctcaagtgcatcatatctaccattctatgacttttctgcaaagagactcaatgagaagtcaaacttcatgagaacttagataaatcaagttgtcaacttaacaaagaaaaccaaatgatggtaccccatgtgctaattaaagagtagagagaagacaatagcacttgagtaaccatttcatcaagaacaagctaaccaaactataaaccagcaagtgcaaaaagcaaactaatttactcgagggcaatgcaattctaaacccaacttaacccaattaaagaaaatttagggttaatatgaagaaactcttacttcaccatctccgatttgacgcttaaatctctgcatttcctcagacattcttccaatttcatcctccaattcacgaaccctagcttctgcttctctagctctctcatcagattcattcccaaactccatcaacgcatcacgatcttgatgataaagcaaacactctttctccaatttcttacactgactcaacaaattcccacactcactagccaatttctgattctcttcaacaaacttcttcaacgcttgcgcattcatactcgcttcagacttataaaaaaaaaaaaaaaaaaaaagattcagattcaaatcaatcaaatcccagaaaacgaaagatacccagaaagaaattactaaccctaacacgatcgattacatgatctttctcctttaatcgcgaaatcagaccctgatactgttcgcgaagacggcgttgagattcttcagccgtataaagcttcttctgaagagattccatggagatcggaagacctaaagaatgatcaattgtatctttgatatattcttcgacttcttgcgagagatttgttctcgattttgtttctgcttcatctgaatcaattctctcgctccgcatggtttactcttgaaacaagatttggatttcaagaagagaatttagggtttcaataggaagaagaagaaaggggaattagtaaaagagacggaagagaagaatttcaaaaatgaaatcagaagtttgtagccgttacaaaagttattgcatcgatcgattcgtgcctacgtggcatgttttaagtggcggaaatatttggctcctaatgcaattttttggttatggtttttgggatccggtttggtttattttgtcggttttacttgtggaaaacttttttttttctctgttcggtttgacacaattcggtttttgttcgagttggttttttatttcggttttgtttttgtttaaaaacgtattttaaatatcaacaaaaagtgattacctaaaattacaatttaatgtcattatatcaaacaaataattatcaactaagtaattatttttcctctattttcagctcaattttttttattggtttatttttattttttcatcttgactagtattaagcaaaagcgtatcattcaattatataattgtatcaatttccaatttatttctatataaatttttcattttttgagtgtactaggataaaaaaaaattatatcattgggtggaatgaaaccttaatgtttcatgactatgcataaaaaatgaacgaaagatgagaagaaacatgaatcaaacctttatttttatttagatgattagatgagatatatacattaggaattttgattcgttcagttaattttgttcagtttcataaaatttaaatttgatttaaggttcagttccaataattctatttataagattttaaactattagtattattcgaatttggataagttcggttagattcattcatgttttcaccactcatttcctaagaaaacctttttaaaaacaaggtcattttaagaaacacataattttacacgaagtcgttttaaatgaggtagtttaaacgaggtcgttttatcttagtaaaacaaacaaactcctatgcttttctctatataatg

SEQ ID NO: 6107 - DNA, 3000 bp, Unknown
  misc_feature (1)..( 3000): cDNA_ID_2106758_gDNA_ID_1620845_Annot_ID_170192 3000 nt of promoter + ATG
aacgaccttttcgacatagcttcttgccatatctccaagaactcctccatcaatttttttgccattcccattgatgatataggaagatactccacctaaatagtacacacacataattataggtttcaaatgaaagtagtgcataatagcataatggcataagttgatagcactaaaaattcgtataatgaaaacttgttgcatggaaaaccgtagattatgcaaattttcttaattgacaaattttctgcctaatcacattagaaaccgtcattatgtgtgttaccaatcatagctaataacctttagttactgagttacattacaaactccaaattatgaattaactagagtgttagataatcattaacattgattattaatatatctcaacgtactcaaaagatataaaatttgttacctccatgactacgcctctaatggtctcagcatgagtaggaacaactttaccaactctcaaacgaaaatccccaagttgatactcaagcccttcaaagtaaaacgagagtttgcatttgtaagactgaaggctctccatgatcatttgaattgaagaatctgcttccacgacgatcctttgcgacctgatgacgaaatagtacttatctggctcctccggaagcgaaattcctacaaattcacgcgggaactcagcttgattcgcctgatcttgcaacatgggtttgtaatagttgagagtggctttccatgttccctctttgacgccattgagactctctatgctttgtgttacttcgtttaggatttggctgctaaatgttgatccctgatttggttgccaatgcaaaagcctggaaaagtattcccccaaagaaatttgaaaaaaggttaacgtattataaaagaaattacaataatggttatttagtttatgtaatcatcaaacctaccatttgacgggcatggctaatggaggtacaacaaatttcacttgacaacaaaattaaaaaaaaatgatctctattaatttacaataatacacaaacaataatatcttatataatatagttgtattcagatatataatttaccaaaaaacaaaatgataaaactttacaataaagcaaaaaattatttaatcaaaaaatactttttgatagaatttcaatcagtgttcataaggaaaatacatttaaatgctcaaatggagttcatttttttaatcatttctttcatttgaaatagaacgtggtctatatggaaaggaaaatttatttttaaaagtaatttacagaccaaaaataatacatatgcatcaactttggaatcataatacaaatttcattttttaataaataattataacatagagaataattagatattttagtgcatgtgcacaattacataagtgtactcacccttatcaagataaaagggaagaaaatataaattcttataagaaaaaaataaagtaacttttgactttaaataaaaaggaaacaaatctaagaaattaatgttataattaaattatttaccaaaattaattgaaaaataagaaacatttttttacaaaaactaaagaaattcattagatctgctatgagtatccgtttgggatcacacgttctgtgatagtagtagatcgacaacagattaactaaacgaatcaaatatgaaatatatcacttcttgaatacaatctaaatataaaattcatacatctcggataaacaactcaattctgcttctaagtatatttagtttataaaacgatgctttttatctttatcttatctaaatcattttaaaaagatgagttgaaggcatagtaaagacttttaggcttaataatcatcgagccataaaaacaaaatacaagattagattgcgagaaacacttaccgatgaaagagatttctggtgatgatcttcttgggaatacgtagtataacgaaaaattaagactcgtacactgcattatatagagaaaagcataggagtttgtttgttttactaagataaaacgacctcgtttaaactacctcatttaaaacgacttcgtgtaaaattatgtgtttcttaaaatgaccttgtttttaaaaaggttttcttaggaaatgagtggtgaaaacatgaatgaatctaaccgaacttatccaaattcgaataatactaatagtttaaaatcttataaatagaattattggaactgaaccttaaatcaaatttaaattttatgaaactgaacaaaattaactgaacgaatcaaaattcctaatgtatatatctcatctaatcatctaaataaaaataaaggtttgattcatgtttcttctcatctttcgttcattttttatgcatagtcatgaaacattaaggtttcattccacccaatgatataatttttttttatcctagtacactcaaaaaatgaaaaatttatatagaaataaattggaaattgatacaattatataattgaatgatacgcttttgcttaatactagtcaagatgaaaaaataaaaataaaccaataaaaaaaattgagctgaaaatagaggaaaaataattacttagttgataattatttgtttgatataatgacattaaattgtaattttaggtaatcactttttgttgatatttaaaatacgtttttaaacaaaaacaaaaccgaaataaaaaaccaactcgaacaaaaaccgaattgtgtcaaaccgaacagagaaaaaaaaaagttttccacaagtaaaaccgacaaaataaaccaaaccggatcccaaaaaccataaccaaaaaattgcattaggagccaaatatttccgccacttaaaacatgccacgtaggcacgaatcgatcgatgcaataacttttgtaacggctacaaacttctgatttcatttttgaaattcttctcttccgtctcttttactaattcccctttcttcttcttcctattgaaaccctaaattctcttcttgaaatccaaatcttgtttcaagagtaaacc

SEQ ID NO: 6108 - DNA, 3000 bp, Unknown
  misc_feature (1)..( 3000): cDNA_ID_2138913_gDNA_ID_1620845_Annot_ID_170186 3000 nt of promoter + ATG
aaaaagaaattcacgaaagattttataaaattcatgaaggatttaagaaattcatgaagggtttcaagaaattcagaattaaacttttttttttttgtaacccttccttaatttcatgataatttttcatgaattttgtaaaatcttttctgaattttgtggaaactttcaaggaaatttaggaagacttctacaaaactaaggaagggtttcacgaaagatttttttttgtgaaatccttcttgaattttgtaaaatctttcttgaatttcgtgaaattttttccagttttcgtagaatccttcctaaattttcttatgtggaaaaaatttgacggaatgttttgacaaaaattgtttttggcgggaaagtttttacggaattttttttggcgggaaaatttgacaaaaaaaaattcacggaaaaatttgaaagatttttttttcacggaaaactttgactgataatttttttaattaggtgctattttaggaagaaaatgttttgagtgctatttgtagatattttcaaatgaggtgctatttttggaagaaaatgttttgagtgctatttgtagatattttcaaatgaggtgctatttttggaagaaattttgtgtgctaattgtgtcaatctttttttttttgttaaccgatattaattagagctcaacaaagtcaattcacgtaaaatgttgtttacatatgtgatatattgtggttcaatataattttttttgtgcaaaattatccgtatttatatttgcactatgaaatattaaaggtaaataaaaacttatgaattcttctttattaattccttcaaatatactgagaataataattcttgtaaactagagaaattttaacattaacctatttttctattttctttgggagtttcctattaaggtaactttaagaatagaaactagttatgtatttaaaacgatacaaactaggatatctaaattgtattaaaaagattgtacattcaaaatttgtatacgagatcttcaaattttgtatataaacatcgaattatataaaatatttttaataactaaaaaaaaatatttgtatctttggcggtcaactaaacctttttttatagcatatatatatgatatataaagtttctttatgatataattatctatctaacatttaagattgtattaaagtttcgaattttatgtctacgtaattttgtttcctttcattttatacacaatgttgtattgtttgtacatgaattcttttcaaaataattttttagatatcattcatataaaatagagctaatgagataataaattaccttgaaggcttgaacattgtcgagacaaaagttgaaaacagaaggacaaaagatcactgtcaaataattattaatacatcagaaaaataattaaaaacgataatattgttttcagtattcacctacacataatatgaatatcatgtttacatatttcgaccttttttgatcggttctaataatctatatctcaaaactaaccaatctcatctagattccgtcaaattaagtttagtctataattacgaaactaaaaaatattagcaaatgggaaagtgctagagtcattgcactagtttattatgtgaaacacgaagaaacacggtggcgcgtagaaatcacctagaaactacgaagaagacgtgaaccccacgtctctctttcttcttcttctttctctatctcttcccattacaaaactcaagaagatgttaaagtacgaaacatgtcatacttcaaaagaaacgaaggaacaattgtgtttgcgtttgcgagcatcgggttcatagcgttttatatcattaattactacattcggcgatgcagaaaccgtgccgcagcagccggggacattgaggaagctcgaatgagtccgaggaggccaccgcgaggacttgacgctgaagccatcaagtcgtttccttcattcgtttacacggaagctagaggaattgagccaggaataggcgagctagaatgtgttgtgtgtttgaatgaattcaaagacgatgaaacgctgcgtttggtaccaccttgtgtacatgtgtttcatgctgactgtgtagacatctggctttctcatagctccacatgtcctatctgtcgtgctaaagtagttccttaatacgagtctcttaattagccttttactatgcattttgcgttacatagttctccctttgtaaataaattatctttatagtgttgatattttaccaaccgtaatgatgatactactccatggaaggaaataatctacaaaggaattgaggcatattgaattattcaatgtcatgatgatgatgatgaattagactagaaaatgacaaaaacatagtttatctctttggttacttgttcatgtattacacactaaacacatctatttggctttggagagggaccacctatcatgctgtgtacaacaaatatgtatatatgtaagttacaagttaatgaaacgttcggatatatagttatataccatactttgaaggctttaattagttactcatatgatgtaaacatttgttatggtgcgaataatctagcaccaaatacataaaccttattggtccgtcacattccattgagaggacgtgaacatcagagggatgtgactgaccaataaggattaggtcaaaactgttggaaaagtcttgttgcgtagatcaacaagttaatagagagggcatgagtaatgtagtacttgttctacgtctatagtgacgtaaagacttcttcaaaagtcaaaacgttagaggaagaagccaaatcaatcattccgaccaaaactaatctaactaaacatagtagtaatacaatatgtattgtcgtgacgagtacaaaccaaaatgtgtttagtattataaaaacggcttgttcgtattctcttctctcgctcaacacatgaagctcaagtgatccaccgtggttagcaaaaggacggttcacatcatg

SEQ ID NO: 6109 - DNA, 3000 bp, Unknown
  misc_feature (1)..( 3000): cDNA_ID_2138897_gDNA_ID_1620845_Annot_ID_170182 3000 nt of promoter + ATG
gtaaatgggtgtttcgtctaaaatacaaatctgacggcacacttgaacgacacaaagcacgtttggttgttcttggtaacaatcaaaccgaaggtcttgattacacagaaacttttgctccggttgcgaaaatggtcacagtccgcgcttttcttcagcaagttgtttcacttgactgggaggttcatcaaatggatgttcacaacgcgtttctccatggtgatcttgacgaagaggtatacatgcaatttcctccgagatttcgtactggtgacaagacaaaagtatgtcgtttacgcaaatctttgtatggtctcaaacaagctcctcgttgttggttcgcaaagctcacatcggcattgaagaactacggttttattcaagatatttcagattactctttgtttatctttcacaaaaacggagttcgacttcatgttttagtatacgtggacgatttgatcatcacgggtactactattgctgtgattacagagtttaaacattacttaagctcttgtttctatatgaaggatcttggaattttgcggtacttcttgggaattgaggttgctcggagtcctgaaggtatctacttatgccaacgaaagtacgcacttgacattatcacagaaacgggtctccttggtgttaaaccggcttcttttccattggaacaaaatcataagcttgcttttgccactggtgaaacaatagacgacccacttcgataccgtcgtctagttgggcgcattatttatcttgcgactacgaggcctgaattatcatatgttattcatattctctcacagttcatgcataatcctaaaccggctcattgggaagctgctcttcgcgtcgtcagatatctaaagtctagtcctggtcaaggtattctcctacgtgctaatacacctttggttctctctgcctggtgcgattcagactttggagcatgtcctcattcagatcgatctctcaccggttggtttattcagttgggtggctctcctttatcttggaagacacagaaacaaaatgttatttcccgctcttctgccaaagctgaatacagggctatggcagaaacagtgagtgaaatcatatggatccgtgaattacttcccgctctcggtattccgtgtactgctcctaccacactccattcagatagtttatcagccataagtcttgctgctaatcctgtctatcatgctcgcactaaacatgtgcgtcgagacgtccatttcattcgcgatgagctcgtcaatggcactatcgctactaagcacgtctcaaccacttctcagctagcggacattctcactaaagccttaggacgaaaagagtttgcagactttcttgccaagcttggtatctgcaatctccatataccagcttgaggaggggtgttgggctgtgtggccttagcccatttatattgtataaattaactaggtctaaacttatcgtgtatataaaggcattgcctcttgccgtaatcaataagaatcttcttttcacaacctcgattgattcttgacaatatatataactaggaggaggcgtaaaaggagaaaacaggtaattttttgctcttgtacctttgatatttttactgaaagtgaagcttatggtgattacacttgtggtctacaggagcagaacattgagagtgggtcgagtattggaaacgcttcaagatgttcttggaaccatatgggacttcttgcattgtgatgcctaataaagaaccatatgatgatgttgttcgtattgttgggtttctcttttactttctgttgtctcttttgtagaataaataatgttttgggtaatgaatgatttaacttgcttgtgaccaaaaaaataaaataaaaatgttgttttgttacgagtcatttcgattgcagatacaatgtaacagtcttcacacattgaacaaaacaaaacctaagttaaacaaataactgtttctttaagtctttaaccatgaatctggcctttattagtaaatagtaatagtggttattgtaacatgagcaacatacgtcatactagccaaccaatgtctctcttcttaaactcatcgaactaaagagaggtcaaatcctcatacttactcggcctcgatgtgaattcacgttataataagaaacaaggaaaacacaaactaatcattttcttagtcctaggtgttcggttttaaaatttagtatcattcaagtattttgaaatcttcattttggtttggatccggttcttttgtttttaaaatttagtatcaatttggttatttttccttggatattttgattatttttgattattttcggatatttttttgttatttttgagtattttactttttctatttttattttaaaatttttgattttttgatcaataaataattaatattttgggtatttttggttaccaaaaatatttcagttcggtaccaattataatttttttttgttatataataatatagtatacatccaattatttttaaatttttgattttgttcgattctttttgcttcggttccaattcagtagcttcgattcagtttaattgcctagacctacattttctattagaactgacacaaaaacaaaattggcgtcgcttataaggtctacaatatatggttggcctctggcccaatagtaagcccatatattaaccgacgtcggtttatagccccgataaacacaaacaatatagataagatagtttcttctacttcaaaaaatggatgctttcagaaatttccagaaattacgggtccaattgagaaaaacgcgtatcgtcgtcttcttcatcaaaagcgaacaatttcgaaaacaaacctaacgaacaaaaatcaaatcttctctctgttaaaatctcaccgactagagaaaagctttgttttttccaattaaagttacattttttgtttgaacaaatcactttctgtgatctacatttgtgtggtcgtgaaatcaatg

SEQ ID NO: 6110 - DNA, 3000 bp, Unknown
  misc_feature (1)..( 3000): cDNA_ID_2138881_gDNA_ID_1620845_Annot_ID_170177 3000 nt of promoter + ATG
tcaatatgtatatgaattactatcttcacaattttttacaaaaagctaccactctctctatttttctgcaatcactcgttttatttgttttattttttcttacagtttctctttccatcctcttataattttgtctaaacaatatgtgccataccttctaaacttttcatatgctccatatttcttcttcgaaaatctcttacttttcttgttagtataagcattttttaagctcgtcaagatgtactctgttttgttttctgttattctaagaaaatgttttaccttctaaactggtacttaactctatcacttttctcttttgatgcagtttagatccttttcaccttcacgctttccagactgaaagacctcaatttatatcttcgagaatttgattcaaattgatacgattaaaaacaccactatcaaaccacgtcattgttacgtttctttaagttatattaaaaaatgttggattagttgtataaaattctagaaaaattctttctaatgcccttttcattatgcccctttttaactttaccctttttttagccattttcatttttaccctctttagccattatgaccattttacccctatttgaaaattgttttaggttaacaaaataaaatattaatatttttcgcctaaaatatccaaaataaatttcccgccaaaaaaattcgaaaaaaattaccgccaaaaagttttttgtcaaaactagttttctcgcaaaaaaaatattttttggcgggaaatagatttacaagggattttaaaagggtttaaaaagatttacaagaaattttaaaagagttttaaaagatttacaagggattttaaaagggttttaaaatatttacaaggattttaaaagagttttttaaaagatttacaagggattttaaagtgctttaaaagatttacaaagcttttttaaagatttttaaagggttaaaaattgttttaaaaaggttttaaaatatttacaagggattttaaaagagttttaaaagatttacaaggtattttaaaagggttttaaaatatttacaagggattttaaagggctttaaaagatttacaaaggttttttaaagatttttaaatggtttaaaagtgttttaaaagatttacaaggtattttaaaaggatttcaaaagatttacaagagatttttaaagatgtacaagtgtttttaaaagatatttaaagaatttacaagaagaccctttaaaaactcttgtaaatattttaaaatcttttaaaatctcttataaatctcttaaaatacttttaaaatctcttgtaaattttttaaaacccttttaaaatcccttgtaaatattttaaaacccttttaaaatctcttgaaaatatattttttcccaaaacaattttacaaggatttgcataatcatttttttggcgggatttttctttttggtgggaaaaaagtttgccagaaaatttttttggcgagaaaaataaatttttggtgcaaaaatttggtgggaaaatttcagtttctaattacatgttcctattagatgaggataatttggtcattctgttcaagggaaatggtatttttaaaaaaggacaacataaaaagatattgttgcaaaagggtagtaaaaaaagagtagttttgcaaatctcccaaaattctgtaagggtttaggtttaatattatttaattataattatattgcttccttttttataagtttaaatttaatatttgttattttcgttttttattttaaattttaaaatggaaagtaattattatttttaaaaatgttaattaattagatgttaaatatgttaattattgatgtgacagcttccgattagttgttttaaaaaatgttaaataattaaatgctaaatatgttaattattgatgtggcagctttcgattggtcgttctaaatcctatgtggacggctttagaagcaaatagcctcaacttttatatagtatagattttcagtttttggtgttcaatttttcgatcaccggttttgatgagattgaaaaactctgtgggaattttttatggccgggcaacccgaacaccacacgagttgtaaaagtgctttcaaattattttatttattttataaacatttaaatcttaaaaataatatatgagaattaaaattaataaataaaattttaaccataaattaaaaacgaaagtaacaaaaaaaatttaaaaaatgaagtaatttttttttaagattgtaatattttttttaataggatggttttttattctttactttttttcaccagcgaccattttattaagttaggagaactaatccggagtcgatgtacttacatgaaaaagaaaaaaaacttcgtgttcttatattttttgttaggcaatcaacacagacattgttacaacagagaataactctaatataaaataaagacaaaaaatttcaaaagcttttttaaaatattgtaattcttcaaaagcttttaaaatgttgtaattctacaaagcagctcaactaaataaaagttgcattttgcagacatacgaagtcgctaatttttcacatatcggaattggaccgagaaggtggaaactacgcgcctccatcgagagtggtgtaaaccataatctattacataaaaaaaaagataacaaaagagacgttaaagcaatgtttctctgttacgcgctgacgcatctctaacctttttaggttctgtactatctttatcttttagtcaagtgttagaaaagtatcttaatcagacggttagggttctttattattactagccgcaatttttttattgaaacaaataaataaaaaaataacccaagaacaacaacaatctggtctgctgatgtattaattaaagaaaaaaataaaacagagcaagaaacaaaaaaaaaaatgtaaagaaagagaaaaaaagctttcgtagtgtctattgaaaccagagaaaagccaaaggggatg

SEQ ID NO: 6111 - DNA, 3000 bp, Unknown
  misc_feature (1)..( 3000): cDNA_ID_1830057_gDNA_ID_1620846_Annot_ID_50933 3000 nt of promoter + ATG
tcgaaccttgccttgtttactccttcttcacttgctagtaaagcacttgtgttcgcctttatccatctcaatggaaaactcttctgcatcatcttcatatccagtatccttcttccttgaggatcgttgatgagacatctgttgtcttcaaataagactctgtatcccttggataccatttgagaaacagtcaacagatttcttgctaaacccggcactagaaacacctctttgatgatcttctctcattggcttgtcatcacttggatatttccttttcctgccgtcattacatgttgaccattccccactttgatcggtacctttacactttgatcaagagtgatgaagtatttaacttccttggtcatatggttagtgcatccgctgtcaactagccatgtctcatcattcacgtttgatgatgtttcttcttcgactgcactgaacagcatgtgatcctcatcatcatttgtttcttctagacttagatccactcgctcggtccttctaagtctgcagttctttgctagatgtcccggtttgttacacacgaaacatcttctctcattgttccccacttgttgcgaaagaacacctttgttcttcttcatccagcaatcactctcattgtgatttttacgttcgcaaacgtcacaccatttcccagcctgcgtttgacgcttgtcttcacgtttgttttctccatagaacgctccttccgttgatcattcgtctcgcatctctacccgcttctcgtgtgctttcaatgtgcctatcaactatgttacggacaacgaagtcagatccttcgtttgcttcatcatagccactatgatgtcaaatcttttcggaagagaaattaggattttttgcactatttgatagtctgatttctcttctccatgaactctcagttgatttcccatctcaatcaacttggtcatgaaagtgttgatattgtcactttctttcatcttcaaattctcatactcccttctaagagattgaagctttatcatcctgacttgtggtgatccttgaaattccaataccaaggctttccaagtgcgcttgatgcaggggcgattctcggaaatatggaatctgagacggcagtttgaagaatttgcaaagcggttagatcctttaaggatgctgcttcacatcgtgtcttttgttgcactgcttcagggctatgatctccttctgcgggtggttttggaactccttcgtcaacaatttcccacagtttctttgtctggaaaattgttttcatcttgatgcgccaaaaaccataattctctttgttgaagattggagtcacaatgtgtgacaccatctccataactctctcgtgtttattaaactctttacttgaaatgtttggcccttgaatcagtagggctctgataccatgttggaaattgaagcctcttgttacaaagaaaaaacaagtgtttacttgttgttctgtttcttatgagatacacaaagcaaaagagaaactgacttttattgaatggagaacttgttcgtttcatcacgatacaaaaagtttaaatagaaaacaaatagacacaataagtaaagagttgtgtctctttctctctaagataaacgacacaacctaatctaaaagtcacgactctaacaaacaccttttaatacaacataattataacttatagaccaaactcaattataaactaacagatttgatgcagcttcctaatttccaacagctccatgatgtttatcagctcgttgttgtcagaatctgcatcttcataaatttataataaatataaatatataatgtataactgtatgtagaaccgtatattgtggatccgtgaattggtggaagagttgctattgcggaatcgtccaagaagctattcataaaatcaatcacgaaagaaaaagaatttgttttgctattatctctatattgtgggtagccatttttggaatctttgaaaaatcaaccaatacgcattttctctcagtttggaagttaacaaagacgcgttttttcaaggttttgtggggactggggaccaaaagttcttaatatgggttaacgtctcacaggtaataccaaacatttcatttatttgtgtttttctatcactatcttttccacattttagtattttactattacatataatttttgactaagaagttgattgtgaatgagtctgtacatcttcctagaaatgattataagtatattatttaatttgttactccctctattgtcatttatttgtagtttaagtttcaaggttttggcacaaatgaaattatttcgttttttattattatcttttaatatagttaattatctatttaaaaacaattcaacaaattgaaaaaaaagttttgtagaatttctaagagtcaaaaataataaaatttccattaaaaattgaaaacaacaaataaaatgaaactatttgtttttgcttaaacaacacttcttaaaaaacagaggaaccattgtaaaatagatttttcccaacacaaatcgaaaacgtaacttatataatctctatatttttagtaattcagcgacttatcatttcattgttaactatttttcactgacatgtttctcgttatataaaagtctctgtttatgtcaatggtcgtatgtgaatggttcatgtattatgcaaaactgtttatgataatattgccggggaaaaaaaactgccatgtttcatttttttactagttattacatttgattattatcaaccaacttaccattgaaagataacttgtgattattatttacagtaacgaagaaaattaggccatattttgttttctttttggaacctttcaaatgtcaaagctggtaggctatataaatataaacaaagctcaaaaatttattactatacttaacagtaacgaagtagactacttcaagtagtacatcaaaaaaaaaaaaaccaaagaagttgttatctttaacaaacaaaa

SEQ ID NO: 6112 - DNA, 3000 bp, Unknown
  misc_feature (1)..( 3000): cDNA_ID_1830049_gDNA_ID_1620846_Annot_ID_50935 3000 nt of promoter + ATG
aacaaagaacaatccaaaactaatttatggcataaagccttaatgcttattattatcattttgaaccaaatgatataaataacttaaaaacatcccaaacaaatatgaattatatatgtcattatattaatataaattagttgtagacgatagaaataatatattcttattagattaaaaaattctgaaatttagtttttataaatgattatgctatataagtagttttcatttattttttttctgatttctcaagtaattactcgatacaagttagtataaacgcagtcgatccagaaggaccaaagatactctaaggatttccaagactcatttttagctagcgcgaaaaggttgtttgtttggattttcagattgtaaataaaaattgcaaataatttaaagatcaacttatgaattaaagacattgtgctatagggtatttcagatatcaatgaataatgaaaacattagacaaggaattcaaccatgaagcatcgggcttgaacatgaacacaaatttagactaagtctctcttaagacattaatcattatatttaactatgcaactactaaactcttgtttttaattttctagtcaaatccgtattagaattaggttcattcggttcacaatgcattctaacataaactctcattggttagaaatacattgctcaatttacatttgttcagacagtctatcaaacatttttgatgcatagaaaaatctagaatctaaaacagagtgttcgatctttttctagcattaagaacaagtgaatcaaagaacttaaggattaaaaactcaagaaaacaatcaaaccatcaattcattgaatctcctacttagaaccctaaaacccaactaaaggactatttactcatagcaaaaggaataacacaaagagatgaagaagacataatagattactaaacaataaaagaaaagggattagaaatattttccaaagtatcaaagaggatgaatctctagaatcccaataggggaataaaaaattaggtctcaaaaaccctgctctataaaatgaaaaataaaactgcttaaggaagaccgaaactgggcatcaggtagttgcctgatgagatttgcgtgatgtcattccccaaaagatttttaggcaagaaaacgaaactgggcacaagtagttgcatgataaaatttgcatgatgtcattttccaacagagttgtcttgaatcaccaatttttcatttcttctccgaactcttggttttgatacaaaaacgcctccaactccatcattgcttcctaaaacctgtaaagactcaatcaaggactggaagactctaaaaacatactttgactctataaaataatgatttaagaaagaaaacaaagactcaaaaccgataaaaataaaacatatcattttcatcgaaattataagtagttttcatatacagggaaatctttaaaaattaatacttcaatttatagtgattattgatttaaaaaataatacttcaattaatttatagagacggaggttattttaattacttcataaattaataatcactatacaataatacttcataatttataggattttcaaaaatattattatcttatcttctcattgaattatgttaaacattgcaatcttttgctaacatttatgcatcccatgaagggtggcatacattttagcaaaagattgcaatgtgaaggtagttggcatacattttagcaagagattgtaatgtgaaggtagtttgagctcaagtatatatatgtcatgtcattcatgtcttcactagattggactttaatggactcgtttcttaacagaaaaagtagacatacgatgtgtctgcgttacaaacatgtccatgaagacagttttctgatgatgtagacccacaagagcaacattccttataagcccgtgatcgggcatgaaaactgaccccaacttcaaacctaatatctctaacaggtttgattattggttgctcaagaggctgctcatcttcaaccataaaaaggtatcaacatactcaccataaacctcttctagagtagggtaatacttcttatcattaggaagaacaatttggttctcaatctcaacataacatcattgattgtaataatccaaccatccatgtttgccatgtttattatcttcttcatcctctctctctctctctctctctctctctctctctctctctctctctctctctctctctctctctctctctctctctctctctctctctctctctctctctctctctctctctcaagtccgatatagttaccaaacaagctatagtcctctttatgtaaaccatgccgttgaatagctttatctgaaacatcactacaagaatattgggttttaatagcactataatatagcgtttatgtcagtaatgctattgttatgtaaccactttattttaaatagcgtttatgtataatgaaacgctatgatataataaactataagtcacgtgtttattaatcaggttttcaatagcagattttaataaaaacgctatgttaaagttaggcggtaacctaaaaaattagatcccgtacttagaaaaatttcattctctttggcatcgaaaaatccccaaaatttgcagacctaattttcttccctctctatcaatttctctcgatttgtttccctctctatcaattttgctcgatttctctcgatttcttccctctcagtattctcttccaaccaaatctagctcgctcagtcacattaatctcatctccggtttgatttaggaagacgagaagacaatatctagctctctcagtctcatctccggttcaatctcagtcttgttcttcacgttcttcatctccggctcgatttaggtatttcactcttatcctctgttgttatcagatctcctactctattcttgtacatgtttaactggaattctctttgataattgtatacaccgtcggagtgtttgtacc

SEQ ID NO: 6113 - DNA, 3000 bp, Unknown
  misc_feature (1)..( 3000): cDNA_ID_2997065_gDNA_ID_1620846_Annot_ID_50937 3000 nt of promoter + ATG
atcatccaaaagtcgcgtcggaaaaaagtgccgtgtctatgtttgtttttcttttgttatttgttggtttttttttggtgtggtttctatagacttttcttttaaaaaagattacagtccaataagaaattgaaatagtaattgggctaacgtgggttagccagagttacagaaagagagaattttcggtgaagctaatcggagtataaaaggaaaaactgtcaagcttttatgcaattttctttcatcgacctattgagttgccggtgattgcaataacaacgaaatttcagagttgtgcttaggactgcctagtcctgaaattttggaaaccaaagttacaaaaaacgtttttgaggttatttcctaagatttagaaaacatgggttctttatattataaaattaaataatttgggcctattttatactgtaaaattttaaaaacaaatcagaggcccaaagtcaatgtttcacgaggctctgtttaggaccggccatgtccgttttgttgatggatactaaattactaatgacctaacgggtttatttagaccgaaatagttttattagctaaaaccagttttcaaatggtttgtgaattgcagcatgcaatgtgtgagcatgatttcccaattgttctatcagtgtcaaagtgatatgggccaatccgaacgttttatccaaatggatcaaaagttttgattttataagattgatgagttaaattagaaattttgaatcataatggactaattatcaagaaaatgacactggtaatacatttcttaacacataatttttcctatttttataaacggaatctgaccataagtataaagattgatagaagttttttataaactattgtgtatatcacatttgtttaggaaatatgttagtaagaccttggtccaattggttcacctgatagtcaaaaatgtgtggtggtccttcaggaagaagtccaatctgaaacattttgggccgtttctagaagaactgattggatcagctgatagaattttattaaacaaaaaaagactatttgtatattgatttcatttttagttcccgagaagagtagaacaaatgctaaaatgtatcatgcggcccaataaccaacaaaactagttgaaagatggatcaatggtttttacatgaagaaagcccaaaccatacactaataatctaatattctattaaaaggacttgctgttattcggcccaatagccaacaaaactaattgaaagatggatcaggggctatggaatacctcagaataaaaagtgttattcattgcagaggaccccttaagcggacatggttgggtccttgttcgacaagacttagtcctccatcttggcctcaagagtgctcgacgaagtttatcaccgcttcatgcggaattttattccttgctatgggcaatagaatgcatgatctctattagcgatacttctggcgcttttgcttccgactgttcagacctgatttctatcattaacaatcaagaagattggccgacattcgcagcggaattgacatcctatcgctccttagtttatttttctccttcttttcgtattagatttcttcctcgtagttctaatactcgagcagattgtttagctaagaaaactcgggctcgtaatagccttttctcccatgtaagcacatcggttcctgaatgattctttctagcggagagtctctttccgataacttaatataaatggtgtttgatgaaaaaaacaaattatcgtaatgatcctaaaaaggagttagaaaatattaatatcttatctacatctagatgataattgtttttatgatccttattagatagtgtttaaatttaattatccactaatttaagcataaactatatattctatcaccgtttaaccaatccatataaatctcttttaaagcttctagaaatgagtctcacacatcagaaattagctattttcttattttattacaagaagagaaaaaaacaaacaaacaaacatgtgttactctcattttgccacatgcattataacgtataggtaggtgaatcacctaacttgtttcagcttatgtaattaactttaccaatatattaatttattgttgataagtatattttaaattaagatatgggaccagaaaaataacaaaagtttctattaaaaaatgcttgcatttaaaagagaagaatgtataaaatctttatcaaaaaaaagagtatatcatagattcataataataaaaaaaatttgataaatgactttttatttaaaaacttaagatattacaagctattactctctttgtttatttttaattgattttctaacaaaacacacatattaagaaaacatattaaaactgattataaatgtatcgatttttgtgatttatatttttctataattctaaatcaatgatatttaattatttgtgttgaactttaaaatttatcattaataactaataattagtgcatagaaaatctaaaaatcaatctttttgaaacaattttttttctaaaaaatcaattaaaaagaacagagagaatattgttttaataataaatgttttattggtaatccaatattaaaataattatatggattaaatttaattataaattttaaaaaatttgaacaaaaaattatttagtgaattgattccaacatgtggaaaaaaggaaacagataattaaaaaaattgattggttctgccaaaattgactaccttcaaatcagagatgattttaaaaataaattcatccaattaaacttgccacatcatcaacttggaccagaatattcgcagtcaccaaaaacaaaccaatgtgtccaggttcaatgaatctggaatcacctggttcttcgtatttttgttatataatgccacgcttctcacaaatcatcttgaattgaaaataaaaaacgaagaatcaaaacaaatcttagagaaaacaaaaatccaatttttgctgtgaag

SEQ ID NO: 6114 - DNA, 3000 bp, Unknown
  misc_feature (1)..( 3000): cDNA_ID_1381119_gDNA_ID_1620846_Annot_ID_50938 3000 nt of promoter + ATG
ttttgtttcggtttcagttcggtacattcggttcggtttatttacccagacttgtatatgacttttctatttcttttatcttattttgtgtatatatatatatatatattctcacttaactcaaaaacaacaacatcaacaacaaaactctttaaaaagcaagaaaactttcactagtagttgaagaatttctctcttcctctacttattattattatcaactggtgatttgatttctctctctctctctcacaatggattcattaggatcaagaagaaggacacataatagccgtagggttccttcaatgggaatagaaggggacgaagagtttcaagaagaagatgtgtggtcagttttacgagaaggagaaacttcaagtcctgaaatgaaaatacccaaaagtcatttctcttcctcatcatcttcttcctcttcaccatggaacattcgtagaagcaaggaggtctcaggagtgaaacaatcatcagcacctatgaatgtccctgattggtccaaggtttatggtgactcaaagagcaacagaaggagtagccatttgcattctcatgctgctgacgatgatgatgaagatgatgatggttgcatggttcctccacatgaatgggttgcaagaaagctagcaagaacacagatctcttctttctctatgtgtgaaggagttggaagaacacttaaaggaagagatctaagcaaagtgagaaatgctgtcttgtcaaaaactggtttcttggagtaagtaggataaaatatctcatcatcatcatcaccataattatcatccatgtgcatggaatatgaatcccataactcttgtttaacattatcatcatgaaaaactcaactttatggtatccacatcatcatcattatcaatgtcattgtcgtcatcatcatgtggggatcactataccaagagtctttttgttaagttttttttttctttattgttgttattatttttcaatgtgttatttagagtagataagtatcatagtgatgatgatgacttgtcagccccatgcatgggtcccgttttatgttcttctgttgtttttggtttctctttgaaggtttttttatgatcttaaattagagcctagagaggggcatctcctttagaacctttaattggagttgagttctttaccatgttttggtgaaagattttgtcgtttgctatcgacaatgttatatataaattagatatctttctttctttgttaatattagctatgtccatctttggctaattatgtatttggcaaatctgctactaaatatcattaatttagccgatttcatgcaaaaataaataagccctaaaatgctgagtttccaattctgaagacattttcaaccatatcaatcgatcaatgtcatatattcacatatcgaaggtgtacatataaaggattgaatccatgattttcctttgaactcttttatgaatagttttgaatgtttttttgtttgattatagttataagatatttaatagcggtgagtgaacgagaccaaaaaaaaggtgattaaatgtaataaactttaaaactatgggatatcgagaagaaaataatgtaacgagaaaacatcacattagacttcaataatgcttttaaatatagaaaaaggattgatagtagaagcaaagatttttatattggtatgattagtagtaaaacaacacggtaaaaaaaaaacagtaggcgaaccaaatagttagattttgattggtaatctcgtatggttgcagtattttaccgttctaaacttctaattattactagtgacgaaaacgttgaaaaacgagatttttaaaaaaaagttgtaactattttttttaacaaaaaaaagttgtaactattttggtattgtttattgttttttttatatacctaaaacctctaaccttgttttttaccagtcttacttttgacataaataaaaatagtggttagaaatagttttcagttctgctgctttcttaccctttttatgtctttatgattggtaatttggtatcaatcggaacaaactaaaattgttaattgtagtccttagtcctaatagttcggttatccattcggtttcagtttgtatctattcggtttcaactttttcggttctaaagtttagtattcatttggttattttgaaagtttgattcgtatcggttttttcagttttaaaatttaatatccattctattattttgctttgaatatttttggatatttcggttattttggatattttcgatcatttttgaatattttcggttattttttcgagtatttttactattttatatatcttttcaattatttttaattatgtagtctaaaaataaataatatttagtatccatttagttttggttctttcggttctttcatttatagaatttagtatccattcgaatattttccaatttttggtttgctttgatttaattagttttgctttgattttgattcggtatattcgagttggtttatttgtccacgcctagtagtcctgatcatgtaaatgacagaaaagcccaaacgagatccaaacctataaaggcccaataaatagttcacaaactcatgaccactacaatccaacgacgtcgtatcatctcgctgacgtaagataagcatcgtaactaattaaaatccaagtaataagtttgggtgccgtgcaggtaacaatcactaaaccctaaatccatcctctctgtttcctttatatatattctctccttttttcatttttttgatcctcttcttcttctacaatcaaaattcatttttttttcctctgatcatcatcgaaccctagtttcgtcttttgggtacgtttgatttcgcctctccactttgtcaatttcgagtttttgtggtttgggtttttttcccgatttagcctaacagataaagtttcgagttttgtttctcttaatcatcgtagatactaaccgaatcatcatg

SEQ ID NO: 6115 - DNA, 3000 bp, Unknown; identical to SEQ ID NO: 6114
  misc_feature (1)..( 3000): cDNA_ID_1381119_gDNA_ID_1620846_Annot_ID_170222 3000 nt of promoter + ATG

SEQ ID NO: 6116 - DNA, 3000 bp, Unknown; identical to SEQ ID NO: 6113
  misc_feature (1)..( 3000): cDNA_ID_2997065_gDNA_ID_1620846_Annot_ID_170220 3000 nt of promoter + ATG

SEQ ID NO: 6117 - DNA, 3000 bp, Unknown
  misc_feature (1)..( 3000): cDNA_ID_3079590_gDNA_ID_1620846_Annot_ID_170215 3000 nt of promoter + ATG
attaaaccattacattttttgaaaagctatattaaaaataaccataacaatataaaaatgttgttaatagtctaattataacaatatgattacgctattaaataatatttaaaccgacgaaatcgctattgtatattgtaatataatagcagacattataaacgctatctaaagtgtctgacctacgatgacgagcacagaaatagcgcttaacgaaacgctattaaatagttagatagcgttattcggatgctaccaaaagccaatattcttgtagtgcatgttggcccctaaagctatttgacaagtttaaagaaggagataattgtttagggtttcttatcttgtggttttactatttgtcttttatatttataaataaacttggagggcttcaaccatctaagctgctccttaactccattttgtggtcagtaaactatctattatatgtttttcttttgacgaatttctttgcaaaaccaaatcttggattaaaacatgagcaattttgagaaaatatgggcataaactttctcaaatattaaaagaggagacaatgaatcgcattggaagtaagaacttggccccttgaagaaacgacatacattaacaacacaacagccagaagatcaaaacctggaacaaaatcatgaacaaaaagtccaagatggaatttttgcgtagtaatcatcaaagtgtctaagagaacaccatgcaaagctagaatcgaccgaaaacttaagctaattttgactagatcaaaatcctaggctagaaccatccagaaaccctaggttatcatacaaagatgataatatagattggtttgttgtgtgttcaagtgtatcatacaaagatgccaaccatgagctttgtaatagtttggcttggcaatgagacaaccaccaatctttttctcctgctttcattaggagtctgagaatggtacctaacatacaaattggctatgagttcagttagatgataagtttttttttttgtgcactcagttagctaattcaaatgttatttttaaggtataattgttgtatgtgtcatctaaaataaacttcaaatgttgcacaaagtaatatgatttaaattttaaaataaccaaaatttcttataaaccaagataaagaggataagaaatcttttctgcccaatcagattcttgattttgatttaggttacttgattcctatcttactctgacataaatataaggaagttttttttcttttttgttaaaaagtgtaaagtaagaaattttctaagcattttcacattaattcccaaaaagaaatatatctgtgtaccttatatagttcttttgttgatacctaatatagttcttcctaatttgttttttatatttcttctaaatatatacctaagcaaccaaatatttttaaatttgatttcaattttggcataccaaacaaagtgtgttctactacatataaaaacctctttaggagatgtatttttcctgatctcatttatttgattcttatatatcttactctaaacagaaatataaacaagtatgttttctttttgttaaaaaaatactataaatgtataaggagattttctgagtattttcacattaattaccaaagagaaatatatcacataactaatatagttcttcctaatatatttcttcttaatatatacctaaataaccgaatattttcaaagttgacttcaattcttttcatccaaacaaagcatgttctactaaatctaaataccattttaggtgacttattttgtgcttcaaaagaagcttgttttttattgtttgttccattttgctaccagtatatacttttaatagaattgccaatacccacaaaactttacttacaccattcaaaagctatgttgtttttgagactttctattcataaaaatattgagaacttaaaaacttatttaaatggtatttatcttatggaatataaatattttataaaagtaatctttcacccatatatataatggatggaaaatcacatagtaacatcttataaacgcactaccataatatattgttaggtttttattttttattagcccatcatatatatgggataagcaatacataaaatagagagcaagctaaaaaattagaaaccaagtcctcttcgtaattgtgaccaagagtgagttcaagggataattcttcttcaccagttgtaccaccaccaacaacaacgacatcatgtctctattttcatttagtcccacttgccataaaatatacatctatttcgttcacgttaatgatcacatagtaacatcttataaacatttactagcataatcataatgtaagagatgcaaaggaaaataatacccttgacgattgatagagagacatgcaaagatactttcataggtttgttacttgattccaaaattggggttactttcttagtaatattgttcaggttcttaattttgattcaactttaagtgaccggtttaggtgctgtggttaagtggaattgagtaccggttagatggagccaattgaaacggattggagaaacaaatggaaaccttcttttcacgagagagggtcttctgttatgtttgggacttagtataaaagccctgtaatctcttcttcttcattatccgttttcatacttgtaaaaaaaaaaaaaaaactttgagctctgagactccattgttgagctctgctcttgctctgtaattctcgttctgatttagtgaattgccgaactgatttggccccagacgtagacttgatcatatcgatcttgttgaactgggtaaacaaactcttgtgttgttttctttcgttctctgtttcgatctctttcttgagctgatttgagtttcgattgttgagtgattgagagtttgtgaggatctttgtattgtgaatcgagcataaaacgtaacagattggtatcagagcccaggcttttgggtggttcattcacatcgcatcgatcg

SEQ ID NO: 6118 - DNA, 3000 bp, Unknown
  misc_feature (1)..( 3000): cDNA_ID_2139551_gDNA_ID_1620846_Annot_ID_170213 3000 nt of promoter + ATG
tcatctcccgcatcatttttatttctgtcaaaggattggaggtgcataattatgaataaacggatataaacttcactatgcattatgttgaaaatctaaatattccttatgcaaagttacacgacaaacatatttattaaaatttaatttaaaatgtaagatagttattttacctttactagattcttctttctttttgttcctatacatctattgaaagtaaaaaaataaaaaataattcagtacttgccatcttagatagtatatgttttgtagataagttttatacactatataattataaagacctggagatgacttttgacatgtgatattgtgaggtctctcacacccataagactcaaaattctcttaggagttgcacctgcaaatttaaggagaacaataatatcgactatagtgaattaatctaaaaaaggatataaagagaacattaatcatggaaaggtcttaaaaggaaaaaaaagattgttgatttcaatgacaatttttttttctttgaatttatttcagaagaatcgtcttgttatagttttgcgatatggaaagaaaaccgcttactctcttcgccaccgagtttttcaataacttgaataaaacggatatcaagatcgtcggtccagtgcattcgcggattgtctgacctaatgtaagatctaaccatcggatcttgcattttttttatctctcgtaaaatttttagtttgataatattgagagtgtgcaccaattatttatagaaaaattatatggaaaagaatattaatatttatttcccaaaaataacctaagaaacaaatatttagagctagtaaatgttattgttgtcacgtgtaatttatcatttaaatatttctgtaaaaaggatatataaaatcgcattttaagaaatatttattttcttgacagctccatgtgttcttttctctaataataatatttataataaattttaaaataaaaagttaatactactagatttgtttcaattttattctaagaataattctatctatgcttgatatttatataaataaacaaagaacaatccaaaactaatttatggcataaagccttaatgcttattattatcattttgaaccaaatgatataaataacttaaaaacatcccaaacaaatatgaattatatatgtcattatattaatataaattagttgtagacgatagaaataatatattcttattagattaaaaaattctgaaatttagtttttataaatgattatgctatataagtagttttcatttattttttttctgatttctcaagtaattactcgatacaagttagtataaacgcagtcgatccagaaggaccaaagatactctaaggatttccaagactcatttttagctagcgcgaaaaggttgtttgtttggattttcagattgtaaataaaaattgcaaataatttaaagatcaacttatgaattaaagacattgtgctatagggtatttcagatatcaatgaataatgaaaacattagacaaggaattcaaccatgaagcatcgggcttgaacatgaacacaaatttagactaagtctctcttaagacattaatcattatatttaactatgcaactactaaactcttgtttttaattttctagtcaaatccgtattagaattaggttcattcggttcacaatgcattctaacataaactctcattggttagaaatacattgctcaatttacatttgttcagacagtctatcaaacatttttgatgcatagaaaaatctagaatctaaaacagagtgttcgatctttttctagcattaagaacaagtgaatcaaagaacttaaggattaaaaactcaagaaaacaatcaaaccatcaattcattgaatctcctacttagaaccctaaaacccaactaaaggactatttactcatagcaaaaggaataacacaaagagatgaagaagacataatagattactaaacaataaaagaaaagggattagaaatattttccaaagtatcaaagaggatgaatctctagaatcccaataggggaataaaaaattaggtctcaaaaaccctgctctataaaatgaaaaataaaactgcttaaggaagaccgaaactgggcatcaggtagttgcctgatgagatttgcgtgatgtcattccccaaaagatttttaggcaagaaaacgaaactgggcacaagtagttgcatgataaaatttgcatgatgtcattttccaacagagttgtcttgaatcaccaatttttcatttcttctccgaactcttggttttgatacaaaaacgcctccaactccatcattgcttcctaaaacctgtaaagactcaatcaaggactggaagactctaaaaacatactttgactctataaaataatgatttaagaaagaaaacaaagactcaaaaccgataaaaataaaacatatcattttcatcgaaattataagtagttttcatatacagggaaatctttaaaaattaatacttcaatttatagtgattattgatttaaaaaataatacttcaattaatttatagagacggaggttattttaattacttcataaattaataatcactatacaataatacttcataatttataggattttcaaaaatattattatcttatcttctcattgaattatgttaaacattgcaatcttttgctaacatttatgcatcccatgaagggtggcatacattttagcaaaagattgcaatgtgaaggtagttggcatacattttagcaagagattgtaatgtgaaggtagtttgagctcaagtatatatatgtcatgtcattcatgtcttcactagattggactttaatggactcgtttcttaacagaaaaagtagacatacgatgtgtctgcgttacaaacatgtccatgaagacagttttctgatgatgtagacccacaagagcaacattccttataagcccgtgatcgggc

SEQ ID NO: 6119 - DNA, 3000 bp, Unknown; identical to SEQ ID NO: 6111
  misc_feature (1)..( 3000): cDNA_ID_1830057_gDNA_ID_1620846_Annot_ID_170211 3000 nt of promoter + ATG
